United States Patent 9,029,523 (PROMOTER, PROMOTER CONTROL ELEMENTS, AND COMBINATIONS, AND USES THEREOF) - sequence listing, part 15

SEQ ID NO: 21166 - DNA, 3000 bp, Unknown
  misc_feature (1)..( 3000): 2750-1469P.txt file - cDNA_ID_1841127; gDNA_ID_2926199; Annot_ID_141416
tacagttttatgcacaagtacagggactgtggaaactgaaaagtaagggtattgaaagcagaaagaacttttgtgttgaactatggagcaagtggtgatgaaatggagaggcacgcgatgtttaccaacagcacgtggcaatgtagaaactgcgattgtgccagcgtagtagagtcctcgagagttgcatccgcggggatcgactaataaggtaaaagccaatttatttgtcaagcatacgtttcttaaaggagaggcaccgcaaaaagaaagtaaaaaggagaggaagaacttacgatttatttaaagtcagatgaccgttttttcccccaagttgagacacgcgtacgaaccaccgcagtttctgaagataccattcgatcaatccaaagctagcaaaagttctaatcttgttgtccatatgttaaccagaaaagcaaagcattaagtttgatcgacatcacttgctggaaacatttggaaccggagcttcttgtcgtattcctgtaatccgaggaaccaagcctaacaacattgaaatggaaagaatgaatcaaactggagaaaagggaaagaggggaaagaaaggtaaaatggtctgcagatcttctgatatcagaaacattaactaggatcatatattctcagttacataattatatacttaactgcacaatgcactagaagtctagaacataatcttgtactacagttgtagaatcttctattatcacctagatgaactgcaaagggatcatttgatgatcgtcatacttagcacatgaatctccatcagcaaactggttaaatgtggaaactgcaaagagacaggtactcatctaagtaaatatcaggtagttatggaaatttctctacagagcaaacgcatttaatacaaaacatccagatttgaactcatcagactactgtaattgctacctttctctctttaacgcaatggcttggccttcaattacagcaaatgactaaatgcagcacgcacaagaatatgcttattggaaaatttcgtatacaaactgattggtatgcctcttctaggtgctcgaagaacggaatcctgtgagttactatttggtttcccagctactacgactcttcactaccaaagaggcccaaaagtgggaagaatgtattcagaaactaacaatgtcttaaacccttcttccaaaacccttaagtcacaaatctttacagaacaaaagagaagtaaatagaccaatctcatataaacatcaacaagaagcagacaatgtcacaaaacatccaataaaaccttctatgtagataagatcattatgttcaaaacttaacaagaatgctatagagattgcaaggattttgttctaccaataccaccttccttttagcactccaatcgtttaaaagactcagcttacagaatattaggatctgaaactgtttgcttttcgatctgaagctggaaagcttcagagaattcctttagtaaagactcgtgaactatatcgatcaacctcaaatcatcaaccattccgtgttctccatcttcaagcaagccctttatgtttccaactttccggtctctaatcccacatggaactatccagttgaatggtgttagatctgtagtgacattaagagctaaaccatgatatgttatccatttcgacacacgaatacctatcgccgccactttttggttgcctatatataccatttgcaaacaaaaagaaatcaatctcggaatatatattagatcacttacaaaatcatccatttgaaatatgagacataccaacccaaactccagttaaaccgtcaagacgagaagctttaatggagaaagttgaggaaagcacacggatgacaatctcttcaagcatcctgaggtaccaatgaagatccatctcgtgatttcgaagattgattataggatacataactagctacattttcaaacattcctataatcagcttgaagagctcattagaaaacacacagaaacttccaatgcattgttgacattattacctgaccagggccatggtaagtgacttcgccaccacgttcagttcgataaacattgaaaggagcatcctttatatcgaaattgagataatcctctgtactagcagttcccattgtgtaaacaggagagtgttgtaacaaaatcactgtatcagcgcagtcttggtttctatcaatcaatgtctttttctcctcgacaatgctcttctgccatgaccaagctttcttgtatggaaccaatttgtcgtaaagatcaaaacacaggcacctgcaaaattgatagtgattgcacggaaggtgttcgttaaaatgcctcaaacagaaaatagagagcacaaaaaaggaaactttactttctggggatttcatgattcccggagtttaagatcttgacagatctaactaatctgtttctcttcgcgttagtacgatggtgatgatgaattcccgaaactagagtttctactccattcagcaactccataactctgtactaaagaagaaagtggaatttacttaaaatttatttctgtaaatatacagtcattcaatttttagccaatcaaaaacgacggaaacaacaattttgactctacaaaataatatgtaaatgtaattaattatttgaaaccaaaaaagcaatctttatggataacagatattttacaagcttaatttgaagaagaagataacaaaacaaaaaaaagagcgtggctttatctatcatctggtatccactatccacaactggggtcagcttctggttctctctctcggtaactttctgagctgaagaaccctaattcttatcttcaccggattccgggtatagggctttgtaaagttgttgaatttacaaagaaagatatgctggtttgtctgggttttgtagaagaatctgtgttgttgctttgagattaaagtccgaacaatgttgggtttgattcatgtccttgatgagctcgtcaatg

SEQ ID NO: 21167 - DNA, 3003 bp, Unknown
  misc_feature (1)..( 3003): 2750-1469P.txt file - cDNA_ID_1841162; gDNA_ID_1621096; Annot_ID_55702
aaaaacttgaaattgatcttggcaaatctaagtagcatcttgttgtgatcttcttcttgttcatagaaagaaatgtattccctcgcgaatatcatttcggcattgtaatgttgaggcatgcaaagagcatttcgtatacgcattaagatatggggagaacttgctccagctctagctaacgactccaagtttcttgtagtgaagcttaacgcttcctccaagatatcttctcttgttgtccttaagtgagcagcttcatacaaactcaccatgcccttgacatcactggttatagattccataaacttttcattctcccctttgaatctcttgaaaacatctattggtcaataggagaatcttgttaatacatatgaatcgattacaaaaaaatgtactggtagataacttttaccggtagacatgttgtaaccgtatgtcctgaaaacccaaaacatgatggaaatcgtgtacaaatcatcttcaccggctatcatctcctgtatcttttcaaaaccctcttctagactctgctcaatctcatcttcaaagtgaaacgctacaccaaggctcacaagcatatatatgaaaagaatcctcttcttggtcgactcaatgcttttcgaagaaaacatgagcatctcccctacttccggctttagtctctcaatctcttgggcaagggcattcatttcctaacaataatatcatatgttcatacccgttacatcgatcttttacatttattatatatatgtttgtcagtgtgtattatagactcaccgagacatcaacttgagcagagaggaaatggtgaccccattttgaaagcggcagtctcttgaacttgcgattactttcttgatcatgacaggcccgagtaggggtggccttcatgcgaacaagctttccatgctgacctgaaaatgacttgtggggaaagctagagagttttcttaccgaaaataaattggaacgtaaaggaagagagagtatagatccataagctgatatgcattgcatgtttactactagtgatatggaatacattttcaccaccaaatttataggcaaaacataagcgttttcattaagtcatcttttgaaaagttttggaagaatgtatattaatacccccatatttatcttcttcagtgtataatacaacctatgttgggaccatgatattttctgaatttatagtgatattagtttatctttaaattgatatttattaatctatatagatctttttttaattatttaattttttaaagaatacgagttgacacaattcaatatacatcaaattaatgacttggatgttgaaatttgtgtagtattagaattgaaaatttaatatttcaaaaaactcatttgacaataaatcacaatgactataactgaattcatttatataatagatatacatacatctaagtttatgattaataacctcaactatcagatttttaaatgtagtagactattgaaatgaaaataatgcagattaagaagttgtatacttataaaaacttatgactaattgtattaggaagttataaacgatactacaatatgatagttttaaaacacaacataatttaatgaaaattagagacaaaatcattgtttgatgtaataatagttcaagacaaactctaacaaacattcaatagttcaaaaaatatttaaactatagattatatatattatcgtatatatattatatttttgtggttattaatttatgatgttattaaaatcatattttttatatagggttttaaaaaattgttaacttattattttatcaaattatgttaaattttacattcacacgacttgaaactaatataatattatctccttgtatttattaatttatcaaaaattaatttgtagaggttttactgtaaaacatgtttagtttttcattttttaaaaaacctccaagtggcaaaaataagatccatctccatctaaaaaagtgcaaacaaatctccatcatttaaaaatcaacgttaacatccatatctattgttgttgttttttacttctttttctcttggtcaaactctacgttagtttgatcaataaatatgacaagaatttttgcagtctcataggcgtctttgtaaaggttagttagcgtctacataattttccgaaagatataattttcttgagatacagttaactcaattactgaaatgtaataactttctaaaagttgtggctattaaacaaaattgtgaaaaaatttaaaccaaaagccacttcaaaaacaaagaaaaccataaccattaatcaaaattcttttttttttgttaacaagtactagttgcattaaattgtaaacatatggtggtgttgtatatgtttgatacaaagaacctatataacaaaggcttgttgggatagtgcatctgccacattatttcttttccgattgacatgtccatagatgagtgtgatagcttcaacatccaatatcgtataccaccaaagactgaagagtagtaccaagaatatttatatatatatttatttatttatttattttggtaaggagaatatttatatcatgatcccaccatactttaattgttatgaaaaaattttaatttgattttcataaattttatagtttagttaagtataaaaccacaattttttttctttcaaatattatttttggagaaaacccccaaatttaaaaggaaagagaaaaaatcaaatcattcatctttgagctttcttttcttctacagaaccctaatttcatgttctaggtgtctctcgaatggttctcatctcattgattactcaatctctagggtttagtggttcatccaaattcgtaccctaatgggtgccgtagcgatcaatcgtaaacgcagcgacgaatccttcaatttcattaatcaacaatcaaccaaccctttacgaaattcaccgtatttccaagcttccaagaaacgaagattctcattcgctatg

SEQ ID NO: 21168 - DNA, 3003 bp, Unknown; identical to SEQ ID NO: 21167
  misc_feature (1)..( 3003): 2750-1469P.txt file - cDNA_ID_1841162; gDNA_ID_2926164; Annot_ID_139844

SEQ ID NO: 21169 - DNA, 3003 bp, Unknown
  misc_feature (1)..( 3003): 2750-1469P.txt file - cDNA_ID_1841194; gDNA_ID_1971812; Annot_ID_58128
ttgtgctttaaataaacatttatcaaattgtattcatcttttaactccgcaaagtgatataaaattcttcttacgaaatttctttaaatatctatgaattacatttcgtaggaaaataatttgaatttgtcttataaatttacgtttcttagaaaatggtaagaaactttctacaaaatttctaatggttattttttcttaatgaatatcttctatttttctaccaattttcctacaaacatatatgttgcaggatatctgcagtgcttgaaaagatttgtcatttgtcaaaatgtattcaacttttttttggacaatgtattcaagcttaacatacccaaaaaaaaagtaatactagtataattttctactgttcctaggtgacggttatactaacgacttttatgacagtaggtaattaatttcaacacagaacacagcaatgtctagtaattaaagtcgttgtctgccacaaaacttatgaaatcttaacaactaattctttctatctttatgacttaaagagtcaaaagcctaaaatcatttcaaaatcccaatttagtaatatatattcgtatcatttaaagtcaagtcatttttggttaatcaaatacattactactaatatattacaataaacaatcaatacttttaaatcctcaaggaagaaaatgatctacgcaagcatgcacatatatatgttaattcggcagcatgtaaataaattgatttcatacttctttgatgaattacaaatcaaataagaatccatttttaaatcaatttaactaaacacacacactgattttcaaaagagtccattttttctaaatcatttgtaaagtcacatgggaaagggatctttgttgaacgtaatgtaaatagtgggaggttagagaatctgcatgcgcattaagagaaaatgtaaccacccaagtcacttcttgaaagtacaatttatagttattgtccatcattaccctcataattttaacggaaaaagtctattattgttaagttttcatgttatttaattgaaaacgttcaaattcgatggacgtattagtcaaagtctctgtttaaaagaaacttgtgcattatgtcaatagcaatatcattaattatctactcgaccaataacgttattggtctgagccaatcgtgatatggttaatcttacggaaaattttgtgacataattattatgaattcaacacgagatttttttattttctttctaactttcttagcttatgattccgttgaggtgacgacatgtcctgacttcagctttatgaatttatttctagaactatgcccatcaatatatatgcttttatttgtttatcaaacttattgatgtttatgggaagttttatttttaattagatcatatgctaaaataatattaattttcgggattttaaagacaaatgaataaaattgttttatcagaaaaagggttgtacagttgtgttaattcatagtgtaatgtccaatatatttataatagaacattgtagttaactgtttagcagtgatcaactgtatatcactatactaaagtaacatatttttttagctatgtagttctagaaaaataagtatgaacgcattgaatttgtattcaatcttgttctctattgttcacaaaccatataattgaatcgaatcaagattaaaaatacaaaatcctaaatgtatgttcttctcacattcaatacatattttcacttatttgatcgtatatatccaaattgtcgtatcaccattatacgtgtacaatggcacatgtggaattaacaataaaaataattgatatatgatattttttttttcggaaaaataattgatgtatatgtgacaatatgaaccagttttaccaccatattatatatatgaaaagggcaaaaagtatgtattctaacggattgatgcaaatgaaagtcgttatatgattcaaatattcaatgctaaattcagtatatactcaatctagtaaaaaatccaaattgtgatctgtaaagaagcttcttttggcatatatcttattctcataattagttacatgttaagatggataagataagaccgtaacaaatacaagcaaaatagttaacaaaaaaaaaaaaaaaaaaagacaaagacaaagcaaggtatttgaaaactcaaagcttaggtaaaatgtaaaaatttgataattatgctcgcatctagatcctaataatacacagagtaccttgaaactaaaataaagagcgtccatattttcggttggttgttgaaaacttaaagaggccttcatcaattccatcaagtgacatttttcaatttctgctcataaatgatactctattttgtcatcaagtctgttatatttttggtctatatgatgatatgacgatcacattaaccacatgacgtgtaaaaatcaaataactttccgtatcaacttaagaaaataatcttttacggataagaacatatttatccacactctatttagggaaatgcatacaaagcatttagggaatattttaacatatttcttaaacaaaaatatataattgcaagtattctaagaagtatatatatcaaaattaatgcttaacccattcaagaattcattcgttttattacaattgtatattacatattttcaaaaattcaatattttgtaccaaaatctggtgagaacataaaaacagagatatatgttttctcttgacaaaaaaaaaacagagagatattgtagttttcttaatagagccagcaatggtcaaatatatcatgtgaaatagtttctaaaatacatcatccttttcttcttaattaataaaatagtcaaataaaaaatcgtctccaatctttttctctctctggatttgccaataaattggggataaccagctaccaaactcattcacacaaagtcataacagtcgtttaaagtctgatccttttcatttttctttagtgtgtgaaaagagaaatacagttatg

SEQ ID NO: 21170 - DNA, 3003 bp, Unknown; identical to SEQ ID NO: 21169
  misc_feature (1)..( 3003): 2750-1469P.txt file - cDNA_ID_1841194; gDNA_ID_1971812; Annot_ID_175779

SEQ ID NO: 21171 - DNA, 3003 bp, Unknown; identical to SEQ ID NO: 21169
  misc_feature (1)..( 3003): 2750-1469P.txt file - cDNA_ID_1841194; gDNA_ID_2926171; Annot_ID_140138

SEQ ID NO: 21172 - DNA, 3003 bp, Unknown; identical to SEQ ID NO: 21169
  misc_feature (1)..( 3003): 2750-1469P.txt file - cDNA_ID_1841194; gDNA_ID_2926171; Annot_ID_199523

SEQ ID NO: 21173 - DNA, 3000 bp, Unknown; identical to SEQ ID NO: 7790
  misc_feature (1)..( 3000): 2750-1469P.txt file - cDNA_ID_1841214; gDNA_ID_1621163; Annot_ID_57168

SEQ ID NO: 21174 - DNA, 3003 bp, Unknown
  misc_feature (1)..( 3003): 2750-1469P.txt file - cDNA_ID_1841214; gDNA_ID_2926161; Annot_ID_139721
caagttgattatatacatctgttgaaaccgagttgatcatggtaatattcatctccctcctgtttcttactttttgatattgaactcattcgaaaactcttctaattttctgatattgttgattatacagcctcacccggatgtcaagccaatggcatatgcaaacaatgattaaagatgttctctcttcctttaagcttatccagcaacagttattctcatgtagattcagtttttccctttttcaatttttttttgttttagaaacccacttaaggattccatcaatggtcaataaaattttcaaaaactctaaaaaatctctaaactactaaactatccaaatttattaataaaaaatacatagaaactttacttagaaactaatcattggatttgctattacttactaatctgtttattttacttaaaaacagattattttatcttcaaattagcttacgaatctgtttttttctctcctagaattaacaactgcgtttatgttgtgcgttatggttttataaattgttaggaattatgagttgaaaatttaatctttgtttaacctcttatgagtagtagtagtaatggtttaatttattactactactcgaagacccaaccgaatccgatccaaaaaacacgaaaaaccgaaccggacctgacccaaaaaaaccaatccgaatctaaacccgaaattttaaaatattccaacgcatcctacacttttaaacccgaaaaccggaaatccgaacccaaaaaacccgatccgaacttgaagtcttaaaatacccagacgggttttagatttctaaatccgtaaaaacccgaacccaaaaaatccaatccgaatacccaaacgcccatgcctagaatttataaaactattacagttaaatctaaatttatcttttactaatcgtgtgtgatcggttttataccaaattagaaaggaagttaagatttaaagttacactagtggctagaaattaaccatgtgtttgattgcatgtgtgtgatagatttccctaggcatgtaatctaaagtctaaacttcctcctccaattccgacttcggacctccttttcttaccactttcaaaattttccagatcttgttaggagctttatattagtatcttgttacaagctttctttaatattatcatcaaaaaggcataattacaatgccttgacaccatccatggagaatcaaacatcgttatccgaatccttaaaaagcaatacgaataaaggtcccatcgcgtacaacccacgggcctctctctatttcaacctcattaatcgtcttctccatcaccatgcatcatcatcattaggtctaatatcatgcgtccacaatacaaagacgtgaacgataaattagactcgacggccaagcacaaaaccaacagccatggcggtcgttatgataatccttacgtccacattactagtcccacatcagcttctgataagagtaagtctaaaaaatgattgttcgtgtcttaattatgcttatgataaatcttgattgatatatgatacatgtagggtcgaaggataaggttcttgaggtgttgaatcgctgtgggaagaaagtagaggacgctactcgcaaagcggaagcattagtcggaggtttaaaagaccaccgtacgtgagagtttatattttacacatgttgtcttcttaatcgatccctaaaacatttttttacatatggtctatgcatgaaaccgggcatgaacagtgaagtttagtcctagcataagtgatgcagcaatggctaggctttctcaaggcactaagatgatcgttgaaggaggaccagagagagtgtttcaacgagagtttggtgttttagctgtagagaaacttttagattcgtttgtttgctacatatcgactacttcgggaccagtgaccggagtgatatacatttccaacagaagaatcgctttttgtagcgactatgccattcgtcttccttcttctgccggtggaaacggtgttgcggcatattacaaggttagaccatgagtttcaaacaatattttttgtaatagaagtttggttcatacttaaaaaaaaagatctaagttggtattggtaacaagaattgaattgttctttgtgaaatagctgttttcattttgtaaaataagaaaataataatttggtttctaaagattagtgactatataatatattgagcaataataaaatttatatgtgatattgtattataatgttgtatattgataggtggtgatggagtgggagaagataagtagcattagttcatcaacgaacgtgttgaagccaagtgagagatacgtgcatatggtgacacgagatgggtttgagttttggttcatgggctttgtctcctacatcgatgctttcaattgtctcaacaaagctctcctcaattcccgttgtaatcatgccatgtaatcaaattctaattttcttatcaaaactacgaagactattttgatcagatctcataaaatatcaaaaaaaaaaattacaagtttaccaccaaaattatttatctgattcataactttgaccaaccaaaaaaatacaaaattgggataactgagttacacaggtaacttattgatgcttgttaaattgtcattgcgatttcgtaacaaagggtccaactccaatcccataaaaaattacgaacgatgtgtaatgactaatgacgcaacgtggcaatcatgtataccttcaacggcctagaattctgtagattgcatcaatcaacggctaagatcttcttttggctcttaacaaagtcattggctgattcagtttcccaagaaatgtctctgtcattgtgcagtagataagccactctctctctctttctctctttttgctattataaagaaaaagattcattctcccaccattgaggtttaacttatacaaacagatctttttgaaattggattcatctaagaagcagactctgttttcatg

SEQ ID NO: 21175 - DNA, 3003 bp, Unknown
  misc_feature (1)..( 3003): 2750-1469P.txt file - cDNA_ID_1841306; gDNA_ID_1620628; Annot_ID_47193
gagtttttttttttaaaagacagaaaaaacaaacattaatttcttttgttattttattttatttgtgaagaacaaaagatgaagttcgtcttaggatttatgatatcaagtgttcttaatattttttagtatgtaaaattatcagtgaattgtgaatattttgcatgaaatagaaactgatacgatacatataattaagaagaatcttactatatatgatttattagtaaaaattccaacagtttataaagttatgctagcatgttgcataggtttcaaaattcatgttaactacccataagatatcagttacatgtattatagtattgatgttttgtattaatgctaaaaatatttggctcttgtgtttgttagtagcttagtattaattagtagtgttatctccgtaggtaggtacactatactatgcatgaaagtgaactgtgaaccctccaactattacttctctagatagagtattaaataactcgaaaaaaccttttttcattttatacaaacacccatttatttatatttttgaaatctatgagaggtattaactacgtactgtttaagtagtaaaattaatcataccatgtgcaactaagttttttgggtaaattatacaccacttgtaacttatacagatggtataatcaaactctataaaacagttgaacatttatatttcgtacaaatcaagtcattttccaattaatttatttagattatgatgtttagcttaattatttttcttcgatcgtaaagctgccacctcagctgaacctaccaagatcacaactccaatgttacggcgagatggtctacagcttcgtcggtcaggatctgcttggggaatgcagccgccgtgatcttcccattgaacggctcaaatcagtggtgacgtggaacatctccacactccgtccggtggtctttggcatgtctccgtacaactccgttctcggcgagactcaccacgtatcgaacggtcacatcaacgtcatcgccgaacaagtataatcatttgtaatataatcattatttagtcattacaactataaacgaaacatagactgatatatatacatcgttaactcttaggtagtgcatcatcctccggtttccgctcttcatgcgactcacgaacaagaaaatatcgacgtgacatggtgtcaatatttcactcctaaatttcgtggtatgtttttttttatcattttagttttgtagttaaattgttctgctacatcccaaattatctcaaaaccaagtctttttgttgttgttgtcaaacctcaaaaccaagtctagttttgagtaatccgtccaagaacgaacaccaattcgaatatgcatccggtttacactttcaaaccgaagcatctcgtctttgttcaaagttcaaacatatctaatttctgcatgtactcatttaatggtccataaggtactcacgtggacgttgaggtaaagggtaaaagggtaatgaagcttctgaatcatatagagacttatgagatggaccaaccgagactaataatgagattcttaccggcgccgggagcttactgggccggaaaagtgaaaataaagtgtccggagactgatctcgaagctgagttacatttgatctccgattcattcattgaaagattcagaggcaacaacaacagatcaataaaaggaaagatctttgaatcttcctctggtaatcagctctacaacatttttggccattgggacaggtaaaaaacatagtcgttattacagctcttaaaaaccatcattagctttgaatgatgtgatacgcctcccataaatatgtttcagaacggtaatggcgaaaaatataaagactggtgagctcgaggtcatttacaatgccaaggagaatatcacaggactcaaacctccaacagtcaagaacctggaggaggtaacggagagcgagtcgacaatggtgtggagtgaagtaagtgaaggaatactgaagaaagattgggaaagagcaagagaagctaagatagttgtggaggagaagcagagagcgtctttaaaacagagagaggcttctggtgagtcatgggttcccaaacatttcttagtggtcaaagacggtaaagactgggattgttcaccgctacagcctacggttcctccggcgccactcgtcatcacataggagcaaggacgaatcattcaccggtttcaagattccaaaactctatgttgataattataggttttgaaattataaataaatagaaaaataggttgatacttgataatgacatatccgtcaataagtattaaagatgaatgatgttttttgtcaattcatttgaggttgaatgtgtgagtgatacgtcaggcttttgagaaaaagagttcttaaatactatatgtctatatgagatttttcacctatgtaataacagaaaatattttgtttttcctctacaaaattatttataatccattaaatttgaaaatgaagattcaatctacttctctgttattcgatggtgaatttgcatgtattaaaataatctgtgttaaaataataaatcaatttcatctccataataatttaataatagttaagcattagggcaaccttatttaaaagcattaagcgagccttaaatgacgaaaacatggatctaacgagtaacgactaacgcccctccgatcgaatcaatagttaatgctaacccaactctctattttgatatcctatctatctttctagctagctatatagatggagcaaaaagattgatactactagtaattgtcactatatgtactacttagtacgtaagtcatagctccttggctcttttcttaaaaataatttcttttccaaaagtaacaacctcaaatggtaattacttagtgtgagtcattgactttttggtaaagaagtgaatcatacacgtagattaaatttacagatctaatatttttggttgtgtataggcagaagaagagaaaatg

SEQ ID NO: 21176 - DNA, 3003 bp, Unknown; identical to SEQ ID NO: 21175
  misc_feature (1)..( 3003): 2750-1469P.txt file - cDNA_ID_1841306; gDNA_ID_1620628; Annot_ID_162569

SEQ ID NO: 21177 - DNA, 3003 bp, Unknown; identical to SEQ ID NO: 21175
  misc_feature (1)..( 3003): 2750-1469P.txt file - cDNA_ID_1841306; gDNA_ID_2926188; Annot_ID_140872

SEQ ID NO: 21178 - DNA, 3003 bp, Unknown; identical to SEQ ID NO: 21175
  misc_feature (1)..( 3003): 2750-1469P.txt file - cDNA_ID_1841306; gDNA_ID_2926188; Annot_ID_200779

SEQ ID NO: 21179 - DNA, 3003 bp, Unknown
  misc_feature (1)..( 3003): 2750-1469P.txt file - cDNA_ID_1841337; gDNA_ID_1620728; Annot_ID_49346
ccacacatcccaagtccatcaataacagtattaaaagtgacaacgtttggtgcaacacccgcttcttccatttttgagaacaacttaacggcctcctcaactttacctcccttgcaaaacgcattaatcgctgtagtgaacaagtaaacatccggagaaacccctttgcaaacaacatcaaaagcttcacaacacttctgaaactcattagctctcactagagaagtcaacaaaatgttgcaagtcgtcttagaaggaaacatacccttgtttgcaagaacaggaaatacatcaagagctaaataacaaccatcacgcttgaactgtgtgcaataaacttcaatcaacaaatccgacattttccttctgatttcttcatcaaaacacaaactcaaactcgccattgcatccgcaatcgcaactcgactatctctcaaaccacaaggcaaaaccggtacattcccattgatcaaacgaatcaaaactaccctagcagccgataacagattcgcatcaagcaataaacctatcaataaacaataagaacggagactaaaggagaaactaaacgaatcagaagctaatcggaagaaatccaaagccgtcttgggattaactttggatcgaaactcaggaaacaacctatcgaattcgagaggcgatagaacagttatcagttgtttacactgctcgtaatctagagatctcttcgacaaaactgaagataatcgttcgtgtaaatgccgatcagaggaagtctcttccgatttatccggccgatgaacacactgttgcaggtatcggcttgtatgaaagcattttcgagatttcgctatgaatttcaagcggcgagtgaataagtagcttgcgcgagaaagtctcctcaaatccattggtgagaaagagatgaaatgtgaggaagtcatttgcgaagagattttagggaaatagagaagagccgccattgatcaatgtcgaagaagaagaattgaagatggtgttgagccaccccattggagagagagagagagacggagaaattctcgagaggaggcgatttgggcaaaaacccagggttcagacttgggggacacgaacggggtcgataaaattgggccttttatgggcccgtaatgtttaatcattgggctgaaagctgcaacatagtagcccaatttcaactcgtaaagttttccgcgttttttcccctatcacggacaaaacaggcagccctattgacaacttgtttaaaaagaagaaggaaaaaaaaatccatatagagacgtaatccgatggtcgatggagacgttgtaagaaacaaaagaattgtagaataaggttagctagaaattgtcaacaatgggttcatagaaaaactcgtttgaatcaaaattgtgtctaaacaaaacctttgatttggtgcgtatatgacccacgcattgtaactttaatttaagtcatgataatatttaatatataatgtcatgtcatcactgtttagaataaaacgtttagcttacgattcacgtggaaacaaaattattcagagatttcatttcatctatttatagtaacattcgtcaatattaagtatcatacaattaataacgggtataaatggcaaaatcctagactaaaaaggtgaaactaaaaagaaaaaagtagagagagtatacgtgtcgtgaatgacggagtaataaattatgcaatagagtagataaaaatacaatgttttcgtcatactcttactctcttaatttaataagatatatcctttatgtaattgttctagtaattgatcgatattaacgcgataactccttacgaatctcactcacgattgcatttgcatacattatagatgtaggagatactcggtgaaaatcttagtagactagaaagcaattgatcaacatttagtaacaagctatcaccacaagttcactaaatatagtatatatttttaaaacaaataccaacacttgcattaaaagcacataaatggaaacatttaagaggacacatacaagtcccattgattatttttattttttgaccaaatactaacacacctttaaaaataagaaaatgctaacacttgcagtaaaagtgatactactaaatatagatattttaagagaacatgatacaattaattcttaaatactgtattgttttaaattttatacttttatagtttctaattattaaaatacatcataatacacaattttcataccatatgtcaattaagagtatcaataataatagtccacttatgtgtagatatgtcagacctatttttatgaagtatcataaataatgtatgcacacatcacaatcgtaaacaaattactactctttctatttcataaagtttgatgttttaagttttgcacataaattaaaaaaaaagtaacttttatatattttaattattattctgttagtttaataatattattattacctctgtcctttcactattgactacaaacaaaacttacaatcatatttttacaaaacatcaattttgatgaaacaagtaaaaatttcaaaacatcaaataactcagaacagaatgagtaaatttttagctcactgttttaaccatagtgcctactatctttaaccatctccaaaagacaccatttgtctttttaactatactaaaacaatcaaaacttttaaaaccaatcatatctcattttaagaaaataggttaaattatctaatataataaataaaaatctaaaaaggttgccacgtaaatagaagaattgattcttatttatttttttcaaaagtggaagaatcattttcttctattttaaatgtaaacagaccaaaagagaaaaagctcactcacacaaagcacctccaattctctctaccatacaaaaaaccaaacccacaaagtctctctctcttgctctctcggtgattcgattttcagaaccgaaactccggcgaaaagattatggcgggacagtcacgaaaatg

SEQ ID NO: 21180 - DNA, 3003 bp, Unknown; identical to SEQ ID NO: 21179
  misc_feature (1)..( 3003): 2750-1469P.txt file - cDNA_ID_1841337; gDNA_ID_2926173; Annot_ID_140228

SEQ ID NO: 21181 - DNA, 3003 bp, Unknown
  misc_feature (1)..( 3003): 2750-1469P.txt file - cDNA_ID_1841345; gDNA_ID_1621108; Annot_ID_56033
gcaaatagagttttggacacagaatcaacagaaagcatctcaatttgtcacaatctaagcaattaggcagcatcattgtggcaagaacaagtttatgaccttgcagaatactaaagagaatgaattaagatgattaaaagacaaacaagaaaacacattcatgaggaataatcaatcatatggataatgtcgagaaagagactctttagtgtttcagtcttatcaaacaatcatgagtttcacatctaactggtgtcctaaaatacttgacacaattatacaagcaaacaggaatatgaagatgatagaacaagtaaaaaaaacatacttgattctgtcgaatttgaggctcactctatccgcatcttctttgcctgaagacgtacaagtagattcatgatagcagagacattaggaagtgttcaattttactgagaattgagaaatgtatatagaggagaaataacgaaccttggagtggatcataaaagcctaacacctcgatttgtttaccgtccctgcgcgatttttcatcggcgacaactacacgatagaagggtcggtgtttacaaccaagacgcgcgagccttatcttcaccgtcatctctgcttggaaattgaggtctgagaagtgagaagaaagaagataagtaaaggtttttatttaagctggtgggttttggctttttccccttatctgtgttctctttcttctgttacgatcgttattgataagatgggccatgttgggccagtttacattttatctctttattcacattaagcccattagatctgctatacgtttcttttcgtgatttgctatacagaagtcacttatctaaaatctcggattatccagaaattccaaaatattcaatcagcttcctgtctttaaggatcttcctaaaagaaattgcttcaaaatgttcaatttgagaacaccagcatcttgttatcgtataggtgtttgactgttagtagagagatatacgaagtccatagtgcatgcaacaagttagatataataaaataaaataaagttatctccagtctcaaccactcagatgtcgaaattcagagtgatgcgtacatcctacgagtatgacttttcaaacaaccaccaacattcacaaaaattgcaaaagcttctacaaagataaccaaattaaccaccaccaaacacaaaccttcttcctgttaaatcattgctacagtttagctgtcgttttcaattctaaggttcacacaagattaaacgagctcatctatcaagagttattatgatccattcatcatcttctccatttcaacactacaatttgctaacccaagattcacaatcacaatctgatcaaccaaattaaagagccatcaaagaaagcgatcagttaatgaacaatgaatcctaaaatgcgagttatttaatttccatcatgtacaatgagatcttcagaagcatccgaattacttactactaaagaggaattgaaattgaactaacaaatttacacatcaattaaacccagaaactgagaaattctaccgagagttcttgaagaaaccatcccatcgccttgtgaaacttcgaaatcccaacacaatcagcacttgaatttcatgccgagaccatgcttaccacgaacgataccaggcttcaaaaacggagatatcttcgaggcatagaccttggcgattgctcttttccccagtttcctcatcctttgtctccccaccttcttactcacgctacgcggaaccaactcttcgtcaagatcatacgaatcgtcgtactcgcgatcttcttcgccgtcgtcattaacactatctccgtacgtaattccaacagaataaccagaacctccaccgagaaacatcatccgctgctgagaccatccaagatcattctcatcaacttcatcgcgaacgacatcatcgccaacatcatcatcaccatccagatccacggcgagatcaccaccgtcagcaataggaattatctcatgcggcggagaaatgacagagggtgcgacaaaggaagcgtcgtcaagagatatgacgtcatcgtcggaaagactatcgacggagaaagaatcgtcggagaactcgccatcagaaggattaacaacttcccagagatcgagatcaacttcttgatcgagaatgagaggagacatggtgataaccctagatcgctgcgccattttcgaaattgtgtgttgtttagaggttgcttctttgatttttcaagactgtttgtttttgataaccagaggaagttaccctattaatagaggcaaaccaccgagtgttatcttgtgctaattggtagttacactgttgaagatacgtatttacaaccagttatatgttgccacgtaaggattattttgccacctcagcgtcgccagaaagtttgccagtaaataaataagtggacatgtaaatttgatgtcgtacatttatgataataaaaactaaaaagataccttttcttccatttttttagaatatacctttttttcctttcaacatctataatttgatcatttctttctaattttgttaatttctgattatattaaacacattttctctgttttctgtttttttaatctaattaacacataagaaaaagggagttaaaaagaataaatgtactctccatttccatttgatgatattctttaagtttcgtggctctttttcaatttcattggctctgacattttgtttttaattaaaaaggaagaaacaaacaaaatgtgaatccttgtgagttggctcactggcaaaaaagaaagaaaaaaaattcagaagcctttgttttcatcgatgaataaattaacaaacaaaactaaaaaataggatattcgctggccgaatcgcgtcgatccacatcgcaggtgagggttcctgcaatttatccctcgtggtctctgaatctcagatcgtcgtcaacgaatcctccattttctgaatcaaaattttctggaaacaatg

SEQ ID NO: 21182 - DNA, 3003 bp, Unknown; identical to SEQ ID NO: 21181
  misc_feature (1)..( 3003): 2750-1469P.txt file - cDNA_ID_1841345; gDNA_ID_1621108; Annot_ID_171687

SEQ ID NO: 21183 - DNA, 3003 bp, Unknown; identical to SEQ ID NO: 21181
  misc_feature (1)..( 3003): 2750-1469P.txt file - cDNA_ID_1841345; gDNA_ID_2926207; Annot_ID_141813

SEQ ID NO: 21184 - DNA, 3003 bp, Unknown; identical to SEQ ID NO: 21181
  misc_feature (1)..( 3003): 2750-1469P.txt file - cDNA_ID_1841345; gDNA_ID_2926207; Annot_ID_202336

SEQ ID NO: 21185 - DNA, 3000 bp, Unknown
  misc_feature (1)..( 3000): 2750-1469P.txt file - cDNA_ID_1841503; gDNA_ID_1621182; Annot_ID_57403
ttttgttttatttttttctcccttgcacaaaaagatcattttcaatttttcattatgagttgattacttgatttccttcatgtgttattgaatttggaggactagtgattcttgtagtgattatcacattttcccactaggtagtttagtgtcagtttatttcttaactatagtgattttaaccatttacggtttacacaaaatacttctacagatttggtaaaacgattggaaaagagaattcaactagaaaaaagagagggttactgtttgttacaaacaagacaagctgtttttcattctaaattgttggcatatgactaaaacaaaatattcttaagaattaaaagaacaatcatgatcaaacagagtacaaggagtatagttgcacatttcaccattgctccttctctttgtgttctctccgcctatttaaaaattgaaatgtctttgtgagttccatacggtgaaaaatctgtagtactcacaaaatcttatgagttttgggtaaagaatcaaaccttttgtagttgtttatagccttcctcgaccgatgtagaaacgttttggacattgtagtctatccgatcaacaatcgtgccctaattgatacaagaatataagaaaactaattgttgagaagccagcaaaaactttgtatctagccagttatgtaattcataagccttttaatgactaagctaggcacctggtcaatcacaagggctgataagtctttcattatctgtgcaaggtcattcacggaacccagaacctagacagaactctgaagttaatcgccatcgaaaatgtgaagcacgcagcttcttaaatatggtcgagtaacaacttccattacctgttgtatctctcgttccctttccgctgagacatgttgcccttccttcaacttgattgtctggtgttcatcgaaaccctacaatttattgaagaccagcgattctcattatggtattggcagagtaaggacgacaaggttctgaagattgattaaaaaaaatctgactcgtcctagcatgataaccataagaagtgtttcttaaaaatgtaaggaagacaaggataactgattaaaaatctgaattgctctagctagataaccatattaagtccttattaatttgtcaatgatatatagttttacaatacaagtaagcacttaccatcccaccaagttcatcctcttcatccagtctcgacatctttccattcacattaaactctaaatctacttcatcctgaccctatgattagagaagccaaatacaaataagaacatcatattacggtacatgcatgtctcaagaatcaacactttttttgtttatttcttgaaaataaaggaaacatacctctttctgctgctgcagacgttttaagtaagtagactgttttctgcggagctccatggaaaggttctgaagatctgttgcaagagaacgctgtcaaaagcagtatgccaaaaagtaggtcaagtccattggagagccccactatacatgtacacagaactttatcctcatgctacaaactcaaaacatagaataacccaaagtacattatatagagggaaaaaaaaacacttcatacattttgctgactgataatgtcaactagataggtagtcaaaacatatgagagtgatttaacccaaaattcctaactttcttctctaaaagcacaaaagaaaaggtaatgaccatgcattctttattgttaacaagctcgattctgaaaaagtgtccaacaacctacctgcacatttttcctgagatttgattcttcagaaggccctctagtagataacatctgcaatctcttttctgacttcctcaacaaatctgtgatctcatgagtgagcatctcgacttcacgatgaatccctttgttatctccaaatgtaggcataagagcctttgaatgtgcctttgctagttcattcattttgtctcgcaccttttgtatattaaaagttatctcctcagaatcatcaacccaagctggtggcataccaattgtgaaggcatcactactgcaaacattcacaacaacacttaaatcatttgctcattctgttacctaattcgtttagggttctaattctgtatctcaaatcaatcccatgattacaattcgtttctatatataagttcatagaatttcccaggttttgcagaatcaaacaacacattatattattaccttgatggaccaggatcataggaattcaaaggagcataagaggagtgattggaccgggaaaatgaaccgctaaccatttcgatcaccggaccaccgaacgaatcagacgccgataaagataatggagcacgcgcgctcttacacgcatccctgtgtttccggtacaccgtcgttcgattcctcgtcgccatcaataccaaatcaattgattctcaacagaatctcgaaagtaaaatttcccggagaaaataaacaaaatcggagcttttgtcgtcggcaaaagcaaacgaatctgaatcgcaaaatcgtttctcattagcgcgtgttacagacttagcaacgaaggagaagtatttgggcctttttaggcccatttatatattgggcttatagtccacttgcgcgatagggtcaatataagtgtgtggagcacacgttttaagacggtggcgcaaagacgaaaatgcccgtagattcgtggcggctaaaagtcaacagagggacgttggtggttcagggtaaaagaggctatagtgaccggttaggggtagtttggtcattggatttagctcaatagattcgtgtccatggattccctcatgtcgccagagaaaaagaccacatttaaaggtcttgcctttttggtgtgtttcctcgcactttcaggctgaacaaagtactgacagatgctaataaatacacggaggaagaatatgctcctttaattattatctgagatttttcaattcaagttcgtgtggattcagaatcaaaatg

SEQ ID NO: 21186 - DNA, 3000 bp, Unknown; identical to SEQ ID NO: 3440
  misc_feature (1)..( 3000): 2750-1469P.txt file - cDNA_ID_1841509; gDNA_ID_1620646; Annot_ID_47608

SEQ ID NO: 21187 - DNA, 3000 bp, Unknown; identical to SEQ ID NO: 3440
  misc_feature (1)..( 3000): 2750-1469P.txt file - cDNA_ID_1841509; gDNA_ID_2926179; Annot_ID_140479

SEQ ID NO: 21188 - DNA, 3000 bp, Unknown
  misc_feature (1)..( 3000): 2750-1469P.txt file - cDNA_ID_1841513; gDNA_ID_1620646; Annot_ID_47609
tgtaaggctaaataacctcattttagtaacttagttttcttttcatgcttcgcaatgtaaaaaaagaatggttgatataattcttgtcattgcagccaagactttacagcttatgcaaatgtttgcttcagagagtttgggcatcacgtcaaattctggaccacgatcaacgaggctaatatattcactattggaggatacaatgatgggatcacaccgcctggtcgttgctcctcaccgggtagaaactgctcatcagggaactcttcaactgaaccatatatcgtaggccataacttgcttcttgcgcacgcctctgcttcaagactgtataagcaaaagtacaaggtatacatgcttacacatttttatatattttacataatcctctcttgaatgtgtgagttacgagcaacatgcaggatatgcaaggaggttctgtgggatttagcttattctccctagggtttacaccttctacaagctccaaggatgatgacattgcagttcaaagagccaaagatttctacttcggctggtgagttaggcagaaacataacttccaaattgtaaaacagatccaaggttcttagctgaaaacagaacactctgttcttaaaaatcaggatgcttgagccttttatattcggtgactatcccgatgaaatgaaaagaactgttggatcaagactgccagttttctcaaaggaagaatcagaacaagttaaaggctcatctgatttcataggaatcattcactatcttgcagcttcggtcacaagcatcaagatcaaaccttctatttcaggaaacccggatttttattcagacatgggtgtatctatgacatgtaggatcatcaaactctatcttttgaataacaaatacaaagtctctgcttctttatttttttttcttgattttcttttgttgctaatcatctcttctttgttttactgctttggagggacagtccttgggaatttttcagctttcgaggtaagagtttcaaggctaccaaattcagatgcaaaacttctcaatctatatttcttagttgttttgttcttgtttggaaaagtatgctgttgctccatgggctatggaaagtgtccttgagtatataaagcaaagctatggcaatcctcctatctacattcttgaaaatggtctctccttctcactcttcctgatctctatctcttgtttgtatcttagtctgtttaattctcttgccaatgcaaacgaataggtacaccgatgaagcaagatttgcagctgcaacaaaaggacacaccaaggattgagtatttacatgcttatattgctgctgttctcaaatctattaggtaagtaaagtttcttattgtattttcttcttctcttctcttgtcgatgtactaaagattaaagattttactacgtgtaggaatggatcagacacgagaggttacttcatatggtcatttatggatttatacgagttagtgaagggatatgagtttagttttggattatactctgtgaatttcagtgatcctcatcgtacgagatctccaaaactctctgctcattggtactctgcttttctcaagggcaacaccacttttcttggttctcaaggcatcatgcaaatgcagagcaacttttcttcttcagcttcttcgtagtagtaatgttgcatttacttaattctcacgaatatgttctagcgaaaaacatcaggcctctgttttactgtgtttgaactgcttgcccttttaaagtctatacgaattttatttttcctaaaaacggcatgctttccttaggcccatgtaatagtgggattattttttacactgtgacattaataatgagttccgtatttcgtttcagcacaccactcgctcatataaaattatttgtaattcggtttaatttcagcataccactcgctctttttatttattttattgtctcataaaaaatatcaaatatttggaaaacaacacataaataaataaaaatattaaagagaaacaaattaccataactatgaatcgccaaagttatgaaaagagaccaatttctttaaatattaatttttacctttttaaggtaacttcagtttggttaattggaaaacaaaaatttagggggcggggggggggggggggtaagcagggattttttgtcgggggaaataaaattgattccttaaaactcttcaaagatttgaaaaaattaagggtggcagctgcctcatcttaactaaggtagatccgcgcctagatatcggcttggtttttgtttagaagaaaattcaaaaatatcgaacatatcacaaatggagtgtttgaagtaaaagaaacaataaaaaaaaaatcgtaatggattggtacacgtacgtgaaacacccccaccatataaacattgtactaattaatgtgatacaactaatcaaacaaaatctagaatttggatttttccatcgaagcaagtcggcttgagaaatgttcgtgagaaatgtacatgcagatgcaggggacggacccaataatattgttaaatttgctagtgagataaaagacgacacataattaattttctgtaaaattttaataaaattgtatttttaaaatcaaaatacaaaaaggatttttaaaaatttggaaaactaaaaaataaataagataactagaaacaaaataaattaaataatgaatgcaaagaaactgatcatagaagaaaaaggaaacaaatgaaatagagggttagatttaattgctataactaatgactgatttcataattttaggggctaaacatgggcccgccgttgagtatatatatgatcttgtgcaacaacaccaaagtctcacgtctcaccaatacaagtttaccacaccttctaatctgtccgacacaatatctcatctaacactcccttaagtatacttgccgatcttttctcttttcttagtatccctactcaaaccttaaacccatcggaccatg

SEQ ID NO: 21189 - DNA, 3000 bp, Unknown; identical to SEQ ID NO: 21188
  misc_feature (1)..( 3000): 2750-1469P.txt file - cDNA_ID_1841513; gDNA_ID_2926179; Annot_ID_140480

SEQ ID NO: 21190 - DNA, 3003 bp, Unknown
  misc_feature (1)..( 3003): 2750-1469P.txt file - cDNA_ID_1841599; gDNA_ID_1620811; Annot_ID_50603
agaaaacccaatgatacaaggaagctcttttgcgcaagatttgccagtcaacacaggagaaagcattcagcaagataaactgcatgatgttgcagctataactaatgaggtaaccgtattgtttcttcctgagtacctttgttcttgacctgaggccgtattcacttttcactgagtaaatatagtcaaaggttcataaatctggactagtggtggtagagcgtattttactgttgggcaataaatgaaagttgcttaagttttcataatattcctgtatgtgaaaaaagatatttccttgatatttgtttttgtggttctacaggatagccagccttccaaactggtgtcaaccagaaacgatttgataatggagggtgtagagaatcgtagtagggtcagtgatgtatcaatgggagggcataaggtcgagcgagaagagggtgaattatcccccactgaaagttgcgagcaagaaaatttcgaggtttataaagagaatgggctcgagcctgtgcagaaactaccagataatgaaataagtaatacagaccgagaacccaaagagggtgcatgtggtactgaagctgtaacaaggagcaatgccctccctgaagatgatgataataaaataactcaaaagttatcagaaggggatgaaaatgcctcgaaatttattgtctcagcaagcaagtttggtggccaagtttcttccgatgaagagcataaaggagctgagagtgaaaatgaggctggagggatggttaattccaacgagggtgaagatggatcctttttcacattttcagaacggtatctgcaacctgtaaagccccttgcaaagcatgtgcctgggacactgcaagcaagtgaatgcgacacccggaatgattctcgagttttctatgggaatgattcactctatgtgctttttaggcttcatcaagtaagtgctacgaaacaaccttctcatgttcctcaaatgtcaattgtctcagtccaaaccgctaattctgctgattttccagatgttgtacgagagaatacaatcagcaaagatacattcagagaggaaatggaaagctccagatagcacatctactgattcttataccaggtggtttattttctaagcatcattggtactttttaattgaaaaaatattatttcctaactgatatttgaaagcttaggttcatggaagccctttacaatttacttgatggctctagcgacaatacaaagtttgaagatgaatgtcgagctattatcggagcacaatcatatgttctcttcacattggacaagctagttcaaaagtttgttaagcatgtaagcttccattttaccttgttatcgtcttgactctgcttctgttctctctcctttatttttgtttgctccgcactaatcatttaagtggcttggacatgcttcagcttcacgcagtcgcagctgatgagacagacaccaagcttctgcagctatatgcatacgagaactacagaaaaccaggaagattctttgatatagtgtaccatgagaatgctcgagcccttctccatgatcagaacatatacaggattgaatatgtatgcttctcttgatatgtgtggatacctgtttatatgttcccatatactaatctgtatttgcaaatttctgtgcagtcatctgcccaaacccgtctcggaattcaacttatgaacagctggaatgatcagcctgaagttacagctgtaacagtggaaccaggttttgctaattatctgcagaatgactttctttcgtttgtcagtgatgaagagaaacccggactatttctgaaaaggtgaatgaagcaatgattagagcataaccttttttcgtcttcagttgtggtagtacagttagtaatcaccttagcatactcttttcaggaacaaggcaaaattaagtggtccgggtgaagaatctctagggatgtcacgtgccttggaaggattgaacattatcaatgaggttgaatgtaagatagcttgcagttctttcaaggtaaaatactttcttgtgaatctcttgcactgataatcttttctcttttcacatgtatatatgattgatgagagtttacaatcttcattaggtcaagtatgaaccacacacagcagatcttttatatagaagaaagcagaagaaagcaacactgaatccaactggacctgaaaatgttaaaacctctgatagtagtgaactctcgagaaagaaacgaatatcgcgctttcacatgagtcttaaccgcagacttgtcgccttgccttaactcaagaacgccgtaagtaaccctcttgtcttttatttgcctgtggtgatcaatactgcaaatcatcaataatctctaactcacgataaattgtgcaggtgtgaagttctttgctgagaatgagatatgcaagaatgagtagtagtagagagagactagagaataactgtctttgacaaagattcttgcatcattttaggctcaaagagattcacatggcaacaaccatagtttttatcttctacagtctacactgcagctggagccgccagttttgctgtatagtgttagaatatcttttttttttttaaggatgatgctaaaattggatatttttaattcattcattgaacaattattgaattttccttctaatgttaaattctctttcaaattaataatctctttaatcacatgttttatttatttattttggtttatccatttggttatttatctttaatcacatttgagtttgattatataatatgattttaagagaatatgaatatatattgactcttttatcacaggtgtcacgtgactcacgtgaggctgtgtacggaaaaccttcttatcctctcagagtctcttatattaggatcgctatctactgcttcactgaaattgtcctctcagttcctacgcgaagttttcaacagattcgccggagaatcttcgaatcaacggcggagaaatg

SEQ ID NO: 21191 - DNA, 3003 bp, Unknown
  misc_feature (1)..( 3003): 2750-1469P.txt file - cDNA_ID_1841599; gDNA_ID_1620811; Annot_ID_169068
ataaatctggactagtggtggtagagcgtattttactgttgggcaataaatgaaagttgcttaagttttcataatattcctgtatgtgaaaaaagatatttccttgatatttgtttttgtggttctacaggatagccagccttccaaactggtgtcaaccagaaacgatttgataatggagggtgtagagaatcgtagtagggtcagtgatgtatcaatgggagggcataaggtcgagcgagaagagggtgaattatcccccactgaaagttgcgagcaagaaaatttcgaggtttataaagagaatgggctcgagcctgtgcagaaactaccagataatgaaataagtaatacagaccgagaacccaaagagggtgcatgtggtactgaagctgtaacaaggagcaatgccctccctgaagatgatgataataaaataactcaaaagttatcagaaggggatgaaaatgcctcgaaatttattgtctcagcaagcaagtttggtggccaagtttcttccgatgaagagcataaaggagctgagagtgaaaatgaggctggagggatggttaattccaacgagggtgaagatggatcctttttcacattttcagaacggtatctgcaacctgtaaagccccttgcaaagcatgtgcctgggacactgcaagcaagtgaatgcgacacccggaatgattctcgagttttctatgggaatgattcactctatgtgctttttaggcttcatcaagtaagtgctacgaaacaaccttctcatgttcctcaaatgtcaattgtctcagtccaaaccgctaattctgctgattttccagatgttgtacgagagaatacaatcagcaaagatacattcagagaggaaatggaaagctccagatagcacatctactgattcttataccaggtggtttattttctaagcatcattggtactttttaattgaaaaaatattatttcctaactgatatttgaaagcttaggttcatggaagccctttacaatttacttgatggctctagcgacaatacaaagtttgaagatgaatgtcgagctattatcggagcacaatcatatgttctcttcacattggacaagctagttcaaaagtttgttaagcatgtaagcttccattttaccttgttatcgtcttgactctgcttctgttctctctcctttatttttgtttgctccgcactaatcatttaagtggcttggacatgcttcagcttcacgcagtcgcagctgatgagacagacaccaagcttctgcagctatatgcatacgagaactacagaaaaccaggaagattctttgatatagtgtaccatgagaatgctcgagcccttctccatgatcagaacatatacaggattgaatatgtatgcttctcttgatatgtgtggatacctgtttatatgttcccatatactaatctgtatttgcaaatttctgtgcagtcatctgcccaaacccgtctcggaattcaacttatgaacagctggaatgatcagcctgaagttacagctgtaacagtggaaccaggttttgctaattatctgcagaatgactttctttcgtttgtcagtgatgaagagaaacccggactatttctgaaaaggtgaatgaagcaatgattagagcataaccttttttcgtcttcagttgtggtagtacagttagtaatcaccttagcatactcttttcaggaacaaggcaaaattaagtggtccgggtgaagaatctctagggatgtcacgtgccttggaaggattgaacattatcaatgaggttgaatgtaagatagcttgcagttctttcaaggtaaaatactttcttgtgaatctcttgcactgataatcttttctcttttcacatgtatatatgattgatgagagtttacaatcttcattaggtcaagtatgaaccacacacagcagatcttttatatagaagaaagcagaagaaagcaacactgaatccaactggacctgaaaatgttaaaacctctgatagtagtgaactctcgagaaagaaacgaatatcgcgctttcacatgagtcttaaccgcagacttgtcgccttgccttaactcaagaacgccgtaagtaaccctcttgtcttttatttgcctgtggtgatcaatactgcaaatcatcaataatctctaactcacgataaattgtgcaggtgtgaagttctttgctgagaatgagatatgcaagaatgagtagtagtagagagagactagagaataactgtctttgacaaagattcttgcatcattttaggctcaaagagattcacatggcaacaaccatagtttttatcttctacagtctacactgcagctggagccgccagttttgctgtatagtgttagaatatcttttttttttttaaggatgatgctaaaattggatatttttaattcattcattgaacaattattgaattttccttctaatgttaaattctctttcaaattaataatctctttaatcacatgttttatttatttattttggtttatccatttggttatttatctttaatcacatttgagtttgattatataatatgattttaagagaatatgaatatatattgactcttttatcacaggtgtcacgtgactcacgtgaggctgtgtacggaaaaccttcttatcctctcagagtctcttatattaggatcgctatctactgcttcactgaaattgtcctctcagttcctacgcgaagttttcaacagattcgccggagaatcttcgaatcaacggcggagaaatggctctatcacgcctctcatcacgatccaacatcatcactcgtcccttctccgccgccttcagccgattaatctcaacggacacaactccgatcacaatcgagacttcgcttcctttcacagctcacttatgtgatccaccgtcacgctccgtcgaatcatcgagtcaagagcttctcgatttcttcagaaccatg

SEQ ID NO: 21192 - DNA, 3003 bp, Unknown
  misc_feature (1)..( 3003): 2750-1469P.txt file - cDNA_ID_1841622; gDNA_ID_1621193; Annot_ID_57510
tttctctataatttttgtatatttaattaatgtaaatatacaaaattatatcaaatatattatttccttatatgtttcattttaatcattttttattaaaatgaataattggacacctagatagctaggccaaaacaatttttgacattccattgacttatttacccaaaatggaaagtgtgggtgattctggctgtttagatgcttagacataatcttactttctatccaactaattattacctgtaactgtaagtttcaattttaggcattttatattaattatattaaaataaaaataataacaaatagaaaaatgtatagagaagaaaatatcttaaattacctttgaaatatatattttcctttaaatggactttctatataaaaaataaatcacattacatatatgatacaattttccccctaaatgtctggttttatgccccccaaaaggtaaaatatctatatgggctgtctataaagataaatgattatcactttaccatcaatcacatgccaacacgtaagggtgaaagtaataccatatcctgaaaataaaaattgaaaatagtccagcaaagcaataagaaacacattttatctagtatataaacaatcgtcctcatgctaacaaagcaaaacacatataacaaaaacaatagatatgaagagaaagatgaagttatcgttaatagaaaacagtgtatcgaggaaaacaacattcaccaaaaggaagaaagggatgacgaagaaactaaccgagctagtcactctatgtggtgttgaagcatgtgcggtcgtctatagtccgttcaactcgatcccggaggcttggccgtcaagggaaggcgttgaagacgtggtgtcgaaatttatggagttgtcggtgttggaccggaccaagaagatggtggatcaagagacttttataagtcaaaggatcgccaaagaaaaagagcagctgcagaagctacgtgatgagaaccataattctcagattcgggagttaatgtttggttgtctcaaaggggagacgaatgtgtataatcttgatggaagggatcttcaagatttgagtttatatattgataagtatcttaatggtcttactcgcaggattgagatccttattgagaacggtgagtcttcttcatctttacctcttcctattgttgcgaatgcagctgcaccagtcggatttgatggtcctatgtttcaatatcataatcaaaatcagcaaaagccggttcaattccaatatcaggctctttatgatttttatgatcagattccaaagaaaattcatggttttaatatgaatatgaataaggattcgaatcaaagtatggttttggatttgaatcaaaatcttaatgatggagaggacgagggcattccttgcatggacaacaacaactaccaccccgaaatcgattgtctcgctaccgtcaccactgcccccactgatgtttgtgctcctaacatcaccaatgatctctagtctaagggatgtatttcgagtgaagtgtttgatcgtttgcatttgtgttttctccattttataagacaaaacttatatgtgatgtcttttttattattattaattgttggacaattcttgcgtccacacttatcttatttaccctttcttaagttccttattaaactttacattttttttaacaccatcaaaaactttctctttaagttgtttattacactttacatttattttacaccatcaaaaactaaggtcactaaataaaaaaaactatgaagcctcattttcccataggagcaatgtgagacatagacaaattgagtaaacaattacatcacttggtaaacaatttttttaatatttaattagtattggttgttattgatttaaattttatatcactttctaaataatttaaaatcgtatatttgtatcaagtgatgcaaatggatttagatttgtatcaattttagtgaactgatgccacataaactaatacgacatcgattattgcaattgatgttaaactataattcttgtatcgattgtaaacaagtgattcaaattaatagcattcaatttttttcatgcaactacttttttgtttgtagtatttgttggatagaacgtaatgttatggcttaacatttaaacggccagaactatccacactctccattttggacagatcaagcaatggaaggtcaacattgttttggcttaaccatctaggagccctatttatttgtttttaattacattttaagaaaaatgactaaaagaaaaaatacaatgaattaatatatttaggataatacagtattcaaatatttacattaatttaatatttaaaacagtataaagaaaaagaaacatatctaattagttttataggtgcttaaacatatacgaattcagtagttcttagcaaattttaactattgaactttgtgttcaaaataaccttcctatgatgtcaaatactgaaactattttagaactcttgtgagttatcttagcaccacattttatcacttataactctttttttattatttttaccaatagaaagtttataaccatgtttttataccaattgaatttcttatatttttcaaataattgtaataccaaaagatattcttagagtaatgtactttacaaattataaaagttgaaaatagcgatatatgggctccatctaatgatctcaatgcgggaccagcatgtgatatacgaatgtctatatacattattttctctgttttgtaacaataaacgagtaatgaaattatattttattggcttcaatttgtaacaaccaacaagaggtcgaatgagccaactagaatacagcccacgatcaataatcaaacctatgaaacttccttctctctttcttttaacatttccaaacactatatatactaatgtcacttacctcgattgtccatcaaacaatacatttgagatatcaatactcctgtgagaacaaaatg

SEQ ID NO: 21193 - DNA, 3003 bp, Unknown; identical to SEQ ID NO: 21192
  misc_feature (1)..( 3003): 2750-1469P.txt file - cDNA_ID_1841622; gDNA_ID_1621193; Annot_ID_174630

SEQ ID NO: 21194 - DNA, 3000 bp, Unknown; identical to SEQ ID NO: 15360
  misc_feature (1)..( 3000): 2750-1469P.txt file - cDNA_ID_1841673; gDNA_ID_2926131; Annot_ID_196918

SEQ ID NO: 21195 - DNA, 3000 bp, Unknown; identical to SEQ ID NO: 15360
  misc_feature (1)..( 3000): 2750-1469P.txt file - cDNA_ID_1841673; gDNA_ID_2926131; Annot_ID_138747

SEQ ID NO: 21196 - DNA, 3003 bp, Unknown
  misc_feature (1)..( 3003): 2750-1469P.txt file - cDNA_ID_1841673; gDNA_ID_1620841; Annot_ID_50888
tttttaaatatctgtattttgcctccttttcattctattttgtttgatacaaacgattgtggtttgtaatgttaaaattaggaatgttattgaatgatatgtatatttcataaaaataataataataaaagtaggatgaatagtaaaattccaaggcatttcataatttacccattacatggtcaaaatttatcaatattttaaaataataataatcatccaatcaagattttgggaatagaatatcttaagaacttagtataattacatatatatatatatattcccttttaaatgtatcaaaaacaaactaagaacatacaaggaatttgatgtagtactatacaatttacatgcaaacagatgtagtactatttgatgacaaaaaaaaaaaaaaagatgtagtactattttatcttttcatcggaataattcggtcatgaagctattaattggttttaatgagaatttattataacagttgttgccacactgtcgaaatactaacgcctaacggctagttaaataattaacacgcggtgagaagtgagtgagttacacgaaccactaagaatctaatataggaagataagataagcatttcacacgtgtggtgtggacaatttaacagtgttaacacgcgcatggcatgtgatctagaaattagaacattaattttagcgttttgactttgacctttgaatcactaggcgtaggtatttacacgtgtaacaatataatttttttcaatatgtgatgatcatgggccaacgtttgtgggtaaaggtgtggtgttcgatcatgatccacttaaatttactgaattttagaattataacagcagaaggatataagtaatataccaaacttaactataatctacctctccttgtctatgtatactaaatgtctaacatgtaacacaaagctgtacaaaatttttaactctcaaattttttgaaataatgcaaagctgtaaaaatagctgtacgagaaaactgtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatgtgtgaatctaatacattctcttatatacgaccaaatagtaaaacaatatgcctctcctgcaatttttcttcatccaatatttctatggagtcatcttcttcactccttcatcactcttacctctcttaccttaatccaaaatttggaaaaagacctttggtttcttatccattaatgcagagttcgcgaaaatgcaaacaaactcgcatttgttctaacaagatgtatgttcccggtatgtaacaatatgacatattcatcacaaaatgtggtttttattcatacagaattgttctatatagattaatgcctatttttctaatgttttttttgttatataattgaattaggctttggagaagcttcaccggaggctaaggcagcgaagcatcttcatgacttctttacttacgttgcagtgaggatagtgtctgctcagcttgaggttgatttgacgatttatttgattttttaatttaggtgttttgattaataataagtatgatctatatattaattaatgacagagttataatcctgaggcttatatggagttgagagaatttttagatacaaactctgtaagtgacggtgataaattctgcgccactctcatgcgtcgctcttcacgtcacatgaacttaggtaccaaaaataacacctttatatcaataatttggttataaaattctagtatgcgttttctttttgtgaaacttgttagttggaattttaattctaggttcttaaagttatacattatacttttttaacaaatttggttttcttctagtaatttagacgaaatctctttactttttccaaacattcttttcgtacattggaagttgaaacttctcactaaaataactagttatgggagttcggtttatatattcggtttcagttatatccattcgcttatcgtttttttttttgttttaaagtttagtatcccttcggttaatttgaaagttcggttcggtttcgattatttcggttttaaaatttagtatccatccggttattttgctttaaatatttttggatatttcggttattttcggatatttttggatattttcggatattttgagatattttttttattatttttgaatatttttactattttatatatattctcaagtatttttaattatctagtctagaaataactaatacttttgtaaatatatatttatattttagatatttttggttactcaaaatatttcggttggtatccattcggtttcagttatttcgattataaaattttgtatccattcaattagtttctggttatcggttctgtttacttcggttttggtttggtacatctggttcgggtaatttgctcaggcacaaaactaacagtataacacaactaatctgtgcaattcttgtaaagaaaaactacttcaaaaattgcgtgacgaaatacaattccaccaatttgcggattactaacgaaatcactttgtagatccataagtttcgtatatcttttaggtatacatatacttgatatgagataagtaaactaaaaactttgctttttttttttggtatcatggccaatg

SEQ ID NO: 21197 - DNA, 3003 bp, Unknown; identical to SEQ ID NO: 21196
  misc_feature (1)..( 3003): 2750-1469P.txt file - cDNA_ID_1841673; gDNA_ID_1620841; Annot_ID_170056

SEQ ID NO: 21198 - DNA, 3003 bp, Unknown
  misc_feature (1)..( 3003): 2750-1469P.txt file - cDNA_ID_1841676; gDNA_ID_1620753; Annot_ID_49853
aataatttcttttaattttagtttaaaaccaatggaggatattattgtaaatatttttacggatatattccaaaactaatttttcgtggataatttacaaaagaagtttgaattagatgtttaaaatattttcaataaaaagtgtgaatgattaaaatcatatttgaacgaaatcatgataaaatttacttgaattatccgattgacttctaattatttgatttgttgtgattagatttacttgatttttgtttgctctgtaatttttggccatatatataggtttgagtaaaggctctgttcctctctctttttgtttctacattagactaagatgaccccaaaatctcatgtcttcttggtaagatttaacaaacgaaatcatacactctcgttttagtctcttatatttacccaaaccattatgcatctcattgatctcaaatatagaagcatatgagtaagaatcaaactaatctcaaatgtctacaaatgataactatacactcacttctcgttagaaagaagtactctttttgtctcttgtaccccaaacattatattccaagcatcctaaaataaagcagagacagtcttctataatgtactcatctatctctagcagattttgaccctgatggaccagtggttctcttgaaaacgtttgaaaactccatgactaaatcttcatgaccctgaagaagtgcaacaacctgcaagcaaagataacaaagctaatcaaaccaaagagctaagaagtgcaacacacaaaatgtcccaccaagaaccctacctcctggtacaagtcatttacggatttgtttccttgttggtacattgtcaatatctcgagaaatgactcatatacatggccatcattcccctggaaccttgcctgtacatcgatgaatttgttatcttaaatcacaagttagcgtagaggaaacaccaaaaatagattagtttacccatttagcatcctgtatataccttaagcttgctgataaaatttgctacacgtattcttttgttattatcaggctcagcttcgagaggggtggtttttgtatctccagttgagagcaagacactgaaaccaagaaccagattccggtggtctttcatgagttccgtcatccttgcaacggcactaggagcatcgactctacaaagagagacttagtaacatcagaatcagttcagttcacatgtgtgtgttgttttgtaagcagaaattaggagaaaatcaaatataacatggagaaaataattcatacctacgggcgctataatcattcaagatctcgagaaactgagcatattttgcaggttcatcacgaaatgattccttcaaagaatagatgtatgaacgtacatcatgaaatgtttccttagcctcagctggaaggaaggcattgaaacgaagtagcagattcacgtgatctttcaagagttcccgcatccttggaacgacggtagctaaatcgactctacaaagagaaaaataacatgagaatcaatctctcacatgtgtagactgtttaagagcaaaccaaacatacctattagctcttaaatccagcatgatgtcgagaaactctcgatattttgcaggttgatcagccccaaatgcttccttcacagcattgatgtatgacgtcgcttcatcaatagtaaacgccggtgataagcttcctccaaccatggtctaaaattggcctaatccataaagattgaagaggtctcaactcattgaagaaacagaaaatagagtgcataaatacaaatcttattcctcaagaaacttaatccaccaaacaacacaatagccgaattagaagaatcatgtcaaattcatcgcaacaggatccttaagaagatccagaatcaatctcgagtagaaagaaaagaaaacaaaaccaagaaggatgagcaagaaactagaaaattgctcgagcgccttttaacctaatcgtatctgatgatggaaggagaagatgatcgtaaccctaatcttccggtgagcgaaactatgttcaatcgaatgaggaagcaagtatgttaccgatatataagcagaccaaagacgacaatgaacaagaagcagcttcgtcttcgtcttcttcgcagagtaagggagttcaagatttctagaagcaaagtaaaacttcagagactttttttagagtttttgttcacgagtctatatttatactagggattatcatatattcatacttgacttcaatttttgttgtagttgtaaaactataatttgtaagagaaaattgaaacataaatttataaagatttctatatatcaaagacgatgatgatgtgatatttgtattaattttaatccttggtaaattcttatataaattcgtaatttatataatttaggaaacatatttgttgtcattagatttacttgatctttatttggtttgctctgtttctctctgttttcgtctatacgttgaactctgctttgacttttgagtgcttacactctcgcctctcggtttctaacaaatatgaccccaaaccaaaaatcatatatgtacatgccagaagaagaatcgacctgaattcaaatctctataatatatgaaacaatacaatcacttttcacctcaatgttttttttttgttaacattgaggttttcatatgaggtcatatcgattttgttttgaattattttagattatgatttctacatggatagacaagagttttattgtaagtgcatgtatgtaatgatgttctgttctctatacaataagcatcacactaaactctttctagcaagaagatgtcaaagaaaaaagaaaggatgtatttgataaaagcaaaaaatatcaggggtatatatgcaaattaccaaaacaaaaataaagaaacctgaaggagcaatgacaagggatttgtttttctcaaaatctctgaaagcttttggatatttgtgatcgcatagatcgattccttttgcggagaaatg

SEQ ID NO: 21199 - DNA, 3000 bp, Unknown; identical to SEQ ID NO: 7588
  misc_feature (1)..( 3000): 2750-1469P.txt file - cDNA_ID_1841684; gDNA_ID_1621153; Annot_ID_56942

SEQ ID NO: 21200 - DNA, 3000 bp, Unknown; identical to SEQ ID NO: 7588
  misc_feature (1)..( 3000): 2750-1469P.txt file - cDNA_ID_1841684; gDNA_ID_1621153; Annot_ID_173353

SEQ ID NO: 21201 - DNA, 3000 bp, Unknown; identical to SEQ ID NO: 8241
  misc_feature (1)..( 3000): 2750-1469P.txt file - cDNA_ID_1841710; gDNA_ID_1621202; Annot_ID_57684

SEQ ID NO: 21202 - DNA, 3000 bp, Unknown; identical to SEQ ID NO: 8241
  misc_feature (1)..( 3000): 2750-1469P.txt file - cDNA_ID_1841710; gDNA_ID_1621202; Annot_ID_174941

SEQ ID NO: 21203 - DNA, 3003 bp, Unknown
  misc_feature (1)..( 3003): 2750-1469P.txt file - cDNA_ID_1841791; gDNA_ID_1621143; Annot_ID_56690
ctgatctccttagtattaaacatcagtggtgtaaataaaaaagtgtggataaggagagcttagttacctataatggctgaggagagaaaaagaaatatatagatgataaccatgatcgctgtgctgtggtgattggtgaagaagccatggctgacgattcttatttatacacacagttctgggtctttcacatatggaaattactagtttataactagtggcctatgaggcattatagaaaaatgtttatcagttcttattttcgccttttaaaagtatttagctacacttacacgcatgcattaattttaaaataacgtcgattcaagcgatatagaaagaaactatttcttaaaaaacatggatttataatgcttggatatcaaattaatttacaagttgtgttttttttttatatacaggcttacatttaaccaaaacgtttttgagcttgaaaacaaatgaatatgttttgattaattgtgtaacatttaaattaaacttattaatatcgtacgtggacttatatgttttttagattttctatatgcacacatgcatgttctggaaaacactttcacaaatcctcatgatgagtttataacacttaattagttaattactcccctgaatatgtactccccttctgttcatacttgagtttatgacacttaactacttcttttttcgcctaacttcaccgtaaagtggaaccataacgatttaattatatataatagtattgtcgatttcgaggttcgatttatgggcagaagacgttgatttcacaaattagggaaaatcagaatcttaaattaatattaagaacccatagatttggtcaacatagtttctcatggctcatggggaatctgttttggtatagatgcttttagggttggttcgaaagtttttctttggataatgtgatatactatatatgaaaaattcggcatgaaaaactatttcgagggactagatggggaatatcacattagattggtgaaagtaaagctaagaaatagattttaagatcatttgatactaaaaactgtacaaagatgacttaaagtcataataaggccatctaaagacgagatccaaaccagagacttcacccatcctctattaactttgaacctcttcatggtatatctcactcttcatagacagttagaagcattaatatctaatgttttggccatgaaatggatgctgtttttttaatttagtttctgaatttggtttttagtttttcgattttagattttagttttagtttttgttattaaatttttgtttttaaaaaaaaagttttgctttttgagaaaaaataacgtagatgaagtagaactagatttcctaaataataggataaataaaaatctaacatcatgactggaagattactataaaatttgtttcctaattaattatagaaaaactttgaactatagtttcagtttcagtctaaggccgtttcttctccacttttatcagccgattcttctccacttttatcatgcaactttagattgtaatctatctagcttataaggtgttcttgagtattattaacaatttggtatgaaaatgagattttgaaaaacaaaaaccgcccacacaactgtggtctagtgttaaaggagaattgggaaaatgttggaaggaactaacctaagttcaatccaccttacaaacaaaaatcacatatgtttcgaaagtttgagtttgagctaaaagttcaagtaatttacctattattcagtaacatgcgatttggctacctctgacattagtcagaaagcatttcaaaatcggaaccgacggtgtggtgggcttttagagagaagtccactctaaaatactttggtacatttctactgaaactcactagataaatctataagtttatttaaaaaaaaaaaaaaaaaaaaaaaaaaaaaactacaaaacattctcaatgcctttgtattttttttttttttcccaatcaaggcctttgtcttactagatcgattgtcacgatgattagatggattgattgtttaggctcttaggctctctgccatcaacatgggctgaaattttctgttggaccaagttctcccaacatggatttgggccataaattgtccatattttttttctccttgtattttttattgacaaaggaacacatatcacgagttaatgacactgacatgcatctttagtagcattaaaatatcaaatttaataataaacatacagcgatacaaaactgagtcacacacacacaataagagccagtctatatgaattaaattaaattaattaattgattacctatctatgcatctggtgatgtttgtgatcgactccttcatcattctctgttcaatatttctccaagtcatcaaaattctcgccgtcaaatcaaatcataaatctctgcttctccaatttgttgagaaacatcacattccgtgtttgatcatcggacaatgaaataaacccactcaaaaagacagaatcaaactcctttttgttctctttctcttaaacccattaaccattttcgtatctgctaccaacttcctgtaatttttctcgggaaaaacaaaaaaacataaaacccaaatctttaagcgattttttcatggcgtttctggtgagtttacttgtttatgttgttcttttgacttaatttatctccttcaaataagacaaagattcgatttttatgttttgggttcttcccaaagctctgttttttgtactattagatatagaaaggggaaaaaaatcaaaactttttcgttttgatcagatctttagtttctgtagtgagtagattactgttgatccttggtggttatttgatcccatcatcaaaagtttgtctttttgattacaatctgttactttttgtagatggaggtcgatgaagaagaagagatatgatttagtcgttcttcaaattgagaatcttggggtggttgttttttattggtagtcatg

SEQ ID NO: 21204 - DNA, 3003 bp, Unknown; identical to SEQ ID NO: 21203
  misc_feature (1)..( 3003): 2750-1469P.txt file - cDNA_ID_1841791; gDNA_ID_1621143; Annot_ID_172925

SEQ ID NO: 21205 - DNA, 3000 bp, Unknown; identical to SEQ ID NO: 5841
  misc_feature (1)..( 3000): 2750-1469P.txt file - cDNA_ID_1841814; gDNA_ID_1620821; Annot_ID_50698

SEQ ID NO: 21206 - DNA, 3000 bp, Unknown; identical to SEQ ID NO: 5841
  misc_feature (1)..( 3000): 2750-1469P.txt file - cDNA_ID_1841814; gDNA_ID_1620821; Annot_ID_169481

SEQ ID NO: 21207 - DNA, 3003 bp, Unknown
  misc_feature (1)..( 3003): 2750-1469P.txt file - cDNA_ID_1841836; gDNA_ID_2926128; Annot_ID_138659
gatcagtcgtcgatcctcttgagtgatttgattttagactttctagttatcaaactcgaaagatggattctgtccttgtagtgggcattgcatcggttattctcggtgcgttgatcgctgtactcttcttcggtagctacttccggaagcggacatcggaggtgcaatccatggccaaagcggagcctcaggatccgatccggaatccaaagtcgaatcatcctgctccgaagaagaatcatcccaaatctcaagcgtccgataaggtaaggttttaactccattttgttccgagtttagggatttcagatttggatatgagttgactttaaagctttctcttcttcgtttctaaattgcttgtggaatgcagaatcagaacaaacggcatcatcctttagatttaaacacgttgaaaggccacggtgatgctgttactggactctgtttctcgtccgatggaaagagcttggccacaggttagaacctataaacactcctacttagctaatccctgtcaagaagatatttttgctattttacaattctgatcacatttgttcctgtttttgatagcttgcgctgatggagtaatcagggtgttcaagctagatgatgcatcaagcaaaagcttcaagtatttcttcctatatataatctttcaatagacaatgttagccggtgggagtttactttgcaagcccattttcatgatctaactgttttttttgtttgctttctaaaattcagatttttaaggataaatcttcctgctggaggacatccaaccgccgtggcatttgctgacgatgcctcatctattgttgtggcttgtcatcatatgtctggttcatctttgtacatgtacggtgaagataagcaaaaggatcagcaagggaagcttcctcttcctagtatcaaatgggaccaccatcatattcatgagaagagatcagtgcttaccatctctggagctactgcaacttacggtactgctgatggaagtgttgtcattgcctcttgttctgaaggtatgtttttccatggctagtgtcactgtcatagcgatgttaaattggtttcagaatctctagtttaaaacttgtgtataaattgctaaagggtgatttcaatttgtgaatacccttatgttcaatataagttcttgtattgctgttcaaaatgtactgctctggtgaaatatcccttgttttttccttaaaccttgttattcgccagggactgatatcgtcctttggcatgggaaaactgggaggaatttgggacatgttgatacaaaccagttgaagaaccacatggcagctgtatcaccaaatggacgttttttggcagctgcagcatttactgcagatgtgaaagtaagtttttgtataaattcaaaccatcatgagtgtatgtgtgaccgtatctcatgtcttagcaagtgctttgtaggtgtgggaaattgtgtatcagaaagatggttctgtgaaagaggtttcaagagttatgcaacttaaaggccacaaggtattattccactacctatagcatgataatccatctccaacgatatagattttttctcactttttgtcttgtaatcgtttcatgtttaaaccaatgctatggtatccagagtgcagtgacttggttatgcttttctccaaactcagagcaaatcatcaccgcttcaaaagatggttcaataagagtctggaacatcaatggttagtagaattgtttttaaatgtctgcatcattctgattattgccaaatgcaaaacagatccctggtaacataaggggatctgttctggaatttataatagatggaatgattttgatttattaaacaaataacctgaaaggcattgtgttgtgtaatctggttgcagtccgttatcatcttgatgaggatccaaagactttgaaggtgttcccgattccactttgcgactcaggaggcaatccgttgcactatgatcgtctcagcttatgcccagagggaaagatattggcagcaagccatggttccacattgcagtggttatgtgctgaaactggaaatgtcttggacacagctgagaaagcccacgaaggtgatagatagctctcaacatttctctttgcaacctattcaaaaccttaacatatacctcaaaactattcaaacaagtgatagtaaatttaccacggttggttgtatgtgcaggggatatcacatgcatatcttgggcacccaaggctattacagttggtatgtgcctgtctgattctttcttgtatgtaaagttgtatgtgatctgaatctcatgtggtgttgttggttctcaggggaaagacatgccatggttttggggacatcaggcgatgacaagaaagtgaagctgtgggaagctccaaagtcgcaatctttgtaggctctcgcatacacgtagtcccttgatgacatgaggcgtatttaaacggtacaacttgcgaggaaaaaaactctaataggttttgtttcgagtcccaagttgggatcaaatgaagggtggtttaaagtccttcttgttaccaagtgtcttttaacttctgaagttttgaattttgctcataggactagtacaacactcacagtcttctatgttttccaaattaaggaaatttaaaaagcacacaacaacactaagaaatatgaatcgattaaaattattatacgcattttgttttctttgtatcagaaaaatgatagtctacatacatatggtaatttggtaaataatacaaaaagaatctacacaaccaagtgaaaaatcaaaaatgtgtctggtcgtggactccgatgggctttttgaggcaaattgaaaactgggccagaaatatgaaaggcccacgtaagtcccgaatataacctaaaaagcacactctctaataacagccagaattagggtttctctttgtcttcagcagtcagtgcgcatccgtaggagaaaagtgtgagaatctgccaccatg

SEQ ID NO: 21208 - DNA, 3003 bp, Unknown; identical to SEQ ID NO: 21207
  misc_feature (1)..( 3003): 2750-1469P.txt file - cDNA_ID_1841836; gDNA_ID_1621147; Annot_ID_56780

SEQ ID NO: 21209 - DNA, 3000 bp, Unknown
  misc_feature (1)..( 3000): 2750-1469P.txt file - cDNA_ID_1841841; gDNA_ID_1620762; Annot_ID_50035
agggctaactgcacttgatactcctcctcagaagacatgtaatccgcacggttcgaagcagcggttggagcaggagaggccatagaagaagtagctccggccaccggaagcgtctcagtgactgacgaaggggttgcttgaggaggattagcagaaacgtgaatccgattttgatccgatggaggagctgcatcgttggttcgattctgctgctcttgattcccacctctgtgtagcttcttgaaaatatgcttcatcgctctcttcagattcttcttcttcttcttcttcttcctttggtcaatcaaaaaagtggtgggagtgacggaaacttagccggcgagttaaaaaagggagggaccaaatttacaggatttacgactatgccactgttttgacctttttgttaaaattatccaattaagattaagcaaaaggtaattgtgacacgtcgccatcgggacccacacgctgaagaatttctgtacgcggctaatagggtaactttttttttaatagtaaaaacataattacccgattgacaacagatgtctatatccgtaaatcctccatctagattccaggcagttttcgagcgggagattccgaaccgactatgattcaatgcaacgaaaaccagattaagaaaccatttagccatgagttagtatctataatcgttttctctagagttcaatgatgatcatgaaaccattccttattaggagcattcttccatatcatcatcacattcatgaaaagactagtaaaaaactataaaccaaaactggaaaatccgagtacaaaaaaaggtccaatgggaacagtaaagcagaacagagtcttgatttgacccagacatgccaaagaaccaaggagttttataccttttaaacaaatacatctttattcatgatattccaaacttacagaattctatatcgaccacattatgtgacaaaatttcagctttcttctgcaaatctaattggaaatattacaaacaatacaacaacaacaactctcaagtattcaatctctctgtggaatggagcagccaaccatcattctgattctgactggaacagccaaccatcattctgattctgactggaacagcttctccgtgtttctgggttttgctggaactgcttttgcggaatcaagataacaagtgttcataagtatattaaaaacccacaatcgataacacaactaagataacaaagatcaacaatgtaaatctataacttcaaacattaaacatcccacgtcatagtttcggacaagtccatatcggcataaaactcttctacattgcattgtctcacacttcaaagaacaagcagattttcaggaatatactcatgtataatttttggagagtaagaatagaatttttcggtaacactactacatgaagaaaagtgagaaatgttcataaacttacaatcaatgcttgttttcaacttcctcctcttgccattacttacttggtctccactatagttgatgctagttttcaactttttcgtcttgccattacttccttggtctccattacgtatcgacttgtaatctcgtaaaggatgatacttcatggattctagctcttttattgctatgtcatatcggtgttttacctccctctgcaattacagagataacaatttaagagacctaaaaagtcaaccagtggaagtgtggaacatgattggaattccctaactaagactcacaagtgccctattcaaacccatgatttgctgcttgcataacttcatctccatctcaagtgcacgcaatcgaccctcaacaggaacagcgttttgctcaaccatttgcttttgtctaccacgtactacctccggctgccaaacgttcaaagctactgatgcttgcctgagaaagccattaaaaaattacatgagaaggatgcatgaggcaagaacagtaggaccaatctcatttcacttgatcaacaaagaatcatctttctaaactgtcacaactgaacaagcaatctcctttataattgctattcgtagccatagacagagagctataacgactttaaaaaacgaaactttctgaaatctgacaaaatgttcaccaggttggggactacctcactttcagcaaatctgaaaattgcagagaagaagactgtagtctctcagcctcgtcggacaatcgtgcctccaattcacgaatcctccggccccattcagaaatttcactctccttcctgagtaaagctcttctatgggcagctaatttcctctccttctccctctcaaacctatcaaccacatccataggagcttaaatactcacactaacaacagaagaaatctcagaaagcacaaatttcaatcaaacaaggttacctagtcatgtagataaacttggtgggagattcagaagaagaagaagcagagacgatgtggttagggaaatcatggacgagcagaagatcccagagggaatcatcgcaggacaatcggaagagacggcgagaggagatagagatgcagcaaagatctttgtacgagaaagtcgaagactttacgccaatctctaggatctttctccatagctcgtcgggtatctcgtttgcagacattcctcttcgaaaggttacgccaaaggcaaaatcctggttttaaatccagtttaatccactccggtccgacctgaaaatcgaaacatttgatcccgaaaccgaattttatttttaatatattaaatagatatacttttaaaaaagtagctttgtttgtagttattgggcctaatgggctgttattgttgtaccgttatttgcccttttgggctttaaatgatatatcgtaggtcgacacaaacaaaataaaatattggcatagacgagctgctggtcagaagaagactcagaagtacctctctcctctcgtcttcttcctctagaactcccaaaaatggcgtaagccaaaaaatccaccgaaatcgataacgatg

SEQ ID NO: 21210 - DNA, 3000 bp, Unknown; identical to SEQ ID NO: 8924
  misc_feature (1)..( 3000): 2750-1469P.txt file - cDNA_ID_1841858; gDNA_ID_1971923; Annot_ID_177188

SEQ ID NO: 21211 - DNA, 3000 bp, Unknown; identical to SEQ ID NO: 8924
  misc_feature (1)..( 3000): 2750-1469P.txt file - cDNA_ID_1841858; gDNA_ID_2926254; Annot_ID_143092

SEQ ID NO: 21212 - DNA, 3000 bp, Unknown; identical to SEQ ID NO: 8924
  misc_feature (1)..( 3000): 2750-1469P.txt file - cDNA_ID_1841858; gDNA_ID_2926218; Annot_ID_142350

SEQ ID NO: 21213 - DNA, 3000 bp, Unknown; identical to SEQ ID NO: 8924
  misc_feature (1)..( 3000): 2750-1469P.txt file - cDNA_ID_1841858; gDNA_ID_2926218; Annot_ID_203173

SEQ ID NO: 21214 - DNA, 3000 bp, Unknown; identical to SEQ ID NO: 8924
  misc_feature (1)..( 3000): 2750-1469P.txt file - cDNA_ID_1841858; gDNA_ID_2926254; Annot_ID_204487

SEQ ID NO: 21215 - DNA, 3000 bp, Unknown
  misc_feature (1)..( 3000): 2750-1469P.txt file - cDNA_ID_1842117; gDNA_ID_1620746; Annot_ID_49729
aggctgctcaccctgacttaacgaaaaccaatctttaagacttgcagagcaagtatgagcaggtgaaggactcagcccggcttccattttcacatgttcatcaaatgaacctggcacaacaaaaaaaatccaagcgatgttaatacgatgtacctcaaacagctcaataaatactaaatgactatgtaacaaggcaccctttccaacaactactaaccatttagcaactgtgaatccttgagctcgtcagcagatgaaccaactggtgataagttttcttggctaccctaaaagtagtcactctcaatgttagtttcttctctatcgaaaaaaatagtcaattagagattagtgtagctacagaattgtgaaatcacacatacataaactttataacaaaatacaaatccaaacatctttgtagcagcattcaaataatgcaatgaaattcagctaaatcaaaacgatgaaattgaagttagagaagcgtgtaatcaaaattctcaagctaccacaaaagccgagaaaactacctcagcagaatcaggcttctcatctagaatccgataaagcgtttcgatgtcaatagtctcgtcatcatcttcaaactcaaaaccaccatcacaatcatcaaccggaaattcacctcccagaccaaacattgaaccttcctcacccatcaaaaatcacaaaaaaaaaaaaaaaaaactaacccgagaaagaacgagaagaggaacaaaccctaaatcagaaaacccaaaagtcacggaatttcagctcccgggaaacccaaatcgaaattcagaagtagacgcgtagatccagagattgtagaattttcaggtacgacgaagaagaaggcttgagaattgggttttgaaggaattttcgaggaaaggtagagagcagttgggatagagaaaataaaaatcgcgactttttgtagcgacggtggcttctttttattgccttgttctctcttttggctttctccgaattggaaaaagtaaacaccacaaggctatgggacttccggctttaaataaggaacggtcgaacatttgtttttctttttctttcatttttttccattttttcattatttaataatgcatgattatatataattatattttatgcgccgtcatctttattgttaaagcaaaatcacaatttaaacaaaaggaaacaactttaattagtagtaggaaactgaagtgtttaagtaatggagatttttttgaagtgtttgctaatcataatttattgtaaaaattatttttaattgtgtgaaaattagattttctacactaacaaaaaaatttcatatgttaaagaaaacaaatatgaaactaaatcacaaagatcaattggaattagacatgtggatcgactcattagaaaaataatcatctcaatcaataagaagagataaaacatatatttgactaaatgatcttaccaatcttgtggtcataaaattctacaaagcactatattgctaatttctacaaagcacatttgtaatcttctgaatcatttgttagccctaaaagaagactagtattatacgagatcaccatttttatgattgatcaaatatcttgtagagcgcaaaactttgtaggtagtttgatgagaaagagcttgcttattatgtgatcaacaattccgttcttgccatgtctcaaagtagttgcttgccatattaattgatatgaagagcctttgattttgcagagataggaattgccaaaagaaaccatatgaggattgactcgagaagttttagtgtaacttcttcactaagtccttccaaaccagttgggaaaaataatattaaagaataagtggtccattgattcttagtcggtcaactagctagaagacctcaaattctgcaatcgatcctttgtcttattgtggttccacacaaacaaccatgtgcaaagaacaaaacatgttttgggactttagtttgaagatgcaattaaacatattgttagattgttgaccaagaaaaaacatattgttgagattgaaagatatattttgcatcggactgcaaaatgtttatgtcacatatttgttacctaatagttgattttaatagagtataatagagtatcagttattggttttaaattgtgtatcaaattccaaataatatagagatttttaacatcagtcttatttaattatgattttaaccaagtgtcgttagctcaattggtaaagaccttatgcaaagcttagaggtcgccggttcgagtgacgcttgggacgaaactaatattttatgctgtggtttcaggcctgggggattacggactttgacccacaacctccaagatttaaaaaaaaaaataaaaaaaaattatgattttaaatcgaaattttgttcttcaaaggtaaaatagtttaaaaatctttgggtattaaaatcatttggaaatgagttacataatactatccggtatataaagaaccaaatccaaaaacaaaccggttcccttaataatttaaaccggattattcatcgacggttcgtcaacatcctaataatttaaacccgatctcttcttctctatcgaaaacctccaacttttttttgttttatcagattgtaaatttagggaagagactttcgcaagcaatctagaagcaaatcgatcgccaaatctccggattatttgcaagaatcgttcccagataatcttccccagattctccacttctccaggtacatcgttatattcaatttttgaggaaaatagtcgcacactctctctttcttagaactaccactcctgtgctgttttgagattaaagcttgaattttgactaaagccctaaattactttgtatcactatctgatcacaaagtcaatttcttttggaaatagctctgatcggagtgttgctcgaacaggtattaatttcgtattgagtggattagattagatttcaagatatgagagcctcactggcgttctaatg

SEQ ID NO: 21216 - DNA, 3003 bp, Unknown
  misc_feature (1)..( 3003): 2750-1469P.txt file - cDNA_ID_1842159; gDNA_ID_2214555; Annot_ID_134758
gtcaccgacaagacaaacatcgataccagctgtgtctaaatgaacggcggatgggtaatcgtaggcagttacgacggtgatcggttctcctctccggtgtttttgtctgagatgcgttagcgtcactctttggtttgggttttgtggctttggtcctccgtagacggtgttttccggtaggttactcatgaaacggacagagatggcttttgagaagcgagagcaattcctagtgagtgaggacgccattgttgtgaagatgaagaaaccctcttatctgtgactgtgtctgtgtttacaagaacaaggaattttacttttaagaagattcaattcctagtgagtgaggacgctgtttagattctggcaagtggcgattcagttctgggtttcacacacaaatcaagcatagcaatgacactgttaggaattgtgatagcttaactataaattcaatattttaacgaaatcaacaagatccgttgtagtctagctggtcaggatactcggctctcacccgagagacccgggttcgagtcccggcaacggagatagttttaaaatatctttactatattaaaccggattttggttcagtctggttatgttaacccagtctctgtttctctctaggctctagcctaacccagtctctgtttcgatcttattgaacttctgttccaaaggcgattccttttttatttttccgtttctgggtttagatagagaaatgtagagattgagatcgcggttactagttggaactctcttggagttggagagcatccgagggttctgcacgagctcctttaagatcgtagcttcggttcttttttatgagattgcgcattgtgataccaaaaccggattctactgtttacagtttccaggagttcaagtaaagaccaaaccatgtctctgttttttaagtcacacacgtgtgagatgacgtgaaggaattttttgttgttgttggtctgaagtagttgaatgtagttggcttctaaacctttttatatatctcttcaatataaatcacacgaagaattctaacacacaattcgttgattcatcatatctcctcttcattaatgaatggcctcgtcgactcttctcgagataagaagatgaaaaatccgcgattttcgtttcgcacaaagagtgatgcagatattctcgatgatggttatcgatggagaaagtacggtcagaaatccgtcaagaacagcttgtatcccaggtaaactttttaacataaataatctgaaattgtttttaaaaagattgtttttttgtgtgtttcttctcacttatgatcatcaaaaggagctattatagatgcacacaacacatgtgtaacgtgaagaagcaagttcagaggctgtcgaaggagacgagcattgtggagacaacttatgaaggaatccataaccatccttgtgaggagctcatgcaaaccctaactcctcttcttcatcaattgcagttcctctctaagttcacctaattatgtttgtatatatattaacgttctaagagcatctccaatggaagtatctcaatgagatacctaacaaaagaaaaaaaattaaaaaaaaaatatgagagaagggagaaaaagtaggagagaaggagagttaaatttctcggatgattggacaggtgtaatcacactattagttcaactattaaataataattaatgtatctgttttgattaaaatattaattaatatgtttttgagaaactttctttatttttactggtggagatggtctaatgttccatggttcatataacggagcaaattaaagcattgtaatcatatatgtttgcatgttcatagttgcaatctcgttttgattataaatcagttttaagcatataaccaaaataaaaaaacaaatcaattgtaatattccggtaaaacgattaccacgtgatgattatagagaggcatagagcaatatcgtctggtaaactgaataaaaccggatttggtttccatagatttttctcaagccaaatcagtttcctttcgtttgaataaacctattggcttatcgtgagtgattattgttttgtttatttacacgatgaacaatgtcaatgagacatgtcacatgtacgaagtcagttccgatatattacatgaattgctttcaagttttgatcagcatccttaaatagtcaccgaaaataagaagcgaacaagtcttggcgaagttgaagccacaaagtgtactaataaatatggattgccgaattaaaagaagaaacaaaaaaactacattttcatattttttttcttcttccatatataaatccacttttcaacttaagcaaatgcaatcaatgggaaggtaagtatgtatacctctaaatctcaaataatctttaaaattataaaatatatatgttttgactaattttaggaagataaaataatctcttatattttcatcttcttgggattatttaccaaaaattaatgtttagaaagtagtactactcaacatgtagttgttaaatatctttaaagtttaagttttgataatgttaaaatctattaaaaataattggtcataatagtaaaacaactaataattaattttttaggatattgcttaaaagttaaaacatattgctaatttaaaagtcataatatacaaaatataattgtagtatattctataataaacatgtttcatctttttttcggacgagcaaagaagtaagaacgcacgttatgaccatgatgctctaaaaaaaggatcttattccttttctaatgatggaaaaattattatattattccttttccaacaaccaaagaaaaatcaaaaatgtcacgctccggcaattaaggtatttatcatccttaaaagaggtaccaaaatatatagaaccgacagcgccataaactttagaaaagagagagagagacaaagagagatctgatcctttgaagaaacaacaccaaaaaaaaaaaaaaaagaatg

SEQ ID NO: 21217 - DNA, 3003 bp, Unknown; identical to SEQ ID NO: 21216
  misc_feature (1)..( 3003): 2750-1469P.txt file - cDNA_ID_1842159; gDNA_ID_2214555; Annot_ID_185686

SEQ ID NO: 21218 - DNA, 3003 bp, Unknown
  misc_feature (1)..( 3003): 2750-1469P.txt file - cDNA_ID_1842287; gDNA_ID_1620626; Annot_ID_47134
tcccttaactgactcattatgcggctcacataaactctgtaatcttcatcttccaacatatccgtggttaagcagcaatcaaagactgtaatacaaaaacatcaaagttcagcaaccttatagagcaatcttatatttcgtaagcagcttatagagcaatcttttgtatctttctcactaaaatagtctatttctcagagctaagcatggataagacaaggacgaatttgagaagtcatgcaacacagtgaacatacaaaacctgaaaaatctatccatgagctaaatctcaccgatcaagaatcttaagctatcaaatgttagattcagttcaattaacaagcctaacaagaagtacactataaacttaggctaaaattatgatttttaagacctaaaaattcaaactttctaaaatttaatactctaagagcaagggataagacaagcaaaaggatttgagaaatcatgcaacccagtgaccatacaaaagaaactgtttcctgacaattctttgagaatgagacatcttaagctataatagatagactttccaccaatgagcctgagcctgtgctcatggatagttaacagaatccatgaactaaatctcacccatcaagaatcttagtctatcaaatgttagattcagttcaatcaacaagcctaaaaagaactagaaactaaaacaggacactacacttatcaaaatctgatcttaagacctaaaaactcaaactttctaaaaatcaatactccaaagcccaaagaagagcaaggataagaaagcaaaccctaaacccatcacttaaaagaagaaagagcataccgtaaactctctctgagatctcaagcaacccttcaggaggttttctgtgaaagaactttctaaacaacgccattgagaggtttctttaaatgcttaactcaaaaaagcagagaggtcacacaatccctagaaataatcacttatgaccaaatgcgacccacattgcaggaaaaaccccaaataaggagaaaacaaaaacgagaaaaatgtcaggaagaaagaaggaagcgtgagataatcttattgctgggtctttaaggaacaatgcgatgtgggttttgtttcttttgtagtttggtggtttgtcttgacatacacactttcaatttcttccgttttggaattggaaacttagctttcaatcaaaacagatgtttgatagctctgcacatgcgagaaagaagaaagggaatgatgcagagagagaagagagagagtttggttatcttgggaaaagaggaactagggtttttctttgattctaagaccaagaagaagatgatatagctattgagaaattcagacagagattgaggatgatgtcggatttcagatagaagggaaaaaaaagaaaggaggacccaaagatctgttactttgtttaggactatgatacatgtcttccaatattcttttttgagttatttaagatttgctttcttttctttcctaaactcggaatttgcaatttatttccttttgccatgacttcatttaaaaaaattaaataatctttgaatgagtacacacttagatatcatagtttgtttttaagtcattaatggaaaaatacaatttttgtaattttatatttgttagaaataattttttagctaccgattcaaccgcgaaaggtagattatggttcgttacatatatattgaaccaaatcgacggaatacttggtccgtcgaaaaagttaattggttttaagaatattggggtcacatacaaaataaaactgggatttttggtatatgtataaattcatttttctaatttaatatttacattaaatttagacattttaaatgaaaagtaagctattttttatattttttgaagttcacaaaaaacattttaacgattttgaaaagtagatttcactttaattattttttcgttacactttttaaccaaattacataaaaaaaatgtttcattcatcggccctgatcacttctcaagttttccaatatatgacattattggaggtaacaagatataatacactaatatgactgacaaactgcacaagacattttcttcatgtccctatatatggttagggagaccaaattcacctaaacaatactatagtttacggggtgatgctagacatgtcagtacaatagtctcaatcagtgggaaacgttgcacaaacggatcatgtagctgagtaaatgagttgatgcctcgttagttggtaaactcatgagccattcttgctattagttaaaccaaatcccttgtataaacacgcctctcatagtcatagatgagcttatgtcttgttctagtaaatgttataaagaagataactcaattgataattggttttagcacttggtccttgctctgttgattcgaaatccttattgaaaaaagaagaacaacgtaaattccttgttaaaatttttgaaaatttctattttctttgggccaggagtgatctcaacaaatatatccgaaaatgtaaaggtgtgtatacgtatcaccccaatagctaataggcccaatacggcaatacccaaacgtcaccatcaccaaatagaatgactagattttactttgtttactacgtttattcacgaacaattattttgtcaaaattaaaagcgagacaacgagaaacactcatagttttgcctgacacacacaacaaatgtcagtatccataattacattgtttcaaattttctctaacggttacatcactcgcaacggctacagtaacaaacatttaacgtttctttaccttttcaaaattcttcttttttcacaacaaaacaaaaagtaaataatctaacggctagttttcgaattttcaccactataaaacctcacaagaacctcctcataactcagcaatttccaaaacaacattcctaacactacactccaagcaactagcttctctactactcaatactatgtttctatcggcatctatg

SEQ ID NO: 21219 - DNA, 3003 bp, Unknown
  misc_feature (1)..( 3003): 2750-1469P.txt file - cDNA_ID_1842353; gDNA_ID_1621139; Annot_ID_56599
tgttttagatacatctttcgttttacaaaaaaagtaatatatatacatctttcaaaaacagcttttatatatgtgtgtttatgcatatattactattatcttcttttattttatttttcttgttttataaatcgagataattattctaaaattaacttttattgtacagggacattccgaggattttcccaacctttctccggtaaaatcagatgaggtgtttgctagaggtttttgtttaaaaatatttttatccgaaaatcacataggtaatttgttataagaaatatagaaggttaattattatataaacatattaactatcgaaagaaatctttaatatttaacgaggatagaaagtaattgtttttaaccacaaagctaaagctgtgatatgaaaacttaaaagcaaagatcggttcgtgaagacaaaatggggttttggaaaaggaaaagaggaaaaagaaaaagaacaaacgtgtgaaaattcgagaaaaatggtaacacaaaaagaaattggacatgatataagttgccaaaaccaaagagaaaaaattgacatgatataccaatcaaatttttgaatcaggtcaactaatcaaattcacaacaatcatccacaatattatttagatttgacgctttcactgtttcacatgaaaattttacatttgacgcgatgacttgtggagtcacgatcattttagtcactcgttttaaacggatgcttcattcaaaaaatgtaacttatattcagaagactcctaacgtccgattcagatttacaaaaaaacaatatcattgaatcggaaaacagaaaagcatagtaatattctaagtatttaattataatcgtgaggaaatagttccgtaataatgggggaaaaatatatatatgataaaaccaaaatgagatttgcctgaagatgccatatgtctgatcaaacactctgagctgttgtgtcgatgaactcaccatatgccaagatacgctattagcgacaacacatttgtattgtcaaatgtcattaattaacatccacaggtccaacaacagagaaacaaaataattatcacaagtaaaatataaaattagtaatatacttgtacttataatttttggcttatgccttttaatttattttaacactagactcgacgaaactcatcactaacatgaccacaaaaaaaaaagattacaattctaaaacacaaagattaaaaaagaaaacataacgaagtaaaattaagactagacatcaactttacaagttgaaggagcgagaagaggaacttgtccgttagaagatggattaaatctcaaccacacatcacatctggcgtaaaatccataccgtccagtcttaatcgcaccagctttccaacgtagcctcccaaaaatcaccactctcatcaaaacgacgccgtaagcttcatcattttttaaaccattagctacttccggcgagactggtataccgttgcctcccatcaccggagctatcacaaccgtagatttatgtcctaaacgaagcggtggtagtggaagcggcggtgttatgatctgatctttgtacgttacgtacatagagagcttgtcgtagtgaatggagactctccggttagggtttcttgctaaaacgctgaactgaacggaggttgagattaacggcggcgctgtgaaattcaggtcgtagatggcggctccgacgacggtgagacgtggtttatgtggacggtagacgagccaaaggattaaggctatgatacctagtatgacaaggatggtgaagatcgcgccgcagattgcgcggcgagcatctccaccgcctcctccgccttctttagagtaagattctggcgttgaagaagcggagggagcgttcttgtgatctgctttggctgcgtgctctgcttttgcttctccttctcccatggctatactctacagatataagtgttaaagtgtgtatgtataggtatgtgtgtgtctatacgagaatcagagggttcggtgaagagtgaagactctaaagaaggaggaggagaagaaagaagataagtagatgcaaggttttgtctcttttctagttaataagagtaaacagtcttctagagtacagttttattaattgtttattaacttagaaagcttgtagttgtaattatgtgttaaagctaatctttttataaagtagccgtaaattactactgtttttacattgtgattttattttgttataatacttaatgtaataatataagatagagaagtactttcgaaagactccaaatctcggtgcaaccgttcacgtgacggatctgatgagtgatgaattttttaaaaatgaaaaatccaatgtaacgtgtatacatatggctatacataatcaaatactttgttgtcaatgattgacttatttggtgacaactatggtttcgtgcaacgtgataactatcactttttggccgtgttaatttttaaaaaaattagaatgaaatttatcaggttacggcctgtcaaagttagcaataacctaatatctgtttgcatgccagaatacggttatgtagaaagaaaattaaattatcatatttcacaattctttatcaactgtataaagcaattaataataaattaattagataccacatgtgtcatatttgttctaatgtttagaaaataaaagtacaagtcttttatgtccacatctccaacaatacttctgaccaaattccatatattattagtaagcttccaaaataaataataatcacatttaagaagaatctgttatttaatcacactaactgagataccgcaccaccgacactgtagtcaccgacaatgctgtggatgctacctgggcctcaattataagcccattataaaattgggcctacactaaaactattgtgtacagagagatatttgataatttgctgactgatacaagtctcacttccaacggccgatttattaaaaaaaaactccgacaaatg

SEQ ID NO: 21220 - DNA, 3000 bp, Unknown
  misc_feature (1)..( 3000): 2750-1469P.txt file - cDNA_ID_1842357; gDNA_ID_1620762; Annot_ID_50045
tacagagactgaatgatttacttgttgagagagaaaaactaatacaagatttagaagctgagattgaatacttccgggaccagacccctcagaagaagaataagctagatgttgcagaaaaagtgaccgagatggattcccctagtgagggaatgagcaacaagatacagagttgtttagttgggttcgacgaagagagattatacatcaccagttgtctggagaagattgaaaacagagtaaatggcaaggctcatgacgataatctaccagcacaagaatctgtttctgagctacatgagagagtagaaaggctgaagggagacttatacttcctagaacaagttatgaattctcttggccatggaaatgaaggcgtgcaatttgtaaaggaaatagcttctcatttgcaaactctgcggagtctcagcatgaaaagacaagatcagactgagtgttgatgtcctgagtaacaatcttcacaaaggtatgttctttcctcttccctgattgttgtgttgattttgttcttcagataacttcacctgcggaaattatagctctttgtacaaacatcttattattcatatgtcgttctggttttttaatatgttagacacctttgtggagaggatattgtagaggaaactaaaagaagttcaagattcaagaagcttaaagaaactgtatagcatcgtcttcattgccttcccctttcgtatacgataatctcagaattctttacgatttcatttttgggtttggtgttcataatttccttatgggttttcatattctttgtgtttattttgcatttttcttctagttttgagtgaagagtgaatgtaggttttgttctgaagttctcatttgattttttttattaggttggttgatacttttgtttagcatgtcaaaagtcatgcaactttgttaaacttgttgtacatttcttcgttataaactacttatacgtaatgtcctttgttaaactcatatttctttgttggtgttaggacctcgaatttggaaaataacaagaaggttgatacgcataatacaaacttacaaaagacaattaaaagaggaagagaagccaaaacctaatatctaaaatattttcttactgttaaagtagtgatatctaaaaaattaaaaactgtctttggcgaaaaaaaaaagggttcaagaataataacatgtaagaccaccatgcatcattcttatttcttcttttagtttgaacttcaataatccgtcctcctctgtcttaaccaactccttaattaatctgtcttaagcttccttaatttctacaacacttcctttgtctcaaccaaatttgtgtagtatcattcatgtcccactcttgtacatctctcacttctatgcttaattggaagattgtatcacagaacatgccacagcttgtgcccaatgcctcagtctcgttttaacctgttgaggatcatctcctgcaaatttatagaatataacatcaaaacacaatcatattatgaaaatatcaatctgacgaaaaagtttaggttgctatgttacctggagacataaccttcaaagaatcagagtcgcttattggactaccaaaagaggaagatcggtctccgagggaagtaggacgggaggatgaagaagatccaccactgcctggtgtagaaaccggcgagatctgacgagtcacagcgaagtaaaggtccaatgcaggcaatgtagttgtaagatgttgcccttgctcctcgttaaacccgaaccctaactcaatagatcctttgagctcactcaagtcctcgtccgtcaagtcatctcctccttcgttatgcttctcaaggtgatggagcatctggcgacggcgacgctcccatgcgatgtctctacgggtctctaacatggagagttgcttcgagagacgtttcttagccttagctttcggtggttccaatggcatcttttgaagctcttctacttcgctgtcgtagaaagatgacgacgatgaggttgatacactcaatgcttctccaaccctcaccatctttctctgttgttaatataagaaatcgcaggcacgtttatgattatcaacaaggggcagaatatttttgtgatgatgtgccttgttgtacaagttagctcatgtaagcgaggaaaaacagaagaacttgaatagattagtgaaaatcccagaactctgattccctttaaaaaatgttcatcccggaagaagaaaaggggtaagaagttttttctgtttggtttattttattaatgtacagaaggagatatgttttctggtgaactttaatggtgtgatattacaaaacacagaaacaatgagtttcttctaccacacatttggtgttgtttaaaagtagggtttgtagaatttccatttgccatttttaaagggatctctctgttaattccctggggagattctggagcttgattgattatggagacagaatccaaaaacaaaccttggtggtttttgttggaataactaactcttacttgatataggttttgttctagaaatttttggtgttgttgttggtcgaaacatattactaacacttgcaactaacaagatggtataaccactaaactagtacaagtatcatttagttaattaaacatgttagtatgttacaaaatttacgaatcaataacgaaataagcaaaataaccaattccaagccaagtgggacaaactcgaccgaaaagaccaaaaatcaatcataatttggtatcaaaaccattataccgggaagtaccagaataactcggttgggcctagcctctaataaaaatcggtcgggaaagaaactcacaactctctctcacacagcaacgttctattgaaatttggcctgaatccccagagtgcgacgaaaatgcagcagcaagtaagaaaatcatctcgaataggagtaatttattttgttagcatcttcttcaattgatgctaatggatggttgatg

SEQ ID NO: 21221 - DNA, 3000 bp, Unknown; identical to SEQ ID NO: 4765
  misc_feature (1)..( 3000): 2750-1469P.txt file - cDNA_ID_1842369; gDNA_ID_2926148; Annot_ID_197870

SEQ ID NO: 21222 - DNA, 3000 bp, Unknown; identical to SEQ ID NO: 4765
  misc_feature (1)..( 3000): 2750-1469P.txt file - cDNA_ID_1842369; gDNA_ID_2926148; Annot_ID_139184

SEQ ID NO: 21223 - DNA, 3000 bp, Unknown; identical to SEQ ID NO: 4765
  misc_feature (1)..( 3000): 2750-1469P.txt file - cDNA_ID_1842369; gDNA_ID_1620729; Annot_ID_49363

SEQ ID NO: 21224 - DNA, 3000 bp, Unknown; identical to SEQ ID NO: 4765
  misc_feature (1)..( 3000): 2750-1469P.txt file - cDNA_ID_1842369; gDNA_ID_1620729; Annot_ID_166046

SEQ ID NO: 21225 - DNA, 3003 bp, Unknown
  misc_feature (1)..( 3003): 2750-1469P.txt file - cDNA_ID_1842475; gDNA_ID_1620667; Annot_ID_48075
cacttcatgaatggatacatggttttgctttaagcataagtatatttgtattaaattttcactcaatttaattgcacgaatcattacaaaaataatatctcgctactcatataaataccctataaataaataagtgaattttttttatctctcatggaaatttgatttatgtatttatatgttttaagattcgaagaaatttttaaataatgaaaatttacaaatatataattcttaattcagaatttcagatattgaattacttattggatttttaaaacaaaaagaaaattacatgactttttttttcttttttttttttaaatatctgttagttcaagttaaaagaccatacattttctaaaggcgggacctatatcaggttaaattcatctccttttagaaaaaaaatatatttgggaaaggctttgatagcaagcaattaaagtatccgaaactaacaaaacctatctggtcttggactcttagtctttatataaacaacatcagatagatcgagagaccatacgcaacaatttactaatttctcttctccttcgttgcttttgaaaccctagttattatcgagagatcaaacacgtacgtacacaaaagaccgatcaaacagagaaggatgcagaagcgtgagttcatggagttgttcgaggcagcacttagagcggctaagtctgtgaaaggtgatgagaattctccagaggtatcgaggtttgtcgatgccatgaatcgtttgaaggaagcacccaagtcacttgtttgtgacgtggtctgcaaaacctccatggggcagggtttggaattcttcatcgatcacaaaaaccctaaaattcgatcggaaggaaggattcttcgggatctttggatgaagtttttttacgcttcaggtagagaaaagagccgtgataatagagaagctgcggtgaagatcccgacgcacgcaacgatgaagaagactggagattcaaagcgagacaaagtgcgtgagattctacaaacatctttggctaaagtcgcttctgaggttgttgacacggagatgaagacacgagtgactgcttgtgatccttgggttgtggctgtatctgtggaaactgcaatgtttgagaacttaggttgtttcatgggacctcaaaaagcaaagtaccggtctattctgttcaacatgggagatagtaacaatccagatttgaggaggaaagtgttacttggtgagattagtggggagagattagtgaagatggagaaggaagagatggggagtgagaagattcagaaggaggttcaaaggattaaagagagagcaagatttaaggaagagagtcgcgtgaagatgctttcatcagcagatatgatcatcatttagttagctgcagagatttagtcatgagtttcattattgtatagaatcagtattcgtgtcaattttctatcacaaactcgagatattagtagattgtaatttcaatacgatgatcgttttcaagttgcttcattgaatggtgtttctaaatctgcgtttaaagaatctagtcaaagtgtttcgtttcataagagggagctctgcagtttatgcagtttaaggggtctttggttttttcttttgaatgtttgtcttctattcgcattaggactcattgttcttatgcagccattaattcccggagaaaatgctgtacaatggttccttgcaaattacattctttggctacaaaatcctcattgtatgaagttgttgtacataggttcttggtacaccaattcgagaagaaatccgttgtatgaatccacgcattacacagatttcaggtttccgcagataaaggcacatctgtggcacaaggttcgtgtcttttctctttttacatacattcttgagagaaccaaacgctcatttacttaatggaaggcctttcccacctctcttcaacttcaaacaagaagtagctggagcatcacctgaactagtcaacaagttgatccagaccatatcaaaacacaattaggtctaagtttcttgattcaatctggaacataaagaatctgcacaaagacaataactctttaaatgtaatgtaccattacacgagccacaaggtcatagttgaaggaaaaagtggaggacacacttcgaagtttttcctcctcgaacaagtttgatggtcaaagccagctgcaagcaaaccaacttccccaaatctgcaaaaacaaaaactctcaagttgtatctgcttatttctcttctcttttcaagtttggtgaaaacaatctcatcttttcttgtttcttttacgcatatgtaaatgagtttagtcagaagttttatatagtatttgagcagaaggtgaagaatctagtcaaagtgatcaccaaagtgtttcataagagtttgtgcagttaagggtctttggtttttctttttttcatacagtacttttgaatttttgtcttctattattaccaaattttatgaaatggtttgtttatgactcattttcttacaaaggcaaaatcttaaatacttttttcctgtatttctgcgtaaagattctctcattattcattcattgtccttggtccttaccatattcatcaaaggtagctgagagaagtcagagaatgatgattcttaacatgttgttttaattaaatgtaatagcatgagagggcaacaatccgttgtagtctagctggtcaggatactcggctctcacccaagagacccgggttcgagtcccggcaacggagttttttttataattgttaaccgtaagtcaggggtactttcgtcattaccttatttgaagaaaccctagtgtctttcatataattatcacacactacgcagccgacgcaattcgtgtgccactctatttgctcatctccttcgatttcgaacccctaatcttgagatggtaaagtttcatccttttgatctatggttatcttcgttcctcgttttggggatttaacttactatttacgatg

SEQ ID NO: 21226 - DNA, 3003 bp, Unknown; identical to SEQ ID NO: 21225
  misc_feature (1)..( 3003): 2750-1469P.txt file - cDNA_ID_1842475; gDNA_ID_2926171; Annot_ID_140120

SEQ ID NO: 21227 - DNA, 3000 bp, Unknown; identical to SEQ ID NO: 5785
  misc_feature (1)..( 3000): 2750-1469P.txt file - cDNA_ID_1842487; gDNA_ID_1620818; Annot_ID_50653

SEQ ID NO: 21228 - DNA, 3000 bp, Unknown; identical to SEQ ID NO: 7592
  misc_feature (1)..( 3000): 2750-1469P.txt file - cDNA_ID_1842586; gDNA_ID_1621153; Annot_ID_56921

SEQ ID NO: 21229 - DNA, 3003 bp, Unknown
  misc_feature (1)..( 3003): 2750-1469P.txt file - cDNA_ID_1842620; gDNA_ID_1621150; Annot_ID_56859
aaccagctctctcagccgccacaacagccattacagacgcgtgtggccggatcacaacacgcttaaccactgccgggaaatcagagatgcgcgaaccagaatcttcaactacctcgccaataccaagtcccggatcgggagttgcgccgccgttttgctgaagctcatcggcattttcaacgtcatccatttcttcgttgttgttgttgttattctcttcgtcttcttcctccatatcttcctcctcttgtttcggtttcctcgccgccgataacccccctctcttcttccttttccatttccctcttctatctgcgacagaattgtaaaaagtgtaattcaattcacacgaattctcgaaatacccatcactacgatctatgtgggtaagtcaaatcccaatttaaatttggattttgagagagataaagatgtgaaacagcaatttaccttcagaagctggcatttttgtggatgaagatagagaaatagaggttttgggttctgtggaatcgaagcaagacccttagtaaaaagaattgctttctttgtcttctctcctccgagtcgttctgatttccagctctcgagctaaacaccaaacctttttctcgcaatttctttcaccatttccttcattaatctctatatattaattcattctccacgacgacctaaccttctcgacaaacaagagggttctgatttcgaaattcaagcttcgttgaccaatccaaattttggtttaacttcggttaaagtcaactttacttcggttttatttttcaattttgaatgagaaaaaccgaatcaattatttagttcggttcttaaagttcaaattggttaaaccggtttaaattgatacattagtcgaccgtcgcgcattaatactggtgtggtggttccgttaacgagcaacggcgatgaagagacctcgacctacatctcagccgtcgatctcttccaccgtcaaaccaccactgtctccgccggtcacaccgattctcaaacagaagctacacagaacaggaacacctaaatggttcccgttaaaactaacccacacggagctgacgttgccgttaacttttccgacgggtcaaacattccggtggaagaaaactggagcgattcagtatagcggaacgattgggcctcacttagtctctcttagacaacgtccaggagacgacgcagtttcctactgcgtccattgtagcacaagccctaaatccgcggagcttgcgttgctcgattttctcaatgctgagatctcgttagctgagctatggtctgatttctcgaaaaaagatcctcgtttcggagagctagcgagacatctccgtggcgctcgtgtgttgaggcaggatccgctcgagtgcttgatacagtttttgtgctcatcgaacaataacattgcgaggattacgaagatggtggattttgtttcgtctttagggttacatttgggtgacattgatggatttgagtttcatcagttcccatcattggatcgattatctagggtttctgaggaagagtttagaaaggctggttttggttacaggtgatttcatcactctctaatggttgcattatgttgaattagacatttaggctaaaactttgcttgaagcttatacttttatttactctgtggctatacattcatagaattgaagctaatgtttggtctaagctagataatcattgtgtggccgtttctctgattggttctgatctcatttgaaaactctcattctggtttatcttgtggtgagcagagccaaatacataacaggtacagtgaatgctttgcaagcaaagccaggtggtggtaatgaatggcttctttctctgcgcaaagtcgaactccaagaggcagttgctgcgctgtgtacattacctggtgttggtccgaaggtagcagcttgcatagctctgttttctcttgatcagcatagtgctattccggttgacacacatgtctggcaggtaacaaagtccatcggtttctatgtattgtacttacttaattgagatccaattacataatggtgatgatgacttcgggcaactttttttttgttctgttttggataatggatcagatcgcaacaaattatctactgccagaccttgctggtgcaaaactgacacctaaactccatggccgagttgcagaagcctttgtgagtaaatatggtgaatatgctggttgggctcaaacattgcttttcattgccgagttacctgcacaaaaaactctcttgcaatcgttttcccagcccattaacaaactggatgagtctgcagaagttaatgaaactagctgtgatacgttgaagccatgactatgtgtctacctaagctacgaggaatcgttttcacaacccattcttgatgcgtcaagtccagaaacttgaccttggaagagctaagaaaattctgaagctgatgcagtatttggctccctggcaaatgagcgtagttatttgttatgatcattgtttactaaggaaccaatcttgatatgtacttgtaactttacattcaaacttccaaattaaattctaattgtttgttccctttgcaattctcttgatttgaaatgagaattttttccttttatctatttcttttgtcaaaaaacaaaactaaatttcgtcgaaattaaatttctataagaagcccaataaagcgaggcctaaattaggcccaaaatactattggaggcgaaaaagaaagtccggctggattttcctccaagccaccgtcgactttacttagtactccctctctctcccctcctccttcccagatttcgtctccgttctgaaaaaaactccaaattctactctgaaaccctaagtttccgatgtcggtaagtttgataattcccagttaattttaatttcggagacctcagctctattagtcttacgcatcaatggtttaatagtgactgaacgataaaattgattgatatttgtggcgatg

SEQ ID NO: 21230 - DNA, 3003 bp, Unknown; identical to SEQ ID NO: 21229
  misc_feature (1)..( 3003): 2750-1469P.txt file - cDNA_ID_1842620; gDNA_ID_1621150; Annot_ID_173210

SEQ ID NO: 21231 - DNA, 3000 bp, Unknown; identical to SEQ ID NO: 7287
  misc_feature (1)..( 3000): 2750-1469P.txt file - cDNA_ID_1842703; gDNA_ID_1621137; Annot_ID_56572

SEQ ID NO: 21232 - DNA, 3003 bp, Unknown
  misc_feature (1)..( 3003): 2750-1469P.txt file - cDNA_ID_1842707; gDNA_ID_1621152; Annot_ID_56901
ttcttcaatgactaaacattgtagaatgtgtctgattttcttgtaggcggtaccgcttttcttatcagagattgctcccgcgaggcttcgtggaggtctcaacattgttttccaacttatggttacaattggaatcctaattgctaacatagtcaactacttcacctcctcaattcatccttacggatggagaattgccctcggtggcgcgggaattccggctctcatcctcctctttggatcgcttctcatctgcgaaacacccactagtctcatcgaacggaacaaaaccaaggaaggaaaagaaacactcaagaagatcagaggcgttgaagatgttgatgaggagtatgaatcaatagtccatgcttgcgatatcgcaaggcaggtcaaggacccttacacgaaactgatgaaacccgcgagcaggccgcctttcgtgattggaatgttgctacagtttttccaacagttcactggaatcaacgcgattatgttctacgctccggttttgttccagactgtagggtttggaaatgacgcagctctgctttccgcggttgtcacgggaacgatcaacgttctcagcacgtttgtcgggattttccttgtcgacaaaactggccgaagatttctattgctccaatcttccgttcacatgctcatatgccaggtaacattagttaagttaacttttcttgtgtcacaagcgatcctcctaaactaacaattttctcaaacagttggtcattggaatcatcctagccaaggacctagacgtgacgggtacgctagcacggccacaagccctagtagtggtgatcttcgtgtgtgtttacgtgatgggtttcgcttggtcatggggccctctaggatggctaatccctagtgagaccttccccttggagactcgaacggaagggttcgcattggccgtgtcttgcaacatgttcttcacgttcgtgatcgctcaggccttcctatcgatgctttgcgcgatgaagtcagggatattcttcttcttcagtggttggatcgttgtgatgggacttttcgctttgttcttcgtgccggaaacgaaaggagtctccattgatgacatgagagatagtgtgtggaagctacattggtactggaagaggtttatgctcgaggaagatgagcatgacgttgagaagagaactgattgagcttgttgatcgatcacattctttctctaactttccttagttttttttttgtcatatggggaacaacatacagtaataagagaccaacttgttattcttgtattataatatgctttcttcaggtttggtatcttacataaaaaaagaaaactccagggtcatacaatttttatgtgttttaagtcacttgatacaagataaatattgttcataataaaataaagttgttgttttacagtgggtaaaagtgtcacattattatcaacgattgatccatgtacaatactttctatgttccttaatatttgatttaaaaaaaaaaaacacatgttaagaaaacatattaaaaaatgattctaaatattttgttttttgtgatttatatttgttataattttaaaccaataatatttaactatttattttgaaatttgatattcatcaataataactaattaatattgcttaggaaacctaaaaaatcaatctgttaaaaacatttttttttctttcaaaaaaatcaaataataagaaacagaaggagtaattaacaaattatcacccgaaaatattcggtgctccatttgtttctgattttagttgtggatttcgaattgaaaattttattttattttattatacaacatttgccattttatttccacagaaaaatctgaatactgagagtgagaggtacatggtcatgaactcatgatcacatggttttggtagcacatggaactgcatttcagttctacatgtagttgtaaacatcagaataactacatgtatggctatatgcatgtaaaaccgcagttgtccgtattcacaaacgtaccaatttttaaccgctaaaatagtcgttcaaaatgctttaaaaccgcaatcgcaggcatccataaattctcgcagtcgtgatcgcacgtcagctccgtttaaacatgtcaagccttgagtcgatcattacaataatatctcgtgtaccacgttatgcttaaaaaaattaatcatatcttaaacacttgccttgccacccactacttctagatctcccacaaatccacagaaataatatatatggtacttagaaaaatcataaaaatatcaaataccaaattgaagtctctggcatgagtcggtcactacaataataactaaactgaaatacattttatggctaattgatgcagaacctgaaattaaaaaaaattaaagatacaacaaaccatacctttttgtctttttttttttttaattattttaaagataactcatttattttgaatgtatgtacgcagttttcggttccgtattgtgtattcatagtctaccataaaatttaacatctacctttcccaatggacccaaacgcttcgaattgaacatgggcgttgctttctcttgtgagttgtatctaatataaaatttggataattatgatttcgtcggtgattttgatatactatatctctcgtgtacaacgttttgcttaaaaatttgttcatatcttgaacacttgtgacttgccacccactacttcgagatctcctacaaatccgtagaaatatcgtttcacaatagacttgcatgttacttggaaaaaggattaaaatattaataaccaaatcgaaatctgatactttacacattcgaagtcaaacaaaataataaaaatgaatgtgtaacaaatatatttttttccccacgaagaatccacttttagtattaactaaactcgatcagtaagtaatccgtctatataaatgtggaggcttcccaaaacaaaacaaaacaaaaaagatctcaaaatatg

SEQ ID NO: 21233 - DNA, 3003 bp, Unknown; identical to SEQ ID NO: 21232
  misc_feature (1)..( 3003): 2750-1469P.txt file - cDNA_ID_1842707; gDNA_ID_1621152; Annot_ID_173295

SEQ ID NO: 21234 - DNA, 3003 bp, Unknown; identical to SEQ ID NO: 21232
  misc_feature (1)..( 3003): 2750-1469P.txt file - cDNA_ID_1842707; gDNA_ID_1620787; Annot_ID_168177

SEQ ID NO: 21235 - DNA, 3000 bp, Unknown; identical to SEQ ID NO: 5434
  misc_feature (1)..( 3000): 2750-1469P.txt file - cDNA_ID_1842723; gDNA_ID_1620790; Annot_ID_50453

SEQ ID NO: 21236 - DNA, 3000 bp, Unknown; identical to SEQ ID NO: 5434
  misc_feature (1)..( 3000): 2750-1469P.txt file - cDNA_ID_1842723; gDNA_ID_1620790; Annot_ID_168240

SEQ ID NO: 21237 - DNA, 3000 bp, Unknown
  misc_feature (1)..( 3000): 2750-1469P.txt file - cDNA_ID_1842741; gDNA_ID_1620784; Annot_ID_50395
taaggcttatgcgttagtagtagggatcggatgcatgatttggacccgtgatttgatcgatatggaacattttgaacgcggtggaaactctatcaacatccggctagcgggttctaaactaggtttggaaaaatgtttaagctatcatataacattgtgaaagatttaaacatgactaatctgtttcttttgttgtgtatacaggtggtgggaaggaaaattcaacactttggataattgttttcagtgttataggagcattcttactaggattatgcatttggatcttatggaagtttaagaaaagccttaaaggtaaagtctctattcgtacatagtcttgtttcacaagaattaaactactgagactgtcaattactccatgatctgcagctttcttgtggaagaagaaagatatcacagtttctgatatcatagagaacagagattactcaagctcgccgatcaaagttctagtaggggatcaagttgacacacccgatttaccaatattcagttttgacagcgtagcctcagctactggagatttcgctgaagagaacaagcttggacagggcggattcggtactgtatataaggtagaaaatgattttttttttctgacaataatactggataataaaactttgctttgtatgcaaaaacttatgtgttatgtttggacagggaaacttttcagaaggaagagagattgcagtgaagagactatcagggaaatctaaacaaggactagaggagttcaagaacgagatcttactaatcgcgaaactccagcatcggaatcttgttagattactaggatgttgcattgaagacaatgagaagatgcttctctatgaatatatgccaaacaagagtttggaccgctttctttttggtatgtttttttctaaacaatttcaattaaaatgttttgaaaatgttcggattgagtatataatgactctgcgcagatgagagtaaacaaggaagtttggactggagaaaacgatgggaggtcattggaggaatcgcgaggggattactttacttacatagagactcaagactaaagatcattcaccgtgacctaaaagctagcaatatcttgctagacacggaaatgaatccaaagatctcggatttcggtatggctaggatattcaactaccgacaagaccatgccaacacaatccgagtcgtcggcacatagtaacttaacaaacctctttatctcctctaaattaaacaatatcgaactctatcaatttttaatgattttgatgttcaacaagtgtagtggttatatggctccggagtatgcaatggaagggatattctcagagaaatcagatgtgtatagctttggagtgttgatattggagattgtgagtggaagaaaaaacgttagctttcgagggactgatcatggaagtctcattggttatgtacgtctcttttctttaaccataaattttcaggtctaactaaaatattcgaatatttgttactaatgaatgttctaaacggaaaaaaaaaaataaggcgtggcatttatggagccaaggaaagacaaaagagatgatagatccaattgtgaaggacactagagacgtgacggaagcgatgagatgcatccacgtgggtatgttgtgtacacaagactcggtcattcacagaccaaacatgggttcggttttgttgatgttggagagtcaaaccagtcaacttccacccccgagacagccgaccttccactcgttcttgaactctggtgacattgaactcaactttgacggtcacgatgttgcctccgttaacgatgttactttcacaacaattgttggtagatgactcactgaccagaagttatttttccccaaaacgctctttgactatccatttggtctcgaactcttttctccatagttttcaactttttatacataattaaattcttcgttgaaaatattataatacatgtacattgacgatgaaaaactaatcggatttgtacacaacatacttttagcaacaaaagagaagaagctcaacaacatacttaattgtgaagaaaaaagcgttgttgttcgaacatgaattggagaagttggaatatggacaaaggtagtggcatcgaaggaggaatttccagtgatttgagatttaatgagttttaagatgattttgttgaattttagggaattagaaaatttgttattaaatttataaaaatcttcccttaaatcatatgatttggacatttgtattcttaatttttttttttttgacatctcacatatttcttttttaaaaaactgtaaaaccataaaaaaaaaaaaattatttacggtttctatatgattatagcttttataaaactaaaaaccgtaaaaccaaaaaaccgaagtgaaaccaaaccgaaaaacggtatgcccatccctagggctagtaatgaaatcaacactcttgaagtggagttatctacatttttatgtttgattataaattatatttttccacccatttgtaaaaatcctatttaaaagagaaaattttcatttataactaagttctcatttgtgaacaatgttggttgatttgattctacattttaaaattaataatccaataacacttgagttttacaaactttttaaattcatgtttgaataacacaagattttaatacaaatcacaccaaaacctttattcaagattttattttacctatctctcctagtaaacataaccaaaaaagtggtaataactcttgctgaaaaaaacaaatggtaataattaggaaccgttagattagattcatatcggacggtaaaggctgtgataccatcaccgacttacatgagaacgaaacactggaaaactcaattccccaatttctccaatctgagaaaatagggtttccgatttggatccttaattcagacacctgactcgtcttctcatcctacccccaattcaatattcgtcgccaatatg

SEQ ID NO: 21238 - DNA, 3000 bp, Unknown; identical to SEQ ID NO: 21237
  misc_feature (1)..( 3000): 2750-1469P.txt file - cDNA_ID_1842741; gDNA_ID_1620784; Annot_ID_168066

SEQ ID NO: 21239 - DNA, 3000 bp, Unknown
  misc_feature (1)..( 3000): 2750-1469P.txt file - cDNA_ID_1842794; gDNA_ID_1620674; Annot_ID_48211
tattaaatatagttatgggagaacccttttgctaatcttcgcatatattcaatttttcatctatgcaactatagtttattcaaaagttttagttaccatcccgtcgcaagcagagctggggcataactatctcggaagaagattctacctaacactaaactacattggttgtttgagatcaatttgattgaaatgatttcgttattgtaataacaaataaaaacaagataacttttagacatttttagttttgaacaagatatgacaaacattctaatccataaagacaagcgttttggttcctacttcgtatcaagagggctacttactaagttactatttgaccttgagagacgatcgttgtgaaggtgttacactaaaatattaattatccactaatgacgaacagtgtccttaattttttgttggtttggggttttggttgggtctctattggcccattgggcttattatgaatgcttctagtttttgttgttgtgtaattttcatctcggtgtcaacctgtcaagtcaattgtcacctcatgcacaaacggtaacttatttgagacgcaaaatttacaacggtaagaaaatatagacgttagaaaagtagccgttgaaagaagaaatccgaagctgcctatataagtggctcgtgctcactcacttacttcccacaatcatttcttcttctgtataatcgcttactattctcgtagtttcagaaagcaaaagtcttttttctagttgaaaaaccaaagagagagagagtcagagagctcaaagttcatccaaagttaatcgagagcaagtttcattcctctcaacaaagttcgtccaaggtttctcgtagtcactagccgaactctgcttttaagattggtaagaattcttagatgtttccttacttttctacgacttatgttgttgatcgaaacactttcatggtctattcttctcactaaagtttcgtcagtttcagttttacgcatcatactattttcactttgtctaaactcacatcttcctctgttttctttttcgagtgttcttgcaggtttctctccaagcaaatagctagaaatggaaggctcatcaagcttcactacaaccaacgcaaagaaagaaaaacagagagcgttcacccaatttccccgtgatttcattatatactatcatcgtaatcaagaactctgctttgagactctgctttagggtttggtaagaatctgatgtttctcctttttgtttgacgaattgagccgtgtattttctgaaacatcttgattttgggaattgtagtcataatgttaaagagagttattatagtgtaatttatctttgagaaatttctgccatctaaactgtttctgacaattacaggtgagagagagaagagataaatgatccgtcacagtcacgacaaacgatccacggcaacctttggcggtgatagcgggcttgttgcgccggggtatcatcttggacttccagttgactactcgccgtgatgttcagggttagtttcatcaatgctcttcttatatgtctctctcagtcgttactctgttaaaagccatataataaatcgtagacttggtgagttatttggtcggattttatagattaactctctcattcatccatatgtagctcgtgtatttatgatttttatgattttttgtcattgcatattttcaaacttgttagtaattttggaatgttgatttgataaaactgattccaactccacgaatcctggtttatcaaaactgtgattgtatcatcgtacacacatcaaataaaaacttttactttgaacattttcaaatgctaactttttccgacaaattaattacatggtttgtgaaagattcccaactcttaacgtttttgttctcgctgtcgcaggttttcttatcaaggaaggttacgttgacccgaataagttcattagcatagacatctttcctcacgaaaggcaaatatgaccaatgttgacattttacatactcggtaaaatatttgttagttgagattattgcaatttttggcagaaaatattaccacactttgttgacatacaaataagttcaggtttggtccatacaccacattctcactagccaacatgcaaattcaactaaccacattcaatatcatcaaacatccttgaaattttaacataaatttggcgagtatgcggaagaactagtgcattacaactttattgtaccgcaattggctgattggtttcataaatattgaatcataacttagagattttttcacatttggtgagcatccggaaaaactagtaaaaaaatgaattagaatagtaaaacaaatcgtactagaaattttacagacagttaaaaacacgtataattttagccagtgttaatttttcttatttgcattttaaacaacaaagacaaaatacattatgtgcaactcctttattttacttttttgtatacaagataaataaattaatttgaatatacactaaaaaatcaaacagaaaaaagaagaagaagtaaaatagtaattatttaaaagacaacagaagaagtaaaaaaagtaaaaagattgcaaaacagtcggaaggttgaatggctgagattaatcgaacgcttcaatggcaattatttccggccatcactttcttctctacttctttctttctctctctagttgttgttctctctctctctcgcatcctccaattcatcgtcctcacgttcccttttgtttattcatcttccttccttcttcacatttctgattttctctatttggggggtttgtttccacattatacatatctagggttttgagatggttaattgaaagataatggtcgaagtttcggaggaattggcttcacattgtgggtgtttctggcttcctcaggtttaaatctgaggttgatctcttttgttttttggtaaattgtgacatattttggctcgaagaagaagaagaagaggcaatg

SEQ ID NO: 21240 - DNA, 3000 bp, Unknown; identical to SEQ ID NO: 21239
  misc_feature (1)..( 3000): 2750-1469P.txt file - cDNA_ID_1842794; gDNA_ID_1620708; Annot_ID_48932

SEQ ID NO: 21241 - DNA, 3000 bp, Unknown; identical to SEQ ID NO: 21239
  misc_feature (1)..( 3000): 2750-1469P.txt file - cDNA_ID_1842794; gDNA_ID_1620708; Annot_ID_165368

SEQ ID NO: 21242 - DNA, 3000 bp, Unknown; identical to SEQ ID NO: 21239
  misc_feature (1)..( 3000): 2750-1469P.txt file - cDNA_ID_1842794; gDNA_ID_1620674; Annot_ID_164209

SEQ ID NO: 21243 - DNA, 3000 bp, Unknown; identical to SEQ ID NO: 21239
  misc_feature (1)..( 3000): 2750-1469P.txt file - cDNA_ID_1842794; gDNA_ID_2926210; Annot_ID_141942

SEQ ID NO: 21244 - DNA, 3000 bp, Unknown; identical to SEQ ID NO: 21239
  misc_feature (1)..( 3000): 2750-1469P.txt file - cDNA_ID_1842794; gDNA_ID_2926210; Annot_ID_202556

SEQ ID NO: 21245 - DNA, 3003 bp, Unknown
  misc_feature (1)..( 3003): 2750-1469P.txt file - cDNA_ID_1842843; gDNA_ID_1620636; Annot_ID_47386
aattctgcaatactgtgccatccctaatgaccatgaatcccgaatctccaatattggctatgtggagttcctacaaagtaattttacatgatcacagactgactctatctcaaaaggatttccaatgcaatatatatgttagggaccaagtctcacattattgtcaagatgagcaattaaggctgttgatgatccagaggacttagtctcattgacacttctatggagaacttgaactgggtcacttatcttagcagtttcattggaaataatcttttcacagttgctcatgagttcttgagcatacattcccttattgattcctgaaagatgaatcaaacatatattcggcaaggccaaatacaagtgactgagtttctgcaagaatttggaaaactatgtgaaaatacttatatacagtatttaccttcaaatgaccactgagagactccatcagcaatacctatccaattgtggtgagagataaaataagcatcttcccgacctgccaatgcctggacatcattatttctaaattactaaccacataacataagtatagggatttaaaattcaaaaattgtcagaatgttaaaaatgatgtttttgaggtggttggaaatgagaacaagatatgaaagatcttgagatatagagtgttaataattaatatttcaacaactgtctcttatttttgtgtatactaaacagaaagaattacaggtaccttaaaggggctttggagtgaagcaaaaccagagtccaagtaaaatgctttggacacaagttcttccctgtttagatgtcaaacatccaaccatagcaaaacaatcatgcttttataaaagctgcaatatgattcctagccctgtatgaaaatatgaatagatacatacatatatgcatgtagctgtatctgtgcaagacaatagtacagtttgtctaagaagagttaaatatatcacttactaacctgccagaagccgctttaatgggttcaagactggccgtttcaggtacaggaagttggagatcttccacttttgtgtcatcattattggatatgctaccactatcagttattgtgtccctcacagttatttcatcttctgtggttgaagctacattttctccatcattttccttcatgaatgataagtaattagagtggtggcactaattctgttcaacaacactctctgatgtctctttccttctacacctgttaaaactacttaatggtttagagttagtactcaccacatcagacgtaacaactacaagcttttcagtgctctcgtcaacgctactatgcactgcttctggttcaacaaaagtttccatagggtttttctcagacgtatcaataataggcttttgagcgatctcatcaacgctgtgacgtgttgcttctgaagttgaaatgagttcatcagaagagacagcagctgtagctgttggttcaactacaggattctcctcagcttcaaaagtgttcagaaggttttcctcagacgtatcaattacaggtttttgagcaatctcatcaacgctgcgatgtgttgcttctgaagttgaaaggagttcatcaggagacaaatcatctgtagctgttggttccgcgacaagattctcctcagcttcaataggcttttccgtcacatccaaattgtcatcaatttcaatggtggatacaggcgtaatttcctgttgtgtagacaatgacggtcttgcctgaacctccatacgattctcttgataaccatttgtctcacagtctcctattttattgacagaaactttcttcatggcttcagaagaaagaggctctacattatatgacttagccgtgatttccttctcaacaacagcttcttcttcagtagagctaattggaatagcttctgctacactaactatggagctcagattggaaacactagcactcttggcatcaattttatcttcgctccgtgatacattcacagtttctttcttcttcttagtaggagaacgaacccttttacgatcctttattttaatgacattgctaagatcggaaggagcagctgtttcctctttctcagtacttgtttcaataatagaactgaccaatttcttttgtttccttgaaacttcactggcttcttcagcaatcttagcattttgcgtttctacctcaacacatctcgctttttcttcagcctcgagatatttctcaatctcacttgcatccccgaaccgaaagacatgacttccatctttaagctctgcaagatccaaacaactatcaatataagagtatagctcagatttcaaagtaaataacttttctattcttaaacttgaaactaaaaaatattttaggttttgatacttgaatccgaagtaaaattggttacaacctagtaattgagtgttcagacacttcaaaaattagggaaaaaactaaaattcaaaacttctccggtgaaggaagataaaacaaaagaagaagaggaaacacgaagacttacgagtgctggacacgagatcgaacttctctggagcagaattctccggtggagaagaagaggaagctgaagactttgaaggtgaaatggaattagccaactgtagctgagaggacaatcggaactcaggaacggaatatctgattccaccgggaaatctccatgaacggtgaagagaacaagggaagatgagaaaaggaggagcttgaagagaaagaatcaaatgatcggccataacttaaacattgaagtctgtaacaaagagtgtcacagaaatggtttagagtagacgaagaagatgataattgggtgacgttacaaccggtggtaaccctctgtttctatcagatgtgttcgcttcacagatattttgtggctaccgtttttttttcataattgggctataaaaatcatatctttttgactcttctcttctctatccattctctgccgaactagtcgtcaatcgaaatcccaaagatcagcgatg

SEQ ID NO: 21246 - DNA, 3003 bp, Unknown; identical to SEQ ID NO: 21245
  misc_feature (1)..( 3003): 2750-1469P.txt file - cDNA_ID_1842843; gDNA_ID_1620636; Annot_ID_162920

SEQ ID NO: 21247 - DNA, 3003 bp, Unknown; identical to SEQ ID NO: 21245
  misc_feature (1)..( 3003): 2750-1469P.txt file - cDNA_ID_1842843; gDNA_ID_2926204; Annot_ID_141659

SEQ ID NO: 21248 - DNA, 3003 bp, Unknown; identical to SEQ ID NO: 21245
  misc_feature (1)..( 3003): 2750-1469P.txt file - cDNA_ID_1842843; gDNA_ID_2926204; Annot_ID_202070

SEQ ID NO: 21249 - DNA, 3003 bp, Unknown
  misc_feature (1)..( 3003): 2750-1469P.txt file - cDNA_ID_1843013; gDNA_ID_1621098; Annot_ID_55773
ctgaataacgaactaaacatgttatggattaggccctaatagctagtccagttaggattttaagattttccgatgtatattaagtgtcaatgtgtcatacatgagcctctaataaacacacgcccaaaatcaatagaactaactaaccctatacaccgaagtaatatagaaccagcacgaactctagatctggaaaatataaatacaaaatatcttttaaaatgttttctaaatattattgtaattatcatatgaaaaaaaaactattcataaaaagtaattatcaacatatgtaatctttcaaagatgcacttgatgtgtgtatcttgttggttagaattttaatttattaatcgataacttggaaggcaaataacagtaaaaataataatctaactgtagtaaatatctccccacacgtcattttttttatttttttttattttttattttggcaactcacatggtttgattcattgataagtcagtttcaattttatttttctcaaatttaaataattctccatttctaaaaataaaggggcaaggtattggtacgcacatgagactaacattcatacctttttatgaaataaataaaacaaaaagggacacaagaaggaacgcaagaattttaaactgaaatgattgtatctctaaattgagaaaaatcccaaaaagaattagtaacaaattaaataactaagcggtgttgttttattcggaggtaaaatatatatatggagggtatagcgtcaactcgcttttttactacattttgatttctctcccaaagttctttaatttttgtttgggtatcacatttgtagtcagaaacaaaattgttgaatgaattatcgacgactattttcactcgttggaatagtcgggattcaatttattaaaccgtcgtaaggaagctaaagatgtaaaaatgatgatatacagacaatttggctagctcattcactttttaaatgggcaaaccaatcatgaatgctagtttaatttatcgtgtgattgattttttttttatataaaaaaatagaagtaaaattgtaactttttatgaaaaccgtcgtaatcgtacgtcactaagctacaaaaatacaacaaacagtgactaataagaaaatgtagagtgatattagatgaatttaacacgtggaaaaatcatgaggaggagatgattttttctgttgcattcccttctgtggttaccagctacgataacgttcacgccctcctccacttaaattagaatgtgagaaaataaaatagcaagaaattggagatcacaacagtattgagtgtaggacatattacaaaggagacaaaatcagtcaatagtaaaaaggtatcacaataaaaaaaaatgtcaataaaaaggggccattgtatgacatgaaagaacaaaattaagtgatcatcacttctcctcctttatcgagagcttcagttttagagcaacaatgtctctatttctgaagcccttcctcttcctatacgacaccactcttagtcttctcttacttctggtactttatagctcgatctctctatatataaatacttaaataattactgtgacattaagttaattgttatttctcatgcatgaattagttcaatggatggagtcttgaggatacagcagcagcccaaaagaggcgtgaagcagacaaaaatgctgcagaaactgaatggatccaactccaatacttgtggaccaaaacaaggagtgttgtactacttcccgttttcaagggtttggtggttatgtgtttggttctatccattatagtgttcttcgagagtttttacatgaactttgtgatactcttcgtcaagttatttaaacgtaaaccccataaagtgtacaaatgggaggccatgcaagaagatgttgaggttggacccgataactacccaatggttcttatccaaataccaatgtacaatgaaaaagaggtatacgcatatatatactacctttattaattacactcttttattatatggttgatttagtagttcaagttgtagatgattttacggatccggccgtaagggtaagtagcttgttcgaattccttttttttcttatttattaattagatattacaaaaaaaaaactaaacaattcatacaacatgttaaaaacaatggacaaaccaatctaaagttcaaaacgcattggttaaatatttattcaaccgattttttgacctagaccgctctaattacttggttaagaacatcagactaatatatttttaaaatttaaatttatttaataaataaccacaaaagtggaaaaatattttgaagatacgaatatataaaaataacatcatgttttattttaatttgaaaatagaaaatatattgaaacatacataatttctgtaactatcatatatattttattaattaaacaaaaataaaataatatgaaaatgtttccgaaattttttgtttaattagttaggtgttagacttagacccccttcaagcgcttgattagtgcctaatttttttgcacaaactttattttgtgtttcttatcttttattggagaaacaaacaatataattgtttgcttaattttttcttttataatacttttaactattaaatttaaaatttgtttgaggtttaaatagttctccttatatatagaatttccgataataaatagtatagtgtgtaacacttttctcacaattttttcacctaagatgtttatctttttcctataattgaatcttcttttgatttacaaatcaaagatatatcacaaaattttgatatagacgggacttctatatcgatccatcacatattagaatgcaaacattgtaatttgtatatatagtatgatgaatgtgaaagtgtaagcaggaaggtgtggacgtagagattgcaaaatggcaaagccaaggcataaacataaggtgtgaaaggagagataacaggaacggctacaaagccggagctatg

SEQ ID NO: 21250 - DNA, 3003 bp, Unknown; identical to SEQ ID NO: 21249
  misc_feature (1)..( 3003): 2750-1469P.txt file - cDNA_ID_1843013; gDNA_ID_2926166; Annot_ID_139913

SEQ ID NO: 21251 - DNA, 3003 bp, Unknown
  misc_feature (1)..( 3003): 2750-1469P.txt file - cDNA_ID_1843072; gDNA_ID_1620769; Annot_ID_50170
ggaatgttgcatatgcttatggacacagagttagatgttacgcaacaggattatgttaggaccgcacaggcaagtggaaaagctttagtctcgctaataaatgaggttttggaccaagcaaagattgaatctggaaagcttgaacttgaggaggtgcggtttgatttgagaggaatattagatgatgtcctgtcactcttctctagcaagtcccaacaaaagggggtggaggtaacttactatatgatctgcaaagcaagggttgtaactgatagcaagtctttcttactgattttttgagtgttgctgatgaacgcagttggcagtatacatatctgatcgtgttccagatatgttaattggtgatcctgggaggtttcgacaaatactcacaaatcttatgggtaattccattaaggtaaacttttttattatgtttttttctgaccattccttgcatccgagttgatcaacggagctgatcatttatatatattctggcagttcactgagaaaggacacatctttgtaactgttcatttggtggatgagctatttgaatctatcgatggagagacagcatcatctccggaaagtacactgagtgggcttccagttgcagaccggcagaggagctgggaaaactttaaagctttcagctccaacgggcatcggagctttgaaccatctccccctgatataaacctaatcgtctcagttgaggatactggcgtagggatccctgtagaagcgcagtcccgtatttttacgcctttcatgcaagtcggaccatccatatccaggacgcatggaggcacaggaattggacttagcataagcaaatgtctagttggactgatgaagggagaaattggattctcgagtactcccaaggttgggtccacattcacatttactgctgtattttccaatgggatgcaaccagctgaaagaaagaatgacaacaaccagcccatattctcggaattccggggcatgaaagctgtggttgtggaccataggcctgcaagggcaaaagtctcgtggtaccattttcagcgtcttggaattcgagtcgaagtagttccacgtgttgaacaggctctacattatctgaagattggtactaccactgtgaatatgatactcatagagcaagaaatatggaatagggaagcagatgatttcattaaaaagctacagaaagaccctcttttcctttctcctaagttgattttgttagcaaactcagtagaatcgtcaatatcagaggctttatgcaccggtatagatcctccaatagtgatagtgaaaccattgagggcgagtatgctagcagcaactttgcagaggggattgggtattggaatcagagaaccacctcaacacaagggacctcctgctttgattctcaggaatcttctccttggtagaaaaattttaatcgtggatgataacaacgtaaacctcagagtggcagcgggagctctgaaaaagtacggagctgatgtggtctgcgctgagagtgggataaaggcaatctcattgcttaagccacctcacgagtttgatgcttgcttcatggacattcagatgccagaaatggatgggtatgcctgattggtatactagtttttttgaaaagttcgaaatatgtaataagaaaattgaaatgtttttctgccctgtctttctgcagatttgaagctacaaggagaatacgagatatggaagaggagatgaacaagagaataaagaatggggaggctttgatagtagagaacggtaacaaaacaagctggcatcttccggtattagcaatgacggcagatgtgatccaagcaacgcatgaggaatgtctgaagtgtggaatggatgggtatgtatcaaaaccatttgaagcagagcagctgtacagggaagtttctcgctttttcaattcgccttcagatacagaatcataagaggagatggggctggaagaagaacagcgaaggaaacacaaaaactcgtgtctcctatgcatcttgaagtagtagtaagccgcctatattcctcctctctatatatttactcacctaaaaacatgtcttctcaactgacagtaacgccttatgtgaacttgtttataggaaaaacagattgacgattgcaaaaagagtgtatatagaaaggccggtgtgaccaggccaagaacttaggaccagtactttctcctgtaaattttttttctacatttttctctggtctgattgagacaacaaaacttgtggtatgtagatgagagtagcagctggaatatattcagagttgctttggacagggaagagagcatcatagtatgtgtgtaaaagtgtgtgtgcatgatttaggatatttcttcttgtattagagaacagtgctgcagtttctttgttatcatcatggtccaagatagggaagtggacattactacttatacatacactggctttgtgatataaagttgaagatagcttttactttctcttccccttctttacgtacaatgcatattggaaccaaaaccaaatgatcggaccgaatcaagaaacagaaccgaatgtcttcaaatagttgtgttttgtgtccaactaaattcacgtagaagaactatagaaacgtggaccccaaaacgtgagtgtggttgtttgacttttaaacacgtccgtgagattttcagattgacctttaggtcacatttttgtccaccacatcaacatgagagggcttttctcaagcatttcaataatcggaatccaatcactgaccgccacgtggacatcatacgtctcaataaccaatcatagaatggttgtgacgacgttcacggtgagttgcagtacccgatcccttttaaggtccgtgacagaataattttgaaaccagcaagacaaatttagtcaaaccaaaaaaaaaaaaaaaacgaaagcgcaaagactaaggagaaaagaaattcttcgcttcttctccggtgtaatcatg

SEQ ID NO: 21252 - DNA, 3000 bp, Unknown; identical to SEQ ID NO: 5326
  misc_feature (1)..( 3000): 2750-1469P.txt file - cDNA_ID_1843230; gDNA_ID_1620780; Annot_ID_50334

SEQ ID NO: 21253 - DNA, 3000 bp, Unknown; identical to SEQ ID NO: 5326
  misc_feature (1)..( 3000): 2750-1469P.txt file - cDNA_ID_1843230; gDNA_ID_1620780; Annot_ID_167902

SEQ ID NO: 21254 - DNA, 3003 bp, Unknown
  misc_feature (1)..( 3003): 2750-1469P.txt file - cDNA_ID_1843238; gDNA_ID_1621173; Annot_ID_57269
gtaacatgcgacaatgcgacatgcggatttgattttggtagttagataacaatatcactagacttatttcttatctcacttttgaggtaggaccaaagacacattaatgttgacaatctcaaacaagaaagattcaagcttaattgacatagataattaagatggctcattgagctttattgaacaagaaatgtaaaagaggaaattgtatttagattgtcaccaagaacactaaaactttagatttgatttcaaaaaaatggaaagaggagagttgcaaggttgtcttacattgatgttcttaagacaaattaatatgtatctctacttggtaaaaccctagtaacatgggttaatggacttctcatcttgggcttcatttggatccaccaattattaacaaggagaagtgttataggaacatgagaaagcaagaaggaagctaagatcatcttttcatatgcccaaaattccctagttagtcttgtttagttcatattttcttgtacctaattgctttatttcatgtaagcaatatcgcatgtacgtatacgatgtatttttatataaccctagttcttaaatatttgtaatgcttattaaaaatcacaggttttcatcttaaaacaaattggcaataagtaaaaaaatttaatgttgaatttatcaaacttccaatgtgggacaatttccctatctaataagtctttgagaatttgtgagaaacggtctaacaagaacaatccaaacttaatatattggaaataccataacaagacggatcacttatacgaaccgcagaggtgagaaacccctttatttggaaaagtgtctagtgggtcaatctggctctgataccatattagaaattataggctttcaactcaaaaccaattgacaatgagaggagaatattagtgtagaatttactacaagcattatataatattaatatatatcaaattacaactttaaaatataaagtatcatattttgttttattcctaatatgatctaatttaggaaataaaaactctaatacatgtatagtacgtacactgatatgtgccctcttgggaggaaaattgcggaaccgcatttttgcgggaaaaatattgactcacgtttttgtggaaactatacggaatcacatatttttgcgagaaaaattcattctcttatttttagctggaaattatgaaccgtattgttagcaaagaactatagaattatgttttgacgctaaaaagcgaactcgcattttttgcggaaaaatggtgagatcgtgtatttgacagaaattttgattttgagagagaatgagagatcgatgatgaaagatgtgagaaatttgtgtttgcttctgtttactaaaattggtttaaacattttattcagttatatttggtttacacatttggttattttgtcaatttggttatgggtaatccactaatctatttcaaccaattattccaacccaaatcattacactcattaatccattgattcattaattatcaaatttccaacaactcattagatccatgagttggattggtttgggttgagttgaaaaattaacttcaattcattttgacatacctataatatggtatatcatacgaaccacctaaaatatgtgatgcatgcacttattaaattgcattttacaccatgtttttgtttaagtacgtcaacattgaattagcacaatgtatacgtacaaaaaagactactttcatggtaatttaatattctaactcaacaagatatcatagaatgcaataagaagttgtcattgcaatgaggtactatcaaaattctaaaagtctcaattgtgtaattttccctaagaaatagggaaaataccatttaaatatcaaacatttacaaaatgctaaacaatgttcaaattttctttctatacttcttaagttttaaatacgaaatttctttcacagtaccaaattaaaactttgttaatatcatcggatatttctaaaaaaggaaataatttacatgatcctcaatccccgaaaaaaagtatggaagataacagttctgcatatgataaagcacctccaattttaataacgattaaaaaaaagcaaaagggtggttggtttatatttattgtcttttggatagagagtctctagtttcatgtgataaagtatcgatcgcccaaaatccattcatacgagatatgctgtgctgtgaggtgtgagcggtaaggctcgtgatgaatggcaaacgattcatgtaactattttcttttattatcttaacaaagtcgttgttactctaaatttaacacttgatcatatttctaatatgtatattctgaataatggcatggcgtcaattctaacttatgagactttaaacttataatgttcactttctcggtagcaaaaacgcttctctttgccccttaagtagaaggacaagaaatctattttttgtttcattgctcccgtttcctcacatctgcacttgctaagccaaccttggcttacttatgaccacctcgagaagaacctatttgaaaacagtctaatgccacaaaccaatcttgatgcatggacttctagttttgcgagaacgtttaatacatattatactgtatgactgttgaccaatcaattgaaaatgtgacttagtttgtgctgcaagtcgtgttccgtatgaggataacatgagataacgatagtaattaacagttcacaactgagtaaaagaatgcaacacattaaaatgatcaattgaaaagcaaagcagtccgaaaagtgtaaacaaacatttaaaaataaaaaattgttacattcaggtagagtaagcaatcccacgggattcatgtcaccttaacctcccaaaatatcatgacgctaagacaaggtaatgtatacgtcactcttctctaacaaaggctatataaaccctagattggcactaggcttccatgcaacacaaaaacatacacactactaataaaccatg

SEQ ID NO: 21255 - DNA, 3003 bp, Unknown; identical to SEQ ID NO: 21254
  misc_feature (1)..( 3003): 2750-1469P.txt file - cDNA_ID_1843238; gDNA_ID_1621173; Annot_ID_174050

SEQ ID NO: 21256 - DNA, 3003 bp, Unknown
  misc_feature (1)..( 3003): 2750-1469P.txt file - cDNA_ID_1957064; gDNA_ID_2214502; Annot_ID_133682
attaaacttgatcctaaaaaaaaatcttaattatttttcttttcatcttaaatactaattttgtaactcaatcttaaatgtgcatatgcttttatcaagtgtttttgatagctatattattttaattctatttatatgaaaaaaacatatacaggtggaagatttctttgttgaaatgcaagaaaaaataatttctatttgttgaataaatgtcttaaatggagaaagctccttggatatcattgcatatgttaaaattttctacatttcaacaaagaatatagaaaatttctatgtttttctttgttagtgtgacagaatctactaaaaaatacatatttttatgccaatggttaatatgtttaacgttttgtgttttagtgatatcatacaaaagtttctagctagctagatttttatgccaatggctctctccatttttttatgattaaattttcaaaaaactaacaagagaactttgtgtattatttcttggttttttatactccaatggtaggttctcttaaaggaggtctcttaaaaaaaaaatattcatataaattattttatttcatacaacttaatattacaaagcataaaatattaaaatacattttttggaaatattataaaatagatgtgaaataaatattataatgtttagttaaatatataattttgtcataaattatgagctaattaaaacaaaattagtaaaccaaaacatttagggggatgtattggattagggattttagaagatttttgtttttcttaaaaaccatatcaaatctagtgttattcaaaaattaaaaggtttttgttcctctactcatcaacaaattaaaattcttataatttttttttttttgtttggcttgaatctgcatgactcactcaaattagaagccaattactatcatcaaattagagatacatttaactatgaagcgaattactatcaccaaatcatgagctatatgtgttccatagttacagagtctatcaccaaaatacataacgccaacaaaacaaactcctagtcttgtacatctatgaagccaatgactcaaaacatacaacataaccatcatgaagccaattactaagaaaaagcaacaaaagaaagagatagatacagagaaaagagaaaatacttgagcaagttgggactgagtcagcttcttgtcttctcgggcttgcatgatggctttcttcaacttagtgggcacacgatcacctgattttaaaaccatataaaggtgttaacgataaccagcattacgaatcaatcaaacacatatgtagacttcctctcgctaataatgcaaactgaagaaaatattaataacccaagagaacagactagattactagaatgactgtacccaagcaaaagctggttcttatgggatccaaatcaacaacactgatccccatgcaacaaacaataaaacgaaacagatcaatcagataacttcttcgttttctaaagaaccaaatcatctacacaactaaatcaatcaaagcttagtcatcttcctatctgacaatgctctgattcgagggaacgaagcaagggtttggtgggagattggatttgggacaaacacatatagaattgggtcatcgatttggtgaaacgaactcggaatggtgagcagcgtcgagagagacgaccaatagagagagtgagaaaatttcccgacggaatgaaaaataaagacacaaggattttttgttggttaaatatatcaaccaaccactgactgccacgtaggaggctctctccagaattatttgttttgattatttttaatcaacaacttcaagagaaccctatcaaattgtgatactcatatcatgacactgacaaataaaagagaccatgaatatggttaggccatatgcgatatggcttcaaaaaccaagttgggacaatcttatgtttagtcttaagtttgagttcattttaattcattttagatactattgtttgatgtaaaattaaactttgataaataaatgtacctaaatttggattgattttttcataatcatgtttaaaatttttggtgttatgcaattctgttttgttttgtttttccataataagcatctgaacatttttacaatatttatatattttaagaaactgaagttttaagatgtattaatctacattaaccttttctattttaatgttaacaaatattatatattataagtacaatattcatcaaatactataacatatatgtgaaatgtaaatatttactactaatcaaatatcatactgcatatttgattgcaaaagagctaaaaatcattaatattgcacattaaaaatagtcaataaactaaaatcattaaatacacaaatatatcataacacagcaagtgtgtaccattattaatcaatagatttacgctatacaagttttccgaattatgtatgtgaaataaatcacaccaaaaaaatgtatttgaaatgaaaaaattccccgcctctgtaatttaagttttttagattaaaacagctaaactcttttcattaatttattagagatacaagatattgttatttgttaccaataccaatatgtaaatttttctgagtaattattataattagttgaatttggctaccatatgccaattttcaacacataaaattcttttaaacgtgaaaattccaataatctaagagccaacaaccacgaaaattaaacctcgttttagtctaaactctaaaatgagaaataattagaaaccaataaaggctcttaaagaaagactaggtcaagttcaaagcaagttttgctttgtgtggtggtcgtcgtctctttctttaaacacacttgtttttttctttttcctttgaccactccaatataaacaaccaagaaccagtgttcctcgtccattcactctctcgtaatcacacacacactcactcatacgaagccaattgttccacacaaattggaagcgacgacaatg

SEQ ID NO: 21257 - DNA, 3000 bp, Unknown; identical to SEQ ID NO: 4153
  misc_feature (1)..( 3000): 2750-1469P.txt file - cDNA_ID_1957076; gDNA_ID_1620687; Annot_ID_48475

SEQ ID NO: 21258 - DNA, 3000 bp, Unknown; identical to SEQ ID NO: 4153
  misc_feature (1)..( 3000): 2750-1469P.txt file - cDNA_ID_1957076; gDNA_ID_1620687; Annot_ID_164648

SEQ ID NO: 21259 - DNA, 3000 bp, Unknown; identical to SEQ ID NO: 4153
  misc_feature (1)..( 3000): 2750-1469P.txt file - cDNA_ID_1957076; gDNA_ID_2926209; Annot_ID_141906

SEQ ID NO: 21260 - DNA, 3000 bp, Unknown; identical to SEQ ID NO: 4153
  misc_feature (1)..( 3000): 2750-1469P.txt file - cDNA_ID_1957076; gDNA_ID_2926209; Annot_ID_202489

SEQ ID NO: 21261 - DNA, 3003 bp, Unknown
  misc_feature (1)..( 3003): 2750-1469P.txt file - cDNA_ID_1957136; gDNA_ID_2214537; Annot_ID_134417
tacgaaactaaagttgtaatttgtataaacaaatcagaacttgagagagagagaagagagaacctgtaaattcttgatcttattcagaatgaaattaaggaactatcaactatgtctatttattgatacaatttggaacacgtttttgttgattccaataatttagttatacttgtaagttgtaactaaatcatgattgacctttttctgttccctttacttttccttcaaaaagaatatgagaaggaaaacattttacaaggccaaaccaatccccataatttgtaatttaagtcatattagaagagaaatagccaaactaacccaaaatatattagagatctcaagagcatcctggctgcatgttatcattctggacgatatgtcacgagacgagaggttctaacaaataaagcaatagatgattttgataagagtccaataatactagcatattacaagttgtcagatggagacatccatgattgtaatgaacagaggaacaaaacaattttgtttcacaaagaaattttgttataatatttttcatatactgtttacatcgtcgtcccattcacgtcctccttcatcaccgcaaagtgccaacttccgctagatcctcatccattttgaatcaccaaattaatccttaaaaatgaaaaaaaaacaaactaaactatttgttagtccaagtatgaatgcatagctttataatcatttcctaagctggatatgtgattggtaataaactaatactaccatgacaacattgtaccctattcatatacatcgcaataaaataccaaaattttccactaatcgcagatagaggaatcaactaatgcatggtagggtaaatatttatagtgtgatgttgatagctctattataggtgtactatataaatcaatgacgatataagtatactgtatagtattaaacaagccccacacaacaaactgaaattgcatccacatattcatttctcacgtttatttcatctatatatcctaccctacttgctcataaactttcctctcttgtcttaaacttttaacgttacaaagtcacagccacaatattctatcctcaccgatataataatcaccgcaacagtataatcttaccttgatatctattatatggattaaaacccgatttcttactaaacatttgacactttcgcgtagaacataatctgtacatacgaatttcgaattcatatatatatatatatatatatatatatatgttggataatgattgttttctcgaatattgtgtcgatttatagtgtagtcatattttagatagctactccgttcatcaccaatagcttgtttctatggttaatttctttcacttattagatttatctcaaccaatcactcaattagtttctagagattgttgtgattgctatactacatgttaagcactttttatttttgccggatttcttggccaaaagggttggcgatagaagcaactacattaaattcatgacctaagctaaattacatgtaacgatatacaatacaagatttgtctaaactaaacattgattcaaccaaaacttatatagactatatatttaacccaaatacttatcatataaatgttttcttttttgacgtcaacacaaccgtaaacattcgaaatcttatatatttaattatttactatgcttgttatttcatttgtcgacgttgttttttttttttgcattcttcagatccactaagaaaaggcaagtccgaaagataatgggcccaattagtggctatataaaaacccgacccggaaagactaaacctgatccgcaaccgaaccgacccgacgacgctagtataccgtaaaaatttgacaatcttcgtctccggcacaacaaaattgttcttcttcggcaagattcctcgattttctccgtgttctgtaatttccgatagattttgacaactctctttgattgtttccctttagctttttatttttatctgccttttttttttttgttgttgttccggttctattcgtttccttttgttaccttgtttttggttttgatctcaaatcctgctctgctctactatcttcaattcgattcttcatccgaacgaagaagacacaaattggagcttcactggtacatattcttgacgctttatctctgatttgctatttagggcttttcaatgaatgaatttagtttttctgctatgttcattgggaagtaagttcaatcgtatgtgtgatgatttttcaggacgttgatgataaagcatgaatcacggagggaacactcaggccgtagcaccaatggaccctaattccattgaggtaattaacaatctcttgcgccttctctttcttttaagcttaaatttttccaatttgcagatttatttagtctttatatgcaagtgaaatttcgtgcattggttcaatttttgcgaattgaatttgtttattttagtttgctccagatttaacttggtagatatgaaagttatgcttgttgttagttcaccattgtaatggttagaggaattttgcatgtcagtatgtttatgcagcagaaaaaaagtgactttgattctaggctccgtatgtgaactcttggaacatttcagaaaatcagtttctgctttaagaatagacctatcatcaattctgtggagccgtatgattttcactagtaatatgttatgaatacagctcaatgatgcaaagtacaacattttctattaggtgttaggtattgttacgaaacttagctgctgatcacttacttcatggaaatttgcagttttattgtttgattcaatcagattgatttgagactgtgggaggctttagcatcctaatgtagtctttatctgagatgacatttctgtttgttgtttgtctatgtttcttttcactcttcaactttttgtttatgtctacttgttaaatgaagattctcagaccttggccagtactaatgttttttcttttatg

SEQ ID NO: 21262 - DNA, 3003 bp, Unknown
  misc_feature (1)..( 3003): 2750-1469P.txt file - cDNA_ID_1959852; gDNA_ID_1621095; Annot_ID_55655
tggttaaaaactaagaaaaaacattgaaggaaatctacactaaacacttaaattatcatgaagtagttattagtaactggaaaaacaaattgacaaaacaaataaccatatagagtacaaacaagatcaaggtaacatataaactgaattaacatggaacttgaaatgattggtcactttattcaaatcacaacgaaaagcgaaagccaataattaattaaatccagcgtagagcaattggtagtagtcttgtttatgccacgaccgggggatttaggacggcataagcaagcaactcttggtcatcgacaaacacggacatgtcttcctcaggtaagcttatccatgcttctacaccatcaccttcttttgaatcaatcaacacgacacccaccatgttgtcgtaaatggtatgtgacgcgtatcccacccagaccggactacccgatccgaagtcaacctcgtagaaaggctttctgcaccagctagacattatgtatcggtctatctccgttgactctgacacagtttccgccatcaaactcaacaaactctgaccaattgtattgccttgaagactctctttgatcatctcgttgactctctctttgttcttcctgaatgtggccacgatttcagggatctcaaactcgctctccgcgtctttcttgagagaaaatccgctttgtaggttaccaatcacgtcttttggcgcaacactagatggaatcctaagtcgaatgtccatggcctgccacatgacggcttgccttggaattaacaagttagagcgtgaggagtttctagcacatctccagataagtgacatgatagcttcaacacgtgtaggcacagggacgctttcgctagcggccttgtgtttcagctcagcaatcttagaaggttcgaagacgaatcttttgagtacgtatttacttgtgatgttagaatcggaatccgttgatgggaactgttcatacatatgagaaggaggaggaggataaatagtcgtttcagcgaactcgatagtactgtttgacttccctttggccgtggtggtagcccagtcttttacaaaggtaaccaatgaggctatatcacagattttgtgagagacagagacagaaaccgccactcctgatccagacccgaagaaagtgaccttgacactcaacaacggccaggccgctggagattctccagcagctagtgtcgggaggaatcccgacagggagtcagtgttgaggtttctaaggaaatcaggaagaaggagatcggtgcgtgcctcggtgaagacggctccttcgtcgttacagctgatggaaaggccttctattcgtccagctagtggatagaagcgtgagagagtctcggacagagagagtttcagattttccgagaaaacctccgaggactcggtgatgagatcgtagaagaagatcgtcgacacgtagattccaggacaatagagatcaaggatagagagctgaaggcgatcacgaggtgatggtgaagcaggtttgatcacttctttcccggtcacctctagcttcgcttccatcgtcttcctttaaaagtcaacgggttacaagattgaagtattgaggaaactttgacaagaggagaagatggaagagacaaatggatcagagatgtgtccttttaaactggtagttgaatcgttgatacaagtttcaactcctatccatgtgtccacactaggaacaaaatttaatttaagaaaaaataaagtctgctaacaatgtttatttaattcattcatattagtaaattaaataaaacttcaaatgcttaaaatagacgactatgtaatatttaattggtgatagtaatataattcgacttctaaacaaacaaaaaaaaacatatattgaagattgatttaattgtatttaaaattttagagagcgtttatgaattataaaaggggaaataattttgaaatatatagttatatatatagaaataaaataaaaaatcagaaagaaaatataaacgttatgagaaagaaaaaagagcaaatgatagtggcatataccaactggtaaaacttctaagaggattgtttgttaaaagtctcacatcgaatatgagactgagccctagtccaaaaattactaaaatggtcaaaatgatttgttcaaaaagggggtatggaacctcactaaaataatagtggttgcattttagtaagtgaggttagactaatggttgaattttagtaagccaaaaactttccatcagtaattgctaattggatcaactaaatgccatcacacaaagaaactattgctgaaattgaatattgatattatcaaattttggtatatctccaacaaccatagtcctcaacaaacatagagtaagtctagttcctaaattttcaatatctagctgtttttttcttttcaatatccaacttagtaaacacattgttcagaaacacgccaaaaaaaaaaatcaacacatctcaaaccatcattatccagaagggtacagtaaatccagttcctagttttcgatttctaacttcaaaaatgctctctttctacatacacttttttacaagtctctatcacagaatcggaacatgtggatagagcaatggttagtagactcttttccccgaccactctttgacgttcctcgataaatccgaacctaatgatcaatgaacacgacgagtcatttatacaaaggcaacaacaaaatgtggtttcttctcagtttgcttccttgaaaatttagctgttatatactaaaaggccttttgtaaggctaaaaggccaagcctttgggcccattaacatcaccgtttattcgaaacgtatgttgttaagacttgagagaagtttgacggtgaaaaaaggaaaatatttacatatatatagtaaaattaaaatagtagaaagaaaaaaatcagaaagctacgaaagaaaaaaaaaacaatctagcaacagaagaagcttcgagaagacgatg

SEQ ID NO: 21263 - DNA, 3003 bp, Unknown; identical to SEQ ID NO: 21262
  misc_feature (1)..( 3003): 2750-1469P.txt file - cDNA_ID_1959852; gDNA_ID_2926163; Annot_ID_139799

SEQ ID NO: 21264 - DNA, 3000 bp, Unknown
  misc_feature (1)..( 3000): 2750-1469P.txt file - cDNA_ID_1960072; gDNA_ID_2213644; Annot_ID_132354
ttcgtagtttcttggaagtgtatgtattttatatttgattcagacagcctgtcgacaaatatcgacagctacttatgttgactttaaatatctccaagcttcagaaataagttcaaacaataatgtaaaataacccacataagcttagacttggaaattggactatatattcgtaaccgcaaagtaaaaatgatggaaatttcaaatgaataaatctatgaggttgttctgaagaaagcaaactaataaattgctaatttggaagcagattaataatgggcaaacgattttatatgatcagaaaaaaaaatctaagcagagagtgaaaacagaaaaacggagaaaaagagagcaaactcgaaaaaagagattgaaaccagtcgttgtgcatcattcacatgtaaagaccttcaggaactccttctttcttcttgaacataaccttctccttcgccttcttgaagtccacatgcgtcacctaaaccaatagaagaccaaacaaaggttaaagtaaaattattcaaagattgcgttcgatgaatcaagtggtgagaagccagagaatccttactttcatccgacgctctctaagagcaagcagaccagcttctgtgcatattgcctttatatcagctcctgagaactcgtcttttgtcattacaaactcttctaagttcacatcttcagccaaagtcatctttgatgtgtgtatctaataatggcatgcaattaaaaaccgatcagatctttctagaaaattcacaaaaaaagaaagaaaacttaaggatcaccagttgtggaacctggaagatacgtcttcttgttttgatatctggaagagggaattcgattttcctgtcgatccggcctggtctaagaagtgccgggtcaagactctcgatcctgtttgtcgcgagaataaccttaacatctcctcttgaatcaaacccatcaagctggttcagtagttccaacatggttctttggatttcacgttccccacctgagtttgcgtcatacctgtttcaaccaccattttatatcacatattagataccatctcttgagcaaaatcaagaacattgtttatcaatggatcatgtttatgttgtatttaggcataccgcttggtgccaacagcatcaatctcgtctatgaaaacaatagaaggagaaaggtcatcagcaaccctgaaaagttccctcacaagcttgggaccatctcctaaatacttctgaatcagttcactaccgacaacacgcaagaaagtagctgaagtagaatttgccactgcctgaaagaataacaagaaataacacttgctcatctccaacagttccgaatttaacaagcataagagacacattaaaaagaggcacactgcaacaatccatgcttgcgacatagacaaaaagaaaacgaagacattaaatcaatccacgtgactctgaaaatcttcctctatctacacaagtactatgatctaatatctcaattctaggtgatcaaaccaaagaagccactgtcctgactaattcatctttctagtgaagattgataaaagacagaaaattttgcatgcatgacttgacataaaaccaatcatacttgggaagtaccattatgtgctgtattaagcaattaacaactagaaagcttattatataatggatacactataggctaaaagacgaaccttagcaagcaatgtcttcccagtgcctggctcaccatacaagatcacaccttttggtggcttaattccaatatcttcatacagctcgggatgtgttaaaggtaactcaacagcttccttaatctcctgaatctgagcttctaaacctccaatgtcagcatatgactccaaaggagccttctccactttcatcacagacaccattggatccacttcatcttgaagaatcccaacaacagagagtacctatcacaaaaataataaaaaatatcacatagaagaattggttcaacgtttccatggaagagcattgtaaaactcaataccttgttatgcatcaaaatagagcagccaggttcaagctgatccttatcaacgaaagacaaaatgccaacgtagtactcaggaccaaccgaagaagaaacaatggcgtgattctcatcaataagctcttcaagattgccaacactcataggtgtaccacgaagatcatcaactttagatctatcttcctcagctttctcttcctgaggtttcaatctctcctgattcgctacgaactcttcctccataagcaaatagtccttgattcgctccaatttcagcaatcgaagcttacatttagtagaaggagtcaccgtcggcaatctcgccgccgcttcaggtcctttctgcttccgttgcttcctccctacacgagcaggtggtgcggctggttcgaacttcttctccttcttctctccaccatctggtttccgatctccttgccgattcaatccgccggaaggtccttgacccattgtgcttcgtctctctgaggtttcttgctctcggagaaacaaatcttttaatctgataacgggaggagatgattaaagtgggcttattattttaggcctttttacgatgtgaaaaacttagtgggccttaggtatcgcaaatttttttaaaactgattcaacctaagctattatctggtttagttcaataactcggtttaattatctttaatttcggtttaagttttgtaaaagtcaattcgttggtttggtagttggtacggtcaatcggtacaggtaaggaacttttcttttgccatttggggaaatcgaatcaaaaatcaatttcatcgtcttctctatctgtcattcatcatcatcacaatcatcatcatcaaatctcaggatcttcgaggtggttcttctgtttcgcaactagcttctagattgtgatttacaatcttcgaactctcggtgagtttctaggtttagggttttatctctctttacacgacaattgttatg

SEQ ID NO: 21265 - DNA, 3003 bp, Unknown
  misc_feature (1)..( 3003): 2750-1469P.txt file - cDNA_ID_1974108; gDNA_ID_1621090; Annot_ID_55491
acagcgtgagatacctcaatgaagactctcttcatcggcttctatctaactgccctgttcttgaagatctattggtggatttacttttgtcagacagcatggaaaagctaactgttgttgtcccatctttgcagattttatcactctttatacctcattcttatgagatcgatgggattgtgatagaaactccttctttaaagtattttaaacttatagaccataacagtaagagtcactactgtttggttaagaatatgcctaacctgatagaggcagatatagatgttgaattacatagcatcaagagtcttattggatcaatcacatctgtcaagcgtctttcaatatgttcacaggtatcattttctcaactcattgtttagatatgcatttgctgataatttttaatattgcgcaggctatgtatgatggaggttttgtcttcaaccagcttaaacatctgaagctatgtagatgcaaagggcattcgtcggatttacttgtccgactgctcaaagattcttctaacttacaagcactagacctttccgaaatggatgtaagtttgttcgtcaaactcttttttcttgtctgatgcacattatggttttagtgtaattcttcttctgtttgatctgtaattcttcttctgtttgatctgtaattcttcttctgtttgatctcagtatcatgagaatcatgatatcctttactggcatcaaccaagtactgtccctgaatgtatgttgttgagtctccaaactctcaacttgtcggcatatagaggaacaccagaagagagagatcttgcagtgtatttcttgaagaacgctgttcacttgaagaccacaacaatcaagtcatgtgtttttgatgatgaaagatttgacatgttaaaggagttggcactttcttctagagcttcaacaacatgccaactcgtgtttgattgagagtatttgatcaccaaaacaaagcttgttcttcagttcttccatgtccccgggctcgtatggtttgtcttcaacctgaaaatttgttttcgtcaaccatctttttctatgttttccgttttttttgtatgtgataaaaactttattctatatgttgtccaccaaaaaacaaattatgttgattggagaagttatatgataagttttaatcgtttatggggttttataggtgtgtagagatatatacataccttgtgaatgaagaaaagagaactagctctgtgttgaaaaactgaaaagcatttgatgccctgataatttctctaaaattattaaaccgaaatactaatacgatccaagtggaaccaaccaatttcttaatatctaaaataccggaatctaaagagtcgaaccaaaccgaaccggaatgtcctctaatttttatttttaaacccatgattatgacatgcactaccggcttagtggtgatgtttggcaacatggtttattcaattctcactcgcactgagtgtctgtggctcataaatcatttaccttttcaatttctcaattccaaatctaaaagtcgtcaaaaatggctctccgatctgtcaaaacgccgaccttgataacttcggtcgccgtcgtctcctcctccgttaccaacaagcctcactctatcagattctctcttaaaccaacgtcggcactcgtcgtccataaccatcagctatcgttctacggttcgaatctcaagctgaaaccaactaaattccgatgctcagcgtcggctcttacgccgcaacttaaagacacgctggagaaactggtgaattcggagaaagtggttctgtttatgaaaggaacgagagacttcccgatgtgtggattctccaacactgtggttcagattttgaagaatctgaatgttcctttcgaagatgtgaatattctggagaatgagatgttgaggcaaggacttaaagagtattcgaattggccgacgtttcctcagctttatatcggcggtgagtttttcggtggttgtgatattactcttgaggcgtttaagactggagaattgcaggaagaggtggagaaagctatgtgctcttgatcctgatttcaatacttggtttttgtgatgatggaatttgatcttatctatctatctatcacctgggaaaaaaaatgtgattttgatgtttcagagtttgtggttgtaacattaagagacatatattgtatgatggatttaggtatacaacagttggagttgcttggaatttgagtttcctttgtcatatgtgttggcctgcaaatttgtgttgtttgttgaaaggtttatgtgtgaagtagtgctagtagaatctaagtttgtttctgactaagagacatgaagtcatgggttgttatgctcattcatatcctgattgagatacaatttaaagaaacttagttccaaagattctgaacattcaccggtacagtgtgtctgcaaatggtattctgtctcacttcaatgtctaaacacgttgtctcaaaatgtatcgtttgttagatactcctttcaagacatatgatttagcctcgcatgtgttcgttgatccaagttttaccggtttgataagtctccagtcttagcaataaatccagaccggattcatgaccaatcgcagatttaccggtccgggtcaagttttaaaacattagtagaaatgtgtttcaccgaacaggaagacttatctgatagcatctcgttgcagtggataaatggcaaaatagtaatatacgtagattctgcttttatctgaaccacatagtgcagatggatatcgaacagaagaacatgatatcgagaagacacgtggcccaatgaaaaagccacgcaggctctgtatagccaattgcaatctggttttagattctcatctcacaaatcttacttatacgatcagtctcccacattcacacttccaccaaacacctctcgtccacatctttctcctttggtggcaaacacaacgacagatagagagaaacgatg

SEQ ID NO: 21266 - DNA, 3003 bp, Unknown; identical to SEQ ID NO: 21265
  misc_feature (1)..( 3003): 2750-1469P.txt file - cDNA_ID_1974108; gDNA_ID_1621090; Annot_ID_170674

SEQ ID NO: 21267 - DNA, 3000 bp, Unknown; identical to SEQ ID NO: 13945
  misc_feature (1)..( 3000): 2750-1469P.txt file - cDNA_ID_1974112; gDNA_ID_2214675; Annot_ID_136651

SEQ ID NO: 21268 - DNA, 3000 bp, Unknown; identical to SEQ ID NO: 13945
  misc_feature (1)..( 3000): 2750-1469P.txt file - cDNA_ID_1974112; gDNA_ID_2214675; Annot_ID_189190

SEQ ID NO: 21269 - DNA, 3000 bp, Unknown; identical to SEQ ID NO: 3127
  misc_feature (1)..( 3000): 2750-1469P.txt file - cDNA_ID_1974121; gDNA_ID_1620627; Annot_ID_47162

SEQ ID NO: 21270 - DNA, 3000 bp, Unknown; identical to SEQ ID NO: 3127
  misc_feature (1)..( 3000): 2750-1469P.txt file - cDNA_ID_1974121; gDNA_ID_2926186; Annot_ID_140806

SEQ ID NO: 21271 - DNA, 3003 bp, Unknown
  misc_feature (1)..( 3003): 2750-1469P.txt file - cDNA_ID_1974269; gDNA_ID_2214559; Annot_ID_134861
gttttgttttgtggttctacgaccatttttgcaaaatgtaaataattttcagttgtgtgtatattatatatctaattgcagcttcattgtaaaatgtaaataatcttcgattaattttatacttttatttttttgggacggtttttgtgaaccaaaaatattgtttaggtcttgaacactttcatagactacatataatccatcaagactggagaccggagaacgtgatgattatgtatgataggaagactgtaaatgaaaaaatagatgacatggacattgctaagattgaacatggacattgctaagattgaacatgcaccattcttgagtcaccttgccagaggttgttatgtttcttataccttatattgatttgataaactaaatgatatgccgtaattgtcaacacgtgattgagttttcaaacaatctttaagaatgcatgtgtaaaaattgtaggtgagcggagtctgggtctccaaccactagagcaatttgacggcaaaaaggaaaccactgcacctgattctcggtaatataatctccaatctcttttcaatttttattccgctgattattcgctaaaatgtatatactccttatttgttgtctgatcgttaatgaagtgcttcttcaccccttttttgaccttacaacagttattggagatgcaaagtagaatgtaaagctagatcgtaatttcttagaacatagcgacaaaaaacagtgtaaagaacttgaacgctccaaataatagctacatatatttgataaaagattacaagtatgacaatgtgattgatttgttaagaattattcccaacattgtgcatcactttggttgactcccgaaaaacataaaagtatgttatttcaactctaattatttgtccatatctagaactagatcggaactttctacacaaaaaaaaaagaactagacgtgaaataatgaaacaattcaatgagaccttattagtgttgtaataaaatttagtattattacttattagtgttgtaataaaattagtatgttaaaatttatattttaatatagccctatattcatttattcactatggttatttatctatattttgatatatgtgaatatttgtgggtccaatgtcctcttaaaggcatgttctttgattgctggtttgattataaaatcatttttcttgtaccatttttattttgttttgtgatttttcttccacttttgcaaaatgtaaataatcttcagctatgtatatattattagctaatttggtcatataaacgtagcttagtctatagtaaattaatcatctacatatgacttatacatgcataaagtgagtataaatgtatgtttacatgcgtaaatcagaagaacctaaacatatttcatttagtactacatgttattgatttttctacctagacatggacgttgaaccccatcaacatattaaattcattgtctgatattttctcagaacatatatacttttattgtttttctgccgatgtggacaacaaaagcatggaatacgttcgaccaataaatcttcgtctcttatttgattaatgtgagtgtatcaccaaaacttgaattatttgccatttatttttatatccgaccgtggactataatttctttttattatttggttatatattgtctccgtttttggtttaaacgtcgattcaattttgattgacatttgaatcgaagccaaatcacgaaaacacacattcgagaaagcttagaactgaaatgaaagagtgcaaaaaagttacaccaatataaagttgttgaaatttcggaatcttgtaagattaaaagattgttagtagaaaaaactcaacctcccaatcaaaaattacaaaaatagtaaaatattcatccacaaatttcatttttttaaaaagagaacattcacacacacttctagattgatcaaagataaaacacttatataagttcgactaaacctaaagatattatcctcattaattagtcacaacttccccaaccaatttcttaagtcaagtaattcctttgctccggtggaggcattctcaatgtttaaggaattagtggcgggaccaagaaaaatcttatcaaagtcaaacaataaaatggagacaaaattaagtgcaaaccttaaacttgaacgggtcatacacaaccaaatctgccaaaaaaaaaagtattttattcaatgaaaaaaacatatattctataaaatttgaaggcatcattttcagttttttcaccctcttctcataacgtaggtcccgaccatatttgagattttatccatcataatgaaaaatgaactaaacggctccctttcaacaccacattaccgacacccaatcagctttaaaactcaattctatggttcatttattttgaatctaaccatattattaagatgtggttggcttacacaatcaatagttatgtactataccaaataacttattgaccaatcctataaagaatcgtttcaaaacacttttagaaagatgctttactttctaaaacgatcgttttcagtcaggttttctatcggttcacctattttctcttttgtagaaaggcgatcgtgattgttaccggcctcactaaattatggtttatatattataattatctatggattgattatgatttcctaggcatgtacgtacgtaatattttttttgtgcgacgtttcagtgaaagtgtagttgatagtgaatgtttcgagttcaagttataaatcatatcaatagtaatccaaatctttttttttgtgatacgaacttggtaaacgtgaatcacattttgtaataatgcaagatgacagaatcgtggtaagaaaaagtaactaatgtaacttatttttacgttttaaccgttatattctctatataaacgaaggagaaatgaaagtattcatcaagtaaagaaacaaacaaacaaacaaaaaacacacttcactcgctacacaaggaagagagatg

SEQ ID NO: 21272 - DNA, 3003 bp, Unknown; identical to SEQ ID NO: 21271
  misc_feature (1)..( 3003): 2750-1469P.txt file - cDNA_ID_1974269; gDNA_ID_2214559; Annot_ID_185846

SEQ ID NO: 21273 - DNA, 3003 bp, Unknown
  misc_feature (1)..( 3003): 2750-1469P.txt file - cDNA_ID_1974419; gDNA_ID_2214620; Annot_ID_135866
tttataaaaataaaacttgcaagttttaatatattacctttaaaaaataaatcgttctgcggtataccgcgggttaaaatctagttaacatataacggagaaaatcactcatatgataagtgataacagttgattgaagaataaaatcattgaaagaatcgttattaatatacactcttccgtttgatttgttgaatcaaatgtgttaaacatccgttcaaaggacaaggccataagcgcctgttcaagtcgaggatcgcaaggtaagtttcctataccgctacatgtgtacgtgaaataacatacttaaagtatgaggttatatggtctgcgaatgcatgaaccaaaaccaatgaatgatggtcattatcgacgacaatgattttgaatcataagcgagcaagacatgacctcagaggtggcaaggagatctgagtatccgaacattgcgagtcttaatgacaatgtgagatttcacatggacacggtttctcaaaataattagtatttgttttcgtgtttttttgtcgttatatgttttcaatcgattatgtgtcaaactcatacagaaatatgatattacaatgcttagaacatggttataagtgataattataaaatatcattaaaaataatttaatattatttataatatttgtttaatagattttttttttttcctttttggtaaatgcgaccaatcagaggatatcacgtcacatgatactggtatcaaaaacatcattgagctgatcaagttcattttaattattttattaatataaaaataatttttggacttgtgatactatagaaatatcactcatgtacatggtcttagtttccccaaatgtacacttgtattattgaaactagaaaagaacccgtgatactagtaaatcttttatttattatgttgtaatttaaataaatatatatttagatattcaattcaacaattaatatctcttgcatttttatttatcaaaaaaaaaagagtacaaagcaaaatattcagagaaaaatagagtccataactccatatatgtttgttttcttaatgtcatttactcaattatttttcatatataagtaataaccaacatatagctgtcaaaaaaaaaaaacaacatggttggaaaatggtcacaaataaaacactgctaagtttgccaaaaaaaaaaaaaaaaaaactgctacatgcaagtggagctaccacgcaaagttagaggcttaaacacatttactaaaaagtaaaactttaggtacgaaagttccataacttctcaccttctctgtagtcgaagaatctgaggattgataaatgttttaaacaaagaagcacaacaagcgtaagaaaggcgcagaagatctctcgaagataagatcccaagatttggagaactagtccgattctctaaccatgttcaaaggtgaaaattaaaaagaagacaagaacacctgaatattctttgataaatgtacttcttttcacatctctaggccagccagtaacttcgattcaagaactcaatcatcccaagagatcaaagagatttacacaagatgaactagtttacaagaggctgcacaaaagaaaagaaaaaaatggtttggttagtgaggaatcatcttgattaatttttcattttaataaatgaacatatcattgtcaaagaatgttattccgtggcacccacgaatgaacatgttttagagggctaaaatctctgattatgccaaagtacatcttttttagtactgtgtgtcgtctgagatttgtcttattgtctaataattggaatcatgttctgacgtacacctactagctaaaggcaccagacataaatagtgtttaatattcagcaaaatcatcgtccttttctatagatgctcaatataaaccagtaaatgtatagattacccaagttgctcaacgatcttgaagccaataatggcatgattcgctttttgtcacactccggtgattaaagacttcaacagagctaatcagatcgaaaagacatctatcactgcaaagaagtacttaactatatacttttctcgatcacacaagatggaaaaattgcaagaaatattacacacaagcttaacaattcacctacaactacaacactacaacagatactcaataaatttcagtaaatataagattacctgaagttgctctttttttatttattgaataccatgaggttttaagccgaaacccgtaattctccaaagcccgaaatcacatcatgtaatattagtttcatctcaaacgtcactcgaaccggcgacctctaagcatgtaaattgcttaacgatctttggagccaagaatggcaaaatcacaatcccacaatggaaacaatataaaagttaactaagctaatccaacaatgcaaagaggaactctatagagattatattattttcaatcatacaagaaaaaaaaattgcaaaaaatattaaacacaagcttaacaatcacatgctttatgaatagtatcggatacgatagggggttaattcgacactaatgatgatgataagatccaaaatgctgaaagaggtaagggagggtccaatagttattggtaaactttacggacactagcaagaaaaaggaagcctcctaatttccttatagcaatggtcaagagaatctcattccactaaaactattaaacctttattatgtcctttaagggactagactctaatgatcattatcatatcaaagcttctatcaaaacttttgtcccttcactaaaattttatgtggtagctaaaagaatggtcattctaaaaatctctcatttcaaagtatatattcttccaactggcttataaccccacacattgcttttctcctcctacatataaggagctccacactccctcaaactaaaccaattcaagtcatctctatccgtcaacaatacaaaccaaccttctcaattcctctcttttcatccacattttcactagctaatg

SEQ ID NO: 21274 - DNA, 3003 bp, Unknown
  misc_feature (1)..( 3003): 2750-1469P.txt file - cDNA_ID_1974423; gDNA_ID_1620620; Annot_ID_46992
ttcacaattttgtgtctatattttagggtaataaaatgggtcgaactaagaaaaaaatattagtacaaatctacaatgctgggattatttggtatgacatcattaagacaacagaaaaagagaaaaatcttttggttgtcggctcggcgcagcgccaaattaaacagcaacaaagtggtgaatgaataataaacagctacagagggacccacaacatggccgtcatgacttatctgtaataatacacgtggcgaatatctatttgtggtcagtcatgacatcagttcaaacgcgcaaaccagtcacgtttatacgtgggaccgttgtttgctgtaaacacccaaacataaaccctaaacactttcgacaatttatctttcttttttgcaaataaaaacatttcagaaggaacgtttctcactggatgctgatgttgatgttggaatatatgttttatttgacttttaatatacttatttttacttggtcaacttccaatacctgtcccttatttaattaggctctctaatcatatcattgacctctatcttgtaaattatacgtttagggtggttcatttttgtattgcatttattttctcagttatatttatcaaatcttctatatatgatggttcagtcgattcgagattcgacgaccaacatacctggctgtccattaggattattaaaattcaattcttgccaccctaaattattggaaccttacaaaacatatactagtatataactatatattgtcacgatacacatgatcgcgcggtttaaacaagatttaactttaaaactaaacgatattttttggtattttgtgggaaaaaataaaacaagatttggagacaagattttgtcctaacgataacgatgaaaaaatgaaatcaagtaaactggaacacatacatttttccaactacgtactaaaaataatgagcattttaatactatatagttgccttttaacactaattaatttatttccgatttatgtatatctggtgattcttgtcaaatgtaaaagaacgtagatatctatttctttcattataaaggctcgactctcctatatacatatagactcatgactattgtctgttagctagatgtacattatataatatacacatgaataaacatagatgtagtttacaaccaagcaaacgagactaatttcatattttatactaccttttttataacattagcgacaaacattcagttaagaatttatataattttgaaataattgcttccaaacaaacacaagttgggaaataaccactaataaaaagttaaagaaacatcatacacaaaacttgaagttgggcatgtgcatgtgaaggaaattttttatactttatagacccttttttgtcatcatttacacttatagatattatagagtgagtgtttgctcaaaagaaaaagttattaaagagtatgatcatttgcaacatgttactgacatttccttcttccatattttgtatagtttttttatttattttctcgatcgacaatgggccgaaagttaccacagatatgagagcttgagaacagaataagatcttcaatatttaaactaagaaaatgtgaacaagggctccacacttatgttctttgttctaaaacacgtaggcaaaaggttccctctaactctctaagcattttagatcaaattgtcatctatgaaaaacaaagctcaaaagacgctttatttggcttgaatcaacaacatatttaggtacttcttgtcacaagttttttagaatcacatgtgctaactacatacaaggacacaattacactatactaatactacaactgtttgttctttgggttagaagcaacttagtacgttgaccctcaaaagactcgtttcacgaaacacgagttacattaatatttttctaatcgaaggaaaaggaacgaaacgtaataatgccgcttaacccacaaactcagtcttttgcttaggtagacccaaatgcatccttttagttctaaggttccgcaaatcttgtcacaatctggttcaccgttcacgcatacggaaactcatacggctaaaaaaatgtttgcatagatgaattgaacatgatccaatataatgttattaaacgcatacggctaaaattttgacatgtcaagggaagtgacacgtagacaagtcgttacgccatgaggtcagcgtccttcgtctacgtggacacactgcacatccacgtgtatccatcaaaaagcgagtttcgtaaacctatgcttacactcgcgcgcgtgatattgagatgttgatccctctcaattaagcattcaatgccactgagcctaatttccccgcacgaaacatttactctgtttttttgtttccctccttctacgtttctctgtacacggctttcttaaattgctcacacgaagcagataattcgtctctctatctctctctccttgcatcattttcttcgtctcattggtattgattgattcacgtgactttgtacattgcggttaagttcttccgtcttggtcattccacatgttgtgtagtgttcaacgccgaattttccttcacccgaggttagaggcttgcggatttttctgtacattggaattagcttcgatgtttcgagattagtgttagaaataatagtttgcgtgttaaagttcttatctttcctgatttggtcggttacctcagttttgtcttgttgtgagatgaatccatctcttgctatattaaggacaaatcttcaaatcggtgatattttgcttcttttttttctcggccacagattaaaatcgtcaaattatctgatttttgatgccctgaagctttagcttgcatctgtagtcatttgtcaaagataattgaacagaggctttctatattcgtcgtcaagggtttaggagattctgggttttggcgtgattttgaggggaaagattgaaactttccccgtgaatggtaagacagtgagagatg

SEQ ID NO: 21275 - DNA, 3003 bp, Unknown; identical to SEQ ID NO: 21274
  misc_feature (1)..( 3003): 2750-1469P.txt file - cDNA_ID_1974423; gDNA_ID_1620620; Annot_ID_162239

SEQ ID NO: 21276 - DNA, 3003 bp, Unknown; identical to SEQ ID NO: 21274
  misc_feature (1)..( 3003): 2750-1469P.txt file - cDNA_ID_1974423; gDNA_ID_2926189; Annot_ID_140955

SEQ ID NO: 21277 - DNA, 3003 bp, Unknown; identical to SEQ ID NO: 21274
  misc_feature (1)..( 3003): 2750-1469P.txt file - cDNA_ID_1974423; gDNA_ID_2926189; Annot_ID_200901

SEQ ID NO: 21278 - DNA, 3003 bp, Unknown
  misc_feature (1)..( 3003): 2750-1469P.txt file - cDNA_ID_1974557; gDNA_ID_1621119; Annot_ID_56252
actatcattgtaagtaaatgtttaacaaaatttcttgaagttgcatcatttctattgtgccctatttgtttacatgctgtatcacattttcattgcagttgtaagacttatgggtcgtgctgcttcccacattacgcttgagtgtgctttacaaactcacccaaacataaccattattggagaagaggtaacgtttttggttgacttcaattcaaattaccgtaaagatatctgaatcttaatcgtgtagatgatagaattagactgcaaatcagattcatatttgtgacacttttccattgaagcaaattattcatttcaatatggggttattggttcagagagacctcacacatgcctcattagatcagtttatatttactcaactttgatctggaaatacttttttgcaggtttctgcccagaagcagactttgaagaatgtcacagactacatggtggatgttatctgcaaacgtgctgaacttggttacaactacggtgtcatactgattccagaaggtctgatcgactttattcctgaggtgtgttgtcattgtaaaaaaatagaatctactacttttaaaccgattaatataattgttcttcttaactgatgattaattttatttcatgacttctcaggtccaagagctcattgctgaactgaatgaaattctggcaaatgaggttgtcgatgaaaatggtttgtggaagaagaagctcaccgagcaatccctgaagctgtttgatcttctgcctgaagcaattcaggaacagctgatgcttgagagagacccacacggaaatgtccaggtaattgatcatggtcctgtctcctcgtactaaatttccaccacaatgcagttagcttcatctctcacaaatcattattaataataccatgtcctcatctcaataggttgctaagattgagactgagaagatgcttattcaaatggttgaaactgaattggagaaaagaaagcaagctggtgcatacaagggacaattcatgggacagtcacatttcttcgggtaagttacgcaatttgttctttcagttaaccaaatcgttatataatacattgcttatttattgatgtgaataatacaagcttgatttatggtttgtaatcaacttgaatacaggtatgaaggaagatgcggcttgcccacaaattttgatgccacatactgttatgcacttggttatggcgctggagtactcctcaacagtgggaagaccggactaatttcttcggtttgtactccaccatttccactaaaatctgttttccatctgtgatcataatagcctttggtaaactagtatgtgcttagaatgagatgagttaacttattggcgcaggttgggaacttggctgctcctgtggaagaatggactgtaggtgggactgctctcacagccttgatggatgtcgagaggagacacggtacagaaatataaatcaataaagcttactaagacacattttgaaatctagatattaaaaaatcagagttgatttcaacttgcaggtaagttcaagcctgtgatcaagaaagcaatggtggaacttgaaggtgaccctttgattcccttcccttttcatagttttcgattggcggttagattgtcttgctgactgtctttttgagctctgcaggtgcaccatttaagaaattcgcatcactgcgtgaagaatgggcattgaagaaccgatacatcagcccaggtttgttgcatgtttcttgtctttttttgacaaaccatctgttgtgtttcagattctaatccctttgcgggaatgttatcgacttgcaggtccgatccaattcactggacctggttcagactctctcagccacactctacttcttgaactcggggctcaatagtctctcgactaaccaccattcctttgcttttctgccttccttggaatttcgcatcagtcttgttttatcttgaatattacgtgtccgtaacatttcgattaagttgattcctctcgtgtttcttcaacatataagataattataatattatttctctcgtgtttcttcaacatataagataattatactacatggtctaaatttactacaaagatctaaagtcggagtctgtctagaaaaaagtcctttgcgggtctattaggaaaatcgtaagctactttttgtcaacatatgcgttacttgaatttttatgatgtttttaaagtacaaatttagtttaaggctaattattgtttcaacacactaaaagtcctggtaggctctatatacacatcaaggtcagattctaattttaatacaaagttctaaagtcagaattcaaatttaatacaaagttcttttggtttctattaggaaaatcttaagctactaaaatcaacatatcgttacttgtgaggttaactgttaaaccaccttttgcttaccagtaaaccctattaaaagaaaatagtaaaacctaatgctggtaggttctagagatacatcaaggtcattttcatatcaaattataccggtaggttgctttgttaacgggtctattatttgcttcttgaaagcaaaacaacacataacttttacatgtatgttaactgtttatagatcctaacttagcaagtgaaatgatatttcaagtggtgccttggtggaatgttaaattgtgataaattaaagatatttataagaagaaataaaaaacactaaggttgtttctgttaatagctaaactataggactaacattaaacgttaatgatgttcgaagttttctaacgaagagaataacagacacactgaaattcaaataatctctctctctctctctctctctcactatcttcgttaaattcggcaaagctttcgctttcttatttatggaaatttctttcatcctttagtttagtctctctctctctcccttttttgtcaattcagagacagagaggagagagagaccaagaaaaggagacttttgttgatcatg

SEQ ID NO: 21279 - DNA, 3003 bp, Unknown; identical to SEQ ID NO: 21278
  misc_feature (1)..( 3003): 2750-1469P.txt file - cDNA_ID_1974557; gDNA_ID_1621119; Annot_ID_171993

SEQ ID NO: 21280 - DNA, 3000 bp, Unknown
  misc_feature (1)..( 3000): 2750-1469P.txt file - cDNA_ID_1974569; gDNA_ID_1621138; Annot_ID_56586
tcgggacgaggattattttgccacagctggtgtgtcgaaaaaaattaagatatatgagttcaattcccttttcaacgaatctgttgacattcattatccagccatagaaatgccaaatagatcaaagcttagcggcgtttgctggaacaactacattaggaactacctagcttcctctgattatgatggtattgtcaaggtatttgaacctttgaagttttacgtagattgtttatcacttgattacccctttatttccttcggtctaatgaatacaaacgtatttatgatgaatccagttatgggatgtgacaacaggacaggccatttcacatttcatagagcatgagaagagggcttggtctgttgacttctctgaagcttgtccgacaaaattagccagtggaagcgatgattgttctgtgaagctatggaacatcaatgaggcatgctcttctatactggattttgtcgttttaatagctactcctactgagatatctggcatatatacatatgaatatatcaatagcactttggattattctgtcaatgttgtcatgctcgtattttcagccttgtagctaatagacaatcttcttgtttgactgtgcagaggaactgcttaggaacaatcaggaacattgcaaacgtttgttgtgtgcaattttctccacagtcctctcacttgctagcctttggatcatcagacttcagaacctactgctatgatctaaggaatttaagaactccttggtgcatactgtcaggacacaacaaagcagttagctatgcgaagttcttggataatgaaactcttgtaacagcatcaactgataacacgttaaagctttgggatcttaagaaaaccactcacggtggcctctcaacaaatgcttgcagcttaacttttggcggccatacaaatgagaaggtagctaatgctgaaacgtaattttgagttaatctatataatgatgtttctctttttccttcgtggttgatttgtcttttcctgcctttttcagaactttgttggtttgtctacttctgatggatatatagcttgtggctctgagacaaatgaggtatgcccctacaaacctgggaactctttgatattcctataactttgtgtatggaatctccttttctataatcctttaacaagcattgccacagattgatagtttgattctcaacttaactagaagctccagagtttatttcatgtgatggaaaaaatcacagttccatgtgaattccgtctatttatacgcgatggaggaacttatccattgatactaacaattagtaaaataactggcgtagggtcaaaaaagaactaatctggtagtattgttgtttaagtgatctctctgattgagaaatatgctgtttcttgttttgttcaggtttatgcctatcaccggtctcttcccatgccaattacctcgtacaagtttggttctattgatccaatatcaggtaaggagatagaggaggacaacaacctgttcgtttcaagcgtttgctggagaaaaagatcgaatatggttgtttcagctagctcaaatgggtcaatcaaagttctacagttggtctgaaataaatacatacatacagaagaagctgaggtaattctacacctagagccctcttggtttatggtaaaacaaaaaccccatcaatccaagaatcaggcaaaacaacggagataacgaacaagctttcaacacacagatatgagatagttttatctatctgttgctaaagttttcctcaaatggggtgaaggaatgagagtgagtagaactatagttgttcaatagttgcggtttgatcagcgcggtaagggtttataccgctgatgggtatacatagtaaggtaaaagaccttctcttttgtggtgttctaaggtgtttatttttttattttttattttggctcttacaataagattcctctttgtgatatgtaaatttgctccgatagttctaaggtaaaagagcatactctgatgtatatatagttgaaatgagctttttagttctacggatgaatctcctccaccaagaaaagaaaaatcttcgtttttctttttaaaaactttaaatgcatcgttttttgttgaatgttcacaaaagtaatctttgaaatgctttatcattgtacatagcttaggactgaatcagcgtaataacgttatcaaggtttcttgctcaatcaagctgctccaacttgtttatggtcttcttcacttggtactgaaaacttttttactttctgagacaaacaacaacagaagatgaatcaaggccttgctcaatctaagatcaagctgtcttacatctatgagaaagacttaagaatcacaaagaagaattcatagtgaactagtgaagcatgccatatggaaaaacaattgttcaaaaactccaattgaggaaatgttggaaaaagaaaagaacaaaccttagatagaacacattctcagagagattgcagtagaattagacatttctcttgatcgaatttcgattccgaaacacaattgagaagattcacagcttcttgtcgtcaaattggtaggggaagctttttctccattatcataaaccctaaactaaaagtttctgcaaaaacaactattttatcgaactcttaatgggccatcaatgggcccatacttataaacttaaacccttttccaatttcagtcgtattttacaaaaaccatcaccgtcgttatcacagtaaccaaacaactttcatcgccgggtaagctccattcccaagctatttcgatctcgtttcacgtcgatctatttctagtcaagttaatctcttcttttagggtttaattagttaagacttgcgtttgattatctcaagttcagaatttgtttcttgatgatctaaaggaaggaattttatacttatcaaattgaggatttttgtttttggatgcagagaactgattaacatataagaaaatg

SEQ ID NO: 21281 - DNA, 3003 bp, Unknown
  misc_feature (1)..( 3003): 2750-1469P.txt file - cDNA_ID_1975940; gDNA_ID_2214651; Annot_ID_136421
ccaccgacaagaagacctacttcgccggatacaaagactgccacgtaaaacccggattccggatcgggtcctgatccaaattttgcgtgagtcaggtcccataccacccgaatatccggctttcgagataacttctttgatccattttttctccagaatgtcaagggtttgatttcgagccggaaggcgaagggaatggagtgacggtaacaatctagagagtgtagatagcaatttgtggagttgcatgagtagaaatgaaggtggagagagcgtcggaggaaggatcgagaccatgaaagaaagaaaacaccaacgttagtgtggtactgacaagttgtggtagcgtcgccggaggtggagatatacgatggatttgatggggatggaagagccgacggtagatcgtcgttgatggcggtggcggaaggatggaaacaggcggacaaaggggaggagccaccgcgaccaagagcagagattttcatttttaggtatagtcaattaatatgactggttgatcttatatacgcacatgcatacaaaaagacactaattatatgtaaggatatgactatttgagtatttatctatacttgagttggcttatgtgtctgaaaatgagttgtcatgttgtgaaaattcaaaagagtgggtcaatgtcgagaaattgaaagcaactttgtggataaattttatagaccgaaactgacgttcattgatattttgtgctggttttcacattatttatatgtagattatgttctagttcaattcttttgaagtcgcttgactttttgtctctttcctagtttccttaatcttttccacttatattagtttttaacgtttgtagtcacagtgaaagctaccaaaattctaaaaatggtaaagagaaatagaactgtatcttgttaaagctcggttttcatgttacttaacattacatatgttgtgtttgatagtataaaataataaatttgttatggataattagatgaaaaaattaaagagttttgcgataagtaagatatttgtttcttgttggtttaagagtcggtttgggtccatgatataacactaattaaccaatagttgtggccttgtgggaggtaaatgatccaacaaactttgctttactaactcacatcttttttcttttgaataactaagaggttttggcctaggccaatacatcctctcgggatgggactaaagcattttatagaattttctttcaaatgttattggaaccagcaacctctaggcttagctaaaatattttaccagttttgagctattgacacttgataactcacagtttttagatgtagtttctctaaatcatgcatataaaataaacatcatagagatcactagtagatgatttcatcaactagttctatattcgatacgattttacacgaaactcgtattttcgaaatgttgtacattgtatgatataaactttagaaagggaagatacaaaattaagttgctgactatatgctaaacctatagacacgtgaacaatgagatgacggcaaacatgtggatttaagtttgcttcggtttgtttcagtttgttctagtttgctacaacaaaactccaaaatattgttgatttggtggctacaaaaaaattataatataaaaatagaagatatgtgtttgattaaatatactaacatagttttgatcgtattaggtagagccatatttagataagtttgtggactgcgatgaagttatgaagccacacaatatgtatttttttttccctcatgcttgattcgttattttctctgtgatttgatatgtatgcaaatttatttattaatggttcctttttggattccagctaacaaaagaaaaggtttgaaaatgtccaactacaaatttaatatggaaacgtacaccaattcattgcgagattggtgcattactcgcttgctttttgtttcataccagacaattcaaaacatgtgattgatttctcaactttcattctctaatcatttagaggatacctaccaaaaattaatatcctccaaaattatttggccattgacattacaaataaagaaatgtctttggatgaaatatttcaaaattatttttattcattaaaacaataatgatttaaatactaagcacacatatagtgtgacaaaaatatgtgatttaaggatctcaggatacaaacatctctaaactagttttacaagcattcgaaaacacagctctaacaaaccaaatcactatgatattctcgaattacttactttctaacaagaaaagattgttggagatttttatttgcgttaaacgattaagttcttaatcgatgtaatcggtgtactagacgacttaaagaataggttagctatgatgttgagtcaatcaaccacatcccctccacaaatccaggagagttaaaatttaatcttttaccattcattttttccttctacaggttcgaaatcgaagtccggtccaatcttgaaaacatcaattatccaacatttttgtgctggaccgaagccaatggcaggccagatattataaccgaaggcctgaaagtaagttacaacgagatagtaagaagatgcttaagtaaatgggcctttgtggcccaatctataaaacctaaccctagcatcgtgtccccatataaaactcacctccatcgctttctacaagtttcttctccagatttagggtttctcagtgtttcggctcggcccagaacaagatcgcaagacttcaagatggtaaatcctttcacatctccttcattcttaatccttatacttttctattatcaattagtatgtaaatgttacggaagttcgagactttgaatcattttgatgatcttctctgcttcaaccttaatcatctacactgaattttatcttaatgttacgaaagtttaagactttgaatcatttttgatgatatcttctttgtatgaaacagccgtcgcacaagtcgttcatg

SEQ ID NO: 21282 - DNA, 3000 bp, Unknown; identical to SEQ ID NO: 11724
  misc_feature (1)..( 3000): 2750-1469P.txt file - cDNA_ID_1975979; gDNA_ID_2214512; Annot_ID_133875

SEQ ID NO: 21283 - DNA, 3000 bp, Unknown; identical to SEQ ID NO: 11708
  misc_feature (1)..( 3000): 2750-1469P.txt file - cDNA_ID_1975979; gDNA_ID_2214512; Annot_ID_184307

SEQ ID NO: 21284 - DNA, 3003 bp, Unknown
  misc_feature (1)..( 3003): 2750-1469P.txt file - cDNA_ID_1976286; gDNA_ID_2214536; Annot_ID_134381
tttcgggaaaaaaaacgttcagatattttccaaacgtgacctaaagatggtcatcaaaataaaaatcataaaaactaaagttaaaaatctttctctctctcattaatcttatttcttgatcgtcattgttgtcgtcctccactgcaaatccgttataaacgagttgacgtcatcttccggcaagaaactcaaccgtctccggcaatacattgttctacctctaaacatctccgacgaacgtttcatcggcgccggtggacattctctaactatagggattctattctccggacgagtcggtgtcttgaacccatcattctcttcctccacaacttcttcttcttcttcttcatctaatctcttccttttcagacaaatatccaacacaagtttatcgtcggaacattcttcttctctcgtctctttaacaccacctaacgttacctcttcctctttcaagctcgtctccgacatacctaaaaatctataaaaatcaagaaatggcacccaaaaaaaaaactcttgttcctagatagagagagagaagagaatgagaagaataagaagaagaaataatgattgatcgatgtagatagatccaacgtggtaaagaatattaatcaagaaaattgtcagcttttgtttttttattaaattatttttcaggtttatttatagtcggagattagagcgagtttgttgtgtattgttggatgtggtaaggagagtctaaaggcatacataacgtaaccaaaccctctgattcattgagaaggagacattattcgacataataccgttacgataaccataatatctcgtcgataaagtaatcaaaatatcgccgatgcctttctgcttctcgcaagttaagcaccaaattgacatctgcctttacgtttccaatctccatgtgcgcttttttttcttctcaggaggaaaaaaatatatttgttgccgttagactttaattacgtatctaactcatatttattaccacctaatcttattgctaataacttttgtgtatttataaggaggagacccactcttatagttttacattaatgacttctatgatcagtttagataaatatttttcctcaaccggactaaatgtattcttctatatatatataattaggataaacattttatgtaagaaatctaaatattgtttagttgaatgtaagaaagttttttggtgtaaatgttaagaaatgaatgtaagaaagttttcttccctattcatttttttgtcttaactttggtgatttcatgatatttatttcatttaagaataggaaatcgcttgtgaaattggaagcaaattaagaaaatacatgatagagcttttaaaagtgtggatgacctttcaatacatatttgcttggaggcgatggtgaaaaactgaaaatgacatcagatacacgcttgtgaaccatctttaaagtattgatggactcttcactatgaaagctctctttaaaattaattttctttgtacatgtctctaagcaatgtcaaattaattagaggtccaaattcaaaaaaatgtcgtattgaatcattccattactaaattggttcaatgtcagatttaaacagcctagggataatttagtgagatatgagattctactttcaacatatactaatcctaaatctctagcaactttttatataagctataaatatcatgaaaatgtattttaatcgtttcataatttatgcagtcacactaatggaaaaaaggccaattattattattttcttcagactataaatgaaaacataaattaaaatgcagattagtttaaaattttaataagtaagtaaaatgcttatagccttatacaaaatcatatttggaagtttctaacattgttgcaatttgttatcacaaatcacagtaatatttgtatactaattagtaattacaactatacacaaatttaaatgggtaatcatatatttgtgtccagtggattgaacaaatatgctcggcccatgcggaagtaatgccaattttgggtgagtaaagcccatgcgaaattttcacataagaaatgcatgctttttgttttcaacgacatgagttgcatgctttttatcattgcttatatagttgcaagtttgcaactccttgatattttttttatgtagacactactaccaccaaaaacttttggtctgcttattcttgtttactatgtaaaaaaaataaatgaattgtttatttactccgatttgatggagtctggtttatgaggttttatagcctttacagaaaattgatagttacaaaaatatttttcaaaaataaaagggtaaaaccgtcatttcaagttgttattgttttgggggactggatttgaaatgaaatatagaaccggaaaacaaggtgagccgaagtcgaagcctttggacccgtttttatatttactcctcccattcccttctccttcaatccttccttcctcctcctcccttcttcttcttcccctctttcattttccagccactacaaacttttctatctctactttttttcctctcgatttcaggtactttttgagaccctttgttgtgattttcgaacacacaccccaattacgtttgatttttgatcccgcatcgatttcaattcatccgtttctgagtttcttttggatctgggtgtcttgagctaatcttttcgatctgttgtttatcgattttactcatgcgtatgttcattacaccatttgttatttgtttaatcaaccaaaagactcatgtttttcaaatgtctttaatataatttttctgattgaattttataatatttacatgattctggatccagaatatccttcttcttcttccattttgtcctgtattgatttgtctttgaaaaaggattgttctttgtatctgtattggtgaaaaaggattgttatttgttgataaaaatttgatctttaaacaatgtttggttttgcataaaggtagaagaaaatg

SEQ ID NO: 21285 - DNA, 3003 bp, Unknown
  misc_feature (1)..( 3003): 2750-1469P.txt file - cDNA_ID_1976336; gDNA_ID_2926258; Annot_ID_143155
agctgatcgcagtttctctccagtccacatgctttaccatatcctaaaaactatatctatgtatggtttggtttaatggcgtagtagtttgttgcgaggaatctttcatgatgtaagaaaaacaaagctgtttggaaccttttgtcattataaataatctcttctctttctttttcgtcatgtctcgtaaactttatctgccacggatgtatgttcttaaagaaattgaagattgaaattgatcaattgccaataatgatctcttttgtctctgtatatgtattgattcaaacagaaatcatagtagaaaactgtcaagagaaattgaccttttaacataatatctaagtttgggctggataatatctaatttttgggcctggataacgttttacgcgtcagggactaagttgtacaaaatgaaactaaagggacaaaatagtaaagttgggtgccactgttccccgcgccacaaaacaaaaacagtacagtgagtcagtgaagctgacattcacacacacacactcacacaaaaaccaaaaactaattttcacgaaatccgaagcttaaaaattattcctctactgtttcaatttcatctcttcttcctcttgagttggcaatttctagggttttctcattttcctttttttccatttctggaaactggtaaaaggctttttctttgtctgtgggggagaaacaaaaatggagacagacgaagcataccaaaagaaagagcgagctgcattagtagccatcgttgtccttgcttgtcttgctttatcttctttgttcgtcgcctttagctactactgctatattcgtaacaaggtttctaagcgtcacagaattagcaagagtaagctcaacaattcacacttcatttctccttcttatctttttacctgtatttcttgttcttacgccggatgctgaaatttggttctaattaaggaataattttggaagataattgttcaattagggttcgatttatgttctgggtattgaatctgttattgttttacctgtcgatttttagggtttgattgtgaggaaaaaggcgattgtcagaaagtacaagatgttactgaaaatgggttgcaaattttcacctttaagcaattgcattcagcaactggtggatttagcaagtctaatgtggttgggaatggtgggtttggcttggtttatcgtggtgtgcttaacgatggcagaaaagttgctatcaagctcatggatcatgcaggaaagcaaggggaagaagaattcaagatggaggtttgattatttttagcttactctttgatctttattttttcaaagcttatgcacattttgctgtttgcagcgtttttgattacttgattgatcaattttttgtatctggtgccaggttgagttactgagccgtctgcgttcaccatacttgttggcacttcttggttattgctcagacaatagtcataagctgcttgtgtatgagttcatggcaaatggtggtctgcaggaacacctgtatcttcccaacagtaagtttctttttccagtagagttagaagttgctgcatgtttgaagttgtcatctgaagactccaaatttagtctatctgtctagatgctaacaatttgaacatgaatcctagatagtgtataataattacgaattggtgaatatacgtctggaattcttgttggatttgatagaaaaatctctttttcttgcatttagggtctggttctgtcccaccaagattagattgggaaactaggatgagaatagctgtggaagctgcaaaaggcttggaatatctccatgaacaagtatcacccccggtgattcatagagactttaagagcagcaatattctgctggacagaaacttcaatgccaaagtttcagattttggattggctaaagtcggatcagataaagctggtggacacgtttctacccgtgtattaggcacacaaggatatgtagctcctgagtatgtttttcactcaatcatctctttgttcttgtttccatcagttaactttgataggttggatactaataccaatattttcaatatcttatgtcaggtacgctttaactggtcacttgacaacaaagtcggatgtctatagctacggtgttgtcctgttagagttactaaccggtagagttccagtagatatgaagagagctacaggagaaggtgttcttgtctcttgggtacgcgttcctttcacaaactgctcttgtgtcatttcttcttgtctttgctctaataacttaacttttcctatctccaggctttgcctcaattggctgatagagacaaagtagtagacataatggatccaacactcgaaggacaatactctacgaaagaagttgttcaagttgcagcaatagcagcaatgtgtgttcaagcagaagctgactacagacccttaatggcagatgtggtgcagtcactggttccattagtgagaaaccgtaggtcagcttcaaagcttagtggctgctctagtagctttagcttggctcggtctcctaactctccgggtaaagcaagcataggttctcaatgaataaatcaatcagagaagacgaaatgtgaggcttttattatgtaacggtatttactaaaacagacaatgatgtaaacacttgagtgatcaaacatggagtcatagagataatcatcaaataaactttttcgaatctctatgggctactagttattgggccaatcctgacccattactatattctacagagacgagaatgatattagttcatgagaaaaaaggtcacgtgagggaacgtgggcttgatggagaaaggagggtacaatcgtcattttgagtactcgtaaaatttgcttagaaccctagaaggctaattagaactagggtttatatagtttgccgcttcatctccgtttcttctttccgattcgtgttttcccgtcggccggagatatatcgcaaccctaatccgaaatg

SEQ ID NO: 21286 - DNA, 3003 bp, Unknown; identical to SEQ ID NO: 21285
  misc_feature (1)..( 3003): 2750-1469P.txt file - cDNA_ID_1976336; gDNA_ID_2926258; Annot_ID_204622

SEQ ID NO: 21287 - DNA, 3000 bp, Unknown; identical to SEQ ID NO: 6953
  misc_feature (1)..( 3000): 2750-1469P.txt file - cDNA_ID_1976558; gDNA_ID_1621118; Annot_ID_56235

SEQ ID NO: 21288 - DNA, 3000 bp, Unknown; identical to SEQ ID NO: 6953
  misc_feature (1)..( 3000): 2750-1469P.txt file - cDNA_ID_1976558; gDNA_ID_1621118; Annot_ID_171958

SEQ ID NO: 21289 - DNA, 3003 bp, Unknown
  misc_feature (1)..( 3003): 2750-1469P.txt file - cDNA_ID_1976558; gDNA_ID_2926161; Annot_ID_139708
acatcataagcaaaacaaatccgatcaatatgtttaaattctgtaatacaagaacaatataaacaaaaacatattattcagaaagcaatgatacattatttgaatattgtgtgtaagagtgaacgacaagatcatacgtcagagataatcgactggtaacaactctgatcttttccaacttttggtcaaagtcaaaccatttggtcatttttacagtaaattattgagtaatatgtcatttactcatttcttttgaggaaaactctttttttatcagaaaacaaaaacaaattactcattttcgttttgggctcaagacaaaagtccttcttttaaaaatattagcccagttaatctatacaggcccattaaagcccatactaaaagagccgagcgttccaccgcgtgagattgacgtgcgtgtatttacgcgttaatgtttcgcgtggtatttgtttatttgaataaagattccttagctttattcttagtaggtcctcatgagtcatattcgtgaaattgaggtttttgaacgaactcggggctttgattcgaagtcgaaagttttgattttatattgtgatttctaagtcgaaggatgtgttactttggtgttttttttatttgattttttaaaaagaatatttgatagttgtaaagagtttttgtatatgtttaatttttaaatagagaaatggtcaacgtagcacaattaacttgtaatagagaattgctcaacgtagcacaattagtgtagatctttaaaattaaatcatcgagcgaattttagaattctcccaaatagttgttatctgcaaatgtcatgttatttacaattcttgatacataaaatagttagttttccatgtggtaaaaacaataaaacatacgaccaatcgaccattgacataactcttctaaatccacgatgagttatatatataaacttataatactaatcacaattattgttattgaggaatatacatcgtgagtatcatcaaatctcgtcatcgcactttgcttgaacgtgcaagaaacttggaaacgcgtttagagcaaacaccgggacaccgaagtaccgtttattgaattcctttttttgtgtgtgttgttcaatacttaaatcgactaaaaaatcattagcctaagattcacatatcagaacgtgcttgggccaaaaataaaataaagaacgtgcatggaccaaccaaccatatatatatcttcatagtattattgataatggcgggtcccattatgtttgatatattttcagttttcaccatggaagcataatctcaagaatatgcctccaataaaattcgtttgtacatgaattccttaagtatggcagaatactacgtataccccacataatagtttaatctaatttaaattagtgtaaattttccaccaatcaatttattaattacttaaaacaacaaaagtagtgaaaaacaattaaaaacacatatctccctcaaaatacccatagtaggctacaactgtagatttcttgtttcacaagacacaagaaaaaaaaacctaacttagaaatcattagaaggaagtggttcatgtccattactaccgataaagatagtatcataaacaatagctgcaatggctgcaccgataaaaggaccaacccaatagacccaatgattcgtccaaatccagctaaccacggccggaccaaatgaaaccgcggggttcatcgatgcaccgtcgaaagcaccaccaaccagaatgttagctccaacgattaacccaatcgccaaaggcgcaatgattccaatatcacctttcttgggatccacggcagtagcgtaaaccgtgtaaactaacccaaacgtcatcacaatctcgaaaacgactgcgttccagggcgtcactccatatgatagcgaaaacgcagccgtttccatcccgccagtgcttaccttgagcaacaagcaagctacgactgctccgagtaattgagcgatccaataaagaatagctctcaacaacgttatgtttccaccaataaaagccccaaatgtaaccgccgggttcacatgaccacctgaaacgttagctccaacggaaaccgcaacgaacaacgcaaacgcatgagacaaagacgcggccacaagaccggcaggtgtggctggaccatctccagttagttttccataagccattccagagccttgacccgcgaaaacgaatataaccatcgagaaaaactccgcgaaagctgctctaatcgcatcgggacgactagcttcccccggcgttccaatcgcaattctgttgataggcatcgttacaaaaaaatttgctttcttgcttcctcttcattttgtttttcatcagtaaaagtttaaatagttaaagcgttagtgccaagtgtgtgtatgagaatcgttcaagagactgagattagtgttttacggtgggccctaggttataagaaatcgaacggtgattataaattcatatttaattaataacttacttaccaattaattaaatcttaatccgtttttctcgctttctataaatactattatgggtagcaattgaagaacacgcgctttactgttttctcatcatcgtcacttttctttctccacactttccgcaagattgttctgttcttcaaacgattctaaggtacgacttttttttttgaaggttcttgatctcaacttttgttgcgtattgatgtttgatcctctggattttgtatccaacggaagatctatcgagaaatgaacaaattcgatacaaattgttagtgtttagctgaattatgtagattttgttaacttcgatcttgaagatgattgatgtttatcgtactagtagaatctgatgttaaatctttgagtgatggatcgtgttatcagcatcaatagtgaaaagattctatattgatttagacgtgaagtcatgaaaattgactaacaagattctaacgtttggttctgttttgctctgttttattagatg

SEQ ID NO: 21290 - DNA, 3003 bp, Unknown; identical to SEQ ID NO: 21289
  misc_feature (1)..( 3003): 2750-1469P.txt file - cDNA_ID_1976558; gDNA_ID_2926161; Annot_ID_198757

SEQ ID NO: 21291 - DNA, 3000 bp, Unknown; identical to SEQ ID NO: 14168
  misc_feature (1)..( 3000): 2750-1469P.txt file - cDNA_ID_1976561; gDNA_ID_2214704; Annot_ID_136931

SEQ ID NO: 21292 - DNA, 3000 bp, Unknown; identical to SEQ ID NO: 14168
  misc_feature (1)..( 3000): 2750-1469P.txt file - cDNA_ID_1976561; gDNA_ID_2214704; Annot_ID_189782

SEQ ID NO: 21293 - DNA, 3000 bp, Unknown; identical to SEQ ID NO: 7000
  misc_feature (1)..( 3000): 2750-1469P.txt file - cDNA_ID_1976580; gDNA_ID_1621121; Annot_ID_56281

SEQ ID NO: 21294 - DNA, 3000 bp, Unknown; identical to SEQ ID NO: 11179
  misc_feature (1)..( 3000): 2750-1469P.txt file - cDNA_ID_1976634; gDNA_ID_2214482; Annot_ID_133295

SEQ ID NO: 21295 - DNA, 3000 bp, Unknown; identical to SEQ ID NO: 11179
  misc_feature (1)..( 3000): 2750-1469P.txt file - cDNA_ID_1976634; gDNA_ID_2214482; Annot_ID_183399

SEQ ID NO: 21296 - DNA, 3003 bp, Unknown
  misc_feature (1)..( 3003): 2750-1469P.txt file - cDNA_ID_1976638; gDNA_ID_1620671; Annot_ID_48158
agaccagtttccctggcttttgaaaacactcttgaagcaaggaaccgattcatatgaactacaaacactctggttggtttggtcatcaatttgagaaggtccacagagatttcatcatccgttgcattgggagaaatcaccgtcctataaggtatacggatgttaatcgcttgtaatgcatcagtaagaccaggcattataccttctccaaacgcattgttctcatacacaggtacgacctctctccaaccaaacacctttatgatctcacttatggcttgcacttgtgatgagtcgtcgtaagtagagcgaaagaagtatggactacggccagagtcaaggaaagggctcgttgcagaaaatgaaataattggcacctgagatttttggcctacctcgatcacgaaagaagcttgcatcgtcgttcttggccccagaattgctttcacttccttgttctttataagatcaagagctgcggaaacaaacataagacatgtggtgttatatgagaaacttgaaaacagaagaccaaatggaaggtagtgatgactatatctttgtggagctgaaaactatcaagttctatatagtttagagccgaaataaattcattgccatgaaaatgcagtactgaaggatgcattgtccacaatataccacaattacatttaaacttatgtaaacaataccacaagaaaatatatatgaatccctttatatatatgtacgcatgccaagacgtcatttcacgtaaaaacgatattcaaccgttttaacagaaaacgtacttttgcggtttttgacaacaaaaatgtgactaatcggttttaaagggaaaacatgtgattgtgcggttgttgatgaaaaacagggattatgctttttggagagaaaacatgattctaaaatatctaatttttcatactgaattaaaaaacgaacaaccctatatttcatattctcaaatttatccttccagccaggaacatgttacacgtgtgcatatatgatgcgcataattagtgtgaataaggccacatatgatacgcatatatgatcagttgttccaaaaaacaatattagcggttgcatgaacgagaaaacagaacccacaaggacaattcacatttcttgagctatactatatatagttagtataacgtggaaacggaaaaaataatcacaaacgaaattttttgctttcatttgcgtttcacgtttacttatagaaacaatcgaatcattaaagacagaacataccagccgctgcagcgccaacaacatcgtctctagagtcggcaaagttaagaagaagcctggtccgagattctggacgagaagagtaaaagtctgagagagacatgttaatggcgagcaagctcaagttggaggcagttgtcccaacatcagtcacaaccccaacattaattacttggattgtcgtattctgtcccttccccaatttcacgccgaagataaaaacgagaaacactaagacgacgtcgttgagatgtctcttcatttttcttttgtttttggttttggttaagtaccgtggaatgtatacatcttgaaaatattttgaactcatatttataaatggataagatttaacgccaaaaggtgtttggttcgaagaagtttttgtttttagaagtaaattatacatattaacgaccctttctgctaatgacgtaatataaaagttacatttccataagaaacattcttttcttttttgtttaattgaagatataaatccttacatcatctcttgtcaaaaaccagcatacaataaagtacttatcttattaaactattaaataactaataatatggttgaaattttaacaaaataggtttttattaattaaccagtactggactaacgtacctttgcaaaattaactttttttccattttaacttgacaagggcattattggacctccctacacacgcatgcatttacatagtagacgttataactcccatgttaacatattaaactcatatcatatgttatatgtgccacaaattaaatctctgctcaagtggccgcaaatttcagtatctcatattttctgttctaacttaaaagttaacacggttacttttcattcctcggtctcaagtctttcgtgatccatccagttttgtataaaaacacaaaagtaacaaaattatagatgcagcaagtcgcgggtagtggtgaaaaataagtttcatcagtaaaactaaataaagaaagcatatatatatgccttttgtaagtgatatcatgcaaccccgtttctgattaactaatattacagaactagatgtaaaaagagaagacaaatatattttacttatctaacatacagtttttaagttttgatataagaaaaacattgtttaattaacaagacgaatgtagtagtaaaagacattgcagtaaggcgtaaccacgtagtattcattcaccatcacccgtgacccgaaacattttattttatatcgttgaaatgacttggtttgtaaggaagagagatagtcaaacaacaaaaagaaagaattagtcagatatcgtactcccggaaaagaaaataaaaaacgattccgtgattgaaacaggttgcttaagagaataatcattggcagaaatttgtttaacacgaacttttttaatcaaggccaagttgcaaaaaaaggtcaaacaaaattacacattattttgaggagaaaaggtttatatatatatattttttatttttttttgaacacggaaggtttatatatatatatatatatatgtatcaaattttcttcaaaataaactaatgctatgttttttctgtttgaaattattatttcatgaatttaggaagaagaaaatgataaaagggccatcgggcccataatcgcagaaaacggcccatataaatccaccaaacgaatcttctctcttggtataaatatgctgtcttgcgttacagagaaaccctagacgtcgaagatg

SEQ ID NO: 21297 - DNA, 3003 bp, Unknown; identical to SEQ ID NO: 21296
  misc_feature (1)..( 3003): 2750-1469P.txt file - cDNA_ID_1976638; gDNA_ID_1620671; Annot_ID_164112

SEQ ID NO: 21298 - DNA, 3000 bp, Unknown
  misc_feature (1)..( 3000): 2750-1469P.txt file - cDNA_ID_1976638; gDNA_ID_2926200; Annot_ID_141481
ccagtttccctggcttttgaaaacactcttgaagcaaggaaccgattcatatgaactacaaacactctggttggtttggtcatcaatttgagaaggtccacagagatttcatcatccgttgcattgggagaaatcaccgtcctataaggtatacggatgttaatcgcttgtaatgcatcagtaagaccaggcattataccttctccaaacgcattgttctcatacacaggtacgacctctctccaaccaaacacctttatgatctcacttatggcttgcacttgtgatgagtcgtcgtaagtagagcgaaagaagtatggactacggccagagtcaaggaaagggctcgttgcagaaaatgaaataattggcacctgagatttttggcctacctcgatcacgaaagaagcttgcatcgtcgttcttggccccagaattgctttcacttccttgttctttataagatcaagagctgcggaaacaaacataagacatgtggtgttatatgagaaacttgaaaacagaagaccaaatggaaggtagtgatgactatatctttgtggagctgaaaactatcaagttctatatagtttagagccgaaataaattcattgccatgaaaatgcagtactgaaggatgcattgtccacaatataccacaattacatttaaacttatgtaaacaataccacaagaaaatatatatgaatccctttatatatatgtacgcatgccaagacgtcatttcacgtaaaaacgatattcaaccgttttaacagaaaacgtacttttgcggtttttgacaacaaaaatgtgactaatcggttttaaagggaaaacatgtgattgtgcggttgttgatgaaaaacagggattatgctttttggagagaaaacatgattctaaaatatctaatttttcatactgaattaaaaaacgaacaaccctatatttcatattctcaaatttatccttccagccaggaacatgttacacgtgtgcatatatgatgcgcataattagtgtgaataaggccacatatgatacgcatatatgatcagttgttccaaaaaacaatattagcggttgcatgaacgagaaaacagaacccacaaggacaattcacatttcttgagctatactatatatagttagtataacgtggaaacggaaaaaataatcacaaacgaaattttttgctttcatttgcgtttcacgtttacttatagaaacaatcgaatcattaaagacagaacataccagccgctgcagcgccaacaacatcgtctctagagtcggcaaagttaagaagaagcctggtccgagattctggacgagaagagtaaaagtctgagagagacatgttaatggcgagcaagctcaagttggaggcagttgtcccaacatcagtcacaaccccaacattaattacttggattgtcgtattctgtcccttccccaatttcacgccgaagataaaaacgagaaacactaagacgacgtcgttgagatgtctcttcatttttcttttgtttttggttttggttaagtaccgtggaatgtatacatcttgaaaatattttgaactcatatttataaatggataagatttaacgccaaaaggtgtttggttcgaagaagtttttgtttttagaagtaaattatacatattaacgaccctttctgctaatgacgtaatataaaagttacatttccataagaaacattcttttcttttttgtttaattgaagatataaatccttacatcatctcttgtcaaaaaccagcatacaataaagtacttatcttattaaactattaaataactaataatatggttgaaattttaacaaaataggtttttattaattaaccagtactggactaacgtacctttgcaaaattaactttttttccattttaacttgacaagggcattattggacctccctacacacgcatgcatttacatagtagacgttataactcccatgttaacatattaaactcatatcatatgttatatgtgccacaaattaaatctctgctcaagtggccgcaaatttcagtatctcatattttctgttctaacttaaaagttaacacggttacttttcattcctcggtctcaagtctttcgtgatccatccagttttgtataaaaacacaaaagtaacaaaattatagatgcagcaagtcgcgggtagtggtgaaaaataagtttcatcagtaaaactaaataaagaaagcatatatatatgccttttgtaagtgatatcatgcaaccccgtttctgattaactaatattacagaactagatgtaaaaagagaagacaaatatattttacttatctaacatacagtttttaagttttgatataagaaaaacattgtttaattaacaagacgaatgtagtagtaaaagacattgcagtaaggcgtaaccacgtagtattcattcaccatcacccgtgacccgaaacattttattttatatcgttgaaatgacttggtttgtaaggaagagagatagtcaaacaacaaaaagaaagaattagtcagatatcgtactcccggaaaagaaaataaaaaacgattccgtgattgaaacaggttgcttaagagaataatcattggcagaaatttgtttaacacgaacttttttaatcaaggccaagttgcaaaaaaaggtcaaacaaaattacacattattttgaggagaaaaggtttatatatatatattttttatttttttttgaacacggaaggtttatatatatatatatatatatgtatcaaattttcttcaaaataaactaatgctatgttttttctgtttgaaattattatttcatgaatttaggaagaagaaaatgataaaagggccatcgggcccataatcgcagaaaacggcccatataaatccaccaaacgaatcttctctcttggtataaatatgctgtcttgcgttacagagaaaccctagacgtcgaagatg

SEQ ID NO: 21299 - DNA, 3000 bp, Unknown; identical to SEQ ID NO: 21298
  misc_feature (1)..( 3000): 2750-1469P.txt file - cDNA_ID_1976638; gDNA_ID_2926200; Annot_ID_201795

SEQ ID NO: 21300 - DNA, 3003 bp, Unknown
  misc_feature (1)..( 3003): 2750-1469P.txt file - cDNA_ID_1976665; gDNA_ID_1620632; Annot_ID_47280
atcattgataagattgagtgtatataattaaaataaaatgcataagactgaaattttgtttaaaccaaaaattattaaattaaagatcagaaaaatatatagattggtatacaatattcaaatattatcgataaaaaaatatttttctatcttacacccgtctaaataggcggaccttatctagtatatatatatatatatatatattttgtaaacgattgagtaaaaaatgtttggaaaaataaaatgagtgacttaaaaatgattagaattgttttaattcctgatagagttagagaagatttatacttaccaaaacaaaagttaaagaacatttcttatttggaaatatttttccagattatcaccaagtttaaaactatttttataataatataattttaaagaaaaaaacgagtcttctccatctgaatggctgtgtttctcaatgtatttggacgaattagagaacgataaaaaaatattcacagattttttaaaaatattgaatctcttataacgtaaatgttaaagcggataatttgacaagaaaggttcatatccaaccgcattatatcatatatgtaaacaaaattgctcagaaatgactatattaaactctaactaatatcggttgacaacaaaataatcaagtacttgattccatcaattgaaaatttaagattttgatttaaacattaaagtagaaaatctaaatagaattaaaataaatacttataaagttataatgtaaacttcttttgctttctgattttaaatgggctcagtcaaatcttaataatatttatcttttccaagagctgtataatgataccaagttaggtcagaatgccgaccacaattataaatgaaaattttctaaatgtaaaagccatgtgaaatcaatattttactccatttctttttaaaagagaataaaataaaataaagtcgcggaggaaatgcacatcgagcacatcactctaattattttatttaacagaaaagacttatttaaacatggtaatgaaaagaaaacattagacgattaatatatggttcgttcttatctaaactctggttattttattaatcttcatttttctgcgaattagatttggatttctattggtcaatgactcgatgcttggtggtcccaaataaaattgtattaaaataattttacgattcatgattgcttccatttcctgtaatttaattaaaatttgtgttcatcaaatattttatacagattgagagaattaaatgaactttcattatattattattagctaaaagagccagaaaaaaaaaaactgaaaagaaaagaatatctagaaattgattttagtaggtcaacattatttatatttaagtaatctaaaacttgtaactgaaaaactacggattagagtttattactgctgttttcaaatgggcataaattagttgggtaagctataattgtgacgaagactttgggaaatgtaaaaggaaagaaatgaatgtaaagcaaacacaaaacaatactccaactaattaaaagggtttgcaaaataaaagcccttcggatttccacaaatacacgaaagaatataaaatggtactgtagtaaattctaacaatcagattggaattcaattttcagaaaacaattttatcgaattaagtgtttaagcacccaccaagtattccatttaattactaatttgttagtaccattttttttgttatgcaccaaattaattacaaaactctataatcatcgacacagtcgacctggtgatctacaaaactttaacttttattccggtataggttttaaaacattgagtaaaagtgaacatgtattaggagattcatgttcgtcgtagataaacttgaccaacactacatattagtatattaccatctcttgactcgttacatgtttaaacatttcaatatacctaggtttttaacccatcatcgatcacgtttatgtcctattgtttgttcagtggaaagaattgggctctatgtcttacattgaaaattgaaagaaatggataaattgggagttagatttagatgttggttcttttaagttattatagttatgcgatttaatacgtttttgctggcctcatatattgttagatgttaaattaatttaaattatttccatactaaatgatttatttatcattttagcagcctagttttacttgtcctttactccaaagcccgattattaattaaggaaaaagtatttttcaactggagaaattgaatatttataaataaaataaagcacacgtaaagaaaatatattttattatttttaagaaaacaatatacgcaggccatctttgtctttcccaaaaaaaatttaattgaattttgtatacccactttaattttgtctactatactatttcttattttattatgtatatttattaattccctcccatcggattccagctaaaaacacgaatatctatatattcctaaatgaaaatttaatataaatccagtgcgagctatattaaaataatcacgctattaaagatttccttttcgcattattgtataaaagtaaaaaaatggacagacataaacaaatcttacaatataaaaaatcattatataaaaagataaaataccttatttaatgacaagataaataaaccattttttatttcttcaatctaattcacaaagcataaataaatctaatttccttcactttcctctccaacattttcttattttccttcctaatttccaacctctgttcttagcaatatattttttctccaaaaataattctcagtttgattttcttcttctagctcttaagtatatttctttgttgttatttatcttttaatcctttaatctcatctttgtttatctttaatcaaaacccaaaatttacatgggttcttgaaaatctagaagaaataaaggaaacataacaaaaatagaaagaaaaagaagctaatggtcttaaatatg

SEQ ID NO: 21301 - DNA, 3003 bp, Unknown; identical to SEQ ID NO: 21300
  misc_feature (1)..( 3003): 2750-1469P.txt file - cDNA_ID_1976665; gDNA_ID_2926154; Annot_ID_139436

SEQ ID NO: 21302 - DNA, 3000 bp, Unknown; identical to SEQ ID NO: 10902
  misc_feature (1)..( 3000): 2750-1469P.txt file - cDNA_ID_1976682; gDNA_ID_2214461; Annot_ID_132991

SEQ ID NO: 21303 - DNA, 3003 bp, Unknown
  misc_feature (1)..( 3003): 2750-1469P.txt file - cDNA_ID_1976682; gDNA_ID_2214711; Annot_ID_189893
tacccttgaagacgttttgtgtactattatgttaacgcgttgaaattaacgatgatgggtattgttacgacgaagacgaagacttatacaactactaacttcgatttctccaataaaggttttggtgttggtggtttgaaacagtttgtgtacggaaacactttcattgttctcgatgctttctgggtttctttctctaatctcttcaggtaaacgtttttgcttcttctttattattctttgttctctgtttttttgagttcttattggttaatgggtttgtttttatttagagttaatccagacaaagagacaagcttggtcttgttcgagaaacagaacacaaaagattcctctgtttttggagatcatcaagatcaaaaccaaatttgtggaacacaagacgatgatcagatggaaagctctctggtttcgattagcaagagatgcgagttttattccgacaacaaaagtatcgttggttttgtagaagaacctaaagcgtttagctttaagtttcatgagtattctgctattactgttcaggaggaggagaagaagaagatggtgagtttctctgatgaaaaaacgagttccatggttttggagaaatcagaatcagatggttttatgaaggaacacgtgaaagaagagatgttggtttatgagttcatgagttgtggtgttttaaaagagtcattggttcacgagaatcttgttggtggtgaagacaacttgtttgatgatgatgatgggtttatagaactaaacccaagtttacagatttcaaactttgcttatggagaagaagaagaagaagagtttatacacagagaagaagagatgaaaatgggctttgatgaacaagaagaggtatatgatgagtttgatgatggttcagattcagatgatgatgagtttgagcatagtgatgtgattgagaagttgaaaacagaattaaggactgcaaggacaggaggattgtgcactattcttgaggaatcagagactccattacaagagctgaaaccactcaagattgaaccaaaaccagatcaacacaaagacagaattgctgaaattcacaaggtttacaagaactacgcggttaaaatgcgaaaactcgatgtcatcgattctcaaacaatgcattccatcagtaagtcaatctattctcaattcaattttcaatcaatgttcttagcagactattacatcattagcaatgacgtatctacagagtcttaaatttttgtctgattccagcttttactttgattgtgaggacatattgttgaagaatgtctctttccttcttaaatgttttctcaactactcaaaagtgttagttgagtatatagttaacatttttggatttgatttaacaggtttgctaaagctaaaagattcatctaaacctagtagaaacactgataaaccgcctaaatcgtctctgcatcagaatatatggccattcaagaaacatacgcttgaatgtgacccgagtgagagacttgtgaaagaagcaagcagagactttgagactgtctatgtaggccaagtttgtctctcgtgggagatgcttcgatggcaatacgacaaagtcttggaatttgattcacaggttactacttatcaatacaacttagtagctggagagtttcagttattccaagttctgcttcaacggtttgtggagaatgaaccgtttcagaactcctctagagttgagacttacttaaagaaccgtcgccatttccagaatttccttcagattccacttgttagaggtaacaaaacatgttttcattattctttatagtatatactgaacctttcttgctaataccataatctgcaaagttttcagatgaccgttcttcgaagaagaaatgtagatatgaaggagaattcgcggtaaagactgaaatgttgagagagattatccgagagtcgatgagtgttttctgggagtttctttgtgcagacaaagacgagtttacttcaatgatgaaagtttctcaccaaactcaagtctctccacaggattctttagaccttgagctcttgacagatatcagaactcatctccaaaaggtatttaaaaacttcaaattcttgctctcattttgtcagattacatcaatgtttaacaattcactcaagaacctgttcttggcctaatgtagaaagagaagaagctaaaggaaatacaaagaagccaaagctgtatagtgaagaagttaaagaagaatgaatcaaagagtagtattggtgtgaaggatgaattactaatagctaaaattgaactgagactggtttcaagagtgatgtacatgtcgaaacttactactgagaagttacattggtgtcaggagaaacttgaaaagatcagcttcaacggtcggaagattcatatggaaccatatttctcgttgttaccttgttgagccatctctgcgtatagattagatcatagatgttggaacaatatggcttcatcagatccaggaagatgtctttttgttgttgttcatatcttcctgagaacaatagtatatctaatgaatgatatgtggtagcttagcgtttttctttctcctctaatcaccacaacatctggaatcacctcgaagaacattttgagaactagaagtaaagttgattaacatttggtacatgaacacaaatcttcttgaacgttgttgaactagtgattactgattaatgaataattaaagaaaagacaaacgttcgaaagatgggcctttgggccaagtcatatttggattattatgtaagcattaacaagcccataaaatgtcgtccattgatgatcataagtcaatatgtaatctgaaccgtccgatctagggctttaggtgttgaagtgaaaaaagaccctatataaagataatatagcttataaagtctcttctctgctccgtcaagctgaggaggataaaaaccctagggtgagtgagacagagagaagcgaaaatg

SEQ ID NO: 21304 - DNA, 3000 bp, Unknown; identical to SEQ ID NO: 10902
  misc_feature (1)..( 3000): 2750-1469P.txt file - cDNA_ID_1976682; gDNA_ID_2214461; Annot_ID_182787

SEQ ID NO: 21305 - DNA, 3003 bp, Unknown
  misc_feature (1)..( 3003): 2750-1469P.txt file - cDNA_ID_1976699; gDNA_ID_2214535; Annot_ID_134362
ggacaaaactactttatataccatttacatatagaatttgctaaaagccttttttttttttaatgtaaaatatatggtttttgtagggttgtgatgcatcgatcttgcttgacaattccacatcattccggactgagaaagatgctgctccgaacgcaaattcggctcgagggtttaatgtcatagatagaatgaaagtagcccttgagagagcttgcccaggaagagtctcttgtgcagatattctcaccatcgcctctcaaatatcagtgcttttggtatataaatatacatacatgacgtatcttttattaaactaatcgaaaatgttatcaattaaaagtctatgttttatatagtcgggaggtccatggtggccggttccgttggggaggagagacagtgtagaagctttcttcgctctggctaatacagctctgccctctccgtttttcaatcttactcaacttaaaacagcctttgctgacgttggcctaaaccgcacttccgatctagttgctctttccggtaaaaaaattcatgttacatcatctaactctaattaagatatgcatgtgtttaaaatgcaattcctttttatatattgatagctagctaagctagacagacacattcctagactaagtctagaatttacatagtaatttgtaagtaataaaattacaatgttaactcaatgttttagattattttgttagagtgatctacaaaatttactttttatgtattttttttctttcttatagatatgatttggtttgagctttgaaattgtcttataatatttaagggttttatttttctacaatgtttgagttcgaattttagcaatatttatttattagaaagtttttgaaggtatatgaattagttaacatgagttaaagatagaaaaacattttcttggaatacatgaccaaatagctgttaagaaaaacatgaccgaatgtaaatgaaaaaaagaaagaaaatctaatcaaatacaaatcatctagcacgtgatttttcaattttaactgagttggtaaacgacaaatcatgtttatctttaaataaaatcactaattccatttatctaaaccttaatgttttgtcaaaacgttttaggtggtcacacatttggaagagcacaatgccagttcgtgacgcctcgtctctacaacttcaatggtacaaacagtccagacccaagtctgaacccaacttaccttgtcgaactccgtcgattgtgtcctcaaaacggaaacggcaccgttctggtcaacttcgatgtcgtgactccagatgctttcgatagtcaatactacaccaaccttcgtaatgggaaaggtcttattcagagtgaccaggaactcttttcgactccaggagccgatacgatccctttagtaaaccaatacagcagcgacatgtccgtgttctttcgagcattcattgacgcaatgattaggatgggaaatcttagacctttgactggaactcaaggagagattagacaaaattgtagggttgtgaatccacgaattagggttgtggagaacgacgatggtgttgtgagttctatctgattatgcatgttgccatgttggggatatatatatggatatgtaagaaagtataaaatgcgcacgtgagaacaatttcgactaataaaagttttcacgagttatgagatttatgaaattggtattaagtacacttacaatgcatatatacgtggtgtttataacacttcaatttctgacatgtattcaagtagcttttgatttaacatcacgtcgaaatttataatatatattcaagcaaattgttgaaataaaatgtcctagtttttgtcagctttcgttacttataaatgagaagaaaagacaaggagctaaactgctaaagtattagattaggttaacttttgttaaccacaaaatctagcacatggacgcgtatgaagttgataaatcatatatgtattaggtaacattgttatttcagattaaattgttttgagcaagaattgtataaaaagtttatcgatttgtgaaggtggcttctgaggctacatttgcgggattcacggggaagagaaggacaaaacataaggaattctatttttcataaaatattaattaggaagatagtttgaaaatgtttgccaattaggaaggacaatccttttagaaggttttccgagatttttttttttgtcttgtatccaattataaatgtacgtacctcgtgtataaattaaaaaaaaaaaagtttaaacattcctttgaaactacaacaaactcatttatacaaatatccgtcccctcaaaaattcagatatatcaacaagaacacgtcacaaataaaacgtaattatggtaacatgatgatattatattttcctacatagacataacttgtgtctaacatgaatcaacaaacatatcttttacgaccctacataatccaaaattgatatcaaatatcgtactaatttcattttccgtaccactgttgaaatttgtgtcgtttataaattatttatcaaacttgaaaaatatctaagaataagaatatattggcggaattgagaaacattagatacgtacgtcgatttgtagtaagtaaaaaatgtaggggagacggttctaaaaagttgtaattgaagttaaaatgatcaatcttacttgatttatcacagcgtcggacaaatacagccaaacactacgagcaagtttaattctgtccaaagaatatatagcacgtcgaaattagtttattttaaattctaattattatttatccttcaaccactctagtaaaacacatggccttaaaaaaagacctaatagtattttttaagaacacaatacctaatagtctaaaataccattaaagaaagactcgaacatctctatatagtgttccttctaggcccttagttaatacacacactcacaactcaaatcatctttttgtctccctcctgaaaaaatg

SEQ ID NO: 21306 - DNA, 3003 bp, Unknown; identical to SEQ ID NO: 21305
  misc_feature (1)..( 3003): 2750-1469P.txt file - cDNA_ID_1976699; gDNA_ID_2214535; Annot_ID_185062

SEQ ID NO: 21307 - DNA, 3000 bp, Unknown
  misc_feature (1)..( 3000): 2750-1469P.txt file - cDNA_ID_1976717; gDNA_ID_2214533; Annot_ID_134327
ccatgaaaatataggctggtataaaatcaattattatgaaaggtatatgagtatttaggatcttacaaaaatatatttcaaatatcttatttaatttgctaatacatatatttagccgagttgtttttagcgatcaaaaccttttttttttccgaacgatcaaaacattataaaactcaaatacttcaaacattataagactttgtgatttgtaagcttatttccaagccgtaatttacatcatttggaaagagaaaaattcgaggcttcacactaccattgctaaaccagcagctaatctggtcaaagagattcaggtcaccatttgtgctaaattagatcgtctagatcgcagcaaaataatattacattcaccttcagctggtccaactcggcagtctcaagaaagacctttcaacctgatttcgatttattcaaccttaaatttcttgggtaactccttcacctatggtcttgtgtttcactttatttctctcttcaaaaaaaaaaatttaagcagtgtaatttcaaatgatgtcttctttagtaaagaaagatgaataaaggttcttaaagataaacaaaaagaaaagaaaggatagttattaggagatttcggggattatgagattgatttgaaaggaaagttaatatcataaaatatattcttattattaaataggtagatttcctattgttccatatgcaaagaacttgttaatcaagttataattttgtataaataagcatattagcctattgaataaaattgagagaaactatatcacttctaaaatttcctccaaacttatcatggttttttctgtcgttataacttcaaatacgatgtagccacatagatgatgaactccaacgggtatatgtggatccaacaaagatgatgacatgatgttgctgtgaattatgagcatgaaccgattgatgatttcgttcacttcacatggtgacataagatgatggagatacacaactactaaagtattttgctatcgaattgataatcttatggcgaggtataaacgccattagtgacccaatagtgggtataaaaactgtgaagatgatttaatgattgtccaatgttatacgtgttaccacgtatgagcttgcggaagagtattagaaaatctcgaagattacgagatcaatttgaaaagaaagttaatattgtaaaatatatgtctattgtgaaataggtatatttcctattgtcccaatataaaaaacttattaatcaaattataactttatataaataagtatattagactattgaataaaattgagaaaaactattctactattaacgttttctctccaaacttatcaatagtctttctattaagcggacctatgactacatgtttgtctaggtgagcctatgcaatttagttaggcttagatatcacccggcagtagctacataactaattgaagtcttttctatgtttcttattactataaatcggtgcgtttaggtttccaactcgggtcatagacggtcgatagtcatgtgaaaatgtttctttccaaataaagggaagttatttcaagtaattttcatgagtactagcataatgtgaaatgtattcaaatatgtgtataattgtagaaaatgttaatgcttaaatcgtaaatgcgtgttggcaaaacagttaagagaaatgaaaaggcagaggaaacgcctcaattatgttttttttttgtataattcaatgtctcctctactaaccatacatgtcttgattctttaatggcgttgtagttttgttatgaatatataagttcactattcaaaatattttaggtgctcattaaaatatcgttgaaattactctattattatgctatttttatataaccattcaaagcattttggccgcacaatttgctcgatttgtgttgtttcttccgtatgaagtgcttttcttcaatccaactgatttgcctacaaataataggggatctcgctggtataattaatgtaatgaaaaaacataaattttatttccaccaactacttttatgacaaaaaaatgaaaaatatagataaacaaaaaatcaaccaattacgttgtataaaatcggtgatggcaattgggaaagaaaagaaaatcggtgatggtggactattttaaattaattaaaaacaatacaaaccggttatttaggtaaaataaatcagagtgatgtgccacttatatttaaattttcctcagctaactaatttctagtactatatattaatactaacctttgattttagatttgctttttcttttattgcgagtttgtcatttttttttaacttcttgtcatttttacatttaattttcttttactactatatactactattagccatcagttttctcctatttagtttttaggataactaaaatttcaagaaatattgtatttggtgcataatacattggggttggtagattctccatagtaagaaatgaatataatttagttggtatacttggtacgtgcaaggaaaaaccaagaaatattcatcttcttatcacaattgcttatattaggaaataaatcagagaaatatattcttaacttacacgaattgaaatggtgaaacaaattatggtaaagttttgttcttcttaaaattttattacttactttagcgtgcgtgtcacacatttctgaccaattttgttttcacttaacaacgtaaccaaaagtattaaacagcaactttaacccaaaaaaacagcaaaattacccattttatccttcaaataaataaaaagttataagaaaacaaaaacaaaaattggagtctttctcattgtcgacacatcttctctctttatataaacaaatctcacaaaccccaaaaattcatcaaaccctttcttcaccacattattttcactgagcgcataacatttttgagacaagagactctctctctctctcttctctctttctctccccctctctccggcgatg

SEQ ID NO: 21308 - DNA, 3000 bp, Unknown; identical to SEQ ID NO: 21307
  misc_feature (1)..( 3000): 2750-1469P.txt file - cDNA_ID_1976717; gDNA_ID_2214533; Annot_ID_185002

SEQ ID NO: 21309 - DNA, 3003 bp, Unknown
  misc_feature (1)..( 3003): 2750-1469P.txt file - cDNA_ID_1976739; gDNA_ID_1620628; Annot_ID_47190
aactcctaatgttatacatgttgtggcagctatcgtcaaaaggcacggcatgggatgagattgacttcgagtttttgggaaatcgcacaggacatccttacactatccacaccaatgtgttcaccggaggtaaaggcgaccgtgagatgcagttccgtctctggttcgatcccactgcggatttccacacctacaccgtccactggaaccctgttaacatcatgtgagtatatagtctatcaggaaaccctaaattgatagtaaattatacaatataatccagtatattaacaaacgttttattaattagttcatttattatcaattggtttttatataataagcttatgaacattgacagcgtctaatctcatatatttcctcttttgatgtgatcccttacattgagcactataaaaaaaaaaaacgagttctcttgacatctatagacatatttgatatatatttcttgacattcatgttggtttcttgtgtctgaagcttccttgtggatgggatcccaattcgggtgttcaagaacaacgagaaaaatggggtggcttaccctaagaaccagccgatgaggatatactcaagcctttgggaagccgatgactgggctacagaaggcggtcgcgtgaagatcgactggagcaacgcaccattcaaggcctcttacagaaacttcaacgaccaaagctcatgcagcaggacatcaagctcaaaatgggtgacttgcgagccaaacagcaactcgtggatgtggacgactctcaatcctgcccagtacggaaaaatgatgtgggtgcaacgagacttcatgatctacaactattgtaccgattttaagagattccctcaaggcctccccaaggagtgtaaactttgattctattatgggaattttcaagcatttttctttccgttttgtttcatcttgtgatgttactttgatttattttgttctttcttttggtgtttctgagatacgatattacatgtatacgtattcttcctgagaaaataagaagttgtattactcgataatacattttatctctcaatgtggtgtgattgtttattgggtttggcgtacaatgaaagctacatcaatgtgctttagaaaaatgcatacgaaaagaaaaacacaacaatcaaaaacccgtgaggtaactaaattatctccatttacaaatatactaacaatactactaatttattgctaagctgtcagctgtcacgaccatgataatgaaaaaaaaaatcatctctgttttcttctaaactttagagtttctcgaattttcacatataataaaaataaccaacagttatggtactctgttgggtgaagatttgctatgtggatatgtaaaatgcttagagtctttacattgtgattttagtggctggttagtggttattaggttattacaaacgcttttatctttgtacatgatcttcttaagtagttacagaaatctcaacttttcttaaactaaacgaatatctttgatttttattttctttacatcactcttattgggtctaactcactgtaaaattcctgcatgtttatattatgaaattgagaaaatagtaaatatatgttttaatttcaaagtttaatgaacgcgttggttggtccaactaactaatagggcccaacattaaagactttaagacccacatttaggaaatgaatttggacagtccaatttaaagcacagaacgtgtctcaatacttattcagtttatttcttcgacaatgatttttcaaactaaattgctatttttgatattcaggatatttcatttcatataattcagttgcattttcaggatttacaaactttgtaattgtctcctcataatgtcactttttccttcattccatccaatttgtcgtcaaagggcaataaaaataataatcacaatgctaaattctgataatcaaatctcaacaaaatatgactcaaatcaaaccctgttgattggaccaacgaattagacacttgagctttagctcctgtgattttaatgtggtatgcttgcagaaaatttcttaccaaaatgtcaactcatctccgagattaagcgtactatttgccaatacccgagtactcggagctaaataatagaaaaagaaaaaaagaatacatatctcatgtccaaacaatattttatatacttatttcatgacaaaaatcaggaacaaattaaaattttacagatataaaataggtccacgcaacaaacacacgttaagtttcattaggtttagattattgaataagatgcagaattgtcattttcaatattgattagtttctggtttaagtcaatatcacctggtttagagccactcgtgacaatgtataaaaaaattacgtaccatctctatatccaaaactagagacagagatgtgtcgaccatgaaactgtcttaagaactatgacaatttggtcataggcatagcctaggcaaaaaaacttcatttaaaaaaaaaagatcaaaatgtttcgattataaaagattcgtaaggttatataaaatacagaaagcatgagatataagttttctcaatattacaaggttattctcaaataattcaaacgaagattctcgtctaactatcacttttagaggataaggacagaaaattaaattagaaagtcctgacggaccaaattcattagacgcagttggctaatcatacattcaatgccaatggagaagtccaactgtatttcatttcaatcttactcatacaactatacaagtgatctgcaaattgccgcgtacatatatgaataagaaaaatacattaaaattttatatccacctgccaaatcctttcaacgccaaaccattcccctatataattatatatacaattacaaattttatgttacagtcttcatttattcgcgtaaagatttcaaaaagtagtgaatatattcttgtaggaagctgcaggggttaaggagagaaaagggatg

SEQ ID NO: 21310 - DNA, 3003 bp, Unknown; identical to SEQ ID NO: 21309
  misc_feature (1)..( 3003): 2750-1469P.txt file - cDNA_ID_1976739; gDNA_ID_2926188; Annot_ID_140869

SEQ ID NO: 21311 - DNA, 3003 bp, Unknown
  misc_feature (1)..( 3003): 2750-1469P.txt file - cDNA_ID_1976743; gDNA_ID_2214576; Annot_ID_135182
atagaaggtagttttggtaagctactggtaatagttttcgtattaatttatactatatatctcgtgtttgtgtaattagaaaacaaacgtatatactgaaacctagacttatccatcacacatatagaaagtcaaatattctatgatgattcttgtgaatgcatgtatgcaacatacacaaatacactcatataaacatgtcttgtttttttgccttgtacgatattctatatggtttatataattctttagggggttcggtcacggtggaggcaaggatttgcaaatcgaggagccaaaagttcaagggaccgtgcgtgagtgaagacaactgtgccaacgtttgccacaccgaaggttttcccgatggtgattgcgacggactcctccggcgttgctactgcaacacacattgctgattctcattacatatatcaaattaaatcaactatatagtaaactaactctatatatttacatgtttattttcttcgatcttattgacgtacactttactttaaattcggttcatgcaacttatgtgaggaaaaaaatcctactatattatttgggaagtacattttaaatataaccttaatttttgtaagaaattacataggtatgccattagaaataaaattttaaagagtaaattaatttatctctttaaggattaaaaaatcaattactaatttaattaattaaatttaattaaaaaacgaaatacattattaattttcaaaaataataaccaatcaaaataaacatataagatttgatatctaaatttttattaatttaatttaattagaaaaacgaaatacattattaatttccaaaagagtaacctattaaaatcaacaaattagatttgatatctaaattatcatattaattttttattaatcattatagttcacttcttatctttatatgattctatttttgcaaaaaataatatcatcattataaaaaataattagagttttttcgcatatctcataatttaaatttttgaaaattgtgaatataaactgttcaatacatgaaaaatattataacgggtgaaaaatagatttaagaaaactttctactgagtaaggggtcatatttgaaatatttatattcaatttcatacatattatattgaaaatttataatcttatatactacaataattaataacatattagattattttatgtgtatgatatgattcaatttttaatacaagatagaaaatcctagaattgacgggtttagatcgatattaatacaagatggtatactacaggtgaaactcttaaattaacaatcaaactacaagtgtataatcttaaacactaaacaatatagataatatcaacaaaacatatacaactcacagtttacttttaatattttatatacaaaatcaattaaatcttaattaaatcttaatcacataaaaattagcacaaaaaaaaaaattcaacaattaaattttttatcaaatctctgtgttatataagttttgatactatattcgaataaagtgtaatataccttttcaatttgtattctttaactaattcaagctaactaatatatttgctaatcttatacctatcaaaaccgactatcgtttcttatctctatagtatttttgcaagacttttttggtggattggggtaaaaatgcattcgggtcatatggtatattcccctattaaataaaaatggtatactcctatgttattagctaaaatgtttagattataattcagagtcatatcattaataaaattaatattaataaaataaatggctttttggcaagacggatttggagtgacgggtttttgaatcaacattaataaaaaagtaaaatataattaatacaccgtttcaatacgggttaaatctttaatttattattttttaagaccactaatattaaacatatcaaatcatcctaatttagaaaagattatataaaaccaaaaatgttatgtggtatgtataatgttactatatataaaatataaatgtattagagaatgatataatttgcaaaacttttatctataaaaaataattcttaaattttaaaaattactactttaaaaaaagaaatcacgggaggggtaaagaaattatagaacgggttttattttggaattgggttatatggtggatgtatttgaatcaatatttataaaattttaaaatattattaatatgctgttttaatagaggttacaacttcgttttttaacaattgtctcatagattcgtggtatagccttacttaataacaattataaagtgtaaaatataaatattttataaaaataaaatttgcaaattttaatatatattacttttaaaaaataaatcgtcctgcggtataccgcgggttaaaatctagttatcatatatagtcgtaatttgtaaacaaattaacaaccaagaaaaagtttattaaagcaaattaacaattactaaacaaagtagtaattaaacacatcctgatttttttaaaaagtatttggagggtcgaatttaataattaatcaggatttcattatgtagcttaattaagatttaagggtgcaaatttaccataaacgtgtaaaatttattattcatctcttgtcattaagtaagatgtataaagaagagaaaaattagaaaagttttattcgttgatcaagacgattatgcattcttctttgttataagttttttccttgttctttaggattaaatactaatttgattatttaattgattggtcagcctttaattacgactgcatctatatgggtaaaggttttaactggttcacgttttgtttctattttttgtaaggccataaattatttatattaatttgtaaaaacaaaaccaaacattttaccaacaaaagaattcatcccctttatatagtgtcatcttcttgatcttcttaactaccattagctttctctaaacatttgtatcttaatctctttaaaaatg

SEQ ID NO: 21312 - DNA, 3003 bp, Unknown; identical to SEQ ID NO: 21311
  misc_feature (1)..( 3003): 2750-1469P.txt file - cDNA_ID_1976743; gDNA_ID_2214576; Annot_ID_186350

SEQ ID NO: 21313 - DNA, 3000 bp, Unknown; identical to SEQ ID NO: 1711
  misc_feature (1)..( 3000): 2750-1469P.txt file - cDNA_ID_1976766; gDNA_ID_1620437; Annot_ID_157046

SEQ ID NO: 21314 - DNA, 3000 bp, Unknown; identical to SEQ ID NO: 5603
  misc_feature (1)..( 3000): 2750-1469P.txt file - cDNA_ID_1976770; gDNA_ID_1620806; Annot_ID_50548

SEQ ID NO: 21315 - DNA, 3000 bp, Unknown; identical to SEQ ID NO: 5603
  misc_feature (1)..( 3000): 2750-1469P.txt file - cDNA_ID_1976770; gDNA_ID_1620806; Annot_ID_168862

SEQ ID NO: 21316 - DNA, 3000 bp, Unknown; identical to SEQ ID NO: 5603
  misc_feature (1)..( 3000): 2750-1469P.txt file - cDNA_ID_1976770; gDNA_ID_2926172; Annot_ID_140162

SEQ ID NO: 21317 - DNA, 3000 bp, Unknown; identical to SEQ ID NO: 5603
  misc_feature (1)..( 3000): 2750-1469P.txt file - cDNA_ID_1976770; gDNA_ID_2926172; Annot_ID_199576

SEQ ID NO: 21318 - DNA, 3003 bp, Unknown
  misc_feature (1)..( 3003): 2750-1469P.txt file - cDNA_ID_1976806; gDNA_ID_1621174; Annot_ID_57302
ttactaagtatctcgacaaagtcagtttcttggagagtgctgattacaggcagtttgagaaagagagagacgctagtttgagaagacacgatgagaccgactcctctaacgttcttctacatctgctgtaagtaatcttgttttctgttctgttagagaagtcttctttagtagactttgtagcattttctcaagtgatttggtcacattctttggcagtgtctaaaccgagtccccgttttcttgattgattcggatttatttcttatgtctctctcgagagagagttcaaaactgagaccatcctctctgaaggccatggccaatgaaatgggcttgcaatgcaacgtaagcccaacttgaatcccacgattctaattcgagccgatatctgaaacaacaattcatttgtgactgcaatctacaccaatctacaccttgttcttgtaaatcgtttgttttcttagtttctacctaatgaagctcatttggtctctatacaacataaatttcttcttttggttttgaaatctaaaacctgaagtaaagcttgattgatttggtttatggattgcaggggaaaaagtggctctctctttaacatttacaaaaaaaaaaaaaagtggctctctacagagttgatagtcgtaaacaagcaagctcgtgttaggttttttctattgttggatggttttgtatcaatgttctcaatattgttttactagataatgaagataacttttatattgtaaatatattaaattcattttgtaattattattttttggacaaatataaatgcatatataagtaaaaatgtgataacacgtttcattgagtgtatatttaaaatgtaattatgcaaaaaaaaaattaaaaaatatttaattagcaatttagaagtttaaacatcaattctgttttgagaaaatagtatagtttatagacatgtagtatagctaatgtttatttcacacatatgccaatttttagtaaataaatcgtgaagtgatcatcaccataaaatctgatggccgcaattcaaacccatgtaatcgaattttgtttctaagatagaatctaacacaaaataaattagtatacatacatgatatattaattttttttttgtaacatgatagattaattaatttaaagataagaaaccacacacataaattatttatagatttttaaaagtttcaatatttattacatagaaacccaaaaaatccatcataaaagcggttatcaggaggcgtgtaaaatttcacttgagcaaatttgttttggttgcagagatttttgcaagcaattctcacaaaaaggaagagttgccgttttagaatctttcatgcactgatttgggacacaatgtttaacacatacttctatcgtactcgcgtatgttgaaactatcatcgttaataaaactacaatcatcaaaacactatatatctttttcattgtttcagttgccattatttgaaaatatgagtttgtgaatgtttgaggtaataaaaatattgtttaggttatatagcaaaaaaaaattaacaagataattagtgttgagttggctttttgtagttttgtactttatatagcaaaagtatttttatccacttaaaattattgattttggaagtatatccgtttcttattaattaaaaagttagttttttttttgtttatgttattagctgtccaaacaatcttgcaatgttaaatcgtcatttaccaaaaaaattgccaaattttcaccattgtcaataataagtcaaatattttataatcttaattcaaaaactatcccctaaaacatgattatataaaaaaaaaatcgtattgatgggtcgagatatttagcattaacttataaaccaaaatgaatttacaggttgatttgatctatttaaatttattggattcataggttgacctaattaatttagctaaataatttatctaacactcaactaattaagacaatagatggtacccataatagattaaatttgagtaacttcaaaagtttctattcagttttttttcttacaatttttttgtggtattaattctaaagcattatcaataatattgtcacatttttaaaaatcttatttcagaaattatcccctaaaaaagattataaactagaaccttttttttgtattgatgggtagagatatgtaatcatttaacttacaaaccaaattgaatttacatgttgatttgatctatttaaatttgatggattcatgggttaacaacaacaagaaaaacaaaattagtttaatattataccacatgtcacgctctagtgagaatgttaagagtttatgtaataacactaacaaattttgtatatttttcctatactataaacatttttaatttttttttttgaatatattaacaacaacaaaattaatagaatgaggttaatagtttaatatattagcattttttatataagaagtaaattttatttatttttgaatatttaacaaaaacaaagtttaataaaattagtttaacagtttaaaatagcaataacaaaagtcgaacataaaaacaattttttttcttacttaatatatatatttcttttttcgataggattaagaacttttgtatttctatttttaaaaatattaacaaaattaagtttaacatcttaagttttaaaaatttggcaaatttttaaattacatatatttttattcttttgtttttgaaaatagggagtaatagttaatgtagttatagactatagagatgcattgtcaacaataaaacgccacgtcgcagcataattaaaatcttttgcacaaaaatgtggttggccttagccttggccctggaattaaaacattatccagaaaatcttacatttccaccaatccttcacttcctttcacgatccaaaacaaaacacaagaaaatgcaacaaaatcttctccatctctgaactcaaaaactcattcactgagaaaaatg

SEQ ID NO: 21319 - DNA, 3000 bp, Unknown; identical to SEQ ID NO: 13058
  misc_feature (1)..( 3000): 2750-1469P.txt file - cDNA_ID_1976820; gDNA_ID_2214594; Annot_ID_135462

SEQ ID NO: 21320 - DNA, 1333 bp, Unknown; identical to SEQ ID NO: 6186
  misc_feature (1)..( 1333): 2750-1469P.txt file - cDNA_ID_1976868; gDNA_ID_1620863; Annot_ID_51296

SEQ ID NO: 21321 - DNA, 3003 bp, Unknown
  misc_feature (1)..( 3003): 2750-1469P.txt file - cDNA_ID_1976868; gDNA_ID_1620422; Annot_ID_156619
cttatttcaccacacaatctctggagaatgttctaaatgagataatttttgtggacgttgtgcaaatatcacacatgacaaaaaaaataaaaattggtataatcgtatgaatgatctttcaaactgtcttttattcgaaagatgattgtatatgtggatagatgtcaacacaccaacaaacattttgatcctatctgtatagcgaacaaaatatttgtgagaatattgaaccaagtcttaacaatgggaagattcatatcttagagatcagtgcaaaatttgagggatcaaaagattaacgtcaagtgtgtcatcagacgaactcctacttttatgatacccataatctttcaatctgttccgatttaaaaattttaaatgtaattactgattgtttgtaattgataataaaaaaaaactatttcatattttcaatttctaacattattgtttattgtttgtaattaataaaagaaaaaaacatttaatagtttttcatttttgacattatactttcttcaaatctaaaactaccaacgatgatatttatattttattaatccatttattctttgatattttcaaaaatgtccattaatgttttcattgttactattactaagtaataaataatataaataaacactgacaaactgaagttacagactataaataatttaccatactaaatgtaacatcaaagctttcatagctcagttggttagagcacccgtttagtaagcgggaggtcttgagttcaactctcaatgaaagcatttttctccttcttcttttttattgaacccataccctcgaaagctttttcttttgttattttttgaagtctatttctcttttcactgtctctcgcaatctccgactctctccttcttatttcgtcgccgtcgctactctttctcgtcggtaagttcccctctgtcatttccttcttctccaacatctaatcttattgtcgattgtgtaaattgctatgttttccagttatttactcgggcacgaaacatgttcgatgaaatgtctcaaagagtatttttttagactcataacgaaactgcttatctctttgcttttgttcgtgattttgtattgcggttctaacgttaatatgaactgggttagctttcaaattgtaaaaaaagtttaccagattcgtctggatctaatgctcatgttttagttttggaataaaaaatgtccagtctttagaaactattgttaaggaaacggaacctagttttggagaatcgttagttagagttgatcgcattgacatagcaaccttaattttatggtctcatagtttgcagattctcgtatttcagaagctactgtatttcaacatcaaagtttgtacctttctatgatgcatttaccattttggctttgaagaagatatatctgaattttgattgaaatgtttacgtttttttgttaaatctatcagactataatgagtgattttgtttcattgtgttgcttacgttaaggtggtatagtgtcaactttcaaggaagatggctagtggtagcctgaagagccttatatcttcagcagtgggtcgaggtgtgaccgaagcaagagcaaggattttcggacatatgcttaacccaacgggacagagatctcctcataagatattaaggaagaagcttattggtgataaggttgcagaatggtatccatacgacatcaagaatgaggatcccaatgtcttggctagagaagaaaaagagtactttcctaaacctctcttttcttgtttactttccaattgattgctttgtttatcatagaaaactctttgagtgggattgagctggaacatgtttccacaagctttttagttcaattgctatttgggggttagtatccaaaatcctagacatgagaaagaaactagatgtagattgtatgagccttcttgtgatttgtggagcttacgcagagtcatgttctttggtttctggtgtaaaatgcaacatagtcacgaactaatcttatttggcaaggatagtactgtctttgaaattcacttacacttggttttatattcactgcttatgttatcattgttttctctctgttgagaggcattttaacttaagtttgggtgttgttgttgtaggcggatatcgaagcttgagatgttgaaacgtcgtgacaaaggaccaccaaagaagggtcatggaaaacgtgctgcgaagcgtaacaagtagaagtaataaccatagctacaaaaaattctctgcactcttagagtcaaactcttctggttgaatcagatagaacttataagtgaaaatttctcctacttaaaactgaattggtttccaatgatgttactatgttgagacatagttgaaagctatttgcttcccttttgactaaaaatgtcaatggcttttgtttctcttctcttactcttttagtctttagagttttttgagattaatattggtgagatgtttgtacttttttgatctagtttttcttatctcgtgatagatttcaaatcctctttgtcagtctttgatgttggattgaaagtgaatttatagatttttaccttttcgaatttaaatattaaggtgactaaatactgaagtggtaggtcggccattctaattctgagtactagttcaactattctgaggtggtaggtcgaccattctaatactgaaatggaacgtgtcacttgttacttgttcttattgagaattgattttttacagggatcctaattaccacggatttacttgaatgagtttagtccatcaaaaagttgaaaaagaaccaaatattaaaagatggttggtgtaacctgtctgcttatataatccacgtgtgaaaaatgcataaaactcaaacgacaacattttgaaaacgatggcaaattcttgaatgattcttctttttatgttccctttttactaaagctaaaaggattcattagcaagtgtttgtgaaagggagagagaaatg

SEQ ID NO: 21322 - DNA, 1333 bp, Unknown; identical to SEQ ID NO: 6186
  misc_feature (1)..( 1333): 2750-1469P.txt file - cDNA_ID_1976868; gDNA_ID_1620863; Annot_ID_170399

SEQ ID NO: 21323 - DNA, 3000 bp, Unknown; identical to SEQ ID NO: 13249
  misc_feature (1)..( 3000): 2750-1469P.txt file - cDNA_ID_1976891; gDNA_ID_2214608; Annot_ID_135703

SEQ ID NO: 21324 - DNA, 3000 bp, Unknown; identical to SEQ ID NO: 13249
  misc_feature (1)..( 3000): 2750-1469P.txt file - cDNA_ID_1976891; gDNA_ID_2214608; Annot_ID_187281

SEQ ID NO: 21325 - DNA, 3003 bp, Unknown
  misc_feature (1)..( 3003): 2750-1469P.txt file - cDNA_ID_1976939; gDNA_ID_2214644; Annot_ID_136332
ggttatttttatgatccttcattcaagctcttcttctttgtctactctttgtttagtgtgatccattgttcatatttcaagctaggttcttttttctgtctagaccgatgcgcttaagaagctctcttcgaggtatcaagttgttgtttccacaggtggaggtgcagttataagacccattaactggtgtgttcccttcatcctgttcaaagtataatgatacaaaactcggttccttgtttaacttgtttggtaatctgatgatattatcaggaagtatatgcataaaggaatcagcatttggctagatgtgcctctagaagcattagcccatagaatcgctgctgttggaactgattcacgaccactgctacacgatgaatcaggagatgcatactcagtggtactgattctgactgttgtacaatcataagccttggatacttcaaacaaaacattcatctttttttctgtttgtgcttgtgaatgaattactcgtaggctttcaaacgtctctcggctatttgggacgagcgcggtgaagcatacacaaacgcaaatgccagagtctccttagaaagtatgtcttcttcatccatcttatctgccatagcctttgttcaatctgtgtaacttcttctggaaattttgctctccttccttgtacgcgaatcatcagatattgcagcaaagcgtggctataaaaatgtctcagatctcacaccaactgaaattgctatcgaggtaagccaggtcctttctcagttacttcatcattaatcatttcaaatcaaactcaacaaagcaaatcactcatcaccaggccttcgagcaagttctgagctttctagagaaagaagaaactatggagatcccagacggcgacctctaatttcccagccttcttttctccgtctcttcatttatctgtttaatcaactaaacgaagcaatcactcatcaccaggccattgagcaagttcagagacaaagaagacctctagttactggttccgggtcattggagcttacacgagcctaattttgactggaactatggtttattgaaagaagattcaatacatgtatatataaaatatatacttttttttttgtttcagtatcatccttcttctcttttccttacaataagaattaagaaaaagtagccgtgtttgttaacatgggccaagaacaagcaaagtgatcattcaaatataaaagtagctttctcatggaatacaacaaagaaatgcacatgcagaagaaagtagatttaactctaaaagtacagaagcaaatctatgaattttactacaccggcaagtgtttcatcttggctcagggcattaagccaagctatactctttgtcgattcactagttccggcaaagtagtctaaaccactatgctcataacaatgattgttgctcacggacatacataacacaaccaataacgatgaatcagaagcagacctgtgtggtatatcatggatgatgaagatatgatgacagtatacatgtatgcatcatcatcaaactgtagctgccaagcaattcacaatggcagattcattaggaaccgtaagcacggtaccagaccattcaatttttccccaaatctccctttctccacgccttccaacatcaatctccgcacaccaaatctccattctcctagaaccaccactaccagctttaccttcccacaaaaccgtaagctttccaccacgattagccattgtagccccacaaagaaactttggaagtgactccacacctttcagctctctccaaatcctctcttttggatcataccctctaatcttccccaagtaatcataacaatacaatatgttctcaatcacacaagctcttcctctccatcccaaatcaagcctcttctcaggcatctcccatttcttttccttgggttcgtaaacaacaccgtttcgatcagccattgcgtaaaccttcccttccataaccgcacttgcgtgcatccatttctcacgaacctccatacctggactagccactggctcccaagtttgagtctttatatcaaacatctctgcccagttaatcgatcgagcccaattatcaactacacatcctccaatcacataaatcttcccatcaattacaccagctgctgcaaattcacgacctactctcatattagagactcgtcgccaagtatgaaatctgcaatcgagaacccacacgctcgaagaaggcacgtctctaatagatccaccgatcacgtaaatctctgaatctaccacaacgtaagcggatccgactagagacggtgaaggacaagatgggattggaacaagcattttcgaattcgttgagttcgataaggttcgatggaggagagtgaaccaacacgcaccagattcaggaggtatacggattgctacgtagaggatgttttcagtggctccgacgagagctctcgtggcgtagagaagaggtgatgttgggagagatcggaaagtcttggagacgagtgagaggattggatagtgacatctagggacgcgagcaaggcaactgagagcaacgtcttctgataacaacggaatcaattgcgccggtgattttgtttccggtggttcgtcgccggagctcgttgtagccgccattgatccgttttgatcagtctttatttccttctcaatttaaaagagaaaattaattttgcaattattcggttcggttcgattcgattaagtcagacaaatccgagaagagaaagttattttagaaactaaaccgtatttaaaccgatatgattgtgccgttatctacaagtgctgacgtggcgggaagcatgatctcgtggtttgaaagaagccacgcgcttcctcgtcttcccttcgtcctccgacgtttccaattgggagaagaagaagacgacgatgaagcatttatctgattctgggtctgttgaaaatcaaaattttcttgagaactttttttgaagagttatg

SEQ ID NO: 21326 - DNA, 3003 bp, Unknown
  misc_feature (1)..( 3003): 2750-1469P.txt file - cDNA_ID_1976954; gDNA_ID_1971815; Annot_ID_58209
atagagaagctttatccatcttagacacattaggaaccacagctcttaaagaatagaatctctgattcaacttctctcttctctgtctctctgcctctacatgattcaaaggctcttctcttccattcgccggttttctccctcgtttcctcggtttcttctccggttcaaccacaactctgttactctcagcttctttagccactgaagcttcaagatcagagtgattcgagtcacatggaagaacagaggtaaaagaaagcatcccttcttcattattcgaaaccggtgatctcttcttattactactatcttcttcttgaccattctcaatcccattcttgaaattcaccatttcacaagatttcagaactttagggttagggttttcaacagagcttccattacaaagcttagaaattggttgagaatcagaattagaagttgagtcatttccaccattattcatcaccggagcagctacaagaccagagtcaacaccattaggttcactaatccacaaacctggatcattctctccttgatctggattcaaattaaacgcccaagaaccaaattcaccaccaccattgttaaaattgaaaaaggtgtcaactttatcaacaagatctgaactttgatgaataatctccgacgaaccaagctcaacgacaccattctctgtcgctacacacaccattgtttgtaacccataaatctgaccttgacgagctctctcacaacttgatccagctaaagcattagaaccagataaccaaatcgtgtctgaatttgagaaagcttgaccaggtaaaccagtacccttgacaaagctctgtgtcattgaaactaagaagaaccattcagtatctgtaacttcttcatctccagcttcatctcctcctcctacaccaccggagattaaagagttgagctctctaatcactctcttacgatgctcttgttcagctgcactagctggatttgatttcttctttctagacttctcttcttctcctttgtaataaccatctccccaacctaacaacactgtgttgttgttgttgttgtcttctccggcgaaaccgtgagatgattgccagaacacggcgtaagtccagttctcgtttgctccttcgattaaagcttggagacgttgctggagattatcttcgttgacttgaggaagaggaggaggaggaagtggaggaaaaagagaagaatgatcggagccgccgccgatgaaagcttccattaccgatgcatcgtcgtcggttgaccagagatttgttgtatccgtttttgattggttgagatggtaatcggttacttgaacattcgtcggagacataacagttctctgacgtagttataaaagagaagactttttgtttttccggtgagagacagaggagagaagtaagttctttaagcaaaatatttgtgtttggtttgattgtttcgggaaaaggaatctgtttatattcattttttttttttaactctaaagaaaaagaaatagtacttttattttcaccaaatatgaattattgattgagttatttctgaagttgggttatatacataacttgattgaaaacaatttttttctgaatagtaattgttttacaagaaaattactaatctatgtaagagaatcggatcaaatttgtcaaggagccttttacatcaaagttgataattaagaacaattaaagaatgaaaatgatatttcacttacaataatgatcttgtctccctcacttttggtattggtgtcaatatctgcttttcttgtgattaatcccatcatttaattcttgtaagcaagtagcatcaattaatttaaacaatgagtttgtagaattgcagttgttctttgaggcaggaaaatatgatttaaagggattaagggagtgttaacaccaaagatttggatacaacatttatatacaaaacctataaagcaaatattgtagacttgtagtttaacattttcttataaacatatttttgttggcttcgttattggacacaactttttgcaatgataaagaacaaaaaaaagacatgggtgattttgatatcaaaggtgaaagagacgcaagagcataaaggaaaataaaaggtatagtattaaaacagaattagatttaattacgaaaattatacgaccacacaaaaataatcacattatgtcgtgtgggtctcgtgtttttagtggccagatttcataatatgctttctttttcagtgagagcaaatgcccaaaaatgttggtctctctatgttcatatccgacgaaactatagtgtctactgtacagtgacatttcggaatcgcataaaagcaaacaaaacaaattaagctgggctttactttatattgggcctcacacattttgggtagttaataaaactagcccgcaaatatttcacatttgacattttttagtgtatggtcaacaacaagtatagcgaaacttttagcatataatatgtgtgagacatattatggaaagaaggcaaaaatgaaaaccgttagttagtttgaaaacctggagttataaaaagtcgtattttaatttactaatacatgttaacttcagatattaaaaacaaatcctgtacgtattaaaccatatgataaacataatattaatacgaaaaatgtataacacacgattagacaaattaggaagtaatctttgaattgaggtttaagaaaaggtgaaaatgataagctttcgtccgttttatatcatccatgttgcttcagaaacggaatttacacactacgtgtcgtttctacgtaatgccattttcgtaatttctagagtttattcagggtgttttcgtcagtctagtcagatcaaatgtttccatcaaacgttagtactgtttcctttagatttacagattttgaagaagaaagatttcaaattaaaaaatctttcaaatttcttcaaggaggtgatcaaattgaacaatttgatctacaatg

SEQ ID NO: 21327 - DNA, 3003 bp, Unknown; identical to SEQ ID NO: 21326
  misc_feature (1)..( 3003): 2750-1469P.txt file - cDNA_ID_1976954; gDNA_ID_2926169; Annot_ID_140036

SEQ ID NO: 21328 - DNA, 3003 bp, Unknown
  misc_feature (1)..( 3003): 2750-1469P.txt file - cDNA_ID_1976972; gDNA_ID_1620842; Annot_ID_50910
ttttcgtaaatggcaaagaataatttatctcgagaatgaggaatataaacaatgactttataatataagtattatactatattatgtataatttaatattgtgtaaactatatataaagtccttttacagcatttaaatatagatatttattgacacactagtgcaacaatggaaatatcttgaattgattaaaaaaagttgttatctatacaatatgaaactctttgtatatcttaggtgcaaaactatttgataatataccgatacatagtataacgatattattggataatcctccaaaactcagctttttgtctcgaaacttaagttataacaaagttaattgaaaataatgagacagtactagagatgtatgataaaccaattaaagttgaaaaagttatattcttatttagctttgccgtcaaaaggtacgataaatggaaaatatgctcttgtcttctgagcctcaaaaccttaagaagattcttacatatcttacatgtcaaagtaaagagatagttggtaacacattcccatgtggtccggaaaacaaaagcttcctttattgttttggaatattaatcagcaactgtgtagtagtattctatgttgcatacgtaaaacatataaataacattataatcatattagtttgaataatagattctaataaaagatgatgtatctttagcctagtgatacgtctaatgatcttaattaaacttgtttaatgtaatgagttaacactcaatattaacaaacaaaaacttcatattctggactacgtatgttatacatatttcaaatatacatcaattgtctattctcaacttattatttatagtctctttgttttcttgacaaattattggtcatatttttctttcacatggttccgaaggttacgttttcatgtatatatacatttgtaaaaaaagtatatatataacatttgtacaaaaagcataaaaaaattaaaatgtttatcccgattgctttttgtttgtcacatcaatatttagtgctctaaatattttggttgagtcacgaaactgtaaattaaaatcgttgaagttgctcaattatatatacgtcaccgaagttgttgtatattaacattgcatgctaaaatatatttcagatgtttaggacacataatgcattttccgtaaaataaagcttaaaaataaattaaaatatggttttataagacactattttatcttcttttttttttttttttttttttttttttttttttgccaaacccctattttatctttttatcttttgaaattttttatgatgtatctatgaaaatgatttgtgactaatgcaccgaggcttcatatgatttcattaatcacatcccatataaaatcacgggttatgttcataatttgtttattcaatattagactactatgtgaacttttagtgaattcacttttttttttatccaatcaaacctctggtttcagaatttagtttccagttttaaacttttttcttgagacgtaaaagctctcatgctttgttgatgatgtagtggtggagaatcgtgatcttcaacactttcatgtaaaaaggcttcatcatcgttaatggcatcttgggtttactcttggctgaatataaaaaagaaataataggattgatatagactctatatattaagaaataaagtaagacagtccacggcaacgcatgtgattataggaaccactatcatgcaacgacgtggatcagtgggaaccgttgctttcgaaagcataagagagacatcaattaattacaaagaaattgtgtaaacacatttatatatatcagtgacatttgagattggttttgacaaagatatacaacttctctcccgacataaatgtctacaagaatacgcaagttaatcatatttggagctctttcatctatagttgtagacaatttgtacactctattagggagttctagacttttgatgaatagaaacattttcagaatttgctttatttttttaatataggaatgtgaatattattttaaatgattcgtttcaaactttggatatatagtcatgtattcttataactagaaacttcgggtatttgggtaaaattttcgattatttggatacaaattcgggtattgggtaaaatttcgggtatttggatataaaccgatctgaaaccgattggatccgaaccgaatccgaaccgagattttctatttaccctattgggtcctagaatagcatatccgacatatccgtattcgaccgattattacccaaacccgaccagcatacctgaataccaagccgtaatttagatatgcaatttataaaggctaaaaaatcgtgaaaaaccattgtgatatattataaattattttttgggagccctaaaaacattacatattttggaagctcgagacaaaagcctttcttttttttaaccctttaggcacggttatatgaatcatatgacatgtaatatagcagtttgtaatagtaccgtcatattgtttaaccttcaaattcaaatatgcatgatttatgttcttgacaaaaatatgtatatttatgcaaaattaaatattcatctataacgatcatattatctatactgttaattttaaaaggatcatatcatctatactgttaatttttaagtgatttttttttataatttggatcccattttatttgctcttaaaaactttggatatacttgatagctttttaacaaacaaaaataaaataaaaagtacttcgagcccacgtaaaatcgaataaacaaaaatttaatttgttgaacaagttggtgttttgaactaaggcccaataatagtaagaatactaaaatgggcttaagccgggtcgtcggatcgggtttaagaaaaaacagggtcgaggtttcaagagaaacccttgttactcaggcgactaaaaccccaaatctcatttgtgtgttcgcctttctctcgtacaagtcaaaatg

SEQ ID NO: 21329 - DNA, 3000 bp, Unknown; identical to SEQ ID NO: 5109
  misc_feature (1)..( 3000): 2750-1469P.txt file - cDNA_ID_1976972; gDNA_ID_1620763; Annot_ID_50073

SEQ ID NO: 21330 - DNA, 3003 bp, Unknown; identical to SEQ ID NO: 21328
  misc_feature (1)..( 3003): 2750-1469P.txt file - cDNA_ID_1976972; gDNA_ID_1620842; Annot_ID_170091

SEQ ID NO: 21331 - DNA, 3000 bp, Unknown; identical to SEQ ID NO: 5109
  misc_feature (1)..( 3000): 2750-1469P.txt file - cDNA_ID_1976972; gDNA_ID_1620763; Annot_ID_167258

SEQ ID NO: 21332 - DNA, 3000 bp, Unknown; identical to SEQ ID NO: 5109
  misc_feature (1)..( 3000): 2750-1469P.txt file - cDNA_ID_1976972; gDNA_ID_2926194; Annot_ID_141197

SEQ ID NO: 21333 - DNA, 3000 bp, Unknown; identical to SEQ ID NO: 5109
  misc_feature (1)..( 3000): 2750-1469P.txt file - cDNA_ID_1976972; gDNA_ID_2926194; Annot_ID_201307

SEQ ID NO: 21334 - DNA, 3003 bp, Unknown
  misc_feature (1)..( 3003): 2750-1469P.txt file - cDNA_ID_1977060; gDNA_ID_2214589; Annot_ID_135393
tttagagaattctggtttcttatgagttaatattgatattggatctttgatctctctctctctcggtttcagaatgtgtaatccggatgttgaatctgaaccaacctttgaatccaagtggaactgcgaacgaagaagtttacaagatcttgatttacgataggttttgtcagaacattctatctccattgacccatgtcaaggatctgcgtaagcatggagttacactcttctttctcatagacaaagatcgacaacctgttcatgatgttcccgctgtctactttgttcaaccaactgaatccaacctccagaggatcatagccgatgcttctagatctctctacgatacctttcatctgaatttctcgtcttcgatccctcgtaagtttcttgaagagctagcttctgggactcttaaatctggttctgttgagaaagtctcgaaagtgcatgatcagtatctggagtttgtgactttggaagataacttgttctcgctggctcagcaatctacctatgttcaaatgaatgacccatcagcaggggagaaagagattaatgagattatcgaaagggtcgctagtggtttgttttgtgtgttggtaacgcttggtgtggttcctgttatccgatgccctagtggtggacctgcagagatggtggcgtctttgttggatcagaaactgagggatcatcttttgtccaagaacaatctgtttactgaaggtggcggtttcatgagctcgtttcagcgtcccctcttgtgcatatttgataggaactttgagctctcggttgggattcagcatgatttcagataccggcctctcgttcacgatgttctcgggttaaagctcaaccaattgaaagtgcagggagagaaaggaccaccgaaatcgtttgagctggacagttcggacccattctggtcagcaaacagtactctggagtttccagatgtcgctgtggagatcgaaacacagttgaacaagtacaagagagacgttgaagaggttaacaagaaaaccggaggtgggagcggcgctgagtttgatgggacagatctgattggaaacatccacaccgagcatctcatgaacactgtgaaatcgctcccggagttaactgagcgaaagaaagtgattgacaaacacaccaatatcgcaacagcgctcttaggacagatcaaggagagatctattgacgctttcactaagaaagaaagcgacatgatgatgaggggcggaatcgacagaactgaacttatggctgctctgaaaggcaaagggacaaagatggacaagctccggtttgcaatcatgtacctgatctccacagaaaccataaaccaatcggaagttgaagcagtggaggcagcattgaatgaagctgaggctgatacaagtgcgtttcagtatgtaaagaaaatcaaatcgttaaacgcatcttttgcagctacatcagcgaattcagctagcagaagcaacattgtagactgggccgagaagctttacggacagtctataagcgcagtgactgcaggagtcaagaatctgttatctagtgatcaacaattggcagtgactcgaacagtcgaagctttaacagaaggaaaaccaaacccggagatcgattcttaccgcttcctggacccaagagctccaaagtcgtctagctccggtggtagccatgtaaaaggaccgttcagagaagctatagtgttcatgatcggtggaggtaactatgttgagtatggaagtttgcaggagttgactcagagacagttaaccgttaaaaacgttatttatggagccactgagattcttaacggaggtgagttggtggagcagcttggacttttgggaaagaagatgggattaggaggtccggtcgcttcaacgtcattgtctggtggtcactgagtgttactcactgttactttcttttttcttttggcttttgagagtttttttttattaatctataaaatataaatccccagtggtgaattatttaacaaacagtttacagtctcgttataacattttctacagaacattttaaggtgtgtttataactccattagttaagattgttaaatggtttttgtcataatctttgaaaaagtaaatgacaattagctaggttgtcattaataataaaaataaataaaaaggtatgaacaaaagtctgaaaaagaaatttgtaatctaacattactaatttctaattaacattttttatgccatttagtacagtgtttttccaaaataaaatatactcctatgatattttgcataagaatatattatactaaaaaagagaagaggaaaaaagcaaaaaatcaaaagaaaaaaaaaaagtaaaggagcaacaaaagcaaagcaggtggtccgttcccatttctctgtaatttgtcttcgtctctaccttccatctctctcacccactctcctcggaaaccacagcgacggacggacggacggacgataaaacttttgcctctaatttgctcctacaaatctggaatcagccggagcgaatctcgaagcttatgatctcgacttgtgaggatcctcttttccttttctttttcttttgtataataataattatctcatccccgatcgatttcgattttcatatggtttctcgccagaaatgatcgattctctcgtttatttcaatagcctcagatgattgaagatgataattcaacagttaataacgcttctcttttttttagtggctttgtgttttgaccagccaatctaaatcactggtcacctttgttttgatctctgttttgttgaatttttgtttcaaacttaaacgaagctaaaaggctaatgggttggtcttaattctgaattttgagagagttttaaaatcatcttttatgagctaagccatgtttgaagctagatctgcctttaactttggttttggttttaaacttttttgtttctaacttgttgtaggctgaagaggctgggaatg

SEQ ID NO: 21335 - DNA, 3003 bp, Unknown; identical to SEQ ID NO: 21334
  misc_feature (1)..( 3003): 2750-1469P.txt file - cDNA_ID_1977060; gDNA_ID_2214589; Annot_ID_186725

SEQ ID NO: 21336 - DNA, 3000 bp, Unknown
  misc_feature (1)..( 3000): 2750-1469P.txt file - cDNA_ID_1977076; gDNA_ID_1620639; Annot_ID_47443
catggtgaagaagaacaaaacactcatttttttcaatagtaatgttttcatattcaaatacttataaaatctttatctcttgtgtaggtttttttataccacaggcttaccaagtgacatagaaatcgaagttgatgatataacatttcatcttcataaggtctcatcttcttctctgtttttttttcttctttcagagtttactcttaaaaactaaaactgatatgttgatcattctttcttcagtttcctctaatgtcaaaaagcaaaaaacttcaccaactaataacagagcaagaacagagtaaagtttattctcacatcaagctcgagaattttccaggaggttcagagattttcgagatggtgataaagataagctacggtttcaaagtcgacatctctgtttccacagctgttccactccgttgcgccgccgagtatctagaaatgacggaagagtactcaccggagaatctcatttcaaaaacagagaagtttctttcagagttcgtcttcactaacgtacaagaatccatcaaagcgttgaaagcttgtgaatcagtctcgtctttagctgaatcactctgtataacggaacagtgtatagactccatcgtcttccaagcttcctcaaccgatccgtcgtcgttttacggttggccaataaacaacggaggtatattcaccgttgaccggaagaaacagagcaaagattcgaaaacagagctttggttcgaagatctaacggagttgagttttccaatcttcagacgtgtgatcttatccatgaagtcgagtgtcctgagtcctgagattgtagagagatctctacttacttacgcgaagaaacacattccaggaatctcgcgttcatcgtcagcatcttcatcttcttcttcttcttccaccaccatagcttccgagaatcaacaaagagaattattagagacgataacttcagatcttccattaactgcgacgactacgagatctctcttcggtttgttacgagccgcgatcattctcaacgcctccgagaattgcaggaagtttctagagaaaaaaatcggatcgaatcttgagaaagctacgcttgatgatcttctcattccaagttactcgtatctcaacgaaacgttatacgatattgatttggtggagagactcttacgtcgttttctcgaaaacgtcgccgtgtcgtcgtcgtcattgacggtggttgggagattgatcgacggagttctcggtgaaattgcatcggacgctaatcttaaaccggaacagttttataatctggcggttttgcttccggttcaagcacgggtttacgatgatggactatacagagccgtcgatatatatttcaaggtaattaattataaaaatttataaaattgtctatggtttggtgctgcccagggtcgaactggagaccttttgcgtgtaaggcaaacgtgataaccactacaccacagcacctgatgattgagttgtgatttttgtttttatagactcattcatggatattggaggaagagaaggagaagatttgtagcgtgatggattgtagaaaactgactgttgaaggatgcacacacgcggcacaaaacgagcgtttaccactacgagccgtcgtacaagttctgtttttggagcagctacagctccggcaagtaatcactgggactttactgacggaggaagacggtgataaaacggtggtggacttgggtagatggaaggaagcggtgaaggagaatcaggtgcttcgtttggatatggatacgatgaggacacgagtgaaccagctagagaaagaatgcttgtacttgaagaaagtgatcgcgaagatcgacaaagaaagtttgttgaaggcgaagcatggggcggggaaatggtcaatcgggaagaagttcggatgcaaattttcggctcaagtttgtgattcacaggaggcaacgatggtcgatagaagatcacgacgttttcttagttagtacataaatcagaatcatcttgtgcttctaaaaattgtatttttacttcttctgtatatcttaaagaaaaagattgatactttagattgaatggaactctaaaacacaccctgatggacttgttattcagagaatcatagtataatgatttagagattatgaatgtaaatttgtaagatgctttaaagtggtgcaagtagagtataaaaccatcttcatcaatagtttatcactaagaaactgttcaatataaaaataaaatatatttaaaaagtatgagagaaagcagaaaaagtctctcaagtgaaaaattatgagaaactaataaaagcatgtgtatatcaattattggttaaattttattttataattaaaaatttaattataaaactaatatttattaaaatactttctttttttaaaaaaattcagaggaataatatcatgttcattgttaatcatatagtttattaatttatttcgatttttcccttggaataatatcattgtttgtactttgtagtagaaaaaattaacaaaatatttcaataatgttgtcatcaaaaactgatttattttttttaaattataatattcggctattgttttttagtttatttatttatttgaccttttgttttttttctccgattatctgaaataattgaggttgggtaacagaacaaaacgcgcaaatcaaaggactaggtcaaccgaataattgtttttgcctgccacatggcggtttaattttcacttcaatactatattattcaaccagataacgacacgtcactaatcacaatcggtttgcggcgataaaccaggaacgattgaagagaagaaaaaaaaaaaacaaatttgggaaagaagcagaagtgtgacaagacgattctggattctggatacagctggaagagaattaaaagaaaaagaaaaacacttccaacgaagaagatcgatttgcttcgagtctctgaaagaagaagaaaaaataatg

SEQ ID NO: 21337 - DNA, 3000 bp, Unknown; identical to SEQ ID NO: 21336
  misc_feature (1)..( 3000): 2750-1469P.txt file - cDNA_ID_1977076; gDNA_ID_1620639; Annot_ID_162982

SEQ ID NO: 21338 - DNA, 3000 bp, Unknown; identical to SEQ ID NO: 8928
  misc_feature (1)..( 3000): 2750-1469P.txt file - cDNA_ID_1977105; gDNA_ID_1971923; Annot_ID_58563

SEQ ID NO: 21339 - DNA, 3000 bp, Unknown; identical to SEQ ID NO: 8928
  misc_feature (1)..( 3000): 2750-1469P.txt file - cDNA_ID_1977105; gDNA_ID_2926219; Annot_ID_142375

SEQ ID NO: 21340 - DNA, 3000 bp, Unknown; identical to SEQ ID NO: 6739
  misc_feature (1)..( 3000): 2750-1469P.txt file - cDNA_ID_1977112; gDNA_ID_1621103; Annot_ID_55930

SEQ ID NO: 21341 - DNA, 3000 bp, Unknown
  misc_feature (1)..( 3000): 2750-1469P.txt file - cDNA_ID_1977135; gDNA_ID_2214541; Annot_ID_134470
aataacataccctttaaacactccaagtgcgcgactcaatttcaccaactgcttcaaacttggtgaagaatcaaggagactaatcatccaacgatgcgcgactcagtttcttgacgggtatgcatgcttaccgggaagagtaatgcctgatgagttcaaccaaagaactagcggtaataattccttgaacattcgtctttcttctgcatccttcaagtttaaagcatgcgtcgtgatttcacctaaccagcaacaacactcatgggaacacactgatatacggtgtatcgtaggcagttacaataaagttatttgcgtagaacacccaaatgaatcgaccagaattcaaaccgaacatttgtgtatatttcatggtagcgtgtctgaagttagcagcaacgaggcattgtttgaattctgcatcgatgcctcgaatcaatttgataacttcaagattctcgaatgtggtgtacgaatcttgactaatgaaccggagagaagcagcaagaagaccgtctctagggggctcaggtcccatgccaaaattttgaaagcttgcttacataaaaggaaacagaaaaaaatgattggttatttactaaaagaggaatttggtttgccaagggataacaggattattgaagtcgatgaggacaacaacaatgatcatacagtgagcttggactcggcatcagacaatgttgaaggaaaggagaaacctatagattgttggagttggctctgcatctgctttgatctatccaatattgtgaggaacatgggaaagcttgtgttgggtaaggaaacgacagaatccatagatggaggagttcttcacgaatacagcactaggaaagatgatgacgtgaccatgggctaatcctgtgtggcgtgggccatctggcatgggtcctaactaactcctatatataatcgaactcattctatttgtaatctcacttttttttttttttttttttttggtaaacattgtaatctcacttttctttcgtattttttgttaaatggtattcaaataataatgtctttcacttttctatggaacgaggattccgatatatatctattgtcttacatcttgctttatttgattaaaattgatacaaagattacatagttatttcttagacatacacatataaccaaaaagtgattaagttttaaagaagaaggtgcaatcaaacaagtgattaaacgccgctttttttggtaagccttacacgctaatagattatcaaatctgttatattccttattagtcttcttccttaaaccgttatgaggattttatctacgctttttagctgaattttggtttatatatttcgaattaaattatattttagatctaattttatattttttataaacaatgttgattttaccatgtgaatatatttatgtgtttatatagaaactaatattaaactaacatttgaaaataaaatgattggaaaatatattttttttttaaaatagaggagagagaatgccattatatggattttgaatgaagtaatcataaaaaatacaaaaaatgttagttttttttctagcaccattgaaaacatattgagcatattaattagaatcaattatgaatttgccattttatgtatttgttgattttggcattttttgaatagtttgcggatttggcctttttcaagcaacacaattatgattaaacatacgttgtatttgttatgtttgggtttagtcggttctatttattattcggttttagtatttggtataaaatacgtaaatttctaagttttaaaatgacaaatttttaattgatttaagtaaaaatggcattttcgtaacaatttttaaaaaaaggcattttctacaagaattcatattaattaagactaattttttccccttccatatagagataccaatactacatacaataaataactttacttatgcaaacatgaaatttttgaattttttcttcctgttatgaattataacattttgtaactctagtaagaaaaacattttgaaattattcaacaagagcgaaatatattttcaaataaatattttcatatgaaaaattttatgaagataaatttccaaaaacaaaattaacttttaaaattgttttctcttaaaaaaaaatcaaattgtatactctggctagaattaatgtcaaattccttaaacttaccaaaaacaaatgtcaaattccttaaaaaatttgttggcccaagtcaaatttaagaggcccatctataattaatattttccaatattttttctcctctattcttctccactgagcggagaaaaaaaaaatcattatcgtccgcgagatatctggtgttcttctcgtacttgcggattcctccgaattgtttcttcacaggttggtttttttgattcgatttcagtttggagtgtttcttctctctattctatagattgtttcttcgatttcaatcgtttggtttttgaatagaaaaccaaagagaagatgattttacttgtttccattgttcttaggttttgggaaaaatcttacgtatttaacatagtgtttcaaatacacagaatctcgaaattgattccgatttatgaggtcatgaatctacaatttcctacctcctgttttaggctttgaacagattaggtttaatatttaagtgaatttgcatcaaattagggaaattttcattgaatccagttaagttcttgtttgcatcaacttgtagtgttatatagtttagctacaaatttgcatcaaattagggatttttcattgaacccagttaagatttttatttacatcatcgtaatgtgtgagctttgttgttatttggtgcttcttgtgcctcttttgctattattcttaaatctcaatgagagaagagtttattttgcagtttattggcgtttctgttggataactttattggcgtttctgttggtttattttgcagtttcttaacgcttggaagtatg

SEQ ID NO: 21342 - DNA, 3003 bp, Unknown
  misc_feature (1)..( 3003): 2750-1469P.txt file - cDNA_ID_1977148; gDNA_ID_1620863; Annot_ID_51295
gaatcagctttccgaggaactaagcgagcgcctcggttctgacttggagcagaataagcggattgcaagcacccttacccttcatgctagcgctttcagagtacctacttctcttgttatatatcatttttctctgcgaagactacgacttaaaacatatttttcctgaaaaatattgcagtcaaaggattcagattctcataagaaatttccttcaaaatcatgtcctatgagatatggagtaaccaagatccaagaagatgcctttaacttgttccaagctgccttacgtgagtacatgggatccttcgggatcaaacctcaaggaaataagctagagacatggaggataacaggtctttctgtttcagcgagtaaaattgttgatataccatctgtaagttcttagagccattaaatgtcttctacttacttatctctttcaaacattggttggtttcttcactgatttggtaggagtgatatcttattactgtagggaacaagctcgatcatgagatattttcaaagtcaacctactgttccttctcgttcagcagatggttgtgttcaaggaaatgtagcgatgactgcttcaggtattctagagtatttctgtatattttcagaactttctacttctcttgattctggtacttaatgtcgtgatctaatctgcaactggtgcagctagcgaaggatgttcagaacagaggtcaacagaaactcaagcagcaatgcctgaagtagacaccggtgtaacttatactttgcctaattttgaaaaccaagataaagacattgatctagtctccgaaaaggtatcagctctcatttccctttactctaaagcatattttaggcctttcttagaggtgtgatctagcaaaaaggctaaacatatttaggctcaattacgttctcagtttcaactttcaaaggagcttctttagtaattataactggtaacgaagtgattggttaggccctgtagtgtttgaatgactcaagagcttatatatatgttcttaaattgtgtatccttgaagaaccaattccacacattccttgtcaggatgttgtctcttgtccatcaaacgaagcaacggatgtttctacccaatcagaatcaaacaaaggcacacagacaaagaaaattgggcggaagatgaacaactcgaaagaaaagaatcgggtacgcaatatattgctttgtttggtgcacgaaaagcttctacctttactgagatttgtttgcttgtttgttctcagggaatgccttcaattgtcgatatctttaagaattacaatgcaacacctccatcaaaacaagagactcaagaagattccacagtgtcatcagccagtaaaagagcaaagttaagtagcagcagccataatagtcaagtgaatcaagaggtagaagagagtagagaaacagattggggatataagactgatgaaatcgatcagtcagttttcgatgaattaccggttgagattcaacgagaactcaggagtttcctacgcaccaataagcagtttaacaccggtaaaagcaaaggtgatggttctacttcaagcattgctcattattttccaccattgaatagatagatctaagctcctttgtctctgttgttgactgtatatagtgtagtccttgtctaccttagatttggtcttgtatcttgagtactacagatatattatgcttaaatcctattaaaaatgtcatttttgagcaatagaaaaactaaatatatatatatcgtctttaaaatccatcgagacctcttgttttttatggtatgcacagtgatagaagggtttttttttttttttggtaaacatgtgaagaagtgatagaaggtttatcagaagtttgtatatctttgctcaaccacggaatctcatgaaatattcaaacatcctacctaattgctctagtttctctagtatgagttctttttggatcaattctatatcaaacgattacattttattttcaaaagtcaaatcaatcgaaatgttaattacaacttcgcctaaatatgacttttttcttaactaacttatttttcatcctactttctagaatagaattctctaatattaattgacctaacataagttttttttttggtaaggaggatttttttttttggtaaggttgaactaccataagtttgtttgctatcaaaacatttttacttcattttgagcgtaaaaacggtaaaaaagaaaacacaaaattcgaaaacctgaaaccgtttttggggttaggacaatactgcaggccactgtcatgccatccaatgggtttactttttattattgttcctcctgtgtgtaaaataccctaaataccctcgaacttgctctccaaaattgcaattaatttacctttaaaagcttaattaagagtgtccgatttctcaagaaatctatctaacaccaagattataatttctattagctgcctaaaatttgtctgtgtgcgcaataatccacacgtacacacgcatctactgtattcgatttcgtctctatatataaaaacacaaagacagtcttcttcgtgatctctcattttactgttgtcttaaagcaaacacaagataagaagaaacaaacaatggcgatttctttcatttagatattttcctcgattcttagcttctgggtacttcaaatctctctctctccttcacgggttcttccaaatttccatactttttaccttgtttcctgcgaaaaaaagctatcttttttttatttgtgaccctacattgatatatgactcaactgctgaaaaattgatactttgcctagattccatcatttattgtttcttgggttaatcaatcaccactttttagcaaaaaccctgaaatcgaatcagttttttctctgtaaatttcatttcttttctgcagaaattagcctatttgagctcagtttcgtgtatttgtgcagattttggtgaaaggatttgaaatg

SEQ ID NO: 21343 - DNA, 3000 bp, Unknown; identical to SEQ ID NO: 1600
  misc_feature (1)..( 3000): 2750-1469P.txt file - cDNA_ID_1977148; gDNA_ID_1620422; Annot_ID_156620

SEQ ID NO: 21344 - DNA, 3003 bp, Unknown; identical to SEQ ID NO: 21342
  misc_feature (1)..( 3003): 2750-1469P.txt file - cDNA_ID_1977148; gDNA_ID_1620863; Annot_ID_170398

SEQ ID NO: 21345 - DNA, 3000 bp, Unknown
  misc_feature (1)..( 3000): 2750-1469P.txt file - cDNA_ID_1977157; gDNA_ID_1621109; Annot_ID_56065
tctatctgtttgtgcatttaggtaaatacatcagtcaatcatcttgtgtttgtaaccaggtatgggacaaaggcgtatcaatgaaggaatacatatcgcagaagtttgagcctagcgaagacgatagagaactttctcgagtgatatctaaagctatcagtcctcgtaaaggttcttctcagacttctagttttggtgcagccacaaacatggcacctgcttcaaattcagcagacaacaaagctcctcttgtagccaacacaaatgaaagtgagttcctcttttattcctcaactattaacaatttgacacacctgcaattgtattctgatgcatttgattctgctgcagttgttgaagcagaaaatcatggaaagatacttcaaccaaactaaagaacagagagtgtttttcattgtttacaaagcctctatgtaagaaagaggctttctatttcaatcctctttttccccctattagttatgttatcataccaaaaccaagattcattttgtctgaagtctgttgtatacatacataagaaattctaatacatcttcttttgttcttttactcattttttggtttttgtttccttccttcttgtagttgacttctgtaataagaagaaaatattgcatcttcataaaaatttgagtatttaattcatccaggtgatcaaagagatgaacctgttcaatgttgcaatataaattacatataactcataatgaaaatcttcattggagactttaaatgccactagtataataaaataccattatcagagatgaaataccattaaataacaagaatggacggtcctggtacaacagttgaccttctcctgaaaagaaagtggtctgctactaatttcccacaacacacaaatcaccaaacagaaacaacgatgacaatagaggactaaaagctgccttgagaatctgcaaaaaatctgacatgtttgcaggtatatttctaagaatgggagcagcattaagatcaatgtatgtgaacagcaagtatgaagaagtacgagaagaatgggaggaagattacagtcctcagaggttttcttacaaagctctctacaaagcaaccaaagggttcaaagagagcgagttattcggtacagaggctaacgggacagtctacaaaggaaagctctcttctaatgcacagattgctgtaaagagagtttctttagatgcagaacaagataccaaacaccttgtttctcagattgttggtattgggaagttaaggcacaagaaccttgtgcagctcttaggatactgcagaagaaaaggtgaattactcttggtctatgattatatgccttatggaaatcttgatgatttcttgtttaatgaggaaaggcctaatctaagttggtcacaaaggtttcatataatcaaaggagttgcttcagctcttctttatttgcatgaacagatcgttcttcaccgagatgtaaaagccgcaaatgtactcttggatgaggatttaaacgggcgactagattacggtctagcaagatttggtacaaacaggaacccaatgctaggaagcgtaggttatgtggctccagagctaataataacaggaatgccgacaaccaaagccgatgtttattcattcggagcattactacttgagtttgcttgtggaagaatgttcattgagtatccagggaagcctgaagagtttaacttaatcagctgggtgtgtcaatgctggaaaagagggaacttggttggcgcccgagacgctagattggaaggagactacgtctgcaaggagatagagatggtactaaagcttggtctactatgtgcacagtacaatccagaggataggcctagtatgtcccaagtggtaaactatcttgaaggaaatgatgttttgcctgagatgcctccagacactcctgggatcagtattccaacaccgtaccatgaagttcttgcgtagcagcacttcgtctagtgcccggcaaaaaacagaacaaatcgcttctctcaacaacctacaaaaatatgaaccaaacaagttaccagaaattatcattggaagaacggtataatttttttcgcaacatttctttactgtttttcctcattctttaactcacaatgtatacattgaaagatcgaatacaaaccctatggccaggacacgacctgtaatgttgtaatggtatgaaaatattcaacaaaagtgttacaattatgtcataaagtagagttttcctataattcttgttagcagttttgtcatcattttgttataagaaataaataaatttgtatatagttcttgttagcagtttttgatttttagcttgttatcactaatacttatgaacaacataatgatttacctgttaatcttgttttgtttccattatcttctagaggtttatgttattgtgtagctccttgtgatccttctgcactgttaccacagccacatgcaaacataagatctcttatttagtctagggttcttctgaattcaatgcatttttgattttccatagggcaataggaaaaattgtgtcagaaaataattgattaattccgttacgacaaaataatagaaaatatgacgaaattattcgcgtatgatgcgatgacgaaacgtatgactttagataaaactatatgggcgttttcagtgaggcccaataattatgggcctagtccatttactttttctattaatatcaacacgtaacatcggaaattgatgagggattactatttacgtccaacattgtttcccttttgaaccacctgaaacgctaagtgaccagagctctgttttgtttctattttcatgactttgtgtgttgtgttgtattgaatgtttctctctccctctctcatcatctaatctcgaatctcaatttcttctttattcttcttcttctctctctcctctgttctatctctttctaacactcaagcctctcacggtcacgggctcacggccatg

SEQ ID NO: 21346 - DNA, 3000 bp, Unknown; identical to SEQ ID NO: 21345
  misc_feature (1)..( 3000): 2750-1469P.txt file - cDNA_ID_1977157; gDNA_ID_1621109; Annot_ID_171747

SEQ ID NO: 21347 - DNA, 3003 bp, Unknown
  misc_feature (1)..( 3003): 2750-1469P.txt file - cDNA_ID_1977166; gDNA_ID_1621093; Annot_ID_55564
actgatcaagatcgatggctttgatagcaactaccattgagttcatcggaatgcatatggccttgtagaccgaagcactaacaccaacgcctatcttgcagatgatctcgtaggcttcagcatcaagagggaactcgagcttgttccgagccataaatagaaagaagatgagtacactcttgcttattgaattgttatgtttttagtggaattgtggtcttttagaggctaatagtaccatgaggctattcatatagggatgaaaaaagaaagagttggtttagcatgtgaacttgaaaaaaaagagagcctttaatgtaaaagcaaaacccttatctcttacttaaaaatatgttgatgaaacaataagatgaagcatgtgaaagagctaactaactaaccttagttaatgagattttacctttggtctttccagggacccaaagggcaaacactatcatttcaacttcaaaccggtaaaggtacaaaaattaaatggagctatgaaaatttattttcatcatttcacagaaatttaaagttctagatttagatatctagactcgttttacaacttttttttcatggcatttctgaagaacttgcatttgcctttgaccacatgagaaggaaacaaagactagagaaaagacgtcagccttcttgacatttggtaaaatgaatgatcaagtattcaaacatcaatatgctaagataaaatcacaatggaacagaacttgttttataagtcttcagggatgtccttgaaacatatactataaagtgggcaaaagacttatgaaacctacttaaacatcagcacttcactgtttactttgtctcacacgtaaagcaaatgcaagtaaatcaatgcagtcaaaactctaagcaacacagccaatcccacagcattaaggtctacttcataagaaacttgtacctgtcagtatgtgtttcttattccatgaactgaagctataccaataatcagtgtgcaccatatcagttggacactttgtcaattcaacacatacacgctttagcctgaacttttctttgatctgaaatatactcacgaactctctgagttttacttcgcatgggctcaatcatattttctgtcttgtgaattatctcttttgacagatgaccctccagaaaactgaacaatgctcctaatgtcatctttcttagatctgtatcaagttcattgttcatatcttcttcaacatgacagcttaaaccctgctctcctgaatcagtaacctcatcattttcaaagctcttcaacggcttctgatccgctttcttgttcttccctttgttctttctggctcgatttagaaccatgtccaattccaaataagaatctccaacaatatcaatcttcttgcttcttgtagccctagtaatcctcttctcctttaaagtctctaccttctctacattaaccactcccaaacaagcttttcctacactttcttcaatcttcttgctcctcgtagccttactgctcactctcttcttcaatcccctccctaaattttcctccaccattgcacaatcctccatttcaaccttaattaagtttacagatgaactctgaatactttcaacattcctaaagcttccatttttctccaccagatcctcttgtaatccatcagtaatccctaatttctccgaatcctcgattttcctaactttcctaaccctagaactcggcttgttctcaaatttcacatccaaacccttttcttcctcagtgatatcccccaaattgatactttctaaaaccctaattcgcttcctcgcattagcctgacgcctattgttcctcgtaagcttcttctcctgaaaatcatcaatcacaaaattcaccaaaatagatgtatactcacctagtttgataacatcgccatctccgagatttaccgacgtctctggatcaagagcattcgaattcaataaagtaccgttggaagatccaagatcttgtattacccaattcccagaatccgattcgatccgaagatgcttagtggagattccagcgtctttaattgcgatttcattaccacgaacgattcgaccaacacgaatcgtagatccaggcttgtaatctagagcatcgccttctcttggacccttgacgaatactaatctcaacgatggcgtaaccattgttaccgtttctctcccaaatgcgaattttgaaattttgatttgtctgacgctccaattattaatgggccttaaatgggcttttatcgtttcgacgataaaacaatttcaaggctaaaagctactattggctaaacaactggcattattgattacccaaacttccagcaacacacgtgaatctctcagcaaacttatctctcccttatccactttttttccaacctttttcccctcacgctcctttaccctcgcgtgtatctcacctcatcatttggatatccactgttaaaattcccttttatattcgaaatcaaccaaatttaaccttactcctataaattaattaggctcttatctacaattgttgcaaatcaacaaaacgtgcttctaatgctaacacaataattgatttttgagtatattcctctacgtagtgaacacgacgcgctaagatctgacgcgtgggatataacttgtcggtcaacgaaagcgccacgtcatcgccactatgcttgtccttatcatttcctttcacccgccaacgtcgtttcaagcacagcaaataatatcagaacacatttttttctttttatgatttaatcaattaaatcaccaaactcaattaaataaaaagaaaaaaattattattatcccttcttcttcttcttcgtcttcgtctttgattctcctgattcatgtcgcttaaatttttagcgatcttcgaatcccattttccttcgggaatctgacattttttctcgggaaatttttttatccaaatcggagtaaagtatcgaatctagagaatccgctatg

SEQ ID NO: 21348 - DNA, 3003 bp, Unknown; identical to SEQ ID NO: 21347
  misc_feature (1)..( 3003): 2750-1469P.txt file - cDNA_ID_1977166; gDNA_ID_2926160; Annot_ID_139674

SEQ ID NO: 21349 - DNA, 3000 bp, Unknown
  misc_feature (1)..( 3000): 2750-1469P.txt file - cDNA_ID_1977174; gDNA_ID_2214511; Annot_ID_133842
ccgtaactcaaaaatgactacatgataacaataattggtctgacaatattaccaatgacatttaatttttagacatcctataaccaaattacttccaaaggaccaaagctaggtcataaatatacatatatacagcttttgttatacttctttctctctttttaagatcactatatacgtatatcataatcacattgattaatcagattttaatagtaaagtgtcatttcaaggtttctattttgtgttcacttatagatgaaaacgtgttgatgatttcacatgcttttttaacttaatttcgcaatgcattgacaaaagcgtcgctcaagttgtggctaacattaaattactttaccaaccattcgattgcctctaactctctcttttttctgctaatatactctaaaactttaacactatatgatttgaacacatgatttttagtcaattagactttggattttagacatgtaagaatttttctaggttagatttatttagttctgatgtaatcttgggtaaaaattgtagtatgaggttaataatcctactatattatttgggaagtacattttaaatgtaaccttaatttttgtaagtaattacataggtatgccattagaaataaaattttaaagagtaaattaatttatctctttaaggattaaaaagtcaaatactcatttaattaattaaatttaattaaaaaacgaaatacattattaatttccaaaaataataaccaatcaaaatcaacatataagatttgatatctaaattttaattaatttaatttaattagaaaaacgaaatacattattaatttccaaaaaagtaaccaattaaaatcaacaaattatatttgatatctaaattatcatattatttttttattaattattatagttcacttctcatctttatatgattttatttttgcggaaaaataatatcatcattataaaagaataattagagttttttcccatatgccataatttgaatttttaaaaacaaatataaactgttcaatacataaaaaaatattataacgggtaaaaaatagatttaagaaaactttctactgagtaacaggtcataatttgaaatatttatattcaatttcatacatattatattgaaaatttataatcttatatattacaataattaataacatattagatgtgattcaatttttaatacaagttggaaatcatagaattgcatgtttagatcgatattaatacaaaatggtatactacaggtgaaactcgtaaattaacaatcaaactacaagtgtataatcttaaacactaaacaatatagataatatcaacaaaacatatacaactcacagtttactatacatttaaaatcaaataaaataatatcaaatatttttaaatcatctttacaataaaaaaatttagtttaactaaaatatatactgcaggttaatatctagattatagggcttattggatctaaagacgggtcatcaaagatttcttaaactgaagcaaaatatattgaatattcaaatatctatctgttaccaaattataaacaaataagtcaatttaatattttatatacaaaatcaattaaatcttaatcacataaaaattagcacaaaaaaagtattcatcaattaaaaaattatcaaatctctgtgttatataagttttgatactatattcgaataaagtgtaatataccttttcaatttgtattctttaactaatttaagctaactaatatatttgctaatcttatacctatcaaaaccgactatcgtttcttatctctatagtatttttgcaagacttttttggtggatttggataaaagtgcattcgggtcatatggtacattctcctataaattaaatatggtgcactcctatgttattagctaaaatgtttagattctaattcagagtcatatcattaataaaattaatattaacaaaataaatagctttttggcaagacggatttggagggacgggtttttgaatcaacattaataaaaaaataaaatataattaatccaccgtttcaatacgggttaaatctttaatttattattttttaagaccactaatattaaacatatcaaatcatcctaatttagaaaaaattatataaaaccaaaaatgttatgtggtatgtataatgttactatatataaaattaaactatagatataaatgtattagagaatgatacaatttgcaaaacttttttatataaaaaattattcttaaatgttaaaaaattactattttttaaaaaaatcacgtgacggtaaaaaaaattacagaacgagttctattttggaattgggttatatggtggatgtatttgaatcaatatttataaaattttaaaatattattaatatgctgttttaataggggttaaaacttcagttttttaacaattatttcatgaattcgtggtataccgttacttaataacaattataaactgtaaaatataaatattttataaaaataaaatttgcaagttttaatatatattacttttaaaaaataaatcgtcccgcggtataccgcgggttaaaatctactaacagtttataaattaaagcacttaaaacaaaacaaaaaaagatgataagaagtagagaaataagaagaaagtcttgactcctttatacttaagtcttaaccaatcaaaatgcacgaaattttgacgtcaaaatataaaagagttcctgaatatcaaattctagctagattccaccatatatgtaaatactaacattcaccgtatacatcattgttttctataaactctttaaagttcttgtcaatgattcgacaaagcattatatgtaatttatgtcgtataagtaaataaaagaaatactcaagaaaaatataaatatgagcttaactataatctaagaaaagcatagtctctctctctctctctctcataatacatagaggagaataaaaaaatg

SEQ ID NO: 21350 - DNA, 3000 bp, Unknown; identical to SEQ ID NO: 21349
  misc_feature (1)..( 3000): 2750-1469P.txt file - cDNA_ID_1977174; gDNA_ID_2214511; Annot_ID_184256

SEQ ID NO: 21351 - DNA, 3000 bp, Unknown; identical to SEQ ID NO: 11691
  misc_feature (1)..( 3000): 2750-1469P.txt file - cDNA_ID_1977311; gDNA_ID_2214510; Annot_ID_133818

SEQ ID NO: 21352 - DNA, 3003 bp, Unknown
  misc_feature (1)..( 3003): 2750-1469P.txt file - cDNA_ID_1977413; gDNA_ID_2214503; Annot_ID_133716
atttgtcgttttggataatactattaattgggaacatattgactaattaattttgataggatattctgtttacttttggttcagtctcaatctttgtcgtccgatccaaatgtcaatccctagtcaaatttgttataatttttccaacaaattttgatgctattttggatgtgacacagaccataccagaatcactaacagcgagactactcaacttgatagcattagatgttcactcaaatcagatcaaagctcttccaaactccattggttgtctctctaagctcaagactctcaatgtctccggcaactttcttgtatcctttcccaaatctatccaacattgcaggtttcaccccataacttccacaaagctctcacaagacaacactcccaacaaagcataattcccatttttgttctctttttttttttttcaggtcattggaagaactaaatgcaaacttcaacaaactaatcagattaccagactccattggttttgaactcaccaatctaaggaagctctctatcaactccaacaagctaattagtcttccaatctccattactcacctcacatctctccgtgtccttgacgcccgtctcaactgcctcatgattctaccggatgatctcgagaatctcatcaacctcgagatcctcaatgtcagccagaatttccagtatctttccgctcttccatcttccattggccttttaatgaacctcattgagctcgatgttagctacaacaagatcactgtcttgccagagtccattggctgcatgagacggttaaggaagctgagtgttgaaggaaacccgcttgtgtcgccacccatagaggtgatggagcagaatttgcaggtggtgagagagtatctgacacagaagatgaatggtggctcaccaaggagtcccagcaaaaagaagtcatggggattcggtaaattggtgaagtatgggacgttcaatggcggatcaagaagctggaatagagaggagagagaagggttcatcatgcctgagtaccgctccatcgacagtcttgcttcgcctaggtattctggaatgttctctccacgtcgtctcttttctccaagaacctatttcagcagataaaacagacaacagccaagagttttcacattcctataagccatgtacacctctgtagcatcaaggccaaaacaatccaattttgtctatcattttaatagtagcatcaaaaaatgtgtaaagagtatttcaatatgttcatcagattctagaattcttgtttttttcatatctatgcttgcaccaggtccctatttgactatttctatacacaccaaattttgttcacgaataaagtttgttctttcagaaaacctacccccttctctgcctgatcctttagctataagcaaaagacttaagatttatacagacaaagaaagcaatacttaaaacctaacatacaaggcctcacattctttaaccgtctagaactcactcagttacatactctgacaattgctgagaggaatcaacaatctttattcctctcttcaatttcacatatagtttgatgatcaaaattcaaaacaatgtacgtcatataactaagtatcaaaactcaattcatagccaaaggagaatattttcactttacaaactcctagttcctctactacaagttaagtctgtctgaagattgaagtccggcacacgaatccacttaaagatctcaacttttcttgacttctgactatagaatttgcacaatgaggcaaagagaactcaattgaacaataattactaggactttaattcaaatccaaagagacatgcttcaaattggtgactacggaactgagttcgaacactaaaaaagacacaacttttcaagtgatcactactcttataagtcaagttcccattacacataatctaaaagctaataaagataaccaggaatcttaatacggataaagagcatactcatgacataagcgatcacaatggaggagacaccagcaacagcataagaagctttaacactcttggctttgttcttatcaagcgctaaatcaagcataacaatcccaattccaccgagaacgaacatgaatccagaagagagaccttcaatgatatattgcccgttaacccgacccgacataaacacaacgggtcgaatagttccagtagtcggatcctgagttgatccgatacccggaggctcgacaattacgtcgtagacgaaaccggagactactaaaaagtaggtaaggagaattagagcgtatacagtcatcggagaaggaagcgtgaacgatggaatcttcagacggaggcgcggtggtcggagaaatgagaatgggacgattcggagaaggtggaatattggatccattgaggattgatctgaaccgtctgatacactggagccggtttgcgaatcggatcttggagccattttatcgaatcctccttggatctcttcctctctcaccctatcgacggaatcaggaagagtttcagaattggctttgtttggaaactaggataaagctatccattacacgaataaacaaacgtctatcaatttccttctttcgattttatccccagaagttatcaaagatgcaaaagagaccactttagttctaacttgtattaaattagaaaattcagactattttcgtaattttgttagaaatttgagactatcttcgtaattttctcacaaaatttcttagtttggacgttctgccgttttaatgtataacaaacgacacgtagttctatcttagattgaaaatccggcaagatttggttgctttaacgaaagtatctatctcccgtcatcttgcttcctcgttaaaggaagcaaaagagtttgatcccgtcgtcgagctttcgaactttcgatcttcagcttttctcaggtgacagacgtcgttgtgattcaaatctttttccggtgaacttaatttcggaggctattcgatg

SEQ ID NO: 21353 - DNA, 3003 bp, Unknown; identical to SEQ ID NO: 21352
  misc_feature (1)..( 3003): 2750-1469P.txt file - cDNA_ID_1977413; gDNA_ID_2214503; Annot_ID_184056

SEQ ID NO: 21354 - DNA, 3003 bp, Unknown
  misc_feature (1)..( 3003): 2750-1469P.txt file - cDNA_ID_1977521; gDNA_ID_1620776; Annot_ID_50291
agcttttttggcttttgagttttaaaaaaaaaagtgtttaaatttcatttgtaactgatcgattttgtcacttctgtgtagattagaggttaaacgattttgattgtaaaggcaacaatgtaatctttttctttttgttgataaaaagtttgtgcattgcatttgcagataatttttttgtagaatttaatctatttttctaatacattaaaaaaaaagcagtgtgagactctttctaaacgaattatatttaacgatcgagattagtttttagtcctgagatcagtgatcaatttaggagagttgactacaatttcaattttacttttgtaattagtgggccttattgttagcccattatatgcttataatgtggttttctgaatacgggggaaattaaagttgactttaactctagacctggtttaggccctctaagaacttgtaacggcccaattagattgctatatattcacgattgtgcagttggaaatattaaaaccaaaaaaaaaaaatagaaaggcgggaaagagagttagttacatcgtcttctccggcgagacaagacgactgcgattggatttctctgaagcgcaggtatataagtgatagatcaccattgatactcttcaagaagatcccattcaattcaagctttatcgagtaagatctttattttattccatggaaaccgatttgagatttacacgaatgatccaaatacgtctcatatcatgcgatttcaagacgaaaatggcgtagttttattcaatcgaaggcaattttgaagatatcaaaaagatcgatgcttcaattgcttgatctctaacgtgtcagtttctttctttttgttcagcgacgatccttcttcagtggccatggtttctggagatacaaaatcggatgcgaacaacgttacttatgggttcgtgaacttttgtatttcccaaagccaattttgtggaaatgagagagatcgatcgatgcttaaagctctgcttcaactaataatgtcaatttctttctctttttttcagagaccttccttcttctccagcggctacggattcttcagaaccttcttcctatgcgttagtgaattttattgtattctttagaaccaatcttttagaattgatctttgcttttctggttatgttttgattgatttgttatctcattttcagtgaacagcttgaaaggctcatgatgatagattcagaagaagaccggggtccctctgggtttgtgaccttctcgattctttaaccaccaatctttgttttctctggtctatctatgttttgatattactctttttttgttggttttgtttcaggtttacgactgatgaattgatctttcaggctttagaaacagtctacgagaatcataatggtcttgatgtcgatgcgattttcacttttatcaaggttaggaggatctctctgtctctataagtatctgtgtttcatggtcatatctcatgagtagtgtatattggttctgaaatgtgagtcaatagcgggattacacaatggaacattaggatctgaaaatttgacttcatgttccatcccctaaaagtcttccttttaaagtcttggttttgttgattcctccgttgttcttgatcaactaaccatcatgttcttgtggttaatataaattgcaggaaaggaacgagttacaggaagattttagggagcggttggaaaaccagctgagatatctagtttctgaaggccaagtatacaaggtaactagtttttcagagttgcctcacactaatgttaagattcagtagttttgtttgatcagttcagaaaaacggaaaaaaaaacttgtaaatgcaggtaggaaacctctacaagatcccccgtggtgtatttgatactccagttgtgtcagtaggagattcaaatcaaagagaaaccatggatccagaagattccacgggcacaaaggcacaagacacaccaagtacttgtgcttctttcgcaccaccaacaacagaagtagatcctcggataatcgcattagcaaaagaagtcgcagaggcagaacacttggagttggaagcaaaagaggcatacgaacttgcagataaacacgcccagttgctaaaattagaaagcaacataaccttgcagttagccgtagaaatccttaatcgatgtaagtaatgtccacctcttaaccttttatcatcatcatcatcactgactttttcatttgatttggtccttgcaggtgctaacggtgaaaagattttcctgctgtaaaagctttgaccttctggtccggttcaaggtggatatattcgatcaccggtttctttttagtgtttttggttttgagtaaaaaaaagagtgtagatatgaaatgtgatttcatttgactaactagtcatagtttgttactttgtggttaaatgattttggttgtgaaggcaacagactattctgttagtttttgttaatacaagtttttacagataatgccaatcttaagaattgaataggtttttctaatacataacataagaaagaaaaaaagaaagtgtgtcatggtgtctttagcaagtatttttaacggtcgagattaatttcaaatactgatcaagaaagaaaaaaattagttatgagaattacaattttataatgggcctcattgtaagcccattataagcttacataggacttttatgagtttttgttctcagtctgtccctttaattgttttttggctcttctatcgcccatcgcttgggagattaaagtctgaactttttgatctcaagcttctccatctctccctcaactcaagctcctggttcggaactatttactttcctatgcgattggttgtttataagttgatttcagagttcggattcttgtactcattagatgtccatataggtcttgtttactggtttaattggggttttatcaaggaaataaagagtgtttagggtttgaatttccgtgtttgcagatg

SEQ ID NO: 21355 - DNA, 3003 bp, Unknown
  misc_feature (1)..( 3003): 2750-1469P.txt file - cDNA_ID_1977553; gDNA_ID_2214482; Annot_ID_133287
atgaacatgcagcagataacattcttacattttgtaacaagaaaatacagtaaaggatatttgtgcatataacggggcagtgtcaagaactgatttgaagactaaattctatttgaaatattgttatttgagagcattttaagtaatggaggtgctatcagatgagcgacagaaaaaaggaaataagaacttgtatttgcttagttgacctatatttcttttgtttagatgtaaatttatatttcacatgactttacacttttacagagaaggaatacaacaaaaactgactttagacttcagatagcatgcatgcttgcgcaagaactaaaaaactaagcaagactgctcttataggtaaggtacttaacaaaagcatgtattctgtttggagactacttggaagagaatattctcatatagctctagttttcctcaatatcgtctcaaatttttagagctcctttacaaaattggtgatcaaatggaaaaaccataagaggatatattcaactatttattattttgtctgtagtatttatctaaataatttatatcaatattaagcattggataatcttaaacatttatttagatatagtttgaacttgtaaacttacacgatttttaaagttcgtaattgaaaaaggagtatacgtccaattgaaaaaacgaaccgaccttctgaaaaaaaaaaaatatatatatatatatatatatatatatatatatatatatcgtgtgatgcaactaccacataaaattactcagattacaaaagaaaaaaagaagacaaaaaacctaaagaagatcgaatacgtaagatggagaaacttggcagagatgatgaattgattgtggacgagtcttcgttgaaatccttctctcttctttgccaaggtaacttcagttacgtctgtctcatgaaggactccaaatctcgacgttgcgcaaagaagtcatcgccgatgcagcacaaacagattctcgagaaggaactccggatcatgcatcgtttccgtgaccatcatcgcatcgtccaagcctcaaacaagtttcacatacaaatcaaaccctctgaatgctacatctatatggagtacgcgtccgaaggtaatctccataagtttatatctggtttggaaggaaaatccgtaccagagtctttggtccaacgcacggctcgtatgatcctagaaggacttgaggctcttcactcccatggttacgttcactgcaatctcaggccatccaacgttctcctcttcccgtccaagactcctggagagccgtgggatctcaagcttgctgatttcggctcatccaaggaacctgattccgattatggttggatgtactttggtacggcgcctaagtacatgccaatagagtcttttgggcctaagggagtgatcatcgatccgagccttgatatatatgctctagggtgtgtggtttatgagatgcttggagctatacctatccaggactactttgacgaatattacgaatggaatctgcgtcgtcatatctctccggaggctagagatttcttaagccggtgcagtaacatgcatccacacaggcccaccgcggcatatctcttgaaccatcctttcattactcaaatacttccatcgccaacaacagaagacaacaaggagatatctaggtcgttgattccaagtttctcgaagcttcttttggcctaatcctctctctatctctcttgtttgcataaaaaaaaagaaaaaaagaaactggatagtgaatttgctatggcaaagcctagccgagatgtaccaaggatcggtttgaccttgggaactcgttaaattgtgtgtgtctttgttttcaataatcgtgaaatcttcattaagtgtaaaagttatacatgattaagcttaaatactagtaaactaaaccaaaactactaaccaaacttaaccacaactaaaccaagtatatacactctaatactccccctcaagatgaaaggaactttcatcttggacttgaaaacccaatgaatatgtgtcctccacaactttttttcaatgagagaagcatcaatggacatgaatatccatggcttgaaactgaaaataaacgttacgagcttccggtggtcttgttagtgatccaaagataaatgtgcttaagcgaccagaatcatcgacatgcgcttgcccaacaaagctaacatcgccacaactaaaccaagtatatacactctaatatttgttctttcgattcatacaaacgagagtcgtgcgtgagagatatgcaatcgagaccaaagtcttcttccgtgataagattatcagatcgatatttctctacaacaagacttccatctggtgatttcattttattacataccgcggagaagaaagatcttatcttatttaagtgttatactttagttaggtttattactcgagtttgtttgttacttgcataacaaaaaattactcttaagtcagtattttttctttgaaaggttttacctttttaccagtgtgaatgtgctgagttcaacactccttcatgtttaatctgagtatattttatattagtcctgcatattttatcggagaatatcttcatatattattattagagtgtacataaaattcaaggtttactctatattactctatccaataatttacatttgtctgttagattttgttggaaaaaaataactgtgatttacataagttttttttttttttttttttaattgatgaaagaagaaaaagaagaagaaagtcttctctagaaacaaaatccaatttttggtcagaatgaaaaagtcactggcaatgtttattaaaaaaaaaaaaaaaaaaaataaagcccaagcccactacatgttaaagcccaagaagtaacaataaagatcagctctcctctatcagagattagacgaatgagatcggcaacaagagcgtaaaccctagcagcagacacaacacgagttcatcgagaagcaagatg

SEQ ID NO: 21356 - DNA, 3003 bp, Unknown; identical to SEQ ID NO: 21355
  misc_feature (1)..( 3003): 2750-1469P.txt file - cDNA_ID_1977553; gDNA_ID_2214482; Annot_ID_183391

SEQ ID NO: 21357 - DNA, 3000 bp, Unknown; identical to SEQ ID NO: 3955
  misc_feature (1)..( 3000): 2750-1469P.txt file - cDNA_ID_1985369; gDNA_ID_1620675; Annot_ID_48234

SEQ ID NO: 21358 - DNA, 3000 bp, Unknown; identical to SEQ ID NO: 3955
  misc_feature (1)..( 3000): 2750-1469P.txt file - cDNA_ID_1985369; gDNA_ID_1620675; Annot_ID_164249

SEQ ID NO: 21359 - DNA, 3003 bp, Unknown
  misc_feature (1)..( 3003): 2750-1469P.txt file - cDNA_ID_1985369; gDNA_ID_2926202; Annot_ID_141569
aagttaagaataattttttagttacataaatatttgtctttaaaattgctcaatccatccatcttctcaaaatatatacagggaaattataggagatggaattagcgcattgttttccaagtgaaatattccaagactcaaataagttaaatgggcttgaaaaaattagcactaaaaggcccacttaacgtcttttcaatttataatttaaagataagtcgaagatataaattgaaaataagttaaatgggcttgttaatgggttaacaacagagacaaaaagccttataacatgtagaagatgaagtccacataattaaattcgtggtttagctttagtttctggaatcttcgtaccaaagtcgccggagatcggaagctaacacgggaagatttagccggaagaaatggcttcgttaggtttcaacctcggcttcaccttctccaatgcacaaattcagcagcatcgaaaagtttccggaggtggaagagctcgcgtaatctcctgtaacagctcttcttcttcttcttctcaagcatcatctcctcaggggatttctgcagtgacgcctcttgagatagagctcgagttcttcggtgtaactctcggcgcgattttctcgtcgattattgatacaattcgtttcaaaactcagaagagacttttcgtttttttctttgcagccgaagccgggtagcgacgggtcatatccggtagataaagcaaaggctgtgagtggagataagcttctcagaagcattatgcaggataacaaaattgaactctacgctgcttacgtgagttatgttgatttctctctctttaattacgaaatttaacttcagattttctcaatcttaatacattgattgatttgatgtttgaactagtttctggaataatttagtagacaatgaaaatatttagttctagattttgatgtgaggagatggtttgttgaaggcttatgtaaactttggattttggtcaatttgtgatgattaggggaaagtgatgaactgtggtggtggaggaagctgtggaacttgcattgtggaggcaagtgacttcatacaatgttaattagattctgattatgaatttatgagctatgattgttctagcattcatggatatcaatggaggaaaatagatttgtgtttggtcttcttatgatgaccagtaactcaaagcaaaaaaatacacatttggtcttcttgtgtgcagatactcgatggcagagatcttctgaatgagagaacagatacagaaaaccggtacctgaaaaaggctagttatttgatcactcctctctatattattgttagattcacaagtttctcattgctagtgtttggaatgggtatgtgcactaacaagatgaatgaaatgttgagcattgtttctggttaaatgtgaatatatgttttgttgtctgatatggttactaagtaacttttcttagatatgcaaattttggataaaataagagccttggctgtttaaatcttaagggttttgttactattgtgcagaagccggaatcttggagactcgcatgtcaaacaatagtagggaacaaagaaaactcaggaaaggtacctactttcatacaccaatttatgcatatgcaaattgcaaacgctaatgtgcccattatttgggatcataagagtttatttttcctttttatgatctttctcattgagaaaagtcggctttggatataggttgtcgtgcagcggattccacagtggaagaagtgaattaatgtaaaggttatttgtctcagatttatgtgtatataacacatctctgtatgaatgttgtctcgtattaatggaagattcgtttgtctagacgtatttttctttagttcttggatatgtggtgccatgatagtgaaatttaagagagaaactatcaactagctcgcatgattgaaatgtttaaaatttgcttaaagatacggtaggagtgaagctggtcagaagattcggtaggaagtgtttttatgatgatctgaaaatcagtagcatgttttacctttttgagctgaaaatggcatttgtttcttaagctttgaaaacgtgtttctaaaaaataagaacttggtttagtattcgaaccgtttctttgacaactttcagatcactttatttatcgaatgtcaccgaagagacaactttcagaacatctaattagattacgcgccgccccgtaaaacaggggtaaagtcaaaaagcaatatcttctcatttttactttttacttttttcttgttgagggaaaatataaagaggaaggagccaaagaaagcatcactatctgaatttttctttgtacatttatttatatataatactagtttttgtgtgattgctgtttggctccgaattttatatccataattttttttttttaatctccccttggttgatcggtgaacacaaaaaaaaaaatctaaaataatcgcaaaatacatttgaagaagctacacgatcaacaacagcaaaggatttcgattgttgaaaaagttgactcttcttaatttgattcgttgtcttggtttctgggttttcttcttcttcttctgcggcgctctccaattttacaccttgcgaccagcgagaaaagaaacaaatttcacccccattgaagaaggtttgtttcccctaattgcttgattttattctgagattaatcccaggcgccaattatatgcttctgttcttctgataaatctttgcccttttacgatttttctttgattttaccctagttttatggtataatctgggtgagtttctttcctttaattcatgtatgattaagcttggattggtcgattctgatgagtcaaaatcttgaaacagacataaattgatgatttttcgtggttgttttaggtcatttgagggtttaagctttctttgtggatttgcaggacctttggttaagctccatggtgtggtatgcgcaaagtggacaatacctagatg

SEQ ID NO: 21360 - DNA, 3003 bp, Unknown; identical to SEQ ID NO: 21359
  misc_feature (1)..( 3003): 2750-1469P.txt file - cDNA_ID_1985369; gDNA_ID_2926202; Annot_ID_201939

SEQ ID NO: 21361 - DNA, 3003 bp, Unknown
  misc_feature (1)..( 3003): 2750-1469P.txt file - cDNA_ID_1985373; gDNA_ID_2214599; Annot_ID_135532
tctaaacgcttaaccaaaccagcctggcgatagatctgagcagcgatttcattgtgaaggagaccggcggcagaaaagaggggaattttctgtcctctagcaatggagttcatgacatcaatggttgaaatgccagtctgaatcatctcttcaggataggttctctcactaggattgatggaacttcctggagagaccaaagatcagaagcctctttagtgagagggaaaagaatgcgtcaagaggaggctaaagtgagtgctcaccagaaatatccaagtaagcctctggcaatataggtggaccattgtcaataggcttccctgaaccattaaagatacggccaagcatatccaatgagacaagggtttttaaaacctatattggcaaaagtgagtgagtaaaccaaatatatcacgcaacaagagaagagagtagtaacatacctcccctgtaaattgaacggtggtgtacttgttgtcaattccagatgttccctcaaagacctagacaagcaccacagtactataaagaaaaggccgtgttgcattattttgaatgaggaaaataatagttggaaacctgaacaacagccttctcgccatcaacttcaagaacttgaccacgtcgagtagttccatccccaagatgtatgttgactatttcttggtatttaggtccctgggaatcccaataaatcaataataatgcatcaagaaaacaagacatagaacaatttcttggtaaatataccttaactttctcaaggataacaagaggtccagcaacaccagagactgttctatactctgcagatgaaatatatatcaaaaagaagaggaagaagatttagcatcctcctacattgcaatgaatgaatgtattcaacaaccaaatagttgtttacccattccgatctccagggcaccttcctccatttcgacattgtttttagcagcacccatttgaagatcggagagactatctcttcttcttttttcttgagagccggctgagatctatcgtcgactatcacttctctgattcaattttattttgttttgtataaaatggacaacaatcagacttgttatgtatataataaaaacacccaaaatttgttgttagtctcttcctctttcaatttacttgtccaaaattgaaataaatattatccgacaatccatatttataaatagtgttgatcctagtatttggttctttgctagtctttgtctctggaagtttgttacttgtcgggttatgtctcccttcccttgtttgggctttagcctatgttgatatactcctatgtatgaagactcatgacattggttagctaggcagtaagatgaaggaaaatttagtcctattacaacttgcctgcagccattagaggaagaaaagatatcttgtctgctaaagagagccgagaaaactgcagaaataacaatggtaagaaatgggatcatgaagaatatttgagaaacaggggaaatatttgacttacttgagaatactactgtatagaagaagctcttgaaatacaggaaacttaaccttaaaacacataaacattttcatccttataggtttcttgcttcataagaaacagagaaaaaatatatgagtacctgtaaatcttcccaggttgtgaagggtttgagtccaagttgatcaaccaaggaaaatatgtttccattcggataccaaaacccttgttgcacagatcacatgtattagttgggtaacgtaaaactaaaaggtaattaaatgggttaccttggaacccaacatcaacaggaccatgaccatcgtcaagaactgtgacatcaaatggagttggagatgagaatatcaaagtgaaagtaaccttggttacaaagatgatgagcggcaccaaaagcagcccagctagaacccacgacaaccaccttcttcttcattttttttttggtttaaaacaaccttcttcttcttatctgaggtggctcctccatcgccttgggctatgatacatagtcttctccggcgcacgggaccttgtactattatcagattcaggctcccacaccacaacatctttactgcctcacaatctttcttcttttgtttccttgtgtttaacttgtgagtaagtgatgtgtgggtgccatggccacaaagacatcataaaccaaattttgtctgtatttttttggttacaaagatgatgagccgcaccaagagcagcccagctagaacccacgacaacaaccttcttcttcttatttgaggtggctcctccatcctccatccccttgggacctagtactattatcggattcaggctcccacaccacaacatctttactaccttacaatctttcttcttctgttttgtttccttgtgtttaacttgtgagtaagtgatgtgtgggtaatgccatagccacaaagacatcataaaccaaattttgtctgtatttttttttacctaaaatatattagcattcattctacaattatgcagttgtttctaatacagtatgcttatttttcagtattactcatagattaaaattaacatttacctcacaaacaattatagaaatagaaagacatggaaaaaaaaaaatagaaagacatggaccacaaaataaataatatgtcgaaaacaaaatatccatttgacatacttatcaaatatcaatttattatcaaagattcaaaagtaattgatgtaagtacaaaaaaattgccgaattcttttgcttccacgcttcgaattgtgtattggacccaaatttatgtgtgtgacacaagataatcgttagtataggtctatctaccgtccgccgtttcaatctgacggctatcgtacaagccgtacaatatagactcaatctaacggtggaaatagaaagatcataaatccctcaaatctcacagttacctcaagtttttttttttttttttgttggtggagacgaacaacaacaacaccaacagaagacagaaatg

SEQ ID NO: 21362 - DNA, 3003 bp, Unknown; identical to SEQ ID NO: 21361
  misc_feature (1)..( 3003): 2750-1469P.txt file - cDNA_ID_1985373; gDNA_ID_2214599; Annot_ID_186996

SEQ ID NO: 21363 - DNA, 3003 bp, Unknown
  misc_feature (1)..( 3003): 2750-1469P.txt file - cDNA_ID_1985415; gDNA_ID_2214555; Annot_ID_134769
gagcagatgggagatgttaaaaagcgtattgaggcgctagaagcttctactgatcagcacattgaagagaaggagattgttgttaatggagaactggtgatgaaccttcttttgaaattggatgctgtcgaggtaatgcatgaaagactaatttcattggttggccgagatagtttatctcagtatgtactgctgtgtaggatttttgctgacagtttcctatactgatgtttatcttccagggattgcatcctagtataagagagttcaggaaagctttggccacagagctctcaagcattcaagacaagcttgactccttgaaaaatagttgcgccagtgcagagaaagaggctgtaaaggaacaagtggaaattaaatctcagcctagtgactctccagtgaacttggagcactcccagctcacagaagagaacaaaatggtatctgacacgaatttagagaaggtacttcgtctgtctcccgaggaacatcctatgagcgtcttgaatagaacagatgaaaaacaggctgaatcggctgctgaaacagaagagggatatggattgtttgaaaccctggcaacggattctaagcaagctactgaaaatgcagcggctgcttcctcgacaacaattccagagaaaattggagaggttgagactgttgttccgggtaatccaccgtcagctgatggaaacggaatgacagtgaccaacgtagaggaaaacaaagccatggtggtggaaagtttggaggagccaataaacgaattgccgcaaatggtggaagagactgaaacaaactccatacgggacccggagaatgctagtgaagtctctgaagccgaaaccaactcatcagaaaatgaaaaccgaaaaggagaagatgatattgtattgcattcagaaaaaaatgtcgagctctcagagctacctgttggagtgattgacgaggaaacacagcctctttcgcaagatccatcgtcatcatatactcgtgaagggaatatgactgcaatggaccctaaaacagcgagccaggaggaaacagaagttgatcactcacccaacaactccaaaggcattggccaacagacttctgagccacaagatgaaaaagaacagtctccagagaccgaagtcattgtgaaagaacagcctctagagacagaagttattttgaacgaacaggctccggaaccggaaatcactgaacctgggatatcaaaagaaaccaaaaagctgatggaggagaaccagcgattcaaggaaacgatggagacgttggttaaggcaggcagagaacaactagaagtcatatcgaaattaaccagtcgggtcaaaagccttgagaagaaactgtcacataagaaaaagacacagatcagacgtcgtgcaagcaaaccaatgtccgtaagtccaaccgatgccgtattatgacccccataaacattgatatgtctcaattcctcatatattgtatccatctccatcctattgagtacagaaaagagaacgagaactcaaaaattgtcttaacgaaaatccaaatatttgcctctctgttttcttcgacgttcatggataacctccttaaacgacccattcgctctgacagattcgactaaattttgtgtcaaggcccaatatataactatataaggcccatacaatgatcaacccattagttatttcaaatgtttttattatttatttcaaatttttgctataggtgtaaatttcatgtattattactttaattacatttaaaatttgtatctttcaaatttgttatgggagaaagaaagagaatgattgtgtggtttgtgcggacatagtgatccttttcatgccataactcactcttcgttttcttctttctcatcgtcacgttaggttgtctctgagccgccaaatattcatctcttgtggtcccgttcacgtcccaacgccatttacactcatctccgtaacctctctcttatgtgctttctcattacaaacaactaaaattctcaaagattaacatgtgcaagagaaataacaagtaatgatatgatctcattctcacctaatctatggttgaaaaaaaggaaatggtgtcagtattagtcataataaagccttggagttgtagactatagcatgaaaggaccaggaatcttcaagcatggttattttctgatacgaatgatttatattttaatcgtttattaacacccatttaacctcataatgactctattagcctactctcaatccccaaatttactagcataattaactaattcaagggattatcttcacccacttgtgtgcatccatcaaaagttaatttcttatcttagaaatacatttcatctaaaccaaacaaatgatatacactctcatttctattcattagtgtcatttctacaattgtagcagtatgttaactactgtaactattgtgatccaaatatacagtaaaaggttgcacctctactgtaactattttaacaagttcgcaaaatgtacataggagaaataggttgatttccatggagaaaagaaaatagtaaaaggtgaaaaaggttcactcacacgcatcctctgtctctgagagatatatttccccttgcagtaaataaaaatctatggctttgttgggaagaagaaaaagtcagagtaaactcgtaatctttgtcgggagagagtaacaggcttttgatgttgtaacattatactactattgttttaaaaagcaaagaattgtagtagtaagaattacaatcatacttaacaacaaatcacgtttttcgggtttttgtataaataaatgataaagcaagatggacaaattttaaggataagccattaataagtgatctgtgaatttttaaggaaaagacgaaagaaacagagagagtcgagacacaactgtctccaagaagacaaccttccacagcttaagggaaacagaggtggaaacagaggtgaaaacagagcgagtaaagagatg

SEQ ID NO: 21364 - DNA, 3000 bp, Unknown; identical to SEQ ID NO: 5279
  misc_feature (1)..( 3000): 2750-1469P.txt file - cDNA_ID_1985438; gDNA_ID_1620776; Annot_ID_50298

SEQ ID NO: 21365 - DNA, 3000 bp, Unknown; identical to SEQ ID NO: 5279
  misc_feature (1)..( 3000): 2750-1469P.txt file - cDNA_ID_1985438; gDNA_ID_1620776; Annot_ID_167735

SEQ ID NO: 21366 - DNA, 3003 bp, Unknown
  misc_feature (1)..( 3003): 2750-1469P.txt file - cDNA_ID_1985614; gDNA_ID_2214700; Annot_ID_136836
tggaaactggatcgtagattcatatacaattgagaatttaagatcatgccaaaggcgattgctgatatcatatttatgtagcttttgtactttttaatagaagtggacacaatactgatatcattagtgaataatcttttcatatctttcagtctaagtatacacaaatatatcgtatatgcataaaacgaatgtctctcattttcgtaggaaagaaaacacaattaaaaagaaatatttttaaaaagcaatgtgaaaagaagttggtaacttgaggttcacgagatccaaatgtggatgaacgttggaacagctaaatccacgtaataaaagaggacgaagcttatgattaaatttggtcagttaagattctcatcctatgcaactacctaatacaatacaattaatttgtctccctcccaaattcattcaaaatttttttttgcttggttataatctatttattttgaatctggtggctataatttttcaaaaatctatgtcaagtaacgtatcttacgaaaaaaaacactgtgattaaattcatcggaattactagtctcatactaaattctacaaatagatatcattttctcttgtaaattacacaacaataacaaaataacaacaaaaatcattattttcttctcgttgcttttattcttacgaactggatactatctttcttatatgtaaaaacaacacgtaatatctaataagtaaagtagggaaagtagacttacttatgttacatagggtcccccttattaggctacatatgtataagcaggaagtagacttggcatttgaaatagacggttgatatctccctgtcactatttatccatccttatgacctttcggcgggaaattcgaaatgacatttgcagattttcttgttttttccttttctttttttgtttgtccactccacttatatctttttttcttttggggtttttaatcgcatcctacaacatatcactcggatagggtaaattgccccaaccaaccattcattattaattaataaacctgacgaggaaaatgaatatattttggtttcaaatgttttgtggaatgaaggcagagagaaagacagcttctgtaaaagcatttgctggcagacacaaccctaaacccaccttcacttgcctcacctcaccactctctcttcctcgcgcgtgtctatcacttccataaactctcattgcccataattgcttgttttctttctatatgccaagcctgataaatctcgtagtaaattacgggaaaaaattggattccacctcacacaataaagcattttacaaaaccagctttatcattgggttttttaacagattatagtattgtgggtgctcttaatatctggtacacaatagtataaggtctatcgacaatacagagtagactccgggagacaagagaagccaactaggggcacattttttgggcgtaactagacattatatattaatttaaaacttttgagtttcttcgttgaaaaacaattatagaatatagttttgtcttcaatataaaatgagaaagaagagaagaagatctgttcccgctcttttgacttaacggtgctgtcgttttcagcaggttaacctcgaccccaccctccatttttcacttccttctttttaaattattttctctatcactaaaaatatcaaaaaggcgggaaaatcacctattatccaattcagtttataaaccggtttcggttccgtcgttaacggctgattcttctgaccaatgaaaactcgtgaagtctgacggagaagaagacggaactgttaaaatccgttacgtcagacggagaggagggagagggacggatgactgaataaatctgccgaatcctgctgaattgccacgtcagctttattcaaaattctctgagtggtcacgagatttctatggactcttttttttttgttaattaaaagtttaaaaccctacaaaataggggtcttcaatggggttaccagaaaaaaccgaacagtcgccgattccttggtttaatctttgaaccgacagtgtgaccttttaattttctaacctttgctatattattatgaaaatcagatgtaattatttagtgccattcattaacgtgattcttacttataattcctctcatgaatactaaatggagtgtatataattatatttagcagtaaaaatgtattgtattgattgttggaaagggaggaaaaaatgatgagaaggatttgcatgaggaaaagagagagaaggcgtaattatcaagtgttcgatacttttgattagcccacacatttataatattttagtgtagtagtgagatttttatttagggttttaattagaacatagtataagacattggagctgtaaatgacaacttgtttgggatttagtgggttccacctgtatttctcatgcccttacacatttccacattaatatctatcttatcttataaaaaaaagttccaaagaaaagagtgagatatacatatattagcaatatgagtttaatgtgccattcaaaataaataaataacattttgaagaatattaagagtctcaattaaaaaatatttaacttgttctttagtgagttacatccatatcttaagagacatgtgaagagttgaatccaaatgataacacaccaaaattgatggtttttaaaaaatgtgaatactattactgtttttttctttggatttccaaggcaaaatagttaagaaaagaccaaaggaaaatagttttgattttcgtccatcacgcattaattacggataattattatattaagaaggaaaaaaaaaaacaaaaaaaagcagaagtgatattaaagtgcttttgagctgtctcgtagaaaccatgaaaccttaataaaagcaaccttgtcttcaacattctccatcttcctcctcacttaatccccaagttcacacttcaaatccactctttctatttctctccttcttcttctatg

SEQ ID NO: 21367 - DNA, 3003 bp, Unknown
  misc_feature (1)..( 3003): 2750-1469P.txt file - cDNA_ID_1985638; gDNA_ID_2214558; Annot_ID_134826
tgaagtcagttgttgactcaaggtttattagaacaaaagtcaggtttttagctcattaaagtcaaccggataaagacgaccggtctaattcggtttgggatttagaaagactctatatcgctcagagggtctaacgcagacgcttttcaactttcgagatatttttcttaggtatatatttccaaatgttacggcgtcgttttcaaaaacatatttttgttgttgcgtagtagtccttcggaaattctttgcttcctagttgaagcactcacaacacacagcttttgtaggaatccctaagcttaaagtctctattattctctaatctcttcttcgccgacgacttctctcaccaaggcgacgttttgatcaggcgatgatgagtatcccaatggagttaatgtctatcagaaaccctaattccaccttgctctatagagctcactctcgtccgcctgtgaagctctgtgctccacctcgttctctcctccctagccgacgccatttcagtgctcctcgagctgttgtttcgtatccaggaatacgtttcggctttacctcgccggaagtcttgcttaatcgatccgtcgttgctttcgctgcatcccacgaggattcggtgagtagtgtggttgtgctcaaaacttctaatttctctgttgggtatctcgaaattcagatgctttatcttgtaaattgcttgaggctagaaaaaaattggactttggtgaaatttatttgattaagcaatataatctgccaatttcaagtgaggtgcaatttggggtttgaaattatcaaatgatctgtgattagctaaagaacatgttttgattattaccctttatcgccattgttcaaatagggagaatcaggtgttgaggtggggaaggagaagagtgatatagatgttgaagatgatacatctaaggaagcatggaaacaaactcttgagtcttttaaagagcaggtatcaaagatgcagagtgtgtcatcggaggcatactccgttaactcccaaaaggcgatgacggtcttgaaagaaacttctgaacaacttaggattcaagcggaaaaggcgaaagaagagttgggtactaaagcgaaagtggttagtgaagagggtagagaatatattttgaaagcagcagaagaatctccatcagatgtgaaagagattgttgaagcatttgcctccactgaggatctgaaaaatgtgtcccgagcgaatgattttcatgttggaataccttatggtaaacatgttgtatatcttgttcatcttttgtaagctttcattgttcgtgagtaacgggataacaatgtttgtatactttacaggtctactcttgcttgtgggtggttttattaacttcatggtatcgggaagcattccggccatcaggtttggagtcattcttggtggagccctttttgcactgagcctggcaagtctaaagtctcataggaaaggagagtcatctacaaagttcttaaaaggacagatgggttagtaaagtttttcaatctgtattaaccctttctcatatcattcacaaaagctagccccagttactgaaatctagttttaacaaccagaattgtgctttgattaggaacggctttgataacccctctgatatgcatattagctaaccatgaatgaattagtttaagttgcattattgatttgtctagaaatgagtcttgttccaatagatacttgttgaatcctagattttgagtttagtcaacaaattaatttttcactaatctgatttttgaggctttccgacattctccggttgagtatagatgtaaagcatgtttagtgacgcttatctgttaccgtgttcttatgttcaacagctatagtggcaatcatatttttgagagagttgcggttgctactgtctcaggtaactttcattgctcaatgttatatttcaaatggtttgaagaatggctttgaatgaaacataattcactctcctttttctctttatagaaatcgacgttcctaggtttttttaccacccttacaaggtacactctgaaaaccatatcattaatcattgtacatttgcaatttgataaatgaaacacgataggaagatgattgatagaagaacctaaactaaaattcaaagagatatctgaatgaaggaagattagtcataccttttgaccaaacttcctgctagattcaaatattccacggggaaaagcaaaacacactttgcatataatggattaattaggattcttatcagaaagaaggcttaaaagtttgttggattactgttgcagtggtggtgtgctagggttttacttgtacaagatggtggtcaagagagaaaagggaccaaccttagaagatggcggagaagatgaatcaagcgatgggtttgtaagaagtgaaggataaagaaaaatggggtaagaggaagaagtgttgtcgtcaacatcagcatcatatatgccaaactcttttgatatctctttttaagttgtgtacaatttttgcgatcaatccttctaatttccgttgtatttggattagtgagtcgtttattaatatcaacaaaccaataaaaacgagaattttattttgtttgtgaaaagcccatcaaactttggcccaataagggcctgggtgagcccaagcttgatgcagtaatatcgggataaggagaaagagagcagaagcgtgaatctagtagtatccatagacctagccacgtgatccaaaccgttgattcttcaaggttttaactgaaaccgttgatcactttgtctcggtcgtataaaataaattaagaacacagtttcagtccgtaatctctatctatcttcttcgtcgtgactcaaacgaggttccgccgattataatccttctctccatacttgagagattttgttggattgttctttgttctgagtcgccttggatctatcggtgttggtgctttgttttttgagctagggattgtcggaacgatg

SEQ ID NO: 21368 - DNA, 3003 bp, Unknown; identical to SEQ ID NO: 21367
  misc_feature (1)..( 3003): 2750-1469P.txt file - cDNA_ID_1985638; gDNA_ID_2214558; Annot_ID_185796

SEQ ID NO: 21369 - DNA, 3003 bp, Unknown
  misc_feature (1)..( 3003): 2750-1469P.txt file - cDNA_ID_1985662; gDNA_ID_1621150; Annot_ID_56863
aagggcagtgcctgtggtagaaagggctacggagagctcttttggttcaaagactgtgtcgtcgttttcgagcagtgaagaagagtcggagtttcatcatgttaatgatggagaagggaagagtagcagtaatgatttaggtgggcatgagacggttgctactaagagtgttggagaagtagaagaagaatatgtgaggaagaaaggagttagctttgagttggatgaaaatgtaactacttcttttgatgttgaatcttccaagattagtagtctatctgcattgtcggttcatgccactagagatcttagagaagttgtgaaggagatcaagagtgagtttgaggttgcttcttcacatgggaaggaagtggctgtgttgcttgaggttagcaagttgccttatcagcagaaaagttcggggctcaaaggtaatgtttttacatgttctgtttgtatctgtgattgcttccttaattgcataaatagctgcattttgaaataacttatacatcagaaaccattttttggagatcaatcttgttacttgtggagatgataatgcattactgcaaatcatttgcagttagattagagctatagctttaaattagcagtaatttggagctcttcatgcaggagaaatatatgtatactctgatagtaatattagtagactttcgtgaattttcttcattttaccttggatctgttcaaattaggaactacatttcgatgtaatgggaagtaatgttgagctcttgttgctttcgattgaactgttatgggctttttcttctctgatggagcttctagattatgaaccatagatttgatttgcgtcacttgagtcttaccttggtgctttttttctaatgatatttacttcattttttctctagtcatcttctcccggatcatgtatctggttgcaccatccacagtttcatcgcgctctcagcctcaaccgtcaatacgtttaacatctaggatattgaaaattgcaaaatcatacaatggtcaggatgttagagaaggcttaactgggaacctctcagcaaccttggagcaactctatgcttgggaaaagaaactgtacaaagaagtcaaggtatgtatgtgtttcttgattttgaatggattaatctccttagattggagcatcttttgacagatgtagttgtttgttgatggcaggatgaagagaagcttcgtgttgtctatgaagaaaagtgcagaacactgaaaaaactggatagtcttggtgcggaatctagcaagattgatactactcgagcagccattagaaagctgctaaccaaactcgacgtctgtataagatctgttgattccatttccagcaggatacataaactgagagacgaagaattacagcctcaactaacacaattgattcacgggtataaattgatctcaattcttttactattcctacatttatatattttcgtttgtgtgatccgatacttgggatttgaaggttgataagaatgtggagatcaatgctcaagtgccaccagaagcagttccaggcaatcatggagagcaaggttcgatctctcagggcaaacaccggcttacaaagagactccggtttgaaagctattcttgatttggagatggagctacgagaatggtgcattagcttcaacgactgggtcaatactcagaaatcatacgtggagtctctaaatggatggctctcaagatgtcttcactatgaacctgaatcaacggaggacggaattgcccctttctctcctagccgtgttggagctccacaggttttcgttatatgcaaagattggcaagaagcaatggcgagaatctctggagagaacgtttcaaacgcaatgcaaggctttgcctcgagtctgcatgaactatgggagagacaagatgaggagcaaaggcagagagtgaaagcagagtatgtgtcacacgatttcgagaaacggttgaatgatcttcggatggagagggcgagagtgagaatgagaaacgatcagctacaagacggtgcatcagagaaaagcgtggtcttgtccgagagcgggatctcggcgttggatgatttgaaagtggacttggattcaatgaggaagaagctagaagaagaaagagcaagacacaaggaaacaattaaacttgtgaacaatgcagcttcaagcagcttacaagctggtttagtaccaatctttgaggctttggggaatttcacttcacaagttgtgaaagctcatgaagatgttaggtttcaacaacaacaacagcctgagtctgaagattgattttgcacgaattaaaaagttttggtaatgaaattagattcggatttaggaaacaaattgttgtacatattttagcatttatatattcattgattggttggctacttgcttgtagattcttaatctttttctattttaaggttctcagatctttaaattaaattacttctgaaatctgaaccttataataatcattaatctatgagaaaattgataataatcgcaagaaaccaaacataattggtcagatttaagatctatgaccatttacttgcacgaagtcacggacctgagatctcacaacaagatcaacgaaagagaagaagccacgtcattgtcgatatcgtgacgcttgtacattggtgcggaacagtgtgtcttcggtttagacaatttttctcttcttaaaattactttttactgctggtaaaatggagtaaataactaaataaattttataacggcctaggtcaaaattatcaagacactgtataaacattaaaattcttgccaaatccctataaactatgacgacgtaatacccaattagagatagccacgtggatgtatgaccaatttaggagcattcagttttcgtgttttgcagtgataaatatctctgagagctaaccccggagagcttacagaattcaagctaaacattgttagagagaaagagagagcgataatg

SEQ ID NO: 21370 - DNA, 3003 bp, Unknown
  misc_feature (1)..( 3003): 2750-1469P.txt file - cDNA_ID_1988779; gDNA_ID_1971786; Annot_ID_58009
tagttttctgtcagcccaatgggtcttaacgattacgtgggtataatattttagccatactaattgtttcgtccaaaattcgtcactaatgccacttgtcaagtagcttaaggcaatgtaacgttacctacaaattagtttaagctaatcatttactacaacttgccattttaacttttgaatcatttaaaccgtgctagagatttttgatgtttcggtccacttttagaaaaaatcatagtaactcggataggtaggatgacatttgattccctgttgattcggatcgctaacactactacttagtgcataaaacattcgcagatccgtgactcaaaaattaaccggaataattgtataaaattaattaatataatccatagtaccataattaaggcttaaaaacactatttaatttataaattatatgtgtgagattttcataaacttcggaaacttatgagcttttacaaaatcatccaaaatctccccaagaacacctacacacgttgaaatttcacttaatttctatcatattacggattgttacacttgagaaaggtaaactttataaaaccttccagtaatagagagttattctctggaaaataagcgtgcatcctgcgaaagaaaaaatcgtcataactaatctcatgtcgttaaggatatatagtctagtgtattaataatacaccacatctttgttccagaaattcctcgtgaccatctattatattgtgcagcttagttatacaccaaactaaagtttatttcagatcaccccaagaccatgaagatttccgaatccgtatcgttacaacttgataacgtaagaatatatacgagtatgcatagtttctttaatttgtatatatattaagcaagatgaatacacaagactttaaaagaaaagggtgttgataataaaaaccaaaaagtctaagaaaaagagtactaatcattaagacatatatatattacatcttaaggagcaataatctttctattcagtatcttgtattggagtttcgtgaaacttagcaataaaagccgtggctctcctatcaatacaaggctcagcaatcgtccaagaacatccatcatcgtcggtggtcatgattcttggtctaacattgatcattctctcttcgttccaattgtctttttccttcgaacaacgcgcaaacaacgattttactacagaaaaagatgatgatgatttcctcctcctcccgtgacctcccattttcatgtatactttgtagagagagagagagagggatggtatatatataactatatattgtgatttgaacaaactcttagattagatttatatagtacagtatgtttaagatatcctaataattaatagtacaagagaataattgtaagttacactggtgtattagttaatgaatcagaaaattgggtttatagaaaccaatagaggtgtaaaataatagtgcgatgtctagagaaaatgtatgggaatgtttagagagattaggaaaagtcttattattcttctttttattgggaggaaaccattaccttatacacttttggcaaggatacatgtaaactcgattcatgtatatatgtagatccatgtgaataacaatggattatctccttgataaaacactaacttacacattatatttataatattaattaagatccaaaaagacccaggttcggccatgaaaaatactattagtccatgtaagttacgtatatatactttaacacaattttataggtatcgaacaaaatgtgtatagtttcgtggggaaaacaaaatgatatataaaaaatagcttaaccaaaggctattgatgagattcgatgctcttgtttttattaatctaagaacgagagtgtagagatacactaagaattcaattgtgattctttaacaaacaaaaaaaaagaattcaattgtgattgtagaaacaacatctttgatttgatcgaatcatattctttttctcttctcaaaatctatttcatattcctttgttttgtttagtttatacatattccatcaattaaaaaagaaaagaattatcgtttttacgttagtttttttttgttttcttacgcattataggcagactgattatagttgcaccggcctatatatgtcccatattctccgtctacccatttgaggatgttttatttagtctcatatatataggaacttgtcgtcggataaagagatgaatacatctgaattacccgtttagatactgcattcagataaccttgacaatgttttgctcatccttgatatcttgtgtttagcttcttactttttcctgaaagctctttctttaattacttacttcgatactctattgcataatccaatcctctgaaaccctctttattgttcagatagccaactagttgcccaatttggtgccttgatagtatatggattaaagtctatgataactccgagtacactatcacttgataattatattgcatcgcatacatgtactttattattattccatctcttcaacaaagaatatcattttttaaagttaatttttgttttctgttgtcacttgttagttgttagtttgttactccccaattacttcattaacccgttcactataatgggaaaaaaaaaaagagttattactaatgggcctttacggtagcccattagaggagctcaactttcactttcggcctattaaaccaaactgacaataacgtctccaacgtgtcaaaactatatgactttggtccgaaagactctcaccaacgcccaattataaagtgtttttggacataaaaggtctcagtcaagtaaacgtctttcacgcacctacgcaaaaaacccatttcatcgaaatttccacttgacgttaatcccaactaccaccaattcaatccatttctcaaactctcttatcatctctaacacacccaccctacctacctccatctctctctctgcaacagagcacaaaaatg

SEQ ID NO: 21371 - DNA, 3003 bp, Unknown; identical to SEQ ID NO: 21370
  misc_feature (1)..( 3003): 2750-1469P.txt file - cDNA_ID_1988779; gDNA_ID_1971786; Annot_ID_175484

SEQ ID NO: 21372 - DNA, 3000 bp, Unknown; identical to SEQ ID NO: 6803
  misc_feature (1)..( 3000): 2750-1469P.txt file - cDNA_ID_1988780; gDNA_ID_1621106; Annot_ID_55980

SEQ ID NO: 21373 - DNA, 3000 bp, Unknown; identical to SEQ ID NO: 6803
  misc_feature (1)..( 3000): 2750-1469P.txt file - cDNA_ID_1988780; gDNA_ID_1621106; Annot_ID_171584

SEQ ID NO: 21374 - DNA, 3000 bp, Unknown; identical to SEQ ID NO: 8677
  misc_feature (1)..( 3000): 2750-1469P.txt file - cDNA_ID_1988781; gDNA_ID_1971851; Annot_ID_58399

SEQ ID NO: 21375 - DNA, 3000 bp, Unknown; identical to SEQ ID NO: 8677
  misc_feature (1)..( 3000): 2750-1469P.txt file - cDNA_ID_1988781; gDNA_ID_1971851; Annot_ID_176377

SEQ ID NO: 21376 - DNA, 3000 bp, Unknown; identical to SEQ ID NO: 8677
  misc_feature (1)..( 3000): 2750-1469P.txt file - cDNA_ID_1988781; gDNA_ID_2926179; Annot_ID_140485

SEQ ID NO: 21377 - DNA, 3000 bp, Unknown; identical to SEQ ID NO: 8677
  misc_feature (1)..( 3000): 2750-1469P.txt file - cDNA_ID_1988781; gDNA_ID_2926179; Annot_ID_200097

SEQ ID NO: 21378 - DNA, 3003 bp, Unknown
  misc_feature (1)..( 3003): 2750-1469P.txt file - cDNA_ID_1988785; gDNA_ID_1620835; Annot_ID_57971
gtttttaagtcatccgatccctttcataaatatcagcaagttttgacgtatgacaattttttattgttcatgtaattacaaacaattaaagtgggatcgttttaccaaattttgtttttactaaaacgtgtatgctgacagaaaatctgtcaatgtaatacttgtattcgaataattaaactactaaaacgtgtacattgaaagagaatatgttttactttcatgctggtatccaataatctctatggtaattggtcggtaattttagtaagtttttaacgtgtggaactaatttaacatttcttcctttggttttagaagtaaagcatgaattataagttaaagatataggcgttttgcgactcaacaagtaatcacccactcacagcattagtaacaaactctgagattcttctctataaatatcacttgtgtgtgttcaagttaaagaagaagaaaatggagaataagaaagaaaagaaaagaaaaagaaaaatggagaattcaagttccgaaacacttcatgttgaagatttacaaacggagataatgtcatggctgcctctgaaaagcttgttgagattcgtcatcgtctcaaagaaatgggcatctattatccgtggagaacaattcaaagctctttacttgcgtcgatcgatgacaaggcctcggctgatgttcatggtccgacgaattgcaaccctaccacccgaacctgagatggtgtggtttcagtctttttgtaaagaggaaagatgtattcccggccaactcgaagttgagttcttgtttcactctgtttatcaagaaaagataccgtatttttcatctggtcaacagcagttgcgtgttcctcctaatacaaactatacgtctgtttctcaacccatcggaggtttgatctgtcttcagtcagaaactaagtttgcgctttgcaatccgggtacgaaaaagtctcgggctttacctgatatccaagcacatgaaaaagcttttataacaagttttttaggatacgatgaagctacgaacgtattcaaggtgttatgtttgacgatggtatgggcccatgaaccatcaaaacgagtttatgagtatcaagtcttgacggtggaatccggtgtagagtcttgttcttggagagggatcacatgtaaggagaaggatcacacaccagaaactcaaggactatgtaaaggaggggttttgtactatggagctcggtccactagtgaccatcgacctctggtaatgagctttaatgtgaggtctcaagagtttaccgccattgaacttcctgatcaactacatattagttatttttggaattttgtgatttacaatggggatattgccttagtgaacgaatctgactttgaccctagagttgtgaatgaaccgaatgggaataaagtttttcacatatgggttagggatgcaactgcacaagaatggcagagaacccgcatcgagattcctcgttgggaacaaaatgttggacatgtggactatgttttcagaggtaccactggaacaaaagaacttgttttcgcccaagactctcgccattgcgaagatgatttctttgtgttgtattacgatacattcacaaaagatctcagaagatttcagattggagtgactggccctaaaatttctgttcgaacctgcttggatcatgttgatagcctttggcttatgtgaagaccaagatctcagtctctcttcttgatttatgctaaatattaatgttgtctctatagtagtaatatcttattttagttttcatttcattaatctttatttatgctaaataataatgttgtttctcaagtagtgctatcttattgccattgggatggtttgttttcatttctactgtcgtttatctttatttatgctaaaataataatatgtttgttctattcagattataacttcaataacatttctaatttctatatatatatactcactatttctcaagctctgagagccttttcatgaaaccaagggggttccattccaaaaataaaaaagaattgagtacagaacaacgttgtaagatatgcaagaataaagcatggaagcaaatattagccagaaagatcaacccagagtcgagatgaaaaaaatgttccaagtaagaaatcaaacattcatatataatacttgttcagataatcaatagaaacaatggtaagaaaaagtaccatataaagtctctcaatcttcgctataacagagttaagacgattaggatgaggtttaattcaccatttcattctctgtttgtgccccctgcatttgatatatagcaaaatcattagacaatgataaatatccacattgaaatcactatacagctttagttttgtttcagtttcaagagttagtttattgaaaccctagctccaaactcaatgtcaagaaataaattttccaatttcagctctcggaatgatacaatacaaaaattgttctaacagagacagagaaatgaatacgtgagaatatgcatgtagcagctaagaactcaccgcaccggtgcaaggcgaaactcgaggttaggaagccgaaacgaacaagccgccgttttccttgctagcctcatccataagcttcttccatgatacgagcgtggtggtctcctattggagaagttcgactttaagtactttccgatcaccggcagtcaatatctctgacgagattttacacgattcgccgaaagttggaccgtcatcggttgggaccgggtcagagttagactctgtagagacccgaatcggagaggaagtgaaggcccatgaataagcccatacaattacaattccaaggaaaagaagtatacaaagacacgttttggagctgcgtaaactgtccccataatcctttgccatcaacaacttcgattccggggactacaagcctctgtcttctctctcgtttagggttttattccaaaattccgtgcttcgatcccgaagatcagaaaaaatg

SEQ ID NO: 21379 - DNA, 3000 bp, Unknown; identical to SEQ ID NO: 5975
  misc_feature (1)..( 3000): 2750-1469P.txt file - cDNA_ID_1988786; gDNA_ID_1620834; Annot_ID_57921

SEQ ID NO: 21380 - DNA, 3003 bp, Unknown
  misc_feature (1)..( 3003): 2750-1469P.txt file - cDNA_ID_1988786; gDNA_ID_2684203; Annot_ID_191281
agcgatctggttcgtgactttatgaacgaggaatattctcaagaggtaaggctctcttctctataatctgttccctttaaccccctcataagctatatttttaagttgtgacttgattgattctcattttgcacgtaggctccatttcgacttgtttgtataacgaaatactcaattgcttctaccaacaatatgcgaacctcatggagggaacctatgaggatcaaactacctaagattaaagctgcccccaagcttgtgggattctttgtccaaatcatggttgtttgcgaaaagcccttccatctacagtttccagcgttttcttataattgggactgtgaaggtagcaggttatatcggattaacctcaaaccaaatctctatcaatcatcagagatgatggaggacaacaataatagaccatataaatggcatcacctggtcattgtccaaatcccaactggcatcatcagcgcagaaattgatgaggtgcaattcgaatcccatatccaagttccggagccgggcgacgagataattttgtgtggagttgaacacgttgggttcgttttaaagtagctggtgcggagatcaattcttaagatgatgatggatctgcagatttctaaacacaaggatttgtaccaattttcgttttggaactaaataaattactacccatgtaacctcgtgtcggtttgcttttataatcggtttggtatttttcggtttaattgtgacttgattttatttttttccttttaagagaaccaattttttctttctgctttgtactcgatgtctgccctttttgctcaacaagctttaccagattgtattctggtatttcatcaggctagaaatggagaaagaaaagttggagctgccaaacccacaggagttgtgttctcactggaaatgttacattaaatatcattgcaaaacaactactaatacattgaatctcctttgattttggtccaaagaaaggtgaataacttttgattttggtgcatatgggatgatgacggactgatgagtacccaatatccagtgcccacgtgtcctaattcttatggatcaatcaagggcttaaaagcccataaacattaaacagagggaataaaggaatgctaaaaactaattaagaaaacatcaagtaacaattattatgttttggttgttacttgttacttccaaggataaaggagggattcctatgcttgacttgcactagagctttatttcattgcaaaaaaggttaggtacttgattaagaacccaacctaagttttagtattatacaatcctttttcccatctcattttacatgcttacactttcattaaactattatactcaaggaaactggttgcaggtctataacttgtaaattaaaactgttcgtgttatttattcccatgataaaattgtaagagcgtgtgaatcacgagcttaggagagcgtgtgaatcacgagcttaggagagcgtgtgacatcaatatggggaggggcggctaaagactaacgagtaaaggcataagggggaaattaaggactgttcagagttcagaaatgtttttagtctggaaacgacaatacactttggacaaaaagctaaataacattttaaaagcttcatacaaattaaaaatataatcaaacaaaagctaacgtggccaagatagctaattacttttttggaatcattattagagataatggaaattaagaaatcatacagccaaaacaaaccgtagttattatattcgtaacaaaagatgggggaaaagttaatataaaacaaaccttatactagtatatataatacatggctcataatacattactgctaaatgagcaaaaacaaataaaggtaaagttcttaacggctttgtagagataggaatcattaattttagagaaaaaaaaatcttgaattgtacgtttacctttccagaattacattatttgttggcttttaattgttaatcatttttgttgtgtttttcctccaaattataaaatttaaaaactgtgtcagggaatttaggaatctaatatagttggacgatttcgtattaataaagattttcaaaaaaagagtctgctctaatcgttatttgggggtaaattgattctataaggtagggttagccagagagccttattctgtgttttgggttaaagtgagaccaaataaattaagatatttaaaatgaataattaagagcacttaagacaataattaacccagaaggagaagctggtgtagtggtggttctcatggcgatgttggtttcccaggaaaggtaaaagagacggagacgaaccaaaacaaggaagaaagaagaagatcttacatacgaagatcactctctgattcactctgagagacaaactggtttactttggttctgtttgacaaaaggagacatgcaaaaataaatctctatcccttgtttttcttcttcgcttcatcgattactcaaagaggtttctttctctatctcttatctatttctttctgcatctgtagtctctttgttcgaaaaaaagatgtttaatttctgtcaaatttttctccttttttctttgttcgattattggtgtatctgtcttgtggcgtgcgattgatgtttactgattctgaaaaattcttgctaaaataattcatcttcaagtcaacgactttttgcccaaaagtgatgacgggaacaagaaatttttcttggtcggaaaattactaattttagccaatcgtagcgatctctgcaatcgtgttttggttacccaagatagtacgatcgaatcagttcgtttagagaattaaaaaattactcaaatttagaaacttccaacttctgtttctttctattctgggttttttcacccacttggattattagctttaaaaatctaatctttgagtcatttttgattgttatttaggttgttggttgtgagaataattagcttgttaaggaagacgttatgatg

SEQ ID NO: 21381 - DNA, 3000 bp, Unknown; identical to SEQ ID NO: 5967
  misc_feature (1)..( 3000): 2750-1469P.txt file - cDNA_ID_1988786; gDNA_ID_1620834; Annot_ID_169781

SEQ ID NO: 21382 - DNA, 3000 bp, Unknown; identical to SEQ ID NO: 8953
  misc_feature (1)..( 3000): 2750-1469P.txt file - cDNA_ID_1988787; gDNA_ID_1971948; Annot_ID_58598

SEQ ID NO: 21383 - DNA, 3000 bp, Unknown; identical to SEQ ID NO: 9037
  misc_feature (1)..( 3000): 2750-1469P.txt file - cDNA_ID_1988791; gDNA_ID_1971974; Annot_ID_58698

SEQ ID NO: 21384 - DNA, 3000 bp, Unknown; identical to SEQ ID NO: 9037
  misc_feature (1)..( 3000): 2750-1469P.txt file - cDNA_ID_1988791; gDNA_ID_1971974; Annot_ID_177549

SEQ ID NO: 21385 - DNA, 3003 bp, Unknown
  misc_feature (1)..( 3003): 2750-1469P.txt file - cDNA_ID_1988821; gDNA_ID_1620834; Annot_ID_57941
gcataaaatagagcccaaaaacctgcaatgccgaaaatttccatagcaatgattagaaaagagaaacagtgactctgcaaaacaatgcttttcttactttgtaaatcaagctgttagctcggtattccacactctcgttgatttctcggtttatcagcttgacagatactttccctcctagccgagtgaggtactgaatgattagaaggtagatagctgtcaatacgtacctgagaccatcatagaaaattgtcatgattgtaacaaagttgctaacacatgggactggtaaagcttgtaaacaaaaaaatgagtaagctctcacttgattatatcagatgtgataatctcgaaaatatgagcatacgcgagctcaaatggaagttggaggcagataatgctcatgataacaagaacatcattcctaaacctcttgcgataagcaaaccattcatatctctggtaggcttccttctctttggctctctcatttccgagattcttaataagctcctttggaaaaggaagggaactccattccattccgagaaatctatatccttggctggggccaactaaacaatttatctgccatctattgatagagaattgacacaaaaaaaagaaatcagaaaatagaaaacaaatctaaaattgttgcagaattatgcatcagtgtaggagtttcctacctggctaacaaggccgcatttttacgtttccagaactgaagaaacaaggcagcccagagtattgtgcccacaaagaaacttgggagagcaagaaactgcaaggatctgatcaaagagatagaaaacaacgcatgatggatgtgccggcatgtctattagtatttacttaagaccttgtaacagagttaagaacttacccaaaatcaaccatctgcactataaacccaagtaaggctggaaatatcaaccattgcgtatacattcccaagaacgaaaagtagactccaatctgtgatttttctatgttatgagtttcatatcaacacctttctgctacataaatcatattaatatttataagtgtctacctttgcaccaaagtaagagtagatctgatcaattggttggtttgtgcagttccaccaatttaatgcccaattttggagaagttcctttctcttgagttcatctacaaccaaatgtttttgtgagaattcttaaccatctagagtctagactccttgtaacccaacagatataacagagtagcttaccatgaagaggaaacatttgtttaatgacgccctctgattccaaccttcgaagtaatgattcccctgctgtccaacaaaactctctgccgtcaagtttcagagtgacatcgtgtccaccagagtttacctgtaactcaagagttcatttgctatgtcataaatcaagtacactgtaaactgacacactaacgcaatcaaaattgagttaatagttaaattcacgataaagacagatgttttagagagatggaacttacaattccataaataagatgttgatagcaccgaaaacgttcaaaccagctgaataataacccatcaggttgccgaatgaaagcctcagacccttgcatctcaaagggaagatcaattcctgaagtgagagataaccatcaaacttaagacaaacacaaaatgaggaaatatctgcgatacgagtaaacagtagtatttaccgagacgagtaggtttgcgtatatgaagctctgcagctgcattgcccaagatctccgaaggagctgctacctaaagagatacttgaattgctgttatctcaaacatcactctcataatagcaaaacactcttcaaacgtcaaagtattttacagatttaaagctaaataaggaaagaaacttcactagatacttcgtttaaagttcccaatttgttgaatcctagacataatatagcaagttttatcaaacaaaactcaattctacttgactttcagataagtaattttgtatgaaaaatcaaagactttcacacctgaaaacccctatttggtcacaaaattacaagtaaattgggcaaagaaagaccgaccttgagaaactcatgagcaagaccgacgactctatcaacaaccatccctttcttccttagctcagtcaccaaaacctcaacacagtctccttcttcttcttccagaaccctcttaggaaccaccattgcaacctcgtgaacaactcgctcctccccattactcccattcatttccaaaaaccctatcacacaagcagaattttgagatttcttctcagtagctggaaagcttcctttttctaagatctgactcaaaatgcccaaatgtgtattcaccaaagaatccacctttattcactttttttcctctgaactacttttctcctctgtaattaatctaattttccggtttctgggccacaaaaggggatcagggttttaagtcagaacactgcaaaaatcaagaattcgattccaacattccacgaaaaggacctaatttactacgtatctctcacgaatttgaatcttccattacttcaaaaaaacgtttctgggaaatggaagagacaagacaaaagcatttggggtttgaatttgaaacttagattgaattttggaaagaaattacatgcaaaacaatccaaaatactttaattttgctatgagttggcacgcagatgatgattgatccatcgtgtaaaaaagagtgacacatcggacggtgctgagtcacttttgacacgcgtgccttgtgtgtgtgactgtttattatcaccatgatatataaatcaaaccgggtaatgaccgacatttcgattgaaccggtcaattccgattttgacttagcttccttcctcccctcttcttcaaacatcaacgcgtcgagatattttccccaaatacagagaaaccctaaagtctctgtttttgagaatttttctaccgatagatccaagcgaattgatctagaggaattgatccaacatg

SEQ ID NO: 21386 - DNA, 3003 bp, Unknown; identical to SEQ ID NO: 21385
  misc_feature (1)..( 3003): 2750-1469P.txt file - cDNA_ID_1988821; gDNA_ID_1620834; Annot_ID_169804

SEQ ID NO: 21387 - DNA, 3003 bp, Unknown
  misc_feature (1)..( 3003): 2750-1469P.txt file - cDNA_ID_1988832; gDNA_ID_1620812; Annot_ID_57883
ccggtttcgatcttaagttgtggtaacgattgaatcgcattgcagaatcttgaactggacgatgcatatggttagttgcttcagtgaaggttgacttcaatgatattttggaaagtcgtcgtgagaaagttgattatattgatcgggtcttcttaaaaaaagaaagaataaacctcataaggtcctttaggtagttagctgaaatgtgattttctttatttaatatagcgaaaatgatagttttaggtcataactttgaaaatataatatagaaatcttgactaaaaaatattataagtacgtgtaaaactcgtaaaagactcacacaattagagtaaactattaggacaagttaagaaacaaagtctaaaacaatctgaaacgtaacatgctacaaaacgatagaaaatatgatgtctttcttgtgacaatagaaaagatgacgtcaaattttcctttcgtttttttattgttagcccgttccgttataaagagtggaggatatatttgtctctagcccattggacaaaacgttcattgagaaaaataccatataagatacattttttatggattatatggaaattaagatgcatgaaaaggaaattaagatgcctcacattatttccaccatctagtcatttatgtcgtcttagattcttttataaatcatattcatatgtgactaacacgtcttcacattctcatttgatcatgttgcttaaaacaaatatctcatcaaccacataagcaataaatgtttttagtttttgtttgattcagttcattaatatataattacatgtccatcttaagcgttccgttaattatcacatttttaaactctatgtgattagttgcagtttgcaacttggtttgtcaattaacaataatgtataatttacatatctgttttttttgcgattttttttttttttacatatatgtatgcctcagcatgcattgttatttgttgactctttgaacttaagttgtgtccaattgtgtcagtcataaatatgaacacgtgttaaatattatagagaaagatttgagtttttacaatcttataatccactctccatagtttatatatgtacatgcacgatcagttttaactaataatcataaacatatatgtacatgtacaatcaatctcatatgcaatcaaagtaaatataaattaaaaaaaatgtatatatggatctcgtttagtttaaattctaaacgtatattgtcgaaggagaaaaactataattttgtttgtgtatattgattgattcttcagtaatttcttcaactattctgatatatatatatatatatatatatatatatatctacttgcaatcatagtttaaagatgttatttctgttagatgtttaatcttgtttttttctgtcagtagtctttaatcacgtgccaagtaagcaaaacactctcattattttaaagaatgttgattaaataaacattcgatgggcgatgtctattggaaactggaaagtcagctaaatacaacaattttccacttaacattctaattatctaactattaattattaatcattgctgcatgcctctgttcaactgtacaggctgttttcgaatattttgtagagtacaacttatcaaaaaatcccaaactcttttatctgacaataatattttaagatataagaaatagtcatagtatcatatttttcaaactatacaatttttataatttcattaaaaggcaaaataaaaaccaggttacgtaattaatttaatagtcaaatgtttgctacaataatatatttacaattctagttacatctaagtgtaataaaattacaattccattatagatagtataatggatgataaaacttttgtacagttgatagtaagaaaatttaataaaatataggatatttaccagaaaaaaaaaaccaaaaaaaaaaaacacgttaatgggtaaacttcgaaactgaaatttttgtagaaaaaaacaatcacatcatcaatgtatctttcaaaataatgttttgacaacttatcagtcacttttaattgggtgtgttagaaatagaggtacagtttaaagtttttattaggttttgggtggtaaggtgtgttagaaatcagtttattttttaatcagtcattggtggtggtggaaaatatcattttcaaatttcaagtagcaattatgggtgaaatttcttgtataaatttcaagtagcaattaatatatctttttttatatatagaaaatttacattttggtaaaaatttaaattaaaaaaaggagcatggttatatcttgaatcttggtatctacgagcatattatttagatataacaaacaagttgggaatagacaaaacaaaatgacgaactttccaacgaaagatcccattatagtaatgttattcttatttatacttatacaatctctagtggcttccaaagtacacaaaatgggagtattataccaacaaaaataaacgactaatgaatcaaaaaattcaaaatttgctttattttattctgaaaatctaacgagctgaaaccaaaatgttatagatttaaaatagaaacaaaacaccgatgattgacccaataaaaagcaaaataaagtagaccaaaaagaataatggttatgctgataattgaggagtcgtcgtcactcgtcacatgagaggaacaacaagaaaagtcaaaacgttgaagctttctcgaataacgccttctttagtttacagtctctcgttgcgggtcttatcttcttcttcttcttccctctttcgtctgctctatattatgaccagattcaaaattgcgtagcgtactaattcaatatagagagaagttagatcaaaagaagaacacgaaactctgactgtgtctctctttctcttcgtgtgtttctatatttatatataaaaagacaagatctctggtctggaattagaagaatcttatttggggttttttcttaggattaagctctaatg

SEQ ID NO: 21388 - DNA, 3003 bp, Unknown
  misc_feature (1)..( 3003): 2750-1469P.txt file - cDNA_ID_1988834; gDNA_ID_1971948; Annot_ID_58592
gcgccattgggaccgtagtttcttgcaccataatatctctaggtatcttactcccctctccctgtaattgattctgttgaaagcttactcctgattagtaattgtggatcattaatattcttgtgatgtttgaaacaggtgcaattcagttctttaagaaattagacattgggacctttgacttgggcgattttcttggtaatgtgttaaggagtttcttttatcgattttttgttctagaagacttgattttttttttgcttacttaatcagcaatcggcgccatatttgctgcaaccgactctgtatgcacactacaggtaatgtgattcgccaattagcagaagtacatacaggcccagaatcaaagtgtaattaacaaaaactcttgttcctttggtgatacaggttctcaatcaagatgagacacctttgctttacagtcttgtatttggagagggcgttgtgaatgatgccacatctgttgtgctcttcaatgctattcagagttttgacctcacccaccttaaccatgaagcagcttttcaatttcttgggaactttttttatctgtttctcttgagcaccggacttggtgtcgcagtaagtccattttcttctctctactgctctttcgtctggctactacttgcacgttcctctgttaactacaatttttttgttattcatcttgcagactggtctgataagtgcttatgtcatcaagaaactgtattttggaaggtagataattggctttagctcatatgtgactttatctctattagtcttctgttatgtagtctaattgggtatctttcttaggcactcgactgatcgagaagttgccctcatgatgcttatggcttatctttcatatatgcttgctgaggttagttttgtgaaattttataccactgtcataatttaggcatggagacaatcagttgtatcttaagaatcctttattgataatatattgtttgggttgcagctattcgccttgagtggtatcctaactgtatttttctgtgggattgtgatgtcccattacacttggcacaatgtcaccgagagctcaagaattactaccaagtaatatgacctccattttctcttgaaaacaaattcaaatgttttccatcttcaatacttacttactttctatgcatttacgatgagacaggcatgcctttgctactttgtcgtttctcgctgagacttttattttcctctacgttggaatggatgcattggacatagagaaatggagattcgtgagtgacaggtatggtcactcagtagaaacataaactctctttttgttcattggctatatacataatcttcttatgtttccattgtttggttttggacagcccggggacatcagttgcagtgagctcaattctaatgggtctagtcatgcttggaagagcagcttttgtctttcctctttccttcttatcaaacttagccaagaagcatcagagcgagaaaatcagcatcaagcagcaagtacgaacaatctactttgtctattgaattcaaatttgctgaggattgttgatacttactaatcttctctcactttgtctgtaggttgtgatctggtgggctggtctaatgagaggtgctgtatctatggctcttgcctacaataaggtaaattgaaagtttaatggatagtaaacagcgacatggtgattagtaaaaatctagcagataatttaacttctttatttctctgtgctctctaatgcagtttacaagatcagggcacacagaattgcgcgggaatgcaatcatgattaccagtacaataaccgtctgtctttttagcaccatggtaagatatctccctctcaggtttggactactaaatgtattttctctacagagatgttgtcaatgaggataaaccaatgctgagccgtgagacggatttgcattttctatatccggaaaactgttccctcctatttgatttgttattccaatgttttctggatcgctaacactgaaccctgataccggacatttaacatatgtttttttttttccacggctttcaggtgtttggtatgctaaccaaaccactgattagatacctaatgccacaccaaaaagcgaccaccagtaccacgagtatgttatcggacgatagcactccgaaatcaatccacattccgctcctcgatggtgaacagctagattcatttgagttacctgggagccaccaggacgtgccacgaccaaacagccttcgaggtttcctcatgcgccccacacggactgtccactattactggagacagtttgatgatgccttcatgcgtcctgtgtttggtggtcgcggattcgttccctttgtccctggttctccgactgagagaagcagccatgatcttagtaaaccttgaggagaaagatatatagaaacttaaccaaaaaacttcttcttgctcttccctcttatggtgactagtattggtgatgtaaatgtatttttcgttcttcaaatttacatattcttctgtaaatttgttattattcgatgatgaagaagcttcttacgtttttgagagacgtgtgggggttcatgtgtgttactattagtctttgttttgtttaacaaaaaaactaccaagtttttgactatgcatcatggggtttgttgttgttggtcagaacttagaacttgactaactctgcttcggttaggatctgattggtacggtttggttcgattttcgtcaatagaataaaaaactgtatgaatagaataatccggttaaattggcacgtgaaatgcgaaatgggctgagtcattcattatggaaagcccatgtgattggtagggaacgacgtcgggtgaagggaggggaagagcttataaatgaaagcagcaagcagagcagttcacgctctttgtacactccgccctctctccccatctctttcgacagatctcttctctctctcgtgtttcacgaaacaatg

SEQ ID NO: 21389 - DNA, 3003 bp, Unknown; identical to SEQ ID NO: 21388
  misc_feature (1)..( 3003): 2750-1469P.txt file - cDNA_ID_1988834; gDNA_ID_1971948; Annot_ID_177291

SEQ ID NO: 21390 - DNA, 3000 bp, Unknown; identical to SEQ ID NO: 7395
  misc_feature (1)..( 3000): 2750-1469P.txt file - cDNA_ID_1988838; gDNA_ID_1621143; Annot_ID_56686

SEQ ID NO: 21391 - DNA, 3000 bp, Unknown; identical to SEQ ID NO: 7395
  misc_feature (1)..( 3000): 2750-1469P.txt file - cDNA_ID_1988838; gDNA_ID_1621143; Annot_ID_172921

SEQ ID NO: 21392 - DNA, 3 bp, Unknown
  misc_feature (1)..( 3): 2750-1469P.txt file - cDNA_ID_1988848; gDNA_ID_1590644; Annot_ID_149884
aag

SEQ ID NO: 21393 - DNA, 3003 bp, Unknown
  misc_feature (1)..( 3003): 2750-1469P.txt file - cDNA_ID_1988891; gDNA_ID_1620834; Annot_ID_57929
ggcaagcgttggccgctttggcagatatctccggcgattgttcagggtgaaatttcttaacttggtgataaagattgaattgaattttaaccaagtcgccttggtccagtggtaaaaggaagataattcccgccacctggtttgatggtttccccggacactaagattagtcttccggtttaggaaaaaaaatagattgaatttttattgttagatatgatttgaagagatgctaagtttcgattattttttattttttttgtctatgtagggaagatgactcgaagctggtggacgtaatcgctgacaagatatcaaaagagctgatgatagttacaagaataagcaatgggaggaacctagttgggattgataaacacatgaacgaacttaaccgattgatggatttgaattccaacaaaggtaagagaatggttgggatttgggcaagaggaggaagttgtagatcggctctagctaaatatgtttatcagacatcctgtcaacactttgatagccattgttttcttggaaacgtgaaacggatttgtcagggtaactactttgaaagccatctacacaaagagtttctggataatattcaaggagaaaactctagcaaacaaagtctcaagaagcaaaaggttctgcttgtggcagacgacgtcgataagcttgaacagttagatgctcttgcaggggatttcagcggttttggtccggggagtgttgttatcatcactacaaaagataagcagttgttgatttcttatggtatacagcttgtctacgaagctgagtttttgacattccagaaattttgtcgtagcttccgatcattggcctttaaaaagagagacgacatttctgctgcgttcgagtgggctttgtatatataaagcaatgaattttgccacggaatgttttagctctcaaagtagaagatctggttatgagaaagtgttggaatcagtttaataagttagatcccttgagtcatatgcattaagttaactaaacttaataagttgtgtggctttcaaataaggttgttttgtctatttttggagtgggttctcttggggtgtataaaaatgtcactcttcattggattaaataatatacaaattttttttgttataatcaaatttgtgtattttagttataacctaaatgttgtatgtctctttctagacttaagaactaaagtctatgttttccttaaaaacaaagtttgtataatttcttgggattcccatgaccatttgttctttgaatacccgaattctcaaaggcagtttggttgtccctcgcatcacatgttttccatagccctcttctgcacttgctaaagaagttaattggtttggtcttggaagcagaatcttcataacaacacaagacatgcaattgcttatttcatcaatagtggggagcgtctacgaagttgagcttttgagatgttacaaagttcgacagctatttaggttagatgccttcaaacaaagagaggatcatgttggttttgagcagtctacagagtttttaagaatgttagagcaccctaaatgggggtttctaaacaagtttcttaacaaagaataaaaaatttatatgatttaaatattacataagtctcttaaatttgatgaaacttaggcaaattgtctcttagttaagagataattggtcttggtttcaccaaatttaagagacctataattaaaaatattatttatctatacttacactttaattttgtttaagagacttaggcttagagactaccattgaggatgctcttaaacaaccatttttaacatctggatgtactagttgtttgtaatactgttctttccttataagaaataaagaatacaccatttgaaacctgaaagatggccaagcttgaggcctattaaccactccaactagaaccacgtcctccacaacacagacaactctgcggctaaccatactctccaccgcccagacaacgcaaagaaaatgggcttccaatttagttttaatgtttgtgaatgccggatgactatgcagcaaaacatgtcctgattcctctcttagaactcagtagacaactgccacaaagtttcttttagaccaggagaagccaatattacactgagccctttgacttgtaccagaaaacacataagtgacataaccagtagggctagtccctgtttcaagagaatttctttcagactacacttcctacgcagcaaaccaatcatccacatcctctctcactttctttatggtttccaaagcagagaatgtttttccttcaaaaaacatgaggtttctatttttccaaattctccaaataatccatgggaaggggcatgataatgtgacatgcctcaaatttgtctagagaaaatagactctccatcaagaccacaagttggcatctgcagtccattttcacacccctatgcgtcagaagatccataacatgtacaactccacttagaatcttccaaagaaaaacattaatttttggttttagtcttgagcttccaaacttaatgttttaactcgttggttgaaagttgcacatttgcttaatcatccttatcaattagcctttctcgtccgtcaattgacttagttctaaccattcgtttgatcgataatcaaacaaacatttgaatcttcttcaaccaattaaattagactacgagtaactaaatgccaatacacgagaaaagtaagaggagaatttgtgttcgttaatatgttatccatactcattatcttactttggcggcccatctattctcttccctctttctgagtagtttagtgaaacagaagctgacaagaaaaaatagaaaatgccaggaaacacacagttagcagtaggaagactctttgttctaggatgactcttataggtcaactcctgtagtggtagtgcctataaatatccttgagttctttatttctatcactcattgagaatcaaaaatcaaaatg

SEQ ID NO: 21394 - DNA, 3003 bp, Unknown; identical to SEQ ID NO: 21393
  misc_feature (1)..( 3003): 2750-1469P.txt file - cDNA_ID_1988891; gDNA_ID_1620834; Annot_ID_169792

SEQ ID NO: 21395 - DNA, 3000 bp, Unknown; identical to SEQ ID NO: 6892
  misc_feature (1)..( 3000): 2750-1469P.txt file - cDNA_ID_1988895; gDNA_ID_1621111; Annot_ID_56091

SEQ ID NO: 21396 - DNA, 3003 bp, Unknown
  misc_feature (1)..( 3003): 2750-1469P.txt file - cDNA_ID_1989201; gDNA_ID_1971867; Annot_ID_58437
taatgttgatattcagatggatataggtgttttagatggttgtctttgcttgatgtgtaactatgatcagagttatgttgatgtttggatgatgaaagaatacaatgtgagggattcttggactaaggtttttacggttcagaaaccgaaaagtgtgaagtcgttttcgtatatgagacctttggtttattctaaggataagaaaaaggttcttttggagcttaataatacaaagctagtctggtttgatttagagagtaagaagatgagtactcttaggattaaggattgccctagctcgtatagtgcggaactcgttgtgagtagccttgtcttggggtgtaaaggagatcttaataacattaagtatcgaaaagaacaacaagctaaagaagctagagaagctaaaattatgcagaacactaaaaggaggtgtgatttttttgttcttctctaagtccaatttactttaatatcattttcattcgtttttgtatcgatatgttcagtatctcgtttgtttttattctcagggatgatttcctgtccaaaggattcaagctggtcttataagccaaaaacaagagacaggagctaaagctgcacaaggtaagtgaaaaagttgaccgttcttaatgggtctagtttgctgctgcattcttattgcatttcattcttttctgtctctgctctgttttgtcgcggacgttcatatccggtgtctgttttgtggcggacgagcaattttcatattcgggttgggacaagagtgaaagtcacagtatgtcataggtattgagtgcttagaagttagaacattccctagaaaatgttatggagtcatcatcaggataattactttagcatatgaccatattcaagtgtggttttttcacatcaatctatctgcaaaacaatcattgggtatgattttttcagggaggagaaacgagaaggggaacaaacaataacttcaaccaaaaagctctaatataccaaaggagaataatatacaacttacctacgtatatgtgcttatagaagagaggacaaatgtttttggtttgtaaataactctttttaagtttgatatatataacttactagtactaacgctttgtatacttgcttttttaagtttctgcataatatgagatgttaaataaattaaaatttgtcatatttaacaagagctggttctattacagtaaaacctatataaattaatattaaattaataatttgtataaattaataaattcttccgtctccgagttgggagtaattgatacaaatcactaaatcaatatgataataatttttttaaaaatcttatataaatatatggtctcatcaataatataaattaataattgtataaatttactaatatatattataaatatcatatgtaaaatatgactcttgtaatatttttcttcagtttttattaattttttgtagtgttcaattataatatttaacaaaatgaatttttttttttattgtaattggtttcagaaatactattgattataaaaaaaaattacattttatatcgattttgtgtaaaaatttacgaaatttgtacaattttattaaattttcgataaattaatatctttttaaattaataaatttttttggttctaatattattaatatatagaggttttactgtaatactttgctatcttttcatttatttattaatattattaaatcatcgacatgagctaacgtttttctacaataacttttgagatcactaagtagaaagttgaatctttcatcgacaattttataagtagtcaataagaaactttctacagcttgcttattaccctcgtcgaaatattgtgtttcgtgagcaatcctattattggtcaaactaaactattttgctcaaaattcttcatatggataactacaaaaatccaagttttccatttagattttactaatcggcgctatcgtaagtgtagtcgtcattgcctatttctcgagtttttaatagtctaaatcgtgataccatttcgactaaccaaacaaaacttagtaaaaaatttggtgtgtaacgaatccaaaatatcaagtttacgttttgtcacgattcctttaccaccaagttgccaatgtttggttacatttaccaaagatctaaatagtaaccaagaagtctcactgaatttatagagatttttggctgaatctacttaattgacctagtgctctgctctacttctacaaagacagatgggcctgatatgatcgctggtggactcaggtgtgacgagcccaactccggaaaggagtataaaatagaacgattcgtattattgatgctatcattaagaccaaaataaaaaaaaaaggtgaaaaattagcaagtgataaactataaaacacaacgttttctaaatggtaagaatataaactttttatagaaattaagaaatttaataaaaaatttataggaaataagaaatctacataagaacacagacaactttttggcttttttgtaatgtttttctaggtaataaatttcataatcttccaaaaataattaatcaaaagatttgactaggcgattaacccaaagcttcaaaagaaaaagtaaaaaaaatccttaatttgtttctttatcggattcaacaatttgaaaccataaatgacatattctaattaattcagagatatttttacactaattttatagaaattcattaatctaatcacaaattaataaaataaagaggtgtgaaacgtttaacaatggcatagagagcgagagagagagagaggaaaactgtgttaaacccagacgaaaccttcgatcttcttctcctctctcaatctcttcaccttccttcctccttcttcctcacctctatactccgttacggttaattttccggccatcgaatgttggataaggttttcgcgaaagccgatagagaaagatagagacagagagagagagattctcgtcgctaaatg

SEQ ID NO: 21397 - DNA, 3003 bp, Unknown; identical to SEQ ID NO: 21396
  misc_feature (1)..( 3003): 2750-1469P.txt file - cDNA_ID_1989201; gDNA_ID_1971867; Annot_ID_176502

SEQ ID NO: 21398 - DNA, 3003 bp, Unknown; identical to SEQ ID NO: 21396
  misc_feature (1)..( 3003): 2750-1469P.txt file - cDNA_ID_1989201; gDNA_ID_2926155; Annot_ID_139484

SEQ ID NO: 21399 - DNA, 3003 bp, Unknown; identical to SEQ ID NO: 21396
  misc_feature (1)..( 3003): 2750-1469P.txt file - cDNA_ID_1989201; gDNA_ID_2926155; Annot_ID_198350

SEQ ID NO: 21400 - DNA, 3003 bp, Unknown
  misc_feature (1)..( 3003): 2750-1469P.txt file - cDNA_ID_1989202; gDNA_ID_1971868; Annot_ID_58449
ccatgcttagtagagagatcattgattgttttaggtaacagtctttagagtaaagagtcttgttttcacaatgttcaatgcttattctattcatagagcaataatcgtcattgcaaactctgtttgattgattgtgtagggtgcatggcagctttggatgcagagcattacttacaagagattggatctcagcaaggtaagagtgattgaggaaattgttggaaggctcaggtcattgagttattgttgattgatccctgattcagttagacattgatggaccagaatgagacttgatctttatcatagaacaagttaagatacattgatttgtttattccttaatattgcagttggaattgagtacgggtattgttcaaagttgtagctctaatggtaaaactagctacgacaaaagtcctcttaaaatatgagttttagatgatgccttaacatttcatatattcagtgaacatgatttatccaataatgtattatgtattcttataaattagtataatataaaaatgggtttccagaaatctttaagacatttctgatcttgaagccgagtcatttccagagcttctagaggcttttgaaatgatcacagatttttcagaggaaacggctttggtgaagctttaacactttgatgtcaagaaagagagaaatgacggcttggaagggtcttcaaccgatgacgtcgttcactcctacatggttgaaatattcaaaagagttcataaaatccttcccaaaagtagtcccgattattcttctaaccattcttaaaattcgaaacgatgaatgtgattcttaaatgtggatttttctcaaaattatgtagtcaacaagattgaactatgccttaaataaaaaaagctgtttgattaaaaggttgaattaaatctctactttataataaataaataaaagttcctgcattttatctttgttgttttttctttttgtttgacttgatttagaaatattaaacttttctaatcaacgatataggtttaaagagtttttaaagttagttataaagtgtattttcccgaaatgtattgtgaaataggacttctaaaaaaattgaggttcatacatttttaaagtaaagtttgtgcttatagtagaaatttggaataatgatcaaattcctcgataatagtatgtagcattcttgtaatgcttgaaattgcaatgtgttgcgaccactgaaaagtgcaatggatatatttctgttttatcttattttattggaatttcctataagattttaatcagttatatcaaaacaaattataattatagccagtatagatccgacgttggtgtgtcaagccacttaaaagatgatggaaatggatcagatttactgaataactgacacacgaaattcctaaataattgttttctgtagaagaatatgtacaactagaagataatatatgattaattattcagattttatcttaactttttgttgtaaacgtaagtttttatttggaatggtcatactacaaataatcttcaagcattttataaagagtaaatttaaatatcttcgacacaaaaataaaatatatattacaaaggaaaaaggtaaaagaaaaatatattaaaaattaaatttagtactacattaatgtaagtattaaaaaaaaaaaaaaaattggttcaaaatactaaacaattttagatgagaaattcatccaagaaaattctcaagtaaaagtttttgtttttacttaaaagtttaaaaatctcttcataccaaaaaaaaaaaaaaaaaaagtttaaaaatcttccagatatgcaaatgcatatgcaagtgggggccatgaatgtgacagctggatacaggttaaaggacaacacatcatcgaccacatccccgacacgtgtcccatctcacacatggcgttttcctctctctttcaccatttttttaatttcgcgtctccgtttttacatctttttttttggctaaattgttttctttttcttattattcatttctatatattatattgaaaataatttgattattagtagtactgtagtattattatttcatacaaagtatatatatatatatggcaaaaaatagttgtttaatgcttgtttttttcttcacaaaaattcaccttctacttctccttcttaggacataatgggcctattgatttatctttgttaatccctataacattccaacttccaagtgtaatgcttattttccatataagaataacaaagcttaaaaataaaaaaaaattaacggtcacaacacaaacactattttaacttataaaatggaaataggcaattaggcattgatctccgcagaatctattgcactagcttgcactatgtttattcactttaatctcaccctttttgtcttctcgaaaatcagttgataatatccataaatacggtcaaaatacgtagaaaatacgataaggagagtgtaatagtatagggagaaaatgggaataacgtgatatacatatccacagataagcaataggtcaccatcccacggttcacgttatttccgtcggtttttaaaatcaaaaaatttcctctactgataatgttaattaagaaattaaaattatgtcttcaacttttaataaaacaattaatgaaaaactatcattattgtagtttcattagtgacaaatgacaatattaaaaaaaattaagaaaagtaagcaattattagttgaagaactgaagaagcagaagaagaagaagcagaagaagaagaagagaaaattttgacagagataatacacagatagagagaagagacagagacagagagtgatggaaacagctgtatttattatgagacgaaacaagaacctctgggtttctacttaaactcttctctctttcctctctcactttaaaaatccacactttagagcacacaatacaaaaaataagggtttctttatcttttcgtttcttccaaattttgtaatg

SEQ ID NO: 21401 - DNA, 3003 bp, Unknown; identical to SEQ ID NO: 21400
  misc_feature (1)..( 3003): 2750-1469P.txt file - cDNA_ID_1989202; gDNA_ID_2926209; Annot_ID_141895

SEQ ID NO: 21402 - DNA, 3000 bp, Unknown; identical to SEQ ID NO: 8721
  misc_feature (1)..( 3000): 2750-1469P.txt file - cDNA_ID_1989203; gDNA_ID_1971868; Annot_ID_58446

SEQ ID NO: 21403 - DNA, 3000 bp, Unknown; identical to SEQ ID NO: 8721
  misc_feature (1)..( 3000): 2750-1469P.txt file - cDNA_ID_1989203; gDNA_ID_2926209; Annot_ID_141892

SEQ ID NO: 21404 - DNA, 228 bp, Unknown; identical to SEQ ID NO: 8782
  misc_feature (1)..( 228): 2750-1469P.txt file - cDNA_ID_1989204; gDNA_ID_1971889; Annot_ID_58485

SEQ ID NO: 21405 - DNA, 3003 bp, Unknown
  misc_feature (1)..( 3003): 2750-1469P.txt file - cDNA_ID_1989204; gDNA_ID_2684256; Annot_ID_193146
acgctcactcactcctcctatgcctccttagacggcgttctctataaccaactcttcctcgaaaaaggaaactatcccaaagtcttgattatctcttgctgtatgatcggggaaagaaaaatgattttcatttacaatgggttgtttccatatcagacatgattttctttcagttgaatataattttgtttagttttaccttaataaaaactacaagaaataaccaaacatcccacgaattggtttaataatttcaaacaaagaaatcaaaaacataccgaaagactctcgagacgattataccccacagaacaccaattagatgagataacctcccaaaagatgactaagccttgcggctaatgttctatgaggtgtatcattgtctcgaaactcttttcgaagggttttgatttctttgcttgaaattgttaaactaataagtgcgtggaatgtatacgtgaaggaatattaacatacttgtgagaaattatcagcatatatgtcaatataaatattatatgctatgagtctatgacaacgaatatatatatatatatatacatggttaattaatatagaagataaatcagaaaatatgataattttctactttttagggtgtttagtatgcattcccacgtgttgaatatgcatgatcaattacaaaataacacgacaagtggaacaattatgtgaatttgaatatagtcatggaagattgtcatttattattgctaatttcttttgaaacatacaataaagcaaaacacctaagttcttttgctaatatttcactttttttctttcttttttcaatataatcaatatttcacttttttttatttattaatggaagattgtcatttattttgcgatttatcatgtaagttcaacatgtgtgaatgcatactaaatcccataaatatatgttttgctatgtttatacattttaattcatggatataagaaaaatgcaatcatatttattatttctgatttgattaaacatgtgtcaatgtactttccataatatctagtggaaattggccaacaacaaaaataaatcttacttacaaaatagattcccacagatgttattttatttaaacaaaatctatgttttaatacatttttatatagatatactggatttatttatatcattttccatatttctagttagtggaatatgaaaataaccatgttatttaattattatcattaaattatttgataatatcattttaattgcttaataatttaaatatattgatttcccttaaatatatccaatcttttgtaagaaaagaaatttaccctgaagtttatcacctaaaatttagcatgcttgtcttttaagggttgtcgaaaacaagtttacatagatcttcaattattaattaaataacataaacttgtgtttgtaaactaaaatttagatctttaagtttctgttatttaattaatatttgaagatctatgtaaaaaaaaaatttccctttagattttttgaaccttgttaaatcaaatcatttataataattatttaatatttcaaaatataataaaaacttataaaaactagttttatacttattatctgtaaaagctagaggaaacgaaggaagaagagaagaatcatgctgagattgtgagtgttatatgttgatttagtattttaatcatacatataaccaaatgttgtattataatataagaaaccaaggtttgaataatattttcgtggtcatgacagccagaagtggagaatgtactcacaattcatgcacttccaaattgcctacactattttcctccttaattttgtgcatatctgtggggatgtcattcgtatccggcctaagttcggtctactctacatcctttttattttaatcgaagtgctactaaaacatctttgtccatccgacaagattctttgcagctttgtcgaatttttaagccattttagtggagctatcactatcgggctggtgagctcatgttgtaatgtcttattttattgtgttggtataccttgggttttgtttgccttcatactctttgaatgtcttgttactgaagactgaagaacctaagacgcatacaggctcttcaagagggaaattttaaaccatttgcttgtgaatcgtgttacatatcttcgtttttagcatattttataagctttatagtttgtctttcttggactaccatggctttcctagtctattatatatctatgtgttatatgaatctcatggtggattgatattattaaatgaataatgttttctgtaagctctttatttcatccaagacatttttcatatctatattgaaactgaaaggcttccaatcgctaaggttttctatgaacgagttatctcccgtttgacaatatgtttcttcttctttgaagtgtcgtttaaaagaatctacaaatcctttatcacttcattaattccaaaagtgtcactgtttttatcgatgtcaatagactgattgctttttgctttcgtattcgttttgccatgagatcaaacaattgtaatttctaactatgaacaaaaaagaaagatattttagggtgcccttcataaatttggaaatagtcttcaccaattgtcctgaacagagagaaatgggtatcaagtcaactctgaacactctatgactaaaagaaaaaatcattcacctcgataccagaaagaagaaaagtcatcgcttttgggaaatttgatgaacaaagaccaaatcttaaaactcgaattcttctggttcctaaaaagtggctgtcaagaagagtgagacatgcatcaaactctctcttctcctgccatggcgtcaaacctccggaaaccctatttcctcaggtacttaactattcttccccaatcgatgatggtcgaaagctgaaacctttttctgcaaatcgattaaccgacaagaaaatccaacccaacccacccactttgttttgtttggatgataaaaatg

SEQ ID NO: 21406 - DNA, 3003 bp, Unknown; identical to SEQ ID NO: 21405
  misc_feature (1)..( 3003): 2750-1469P.txt file - cDNA_ID_1989204; gDNA_ID_2684256; Annot_ID_138118

SEQ ID NO: 21407 - DNA, 228 bp, Unknown; identical to SEQ ID NO: 8782
  misc_feature (1)..( 228): 2750-1469P.txt file - cDNA_ID_1989204; gDNA_ID_1971889; Annot_ID_176839

SEQ ID NO: 21408 - DNA, 3003 bp, Unknown
  misc_feature (1)..( 3003): 2750-1469P.txt file - cDNA_ID_1989205; gDNA_ID_1971889; Annot_ID_58484
atatcatatgcgacaaaaagtaatacgtatgagtttacaaagcaaatttgcttctttttttttaataacttctggttgcaaggtgatatgaaaaccccaagtccgttctggctaaatctaattattaaaatatgattttgtttgtaaaactataacgaatatcattcttctgcagaaatcaattttctttatttttctaacaatataatatcctgtattcatgattaatttcttttaataaaataaaagaaaattgatctctgcagtcaataatttacatagcaatcttgggagatggtcttgttacacagaaaattgattttcaaaaccaatgatttacataacaatcttgttgcagggaaataataagatttgggatcccatgagatttcctctgaatttatctgatattggtgtgctcgtctgtattctctacttccacacttcattctttatcgagatagaagaaatcttaaaattaacaacagaatacaatgtttacatgtggaatacaaaaacaaaagtatgtaaaacctataagagtgttataatgtttagaatccttgtgttagtgcaaacacacgtccctctaaaggtggaggcaatgcagaaaccgcatcttcgatttcctgtgaaaactcgcaaagattaattaccactacaaggtaagagagtaactgatttcctactgcttcataaccaggttggataaagaagacacaccttcactgtataccgagccgaaaagtggattagcaggattgctttgttttcaaacttttcagcatgatttactatctgcagtttaaggatatatgaaatcttctatgaccatcaagagacagaaagtaacaagaggtgtcaaagaaaggaggatcctgacctcagatatatggatatgtccataatctctcgcatgctctaccgataccgaatcatcaagaaatgtgctctgcacaagaggaaatagagacagcttcccttttaatacaaagccatgaaacttggaccgggaagaactatatcattataaatcacgcacattgtccaaattcatatcagtagcagatattcacctccatgacgagaacctttgccttgagagcatcagcattagtttcatcaactacaaaatccgacgttgtatctcccgtaaaagcaacttcaggagttattatgctgtctgtaatctacaatccacaatccaaacttattaaacaggcttatatactttggaaagaccattgcaaaactattgactttgtgatagacaaacataagaaaaaattgacaagcaatattaagcaaatcaaagacaaacctcaacacctgaaaccttcaagttcttaatttcatttccagataggccaatatattccttcttgagtttatatttagttgaatacactacataaccctgcaaaatatcaaacgaaagcatgaattcaacgaagacacataacgctaagatatcgaaaatctcatgcgagtttactaaaataaacctggctttggatgacatggaatgtcttaaaggctttgactttgagatctttccttataataaactcctcccctgcatgaagaagtgtccaaggtttaacaaaaaagccaaatcttggctgcaatgaatgctagaggttgagttaccacctatgtccaagccaacaagattgtgctttagctctgaagaatctaactttctgtgaacttcgaataaactctcaacagtttctttaatggatgcgggtactataatcgttggaggcttcattttgtacaagcctctagtagcaacatacattggtaatccaccctaacataacaatacgaatagtttagctcacaatttgagaatgtaacacccaaacagtaacagagcaataggctaatataacataacaatttagctgacaattagagaatgtaacaccaacacagcaacagagcaatatgctaatgataataaacacatggtggctctcaacaagggtttatcaaaacagtaacagagcaataagctaatgataataaacacatggtggcagtctcaacaaaggcttatcaaaattgttcttaaaacaaaaagtcaaaagaaggatctttgcaaaatataatccgaaatttcaagtctttttatagaagattcaagatacttacgatatgatccatgtgagagtgagagatgaagaggaagtcttgagaaattgcgcgatgtgggcaacgaccaatgtcgaaagctatccgaagagatggaaatatgatgcacgtctcgtgcccaccaatcgacaatccctcgatcgggtaaccttcaatttgcattgctttcttcttctccatctcactgttccttagggtttatcgaattttggctgtgctcttcgttttcaaatattgatcaccaagtgttcgatgaaatgtctcacaatcacaagcttttttcttccatgatcattttttttttttttaataattttatggattgggcttaggcccataacggttaacgagactacttcactggagcgggaaccactaggcactggttaataaatttcccacgtgcctctggtgcaaaagttggtctttcgtattcaacgacagtgcaagggtatgattgtaaatttacttcgaatgcttcattagaacgtcgcggtattcttacacttgttttcgaagtaatctcgacgactataacaaaatctgagcaatttcaattaaatatctgttactgttgtattttaaaatctagactactgatgacataaccaaatttttagactaaattaccctttttcttctattttaattatcgcatttaatgattttcagctttttttctttatagattgctctcttaactcttctttaattttccctctttcgagttctgaatttttctgtaaaaattaattttagttaaactaaaaatgtttgacaaaaatactaaatttcagagaagatccaacggctagaaatcaactgcgtaagattggagttatg

SEQ ID NO: 21409 - DNA, 3003 bp, Unknown
  misc_feature (1)..( 3003): 2750-1469P.txt file - cDNA_ID_1989210; gDNA_ID_1971889; Annot_ID_58478
catttcagttacagatactctatcacttttcatagtggtgcctaacgagtcatgcttcatgtaggtgtttcctttgttaatagagaagttttctttccgagaacaagcatcacttgtgtggcaattcatttgtagtgttccagtgatggtgcttgaagactttttgccatggatgatctctcatctctctcacgaggagaaaattgaagttgagaattgtataaaagatgttgccccaaatgaagactcattgcaacaggtatacatatcccctttgctgagatatgctatgtttttcttctttccttttgataagctaaaattttctgaaggtcataagctcttggctgcttgacgatagtcaatcttcttgtgggactcctacagagatcatgaaaggagtccagtatgttaatgtgtctaaaagtttgaagaaatcacctgagtcacatccgtcaagcggatgttttcaacgcttttgggagtggagtaaaaagtccctttcaattccaaatgtaggacggagcccaattcatggtcttagactttttcaaaatgcaattgaaaaagatttgagagatattcaagaaggattatgccaagcaaaattccaaacccttattttggatcttgatgtactgatggctagattaaacttccttgctgatgtccttgtttcttataggtaataatagtttctcggattaacttaatttttctctttggtatagtgtctagtctcttgtttactttccttccttctttctttgagtgagttacagaatgttttgttttgttttgttgcagcaatgcatttaagaagttctttcacccagtgttagaagaaatgacagctcgccgctcttcaactgccaaacagttcaacatagatgattgtcttgagaattttcagagattgttatacaaaagtgctgatgataaaacaaagacggacaattttctattgcagcttcaggaggaacttgagtcccttataatccaagtaacaaagcaatttgccatacagagaacagaggtaaactcttatgatacttactcgtttctataacataatggaagtttttcacggattcattttgaagatgttacattgtgtgtatattatattcaattgtctcattgttgtccaggtattcccaatcatcagcaagaattgcaaccatgaaatgcagaagcagctcctatacacaagcattcatgtcttacctcttggattactaaagtgtgtcatactttggttttctgctcatttatcagaagaagaatctcaatccattcttcatttcttaagtttggaagattcttctcccaagaaatcatttccacgcctcttgctacagtggcttcgttttggctattcaggcaaaacctctgttgaaagattttggaaacagttggatgttatgttcaaagtaagatgttcctgccaaaaggagcacactgaagaagcatcaggatcattttccaaccaaacacagctgcaactatgtaaagtatctaaagatgtttatcctagaaagaaagataagtcttcaacctgcttcatgtcaatggatctagctgttggagacatgtatgagacaccttactcaagtcgaatgaatcaacaaatgactttctcaggaaagcttaagcctcctctccatctcccagatttttttggtgagaagaatatggatgatcctatgattatggatgttaaaccaattgacctccttttcttcttccacaaggcaatgaagatggatttggactaccttgtttgtggatcaacaagattggcagccgactttcgtttcctcgcggagtttcagcaacggttccatatgataaagtttttgtatcagatacattctgatgcagaagatgagattgcatttccagcattggaagccaagggacagctaaaaaacattagtcactcgtttagcattgatcatgagctagaaactaaacacttcgacaaagtttcgttcattttgaatgagatgtcagagctgaacatgttggtttctaccatcaataccactgcagctgaccacgaccgaaaaatgaagtatgagcggttatgtctcagtctccgagagatttgcaaatcaatgcacaagctattgtctgagcatatccaacatgaagaaactgagctttggggtctattcaggaactgcttctctattgaagaacaagagaaaatcataggatgcatgctcgggagaataagtggggaaatattgcaggatatgattccttggttaatggaatctttaacctctgatgaacagcttgccgcgatgtccttgtggcgccaagcaacaaggaaaacaatgtttgtcgaatggctaacagaatggtataacggtcatgttttacaagaggaagcaggagaagcaaacaacgatccatttggggattcagatccactagagattgtctggaagtatctctttgaagcatctgctgatggggaaaaagggagcatgcgcagcagccttctcaaactcccgaagacgaattttacaggtattatgaatcagcctcctcctaattacaaggttgaagttggcaaaaaagaggaaaaagatctagaacggtcagaaagtaaaaagatatgcagaggatctaaccaagagggggacaaagaacaaactgacaaaatgtctcagaaggttagccagtttggtccatccaagaaatatgaacaactgttaacaatgagtgaagaagaacttgtggttgtgattaagaaaatatcatgcgactcttccctggatcctcagaagaaagactatatcaagcagaacttgttaatgaggtaagctctactaactctcttttggtgtcctgttccaacatatttagataagcaggaaatctatttagtcttgtattgagactaaactaatgtcaggttcttctttcagtcggtggaatatctcacaacgtacatataatttggaaccatcctctctctcgagcaacatg

SEQ ID NO: 21410 - DNA, 3000 bp, Unknown; identical to SEQ ID NO: 8786
  misc_feature (1)..( 3000): 2750-1469P.txt file - cDNA_ID_1989212; gDNA_ID_1971889; Annot_ID_58476

SEQ ID NO: 21411 - DNA, 3000 bp, Unknown; identical to SEQ ID NO: 8786
  misc_feature (1)..( 3000): 2750-1469P.txt file - cDNA_ID_1989212; gDNA_ID_1971889; Annot_ID_176828

SEQ ID NO: 21412 - DNA, 3000 bp, Unknown; identical to SEQ ID NO: 8798
  misc_feature (1)..( 3000): 2750-1469P.txt file - cDNA_ID_1989213; gDNA_ID_1971889; Annot_ID_58475

SEQ ID NO: 21413 - DNA, 3000 bp, Unknown; identical to SEQ ID NO: 8796
  misc_feature (1)..( 3000): 2750-1469P.txt file - cDNA_ID_1989215; gDNA_ID_1971889; Annot_ID_58473

SEQ ID NO: 21414 - DNA, 3003 bp, Unknown
  misc_feature (1)..( 3003): 2750-1469P.txt file - cDNA_ID_1989218; gDNA_ID_1971889; Annot_ID_58469
tcgctaatctccagctttctgtcattttcatgttccctcggaggagatgttttcaaggatataagagtgccgacatccttctgagaagagtttggagacactattggggcttctccatctttaacagaagatatggagtcagtagcatcagcacaaccagacatttctaagctctctacaattttacaagacgaaacttcgtgaagacatactccatcattcacatctcctacttctacagaggaagacagaaccccattggccatactgctatctactgtgtggatcatctgagctaaaccttcagtttccctgcgttttgtcagtatagatggaagagtgtagtgacattgatccttgttatctttataagaacaccggttaatactatttatgcgagtcaaagacggtacttttatcccattagccaccactgatccattttgttccactgggatgcaaaaacctacagcttctgtgttctcgtgactgcaagaaacctcaggcattacagaaactgcagcatcacggttattccaacagaggttttcctcatgattctttttaagatgtttctgaccatccgtaagtttcttgagctcatcgtgaagtactctcaactccaacctcagctctcctacaatatcttcagcttctccaagctgagcttcaagttcctcaaccttctgttgctgcttcaaggattgcatctctgtctccttaacctataaacacaaatcggttttttaaaaattagagttgaggaggaaacgcaaagccagccacaaaagaaagatatactccattagggaaagctcatcctcaagcaaacgtgatacagtctctaagatgaaaaagctatatcccccacactgaaaaacctttaacttaaaaatttcacgatgaaatgagaattgagagcataagccatgaaatatgtgtaagcctcactgccaacaatggtacaacgaatctagaacttgctgacactaagctacacttggttacgctcattagttttaggccttaggtttcatgaacaaatatcaatggaggaagagaaaagctatatctgcaaagtatcaatgtaatagtctcaagagtgtcaaaaacaatggcttgtatcaacgttcaatgaagtgaatgtagtgaaaaaacatagcaaaaatgatagtctcgaagcatatcatttgaatgatggaagattttagtcacttcaaatgtcaaagactgaataaacaaaactcagagtcacacacacacacacaacattaacaatgcttaaaaccatgaaagcaaggctgaaaaacttaatttcaaaagccatcttcatatgaagcaagaaaaaagaaatgcctctaagaccccaaaaacataatcaggcagaaaccaaataaaacaaaccaagaacccataaacaaatgaaaataagaacaaagtgatagtaccttggaatcaagcatctgtttaagcctaaccaacgtatgaagtgcttcatttctaaccgtcacaagttcttgctgatacctacgcgccttcttctcagaaaccatcacacgtgccgccgcttccttcgtcgtgttcagtatcgtatcggcgtaggctctcttcaacgccgctaaggtctgtgttaacccaaaacaaaacgaacaaaaaatcatcgcaaaccccgaaaagaaaagcaagacaaaacccacatcgtgaaacccaaaatttaaacaaaattagcgaaatcagcaacaagattctgtccgataagagaaacaaggtctagaagaaacagaacgaaactaaacgaagaaaaatccgaaatcgaaaaaaatgaactcgtgagaggaggagattgagggggtttaaggtaattgtacctctgggtctgccattagagccgataatgcgattgcagagaagcgattgttgattttccgaccaaggtcgcgaactcgccaagaagaaagaaaaagctaaaaaggtttttttttttttttttgtttctttttgtgtttccttgaagcgtctgtctgttaggaacagaaagaagtataaagacctatttacccctaaaaactcgatgttatttctcaaacgccacaccacacgtcacgtcagcttcagcatttcagactgcaaacggcggtacggtttcccgttatctccgtcactcttttcgtaatctctcttttgctttttacatttttcggtgataaatttacaatttcaaaatacactggacttttaatttttacctcatttagacaattagaccactagatttcgtagcttttaccccaaacaaaagactatattgtagctagttctaattattgaattttgtatcaactattccaatacgagacatgatataatgttccatatttggtagatacattcaaagaaaaaaaaaatggtagacagctaaaaaagaagctagctcatgggattaaaccaaaattaagatatccaaatgattttgaagtttcgattgcctagaagatggatggacaattaaaccgacttatagaacattgtctagtttacaacatatattaccaatgtaattgtattctactatttactagtgtacactaatactacttttcttgcaattttaggcgccaattttttttgatcgaaaaatatcgagttaaccaattaaaaccgggaagtaatcattaaaccgggtaatgaccgggtgattactcgagactgttatccacaataagaatccacgtgtcttcttcaagcccctccctcttcttccatttttccgccatttcacctagagagcgagcttttgggtgagaaaatctcttcttctaaactattctactgccaatcttaattcgtgcgtttctgtctagagcttggtggtgactagtaacttagccgttaatcttaaatctctgattcaattcaaatcgaattgcgattttcccgagaaaatctcgtttcacttgctggaggatttttgaatccttatgtgaactctagttacccaaaatg

SEQ ID NO: 21415 - DNA, 3003 bp, Unknown; identical to SEQ ID NO: 21414
  misc_feature (1)..( 3003): 2750-1469P.txt file - cDNA_ID_1989218; gDNA_ID_2684202; Annot_ID_137234

SEQ ID NO: 21416 - DNA, 3003 bp, Unknown
  misc_feature (1)..( 3003): 2750-1469P.txt file - cDNA_ID_1989222; gDNA_ID_1971889; Annot_ID_58458
cactggacgacgtaagtgcgcaatcgctagagttgttcttcaggaaggtactgggaaggttatcatcaactatcgtgatgccaaggtaaatttatttctaatttcattatcttattggcttttacactgttgcttagtcgcttgatgtgtttgcttaggccttgaatttggagtttatacagctgagaattgactactcatatgagattaagatttgaacttgaaattggtattttaacagctaaagctatgaaagcagtccacttacccccgtttgaacatattcttggtttatatgaatatctgatacctgcaagagactgacatcatgcatagtgtgtaatcgattgaagcatttagtagtataaattgtagcagtttgtaggagagaaagtcttgacctttatgaagatattctctgttatgtagggtatactagtcttgtgatcaaactgtatctttatgtacttctttttgatagatgagttatatcagcgcgttacagattaagttgaaactggaagaactctctgaacaaatagtttatatgatgaattctaggctatttagactttagactaggataagtggctgagaaagtgatcaaactgtatcggtattagtcttgtgatcagacgttatctgtatgtagttctttgtgacctgggagctgcatcagcacgttatagattaaggtgaaactggaagaaatttctgaacaaatagttcatatgataaattctaggctgtttagacttaggataagtggctgagaaagtgttaacaaggagagattatgataaaagtttggggggttttgacaagctgttttgttgtgaatgggaaagatttgaatccatacgtatattgctgatgatgatcattgtaaacctttttcaggagtaccttcagggaaatccattgtggcttcagtatgttaaagtaccattggtgactttaggatatgagaatagctacgacatatttgtgaaagcccatggaggcggtctctcaggtcaagctcaagcaattaccttgggagtcgcacgtgcactcctgaaggtaagtgcagaccacagatcgcctttgaagaaggaaggtttgctcactagagatgcgagagtggttgaaagaaagaaggccgggctcaagaaggcgcgtaaagccccacaattctccaagcgttaagagttttacatatcattggatcaactcttcaagtagactcctctgcctccattttttttaaaaacttttcttgtctattatcggtcttttgtttcatgttaatgtttatgtgtagacgaactaatacaatctctgttttgtttgaatggaacgcaaagttgatatgcttttgtaacaaatgcacttatgaattgtgatcagacaaatgcacttctgaatcgtttatcagttagatttcaggtgaaagtgaaaactttgcttctttcaaaaggtgttcatggatagtggataagcagcaatacctgaacacacttgtatcactttgtgtatctatctaattcctttgatattgaagtagtaatgttgattttgatgggctcataccgaacgaatcagaaatcgacaagtgtgagatagtatgtatgtgtgcataaaataggctggtttagctgggaatggtgatgcgaaaatggaatgttaggtatgagagagcttacccactttgactctttccatgcatattcgcttgctcccctctttcctgcttcctctgttttcttttattccatttccatcacttaaaaacaaaacaaaaaacctgaactcttgggttggatttcaaaccaacataaaccaattctctaatacaacttggtttgatacaatattagagctacttgatgtgtgtaatgtttcgatcagtaggaaaaacaaatcacgtgtatcctatcaaacttttgattatacacaagtcaaaagagacattcattgtgtgaatttaatgaatttgaggggtctattatatttattagtcagctttaacgtatcaaatccatgacttttatcaatgttttttcttcttttctttctggatctacttcccaataccatcaccggaccggaccacttgatgatcttcctatttatgaacactactactagtaaactcatgtataaaatacgtactttatacgtgtatttctgaagattagtcacttcaaaaaatcatgagagtaataaatgttaaaaaaaaaaacagtggcgctcctttgccatatcactatcccaagtctgtaacacttcactgccacaaaaacaaaaaacaagtaatccaaaataaaataatgattttccaagtgtccttccttcgattaaaccgaggtcaccaaatctgtgtatgtaacaaaaattgtagtggaacatattgaatcagcagcgttactgtataattattttttgattatatcattacatcaacataaattatgatttcctatcattctgtgaaattactgttttcaattttgtgatttgtacttgaaaactaaacctaataaaagaaaataagttaggaatattttgttttttagttttgaaaagtggggctattttttgataaaatatcatcaactttaacaaaaatagataaaaaggttatagtatatattttttagttacaaaattgagattgagataaaaataaataaaatttaatggtcatcgataatattgagatttgaagtgtcgattggtatttgtatagtgttgtatctctctctctctctctctgtctgtttgtttcagagaaggatttttggcgtctccacgcacgatttaacgcatcgaagctctctgcacgcttcctgaaagagagagagaagagagagatcgcagatcgatttctcttaaatctctcgtgaatcccatttgccttctctctgctagattctctcttcttctcttcacccatttctcgctttctcctttgttctctcatctgggttcttctcaaagcctcttcctttttatgccatg

SEQ ID NO: 21417 - DNA, 595 bp, Unknown; identical to SEQ ID NO: 8822
  misc_feature (1)..( 595): 2750-1469P.txt file - cDNA_ID_1989226; gDNA_ID_1971898; Annot_ID_58522

SEQ ID NO: 21418 - DNA, 595 bp, Unknown; identical to SEQ ID NO: 8822
  misc_feature (1)..( 595): 2750-1469P.txt file - cDNA_ID_1989226; gDNA_ID_1971898; Annot_ID_176940

SEQ ID NO: 21419 - DNA, 3003 bp, Unknown
  misc_feature (1)..( 3003): 2750-1469P.txt file - cDNA_ID_1989227; gDNA_ID_1971898; Annot_ID_58521
gatgttgaatatctaagagaaaatatacatcacaaaagcaacgagaaaagaagacaatatacaccaacgagaaaacaataaactaacataacatggaaaatcaagaaggaaacaagacataccagaagccgccatgtttttatgagaagaacttgaaaatagtcttttttctatactcagccgatttttgttctatattttgagaggagttttggaaaagcagtgatggtgaaaatatgtgacgaacaatgtgtatttatacacccaaaaaagcaaacacatgatatatttttctgtttcactaaatcaaaatgtcaaaaatattggttggtcactcattaatgaaggaaacctaattaattagatgtttcattatcaatatgtgcaaccagacctaggttttaatgtttaatttctttctaattctatatgaaatgataacaaggaaattgaacttatgatatctacagtgtactacagctggaaagtggaaaccaataatatatttcatattatttgttttagttttgtttaatcaattgataaaaccaactatacatatttggaaaatgttaatatgtatgaatctctgaactagtagagattttcgttttttacacgttgactattaatgatggatcttaaaaaacaataatatatatacttcattttctaaattactatttcgtagggcatgcacctacacacgtatatatgaatttttactaaatcgttttattttagttggtatacacattttggcaaaactgtaatagttatgtaacccgcaaatattatagatataaattgaggaaacaaaaaagaattaaaaaactatgagtcgtttcaaatgactaagtgagtcataggaaaacttagtcgcatcaaatttctaattggggcatgagtgtgatcaaagaatacatacacataaaagcaaattactaacaactatgaatcccataactagtatagaattaaattaaggaaacgacaaagaaaaagaatcttgactatgagtacaacaacttcaaatatttataggtaagaataaggaatttcagatgactaagtgagtcacgggtgctttccaaacaaaaagaaatttccatcctcattgtggaacacgtaaactttaatatttccttcttttttgttttaagtcccacaactaccttaaacctgaatatcaatttggttagcacttggtattcttccgtcgcacgttttggtggtttctaagaaaagtataataaaattccggtttgttatagaacaaaaaaagaaggtcatatagagttgatcttttcgtttcaaataccattgacagaaaagcttggaggaacaatttgcgaatataatgttgagtttggtgtttctcgaagctgaacaaacccaagcaacaatatgcacaaggctagaaggtggagagtattatttcaaaaggtcaaaatgttcgttggtctcattatcaaattagtgtagtaattaacgttccatctttggcttcctagattactcttatgtttgaaaaaactgacttgacaaaagctaaatgcttgttttctttttcctgtattgaaaagaggttaccatgtacaacttgataacaccaacagaaaaaaagtgaagaatcaagaaggaaaaacaataaaaagtcattgcaaaaaaaaaaaatcgattaatcttcaaccatatatacctaacagattacaaatcccttctaatatgtaatagagatcagagaaatgttttgatgtgtaattaaattaagtaaaatatcacaaagaaagacaaatgtcattacttgcacgaccttgtggtacaacaattaccaaattcgatgtggtatacattttattttacttgttaatttccgcttagtgttttggttcaacaagttatttaatttcaatttcttagtcttatgatatatatatatgtatatttttttttggtgtaaaatcaccagccccaaaacaaaatctagcagtactagcttaggaattcaaatactaaacatggaaagacaaatgaagaagaagaagatctaacgagaggaatctgagtctctagtcttatgatattatattattatttgttaacattgaccaaaatggcagaatagatgagttaacgttctaataaaaataaaaatatgatcatatgaatccgtgagctagtcccaaaaagagatatggaccaatcacatttaacatgttatcattctactgtgactaaatcagttttaaatttaaataagaaacaaatgtttttaattgaaaataagaaaaattaaatgattttttaatctatgtgggaaaattttaaacatcaaataaattgaaagagaggaagtaatatattttttagaaatttgaacttaattaatataagtttccgttttaatataaaaaaaaacaattgatactccaacaatgtgtaagcaaccaattattttaaaatcaaataatttttaaaatgtgcatagaatctttttttatatataaaaaggcgtaacagctggaaggaggagattggttagtgatgaaaaatgaaaagtttctaattacaaaagacgaagatttgcaaaagcttttaattgtttatgtcccaaagctacttgatttggtgaacctctgttctttgatcatttcaagtctgattttcgttcatccccgacatgaataccattctatattcaaatatcttaagcaaaattcgaagattcccagaaattctgggttttcgaagtagtggagtgctatggatgttgcacacaaggtgttcgacgaaatttcccaatgctatttttttatatatcattcttgtgtcacgtgactctcacgttataaaagccttgtgtcacgtgactcacacgttataaaacccagcttcttcttcgatgcaattctgttattttcgttgcttctttttttcccgcttcacaaatttctctctgaagcaagaaagcttaaagaatcttgagaatcgtctacaatg

SEQ ID NO: 21420 - DNA, 3003 bp, Unknown; identical to SEQ ID NO: 21419
  misc_feature (1)..( 3003): 2750-1469P.txt file - cDNA_ID_1989227; gDNA_ID_1971898; Annot_ID_176939

SEQ ID NO: 21421 - DNA, 3003 bp, Unknown
  misc_feature (1)..( 3003): 2750-1469P.txt file - cDNA_ID_1989229; gDNA_ID_1971898; Annot_ID_58519
gtgacgaataatgtgtatttatacacccaaaaaagcacacacatgatgtgagagagagaatattccatttatttttccatttcactaaatcaaaatgtcaaaactattggttggtcactaattaatgaaggaaacctgatttattagatgtttcattatcattatgtgcaaccacacctaggttttaatattttctttctaattctatatgaaatgataacaaggaaattgaacttatgatatctacagtatactgtatactacagctgattaccaataatatatttcatattatttgttttagttttcatataattaattgctaaacaactatacatatttggagatttaattacgtataaatctcataactagtagagattttcgtattttacacgttgactatcaatgatggatcttaagaaccaatatacttcattttctaaaatactatttcgtaaggaatgcacctacacatgtatatatgaatttttactaaatagttttactttagtcggtatacagattttggcaaaactataatagttatgtaacccgcaaatattatagatttaaattgaggaaacaaaaacggattaaaaaactatatgagtcgtttcaaatgactaagtgagtcataggaaacttattagtcgcttcaaatttctaatctgtgtaatcaaagaatacatacacataaaagcaacttactaacaactatgaatcccataactagtatagagttaaattaaggaaacgacgaagaaaaagaatcttgactatgagtacaacgtaacaacttcaaatatttataggaaagaataaagtaatttcagatgactaagtgagtcacgagtgctttacgaacaaaaagaaagttacatccacattgtggaacacgtaaactttaatatttcattttttttcaagtcgtcccacaactataccttcaaatctctagacgtgagatatcaaagctaccttaaaacctgattatgaatttggttatagtacttggtattcttccttttcacattttggtggtttctaagaaaaataaatttcggtttgttatagaacaaaaatagaaggtcatgtagagttattttcatatattcatatctactattgacagaaaagcttgaggaataacttgcgaatataatgttgagtttggtgtttctcgaagctgaacaaacccaagcaacaatatgcacaaggctagagactggagagtattatttcaaaaggtcaaaatgtttgttggtctcattatcaaattggtgtaataattaacgttccatctttgggttcctaagttactcatatgtttgaaaaactggcttgacaaaaccgaaatacttatttttttctttttgctatcttgaaaaggggttaccatgtacaacttgataacaccgacaagaaaagtgaagaatcaacaagataaaacaataaaaatgaattgcaagaaaaatagattaattaataaccatatacctaatagattataaatcccttctaatctgtaatagagatcagagaaaaattgctgtgtaattaaattaagtaaaatatcacagagaaaaacaaatgtcatcataacgtgcgtacatttgatgtggtatacatttcattttacttgttaacttccgcttagtgttttggttcaacaagcaatttagtttcacttgcatagtcttttgatattattagttaaattgatcaaaatggcaaatagatgagttctatgttcaaaataaaaatatgatcatatgaatccgtgagctagtcccaaaaacagatatggaccaaccacatttaacatgttatatttctactgtgactaaagtcagttttaattctatgacataactacgtaacacattgatactatatatccgctcattcactctacaatgactctcatctcaatcgagtcaatcgccacaatttgtttgccaactaattacaaactcactagatatataacattcgaagtcaaaagataaaaaaaaatgtcgcttatatgatcttacgcatttgacaagaatgtcgctatatatcttgtatacatatctagcttcatgggcacgtttctatgtccttcactccccacttgtctttagttgataagaaattaatgttatacaacatcaaatgaattgaaagaaagcaagtagtatattttttcggaaacttgaaattaatttactctatcctttttgaaatgtaaggatgtttcaactaaaagcacaaaaattataaagtataattttttttttccaaaaacatcattactatttaattaagattcaaccaattatatataaaaaatattgcataataaaattgttgcaaagtactccttatgtcagttaatttgttgcaacaatatgcaaactttaaaattatttgatactccaacaatttgcaatcaaccaattattttaaaatcaaataattttaaaattttgcatagaaactaaccaaaaaaaaaaggtaacagctggaaggttgagattggttacaaagacgaattatttattatattaagccccaaagctacttgatttgtcgaacaacctctggtctctctgatcatttcaagtctgaattttgttcatccccaacatgaataccattatatatccaagtctcttaagcaaaacccgaagattcagacaaatcctgggttttcttttgtttatctattcctgaaaattcacaactaaatcgaaacagtgtagtgtagtgtactacagatgttgcacacaaggtgttcgacgaaattccccaatactaaaaattgttttttctttttctttaaaccaaagccttatgtcacgtgacactcacgttataaaagccagatttttcttcgatacaattatgttattttctcgttgctcttttttcccgcttcacaatttctctctgaagcaagaaaagccctcgagagacacaagaaagcttaaagaatcttgagaatcgtcttcaatg

SEQ ID NO: 21422 - DNA, 3003 bp, Unknown; identical to SEQ ID NO: 21421
  misc_feature (1)..( 3003): 2750-1469P.txt file - cDNA_ID_1989229; gDNA_ID_1971898; Annot_ID_176937

SEQ ID NO: 21423 - DNA, 3000 bp, Unknown; identical to SEQ ID NO: 8833
  misc_feature (1)..( 3000): 2750-1469P.txt file - cDNA_ID_1989234; gDNA_ID_1971898; Annot_ID_58514

SEQ ID NO: 21424 - DNA, 3000 bp, Unknown; identical to SEQ ID NO: 8833
  misc_feature (1)..( 3000): 2750-1469P.txt file - cDNA_ID_1989235; gDNA_ID_1971898; Annot_ID_58513

SEQ ID NO: 21425 - DNA, 3003 bp, Unknown
  misc_feature (1)..( 3003): 2750-1469P.txt file - cDNA_ID_1989236; gDNA_ID_1971898; Annot_ID_58512
cttctataaacactagtcttgtttttcttctacactatgaactttatccaaagactcttgaagaacttgcattgcgactttataatgatccaaagataccgctccttcttcaactacctgaagagagtttttatacaactggtcaaaccattgaacccggtccgtaccatcgacaaaaccagtcaagccgttatcagcgaagtggaggcgtttgtagtcttttctccaccgaggtagaatataccgtaaagggatttcttcaacgccgttgaaattgagaacacatagagcatgtctgcataagtatccgtagaagttgaagcagctacaaatgcaacgtacttcgccaactgatctgttgtacagaacttcgaaatcgcggatttctcttctgctggattcgcctcggacccgttctttcacaaggaagatcacgaaaggtccatcgacatggacctgcgttgtgctgaaacatgagtacatttcttctacctctatttggaatttcttgaacatgtctctcgtgtagattctcgagagctgtgtctcgaaagaacactttgttttaagctccgcggtgttcaaggtttgagactctatgtcgctgagagtttcttccctgtgcttcttctgaagagctagctcgtacttatcgagaaactctttcaatggtgtttgcttgtgaacatacctctcgaaaaatggtttcagggtttctccaggatgagcagcggcgattcctgcaaaaaaagtgtctttgagataaaccggagcccatttagctctctcttcatacaaggaacggagccattcattctcgataaccccaaaattgtgaaccatgaacccccaagctgcttcaaactcaacaacttttaaggtttcgtaaactgctttcgtaaatgccttcctcacggcatcataattatgcagcccccctaatttctctggaattttcctcattatatgtgtcagactgaatctctgatgagatcttgggaacacttgagagatggcagcctctaaaggcttgcatctgtctgtgacaatagtttgaggagaacgcttcatgacactgagccatactttaagcaaccaatggtaagactccattgtctctccagcaagaaaaccacaactaagcaatgtagttttcccatggtgattcactccggtaaatgtcaccagtggaatctcgaattttcctgatatataagaactgtcgatgaagatgacatcgccaaagtaactgcaggaaactttagagaaagcatctgcccagaatacattccgtagttgaccttcatcattcacatccatcaagtaaaaaaagtttggatttgtcaattgcatacggcaaaagtagttgtaaatggctgcagaatctcctctcttaaggttcagcaaatcaggtgacccagtagaattctgaaacttcttgttaagagtcgagtttgggttcacattgctcccattatccaccacacaagctcggtacagcttaatcgtcttagcgtctgagactggactagatacacacttcctcttccttttaaccgatttatataacttacaaccgagtaaatggttatgatcaagtgtaacttcaactacccgccacctcttagaatcaacctgtctcattcttatcatagcaggacaaccagttcgagtttcctttctaacacgattcacatcgttaatcctcttaaaaccttgactactacaacaaagcaccgcaccatacttctctttactacgccgcttaaaccacgaattcttcactcttacacgaaacccaacttcactagcataacagttataatagttataagcatcatcatacgactcaaactccattccaaccgcaggtgcatcgaattcttttctctcatcaacaagtaaaccactctgttcatcaaaccctcccattgtttcttcttcactctttctttcttcgttttgacaaaatccaacatcaatctcatgctcactactacaaactagagcttcttctcctatccgtaaagtatctgacattggatcatctctttcacgaacctcgtcgttctctaaatatgcagatgcttggacctgtaataacaaaaagctataaactttgattctagcaaaccctatttactcaattgaggcatcaaacttgtgaaggagctgaacaaaaatgataatcaacccaatgaaatcaaatgtaacatcatcacaacccttgtgcgaatcgattcataatcttcacaaaatccagaattgaaaagaggagttttagagttaaacacatacatcttcatcaacggactcacttctctccattggaggtttggttcctcttccttcttcaattcgcgggtaaattttgatgaaagcacttgactttattcgattgaaggagaacactcgtgaaattgatcggtccgggatagatccggacgggtcttacacggaaagatccgacccgagagtgatcttgcgcgggtattgacctttgaaagcggttaggtagtttaacttcttcttctgacggtgaggtggtcttttggggctcgactggtgactctagcattttcaccaacatagagacaccttaggcttagggttttcacacacaggttcaaagcacgtgctgcaaacgtcgtcgttcgcacttaaacatatcatttttgtttttccttcacttaagacacttaaacgacaattacactgaaacggagggaatgctatgaaatgaaatccaaaattgcattacatagattccctgaaatgaaatctatgagtctatgacattagtaaaacgcacaaacttgtgaatgtgatatttatgagcttataaaacagcatatataaaaaaaaaatatatcaatttctagattttacccacaatcttaatttatgtcatcattaaccactaatttttcaatattttctctctctttcgaggcgcatatataaatacaggaaatacgcttttttacttaccaatcaaaaatg

SEQ ID NO: 21426 - DNA, 3000 bp, Unknown; identical to SEQ ID NO: 8826
  misc_feature (1)..( 3000): 2750-1469P.txt file - cDNA_ID_1989237; gDNA_ID_1971898; Annot_ID_58511

SEQ ID NO: 21427 - DNA, 3003 bp, Unknown
  misc_feature (1)..( 3003): 2750-1469P.txt file - cDNA_ID_1989239; gDNA_ID_1971898; Annot_ID_58509
gttattcagcatagttaattttcgcaaaagaaagaagccaaaattaattaaaagaagcagcaaatgttgtgtcccttttatgttttctatgcgaatggctcaatggagtaaattgctaattcacgtcatgaacacaaaaatgttgatatattaaacaagaagtccatttttgtacctcatatcaaaattttatttgtaaattttgtattaataattgtggatttgctatactatactatgaaatatttttctttatagacaagttatgttatacattaaattatttatttattaataagtacagtattttagtgtattgtcagagttcagtttctttaaagaaaacacaatattttttttttttgtcgtcaagaaaacacaatatttatgttaaacaaaaatgcatgatatttcaatagtttgtggaaaattatagaaaatatttcattttccttcttttagtttggtattaagaaggaaaaaaccaaaaacatttttttgataatgtatacataaattaaaattaaaataatgagaaaacaaaacaaggtccaaaataccttgtgaagaaaatggcgacggcgtttgccaacacgacttcaagctccaacctttacctccatcgctgccgtaaaaaccatcctcttccatctccgtcgttcttttcaccgttccggtcgtctccacttccttctcagacccttttcctcgtccccactccaaaacctgtacgacgcatcgcggtcgctcctctcggccctccaacgccgcctagtcccgacccacctccgcctaaaaacacgactgagctcacaagttcgtctttcccttcttacccttaaaacttcaatgtttcaactctgagttctgattttgtttactgccaattctatttttcaatctttcctaattcgatgaaattgcattacggaattcgaattaggagaatgaaggtggtttaactgctattgattcgtagataaagatgttaatcttagtcctcaagatcgattactgttcattgctaaagttttgatctttgtgacaatttatagacttttactcttgttaagcattaaggatttataaatctcctccttttacaacttgtgaatgtcttccaaaagttccaccattttcttttccctacaggtttagtcattggttgcaatacgagagcaatcttcttaacaatttggattcatagttgttgtttggtatcacattttgtgtaggtcttgtgggagtagcgtcgatgattcaagaccgtgtaaagatctttctttcagtactaatttggatctctctcttcttttgggcttcggctttacaaggaagaggcagcaaaggtaatggtaaagggaagaagggttcacgcttcaaatagtattagttagattggtgtggtgatgatgatgatgattgatgaaaactcctctacacgtttgtgtatatatacagaggaaatattcttccaagtaaagcaaatttcttgtcagactacagttttatactagaaactagattgttctcttcttacgatatctctagcttagagctatagagattactctactgtgatgaaactaaagtagtttgcatttaagtcaaaatgccaaatcaatatcattgtttattgaaagctgtttcagattgtaaatgactagatgtgtttggtgtgtgcttgattcagccaaacggtaaaccgcaccgtttctttgatttgaatgtttgttgtataaaatgggcctttagatatgttatataacttgtttgggcttcaacatactcttttattgggcctctctatataatataatatttccaaagttgtatttaattattatttgatttatatttaaaacagtggttgtttattcatgatatgaaaaaagaaataactggatttaggtaaaccttattcaatactgggacaatgaattaaccagctcatgattagttggacctgttttggttaaaggctggtagtaagtttagaaacagaaatttatgataagagcctaacattttgttctgaccacactgagtaatttaacaatctatctaaattaagattttatgctatgtttaatttatatttgttctgattatagcaaataaatttccatatctagagatcttcttcatacacaataaaaaaaactagtatttgaacttttgtatgtattaaaaattgcaagattttgtaagtacagattcaccaaggtgaggtgtgtgattaggaaactttgattagttgtcatgtgtcatcaacaggccatgaaaaggaaatctttgaaattcaaaaaacaataccttttgatgaaattattactatataaatactatatgtgactatgtgtggatatgcacaatcattcccactaatagtttaataaagtgtataatttttttcaaattaaaacagctaaacacacacaaccacattcaaaaaggggttaagcattgaagaatattctaagaaaatttgtttctcttcttacagaagtaaaagcgactctctctctcattaagcatcaaaggagtttcgtttttcttgctttgctgttacattcttcaggaaaaaggcgttacctttactctctctgcatcaacgaggaagcgtgtagagctaaaggagctgaatttgagagatttttttgttttgtttctgggtttgttcaaagatgcaaatttttagttgtttctgctgtggaaaaggatttgatcggtatgtatggagttttaatcttgattttcaacttgatttgctggtttatgggttttatctagtttctccattgttttgttcttcagaaatttgttcttgctttgatccgttttgctattcttctttattagggttttgagatttatatcatttctcgagcctattcatgttcaaaatttatttcttggtgtaaagtttggaactttcgaacaataatctactgtttgataagcttaagttgcagatttgataaacccaagaagaaagtaatg

SEQ ID NO: 21428 - DNA, 3003 bp, Unknown; identical to SEQ ID NO: 21427
  misc_feature (1)..( 3003): 2750-1469P.txt file - cDNA_ID_1989239; gDNA_ID_1971898; Annot_ID_176928

SEQ ID NO: 21429 - DNA, 3003 bp, Unknown
  misc_feature (1)..( 3003): 2750-1469P.txt file - cDNA_ID_1989240; gDNA_ID_1971898; Annot_ID_58507
tatttaatttggttaaatgtaaaggagaataaaacaaaaacactgagagggcacttaaaagccaacaacggtccaaagatggataaggtcggtccaaaagctaataattcgacaatactctggacacatgggcttttttggtcgtaaccggtcccatttctgttcttagagaaaatcagaaacggtttttaaataacaaagtagattgtagttgcaaaccgaaagcatggttcgtgcctttgcactattattttcatttcatccctttaattaatagcttgtcatcaaaatgaaaggcaaaacttttactaatttgtgttatttgtgagcgtacaaatagaggatccaaaccggttatatctatatttcagttctgataaataagatgaaagaataacttttcaatcggcatggaggaatcttttgatcgctttggaagcaatcttgatagttggcgtttttgttgtgacggcttgtttatggaaatgggctttgacatgcggggtaattgtagttgcttgacacatagcctacttgattatgatttttgaatttgtcattcgtggtcagagtcggtccaaagactaatcatgtttaaagctcaacaaaatttgatgtccatttacaacaaataaaaatagaaaattgttttaatattttcgattaccaaggatcgaaccaatcactttctaccttcaaagcacagaaaaccaatagattataagacgtttcataaaatttgatgtcttttaaaatatatataaaatttgctgtctaaagcatctatttgctgtttacaaaaaaaaaaaaaaaagcatctatttgctgggttttatgttccggccggccttcaagacaccgcaagcttgtggatagcgatggttttcatcatcatgctgtggtttatattcatctcaaagtaggctttgacatgcggggtaattgtagttgcttgacacatagcctacttgattatgatttttgaatttgtcattcgtggtcagagtcggtccaaagactaatcatgtttaaagctcaacaaaatttgatgtccatttacaacaaataaaaatagaaaactgttttaatattttcgattaccaaggatcgaaccaatcactttctaccttcaaagcacagaaaaccaatagattataagacgttccataaaatttgatgtcctttaaaatacatataaaatttgctgtctaaagcatctatttgctgtttacaaaaaaaaaaaaaaaaaaaagcatctattcgctgggttttatgttccggccggccttcaagacaccgcaagcttgtggatggcgatggttttcatcatcatgctgtggtttatattcatctcaaagtaggctgcaaaagagcgggagaacggtctattccactccaaacttagttactttatcgtatccatacatagaactttgaagtatgcttttaactatatgaactaacttataatttgaatttactacataaacaatcaaaatatggctgaaaccaacaaatcaatagatgccgttagttaaaccgttaatgtagctgactaggatgccacatggatagactttacaaaaacgaatctaaacaacttaaaagacgtcgtatctgtgacatctactgtctcttgaactattgtgttcaagggacagtagatgtcacaggttcgatatgtttagattcgtttagattcagtttacttctaagaaaaatataatatttttttttaaaaacatatatttcatcaagcaaacctgaaatagccaaaaagatttttttttaaaaagccaaaataaaaaaggaagaaaaagggttccataacaagaaaagagaagaaaattaaaaggctagtgactaaagatacattttcataataaaagaataaaagaatttaaaaaatgtatatgagcaaatcataagcaaaatataagtattaaacaatatcaaataggtttaaattaattttattacacagaataaaataattagtaatcatcaataatactaaaaacatatagtagtacaaataaaaacatagtagtacaaactcacggaggaaacgggtgtctaacgtaattaatttttcgattcaaaccaatgattcatcgcctaagatttttgtgccggtctagcgacacaacccacatatttttttcaaagttgatttataaagttctatgagttgtaaaacattattaccttagcaaagagagacctgcggaagaatctggatgttgtacaaatattcaaatttcctatattaccacctcgtttacaatttattaatggttatgatatatatgtttgtgactcagttgcttgttaagtatgaaccgtcaataattaaaaagtcattttagtagaaaaacaaaaaaaatgtataattgtataacaagttagcaacccacatatgttgcagagttgatttataaaaaaagattggggacagagttaccattagaagtttggatcgaaacaattgtttttttttgtttttgataaaatattgatcgacacaattgtttgacattcatttaatgttcttaacacaaaaccaaaatccatatgactatatttatattaattatgttgttagttttgttgaaataagttatccaaaaacaaatttcaagaataatttgaaagattttgggtctttctactttctaggaattgcaaggtcaaggcggttggtcttgtgtcatgattttcttcgttttaactattcaaagaaaacaaatattgataataaaataaccttgttgtgattatctagaaaaagggctgtagaagaaacaagaagcatctctgttttatgttcccaaatgaaccagaaactcttagaaacttctaacacctcttagaaaccaaccttttagcataaaccctaatcccatctttataaaccaaacacttcttgcctttttcttgcaaactcacaaaaaagaagacaagaagacaaaaattaagaaatttaccgatttgaaaacaatg

SEQ ID NO: 21430 - DNA, 3003 bp, Unknown; identical to SEQ ID NO: 21429
  misc_feature (1)..( 3003): 2750-1469P.txt file - cDNA_ID_1989240; gDNA_ID_1971898; Annot_ID_176926

SEQ ID NO: 21431 - DNA, 3000 bp, Unknown; identical to SEQ ID NO: 8819
  misc_feature (1)..( 3000): 2750-1469P.txt file - cDNA_ID_1989242; gDNA_ID_1971898; Annot_ID_58505

SEQ ID NO: 21432 - DNA, 3000 bp, Unknown; identical to SEQ ID NO: 8819
  misc_feature (1)..( 3000): 2750-1469P.txt file - cDNA_ID_1989242; gDNA_ID_1971898; Annot_ID_176921

SEQ ID NO: 21433 - DNA, 3000 bp, Unknown; identical to SEQ ID NO: 8817
  misc_feature (1)..( 3000): 2750-1469P.txt file - cDNA_ID_1989254; gDNA_ID_1971898; Annot_ID_58487

SEQ ID NO: 21434 - DNA, 3003 bp, Unknown
  misc_feature (1)..( 3003): 2750-1469P.txt file - cDNA_ID_1989254; gDNA_ID_2684104; Annot_ID_190342
atgcttagaatacggataaagtttaaacttcacagtgaaattcagttgagataataaagtcaacccgttatatttactcatgttcttcaaatcgactaacctttgtaccaaaaggactttcagggtggtcgatgtcaagcagcctccttccctatacaaggagaacacaaaaaaaaagtcaaaactaagtttctgatctccgaaagcaacatcgaagtacactatactctttgtcaagacgaatcatctacagtagatatcaaacaatatcaatatcaatttctcttctcatctcatactctccgtcgacgatcggcgcattactttatttactctgtttttcttatgtttttacgttgtttagtttaagagataagtcccgagcttatcactcacctttgtgggagaattgttcaatttcgatttgacttggcacgtgtgagacactcgcacatgcgaatctaaggttcagtaactggatgaaatttactgaactctaggaattttttaaaatcataactataggaagaaacaaaaaatgtggtcttaactacaagaattatcacatttttaacgataaattatacaagcaaagaaaaatctatcttgatatttttttagaaataagtatataaagaaccaataaaatccaactgctattttgtttaagtttctaattaatattcacaagctttgttgggcaatattgaagattaaaccaaaaaaataaaacgattttgtccataatcattctcgaccgaccactgtcaccattctaaaatatcattgttttgtatgcaaattgcataaatcaaatggctctttcacgtttaaaataattgtatttcggagaaagtgcatatcaagacattgcaatctgacaaagaaaaaaaagcgtgtagacttatctatctccctaggttaacaatccaatgcatgcgtgtccacctttaaatctccctacacaagcaaaattcagtaaaaagcttgtacgttgattacatatccaacgaaccatatccactttcaatttgttaatcatataaatttgaccctaaaatctatctcattctctcatcaatcttcttcctttaaatccctaaatcttcacgttacttttctatctacattttcactttcaatggctttgattatcacctgctccgctctacccacgatccgagcatcttccggatccggatcccttaacccggatcaaaaccgtaagaaatctgctgcttggtgggctcctctcttcggtttaccctccgatccagattacctcaacatcgaaagctcatgctccaccgtgaatccggataaaaccgatatttccgggtcgggtcaaaagtttcgtcgcggttgttttacggaggagaaagctaagcagttgaggaggaaaaccgcagaagcttccacgttccatgacgtaatgtatcactccgccattgcttctcgacttgcgtctgatatcaccggccgagtcgaggattgaaacggattcgggtcagatctggagacgaatcaattaatgaataattaatcttttttttcttaattcagtgttcttgtaggatgcagaccatcttctatcggtgctcctttttcatttgaaccgttggcttgtgtttggtctttgtgtgttgtaaactctagttccctttctgtttcttctgtaatcaaccgttggatttccacttgttatttttagacatgtgttccctagttagctcttttatcttatctcaaatttaagacattgtgttctctaaatctacatcagaacttgactttggtctgaaaatgtctaaatataacattttctcaacggttatctacttcagaacttgaattcggacagcttttctacttcacaacttgaattcggtcttgttttacaaattccacatagacgaactataatattttgtgacatttctcactgaaaagccaacactaattaaaaccactccagatcttattcttaacgatgatcgtgaatttggttgtgtcgaatcttttaatatagtcgtctcgttgtttcaatgtagtggtgatacatctttcctctctattaagatctttttataatgttcaatgaagaaccacaaaatgtaaagtgtctgtgatctattattcattcttgtaagtttttctctccacaattcacattttctagaatcaaacctcaaattagatgttaaaacattaaacctccaaactggttctctgcctccggtagtcaccagtatcagatgcgctcctccggtgacggcaatgcctttccgattttcctttagtaaaagccctgggccaatttgggatttggccaattattgaatataacattataaactttaaaaaacaaaacattaaaccaccaaacgaaattttaatttatttatttaagaatcatactttgttttactttattttcaaaatcatgctgacaaaaaaaaaacgtacagtaaaatacactactgatttacgatttttttttctaaataaattatttacaaatggtattgtgaattgttttgtcaattacgaaaatatagggtcgcttattgcaacatatgaaacgtataggaactaaattaaaaaatacaaataaaggtcttctccttcccgtctagatgtagaaatccctaaaacttgctactgttttgcatacggggcttgtacaaataaaaaccacccaattcctacgctttcctctacaaattgtccccttttttttttaacttttatactttcaattcatctttggttctgtagaattcccaggaatcagcattccactgtaagctactggtttctctaattaactgtagatcgatcgaacttttatagattcgggattgtttctcccaatatttctgtagaaattactacaaaaaaaattagattttcagctactctgagtctaccttgaatcgtttgaaatcgaaaaccctttcctttaatttcaaagagtcgcttaattagggtttaggatagatg

SEQ ID NO: 21435 - DNA, 3000 bp, Unknown; identical to SEQ ID NO: 8817
  misc_feature (1)..( 3000): 2750-1469P.txt file - cDNA_ID_1989254; gDNA_ID_1971898; Annot_ID_176899

SEQ ID NO: 21436 - DNA, 3000 bp, Unknown; identical to SEQ ID NO: 8843
  misc_feature (1)..( 3000): 2750-1469P.txt file - cDNA_ID_1989256; gDNA_ID_1971905; Annot_ID_58533

SEQ ID NO: 21437 - DNA, 3000 bp, Unknown; identical to SEQ ID NO: 8843
  misc_feature (1)..( 3000): 2750-1469P.txt file - cDNA_ID_1989256; gDNA_ID_2926146; Annot_ID_197757

SEQ ID NO: 21438 - DNA, 3000 bp, Unknown; identical to SEQ ID NO: 8843
  misc_feature (1)..( 3000): 2750-1469P.txt file - cDNA_ID_1989256; gDNA_ID_2926146; Annot_ID_139116

SEQ ID NO: 21439 - DNA, 3000 bp, Unknown; identical to SEQ ID NO: 8843
  misc_feature (1)..( 3000): 2750-1469P.txt file - cDNA_ID_1989256; gDNA_ID_1971905; Annot_ID_176972

SEQ ID NO: 21440 - DNA, 3000 bp, Unknown; identical to SEQ ID NO: 8908
  misc_feature (1)..( 3000): 2750-1469P.txt file - cDNA_ID_1989264; gDNA_ID_1971919; Annot_ID_58540

SEQ ID NO: 21441 - DNA, 3000 bp, Unknown; identical to SEQ ID NO: 8908
  misc_feature (1)..( 3000): 2750-1469P.txt file - cDNA_ID_1989264; gDNA_ID_2926265; Annot_ID_143307

SEQ ID NO: 21442 - DNA, 3000 bp, Unknown; identical to SEQ ID NO: 8908
  misc_feature (1)..( 3000): 2750-1469P.txt file - cDNA_ID_1989264; gDNA_ID_2926147; Annot_ID_139145

SEQ ID NO: 21443 - DNA, 3003 bp, Unknown
  misc_feature (1)..( 3003): 2750-1469P.txt file - cDNA_ID_1989265; gDNA_ID_1971919; Annot_ID_58539
tatcaattacagcagacgcaatgatataattgtgatgattaggatcttgggctgttgcgaaaactagcataccgccgtatacggtcttaagaaaagtggcatccacaataacaactttcctcataactttgaacccttcaatgcaagcacccaaagcaacgaataagtacttgaacttttgttgtgcatccacttccacatatgatattgtcccgggattcacctcctttaatacgtacagataagagtacaagtcggtgtagcttttttcaggactaccacgcacatcattaacgtgttgtcttttccctctccatgcggtagcatacgagcaatgcaaacccattcttccccgaacaatactcattatgcttttaggtggtggagtttgaaactcacctggataatcctcatgcaaaatatacgcgattaatcgtggtgtgctggtatgtttacaattgcctgagttcttattagaccgcttgcatgtgtgcatcttcctgtgaactttaacactaaaacaatctgaactctttacttttgcacatcgtaaatactattgacaacctgttgttttatattgccgacatcgtaacatgagtcgctttggatctgacgctatagttgcggtcgcaaaacaatacttatttgcagctctgttaaccaaatcttgcacggcctccttagaaacaaattcttggtgcaattcaatccccgttccatcttcccattccgtaacactctgacttttctcgctactctgacttccttcaccaacacatgaaagctcataatactcaattctaccatcaacaccattatcttcagcaacatccatccggctatccacatgctccctatcttcaataactacattctccatagcctcttcaaaaacccggttatccgcattctcaatagcctcttctacactattagcctcttcaataatcggttcatcattcacacaattacctcctgcagtttctcctctaaaaatcgtcactactccaccattctccatatcaaatgcattcaactcctcagaattaataccaactgaacttcttccctctacccttgaattttgttccaccctctcagattctttatttactacctccacgttcaaagttggtctaattcctttagcattcactaccgttagataacctaaaaagtcatcatcatctacaatagatgtatctctctgagatgtgcatagaatataactcaatttcaccttccttgaggtttcatctattccaatcttcttgcatatcttttctactaacatagagtatgttacctttaacgttctcaacaatacaccgcttaaagaattgtttgaaatccactcatgctcttttgaataatacccattgtcaaattgtatgaatgtgtgcttgttcttcatcgtctcctgtaattacaaataaattataaaaacacaattacgtaatcattcagatttagacataattgtacctatattataactcactaataccattcacctgtcctaattataaaacactattcttttttttttactaaatcactaatgacataattataaaacactattcttttttttctgtgtggagtagtgactattgaaaacaataattaatatacaattaacgggtttaaatcaatattaatatattatgatatattacaggtaaaattctaaaattaacaattaatatacaattatacaatcttaaacaataaacaaaataaataatattaactaaacaaatacaattaaaatttcagttataaaaatattgtaccatatatttaaattaaacaaaataatacgatatactatagatcatccttataaaaaaatcaattttcttatgaatgtacaactcaatgatgtaacattatgaaaaacaataattaacgagtctactaaattaaaaaataattttgactaatttttgatcatgtttaattctacaaacaccaatatttgaacaatcaaaacccattattaataatctgcacatgaatcgttgaccatatatacacacataataatcaatgtgcatataaagaataaagtaaatgtatgtattcaataatttaaaaacctggaacacagaattcatagtttctactagtttttcagtgtttaaattaaatgatgttgataaaacattttagttaattttctgaaacaacttctttaaaaatagagaaacctccagcataaatttagtttgaataaatttaaattttatgattttatttactccatttgtgtttgacgaacagtccaagtctagtataacacagactgatatataatttggttatctacaacttataatatgcatctactttgaagtaattaatcatatgtcaacacatactctctccatattattttaaatgatattttagagaaaaaatttagtttcatttaaagtgattttttttaatttttaaatgtatataatattttttgaccaataatattttatgatatattttaattattgattgaattagttataattaataatactttatatgaaggagataaaattaaatgaaaattttgtaatttctaaataaatgcgcacaaacaataaatttgtcaaaaaacaaacattggggaaaatggtacccacacccaccataagagagtaaatgggtcggatccaaaggacagtctcgtaactgacaaattcacgccacgtcataccaacaaactgttgctgatccaaacacacgccgtcatttagcccggaagcgcgtgacatttcacgcgccttctctctatctcacccaatcagatcgttttaatggttgtttgtttaatcgatcttcttcttcgtcaagtatctcaaaatcaaaaacaagtttgcttcattcatacttcaaattctctcttcacattctccactctctgcttatgttaacgtagagagagacggcgacgtagaaggagtaggaggaggaggcttcgtcgacaatgcgagaatg

SEQ ID NO: 21444 - DNA, 3003 bp, Unknown; identical to SEQ ID NO: 21443
  misc_feature (1)..( 3003): 2750-1469P.txt file - cDNA_ID_1989265; gDNA_ID_2926147; Annot_ID_197810

SEQ ID NO: 21445 - DNA, 3003 bp, Unknown; identical to SEQ ID NO: 21443
  misc_feature (1)..( 3003): 2750-1469P.txt file - cDNA_ID_1989265; gDNA_ID_2926265; Annot_ID_143306

SEQ ID NO: 21446 - DNA, 3003 bp, Unknown; identical to SEQ ID NO: 21443
  misc_feature (1)..( 3003): 2750-1469P.txt file - cDNA_ID_1989265; gDNA_ID_2926147; Annot_ID_139144

SEQ ID NO: 21447 - DNA, 3003 bp, Unknown; identical to SEQ ID NO: 21443
  misc_feature (1)..( 3003): 2750-1469P.txt file - cDNA_ID_1989265; gDNA_ID_1971919; Annot_ID_177170

SEQ ID NO: 21448 - DNA, 3003 bp, Unknown; identical to SEQ ID NO: 21443
  misc_feature (1)..( 3003): 2750-1469P.txt file - cDNA_ID_1989265; gDNA_ID_2926265; Annot_ID_204902

SEQ ID NO: 21449 - DNA, 3003 bp, Unknown
  misc_feature (1)..( 3003): 2750-1469P.txt file - cDNA_ID_1989267; gDNA_ID_1971919; Annot_ID_58534
cattggtctatgttaatgacataatcatcacatgaaacaatttggatgcatttgaaaatattttacaaaatctagctatcagttttcacttaaagacttgggtgagtaaatattgaagaataacttacaaattgattctatcaatcacaaatcgcaaacctgaatgctttcggttgaacaaatctcgtgcagttactagtgttcctcctctaccaaaatgaccaagatgatatagcatcctacgatatgaactaagaaacccagtcttggtgggatatccgaaatcaacaagatagtacttcccactaggcggatgtgggaaaaaggttcattcctcgcacaatgattcaaaacttttgtatcatgtgctctacaagatatactgacatatgcatatatgaatttcatatcgaagttacatatagcaagaacattcattatatgttctatctttctatatttatatttttctacagattgacttagacggcgaaccgggacataagttccatcaagtgctccaacacaatctctaaaaacaggccaatatcaatcatcattcttctaaacagggtttactctcgtaaattcaccttcttgtggctttagtgtatccactacaaactttaaaagagcactcaaaacatcatcaatcttttttttttttaccgtattcaatgaccgttgatatcttgtaactatatctcaaacagttttatcctgaccaaccacctcgaaaagtattagtgatttctacctatatagtgaagaagaccgtaagtattagttccaaacatttagacccattatatagaaacagacatagaatttggaaattttgaataaaccgatcaagctgagagtaactaagagaacacaaataaataagaaactcaaaatatttaagagatttcagtcagtgaataacgaaagtacctcggagtagagattcaacgttgtattagaagtaaccaacgacgggagatctagttgagctcaagtcaccggataatatttcgcaagattgcggcggcggagagagattggtttcaaagagtttgagatcgatgagtgtaagagagaaatgatgaaaaagaagtagaagaaatagagttaggtttgtttgtagtttctcaaacataataagggtataattgtcatttatcatatataatacaacttttaagcgttgaccgcagcattatgccgcacttacttgcatctgccgctgttgcagcaacctagataatcaaacgaacatcttattaaaaaaaaacagaagctgaaagcccaagcttatttaaagatgggccaataggggcctgcataaagttccaattttatttagaaaatatctatttaacatcatttatgaataaagtgtcctccgatgctatttgggtttggttaaagatggattttggaggttttccaaatgatgtcagattttgaagatgaacaatgaaataaatatatctaaagcttatacatctaggtctcttacccaacggcgatgaaataaagaatacatgtactaaaacgacgcatgcaaaataatacctgaaattttctttctacgttggaactcattgcaaaagatgaggaatattgcatagccatggattggatagagccataaagaatcggtacacattgcttttcatattttaatatcgttaaggcgtaatgtaataagtattagaaatggatttttaaaagtatttagatagttcgggtttaaattttattttattgctgattggactttgttttacaattatagagaaataattttgtgttaaattatagtattatacgacattcacacaattacatttacattaacatgtaccacgtctattttataatattgctccaaaacgaaagagtggtcttcacgacgagcgaggtttaaaatttgtagtcgtgcattgcaaaaagctgcgaaaaccgtgtgaactctcaaccaaaccaaatatgatatgaagaaattggttcttgtccattcggtggttagtgtgcatgcatgtcggtgaattttatatgttttccatttacgaccttttctctttatatcatatagatttttaggggaaaaaaaaatcatatagatttttaaaaaatcatgttcccaattaagacataatgtttagtagccaaattgagaaccaaccttttttctgtttattaaataatttaagtggatggattttacacatatattttaatgtcttacataaataaaatatcatgttattttttttgataatatcatgttttattgataaaatccatacatacttgatacttgcaaaaaatatcatgcacaaatttatctctataaatggttatctaccttttttttttttttttttttgaacacaatttacctaataatcttaataaatataagagaaatgtaacgcatacttttgttggacattgtttttggtcgagtctgattggttttttgttcagatctatcggatttatgtatttaagatctaataaacaaattataaaaaatttgattcgatttggttatcgattttattaataatgttaatataatccgacttactttggttagaaaaattaattcaaaagtaacaacaaaaaaaaattggataacaaaaccatctaaaatcctgctaattaattcacatctaataaccgaatccgaacctaaatgaccaaaccatttgtgtaaaaatctcaagcctagtccctatatttcaatagatttttttcttttttttttggtcaagatcaatagatttttttcatcaattcaatttattgcaaatttgcaataatagttggtaaatactataaatgtaaatggtcacgggataacaaaagagcaataataatataataattgcataagacgagtcaacatgaccaagaaacattgaagggttcgtaacttcgtatcatcttcctcctcctcctttgataaacaccaaaaaaaggcagagactttcgaaatcaagaacaatg

SEQ ID NO: 21450 - DNA, 3003 bp, Unknown; identical to SEQ ID NO: 21449
  misc_feature (1)..( 3003): 2750-1469P.txt file - cDNA_ID_1989267; gDNA_ID_2926147; Annot_ID_197800

SEQ ID NO: 21451 - DNA, 3003 bp, Unknown; identical to SEQ ID NO: 21449
  misc_feature (1)..( 3003): 2750-1469P.txt file - cDNA_ID_1989267; gDNA_ID_2926265; Annot_ID_143300

SEQ ID NO: 21452 - DNA, 3003 bp, Unknown; identical to SEQ ID NO: 21449
  misc_feature (1)..( 3003): 2750-1469P.txt file - cDNA_ID_1989267; gDNA_ID_2926147; Annot_ID_139138

SEQ ID NO: 21453 - DNA, 3003 bp, Unknown; identical to SEQ ID NO: 21449
  misc_feature (1)..( 3003): 2750-1469P.txt file - cDNA_ID_1989267; gDNA_ID_1971919; Annot_ID_177159

SEQ ID NO: 21454 - DNA, 3003 bp, Unknown; identical to SEQ ID NO: 21449
  misc_feature (1)..( 3003): 2750-1469P.txt file - cDNA_ID_1989267; gDNA_ID_2926265; Annot_ID_204892

SEQ ID NO: 21455 - DNA, 3003 bp, Unknown
  misc_feature (1)..( 3003): 2750-1469P.txt file - cDNA_ID_1989273; gDNA_ID_1971936; Annot_ID_58584
ttgacaacgtttatgagctagaattcagactcttaattaagccttaaaacctctttctaatttgcttgtcattgtctgttataggataacatctcataaagattacagaatgtttcttaaaccctaaaagccacaaggatttgtcaacttcagagtcttggaaaagaggtgttgtgacagagcaatgtaagacaaaataaattttattttaagataataattaacaaaatacttgaaaccattggtttataagactataacaatggttcattgaaaactataaagttaaccttagccatctggagcagtccatcataattaattgactcaggttcaatgtaatttattcagtaagaagataagcatgacgacaaattgtgttttttgataaaagttaaaatagaagatggaacatattgatgaacataactactgagtctctgctttggccttcttcgagattaagctccagaaagaactagttaaagctgaggatgtcatcagggaagctcttaacaaactgatagcctgcagtaaaagacataattcaatgaaagaagacaatttttccctcgagctcaaacacttaaatcaaacaaaagactaaacccatacctctagtttcccaatggtgatcacatgttcttcaacatcttctttatccaagtgcatgttcaactttagcaaactaatgtttgagaccaagttcttcggtttgataaccaaatcatcagttaccaaaaaccttgtgttttgcttcataaacccaaaactagtcaaatataaaactgatgttttattggtgaaaaacatgttctggttcttttccttcagagaattcggacgaggaggcatctttctagtgaacttaaagtcatactcattattagtttcaacgacacacttgaaactgcaatagatctcttgttgctcagtgacgacatcaagtaactgtttagggcaactataaaacgaaggaagcttggttttggaagaggatgaagcatcaattctcttgaagcttctgaataagtttccaatacaacctaaactgatattccctgcagagatgttccagacagattcaagtggcaaagctagaaaagtgaaaagaagatcaatgaagtctgctccacattcaacacagagaatcttgatgttcggttttctaacaaatgctttaaaagttatggtttggcctggtactgctccatctccagatccttgcaaagttggacttagaggtatacgagatctgatcatttgcaatgagctttgcttcttcagaaaagtgtcggttaaaggaaggtccgaagtaaagaaacattccagcaaagtcagtacctgttgatgacacaaacaaacactcaacaaaacatatatattcaaactacgaagaccaacgtaagatgatacagtaaaaaatacctcactgacaccgacatgaagaagtatttcactgagcttggaagtatctgcgtagcctaagcctctgagagtattcaaaacattatccatagagctcgcctccactttcagatcatctgttataatgaaagaagaagctttacagctgaaaaaaactccatcattatcctttctcaaaatccttccttgaacttgctcttcttcaagtcccttaatctcccgattcatcactcttttgacaaccttcgagtcaacaatttctccacattcacattcctccgtgttcgaaatgctataatgatgtctgcaggattctttaaagcctgagcaaacaaagtacttaacagccctagtgtcatcaattttcaacttcatatttctgaacttctcaagattcacactcctaggatacagtagaacttgcttacatgcttctgtctgaaaactctcaagatccatctctgaaacacttttgtaaagattgttgaaacatcctatacccacttgaggcgatttttgatgtttctcaagcaatctaacaatagttcccatgggaagagcgagaaaactaaagagaacatcaacaaaatccttaccagattcagccaagacaaccttgttcttcagttcatctatgagaagtctcacacttagcttttttgactttgtactctcagccattggagattgttaacagagaacgctaaggaagagaagaacaatacaaagagatagtaaagagaaaacgttttgaaagtttaaaccaagagaagaaggattgtgacttaaatagtgtttttaaaatttaataactttaaatgttatgaagttctattttaaaagaaattttgataactttaataaaaagaaaaataagaaataaacaaaataaataaatgaaagataataaactattgctagagagttttctataatcttgttgattagttactccataatcttgtaaagtttatcaaacaatctttctattattattattttggtagaaaacaatttttctattttaatgatacttattattactttattttgagaataaaagtgtaaaaaatcataaatcaataacaaaataatttaatttattaacaattataaattcttttattttagttggataaacacaaaaattttcttgattttataaaattttaaatatgataactccaaatttatgaagattttttacaaaacaaaaacattaaattttagcagaattttgataaaatcttaatgaataaccacagatttttcaatcacatataaaattatttaaattacaaaccaataaacacccctaaacttttgaattccccacgtcaacgtgactgtgcattccacgtggcggatgtgggccctatagttggaccatgactcggacggatgttgaaattcattgtcgttgccaattgcgtttgtctcactgaaactgtgaaaattttatctcttttatagataaagaatcttgcttttttcagttttcagtatgaagaagaattgaagagagtgtccgaggaaggagacctttggtttcagtttgtgagtcttgttgtaatg

SEQ ID NO: 21456 - DNA, 3000 bp, Unknown; identical to SEQ ID NO: 8936
  misc_feature (1)..( 3000): 2750-1469P.txt file - cDNA_ID_1989277; gDNA_ID_1971936; Annot_ID_58579

SEQ ID NO: 21457 - DNA, 3000 bp, Unknown; identical to SEQ ID NO: 8931
  misc_feature (1)..( 3000): 2750-1469P.txt file - cDNA_ID_1989278; gDNA_ID_1971936; Annot_ID_58578

SEQ ID NO: 21458 - DNA, 3000 bp, Unknown
  misc_feature (1)..( 3000): 2750-1469P.txt file - cDNA_ID_1989290; gDNA_ID_1971948; Annot_ID_58613
agggtttataactttcaagtcaagagcagcaaaaggaataacttcggggacaatccgaaattttttatcttttatttttaaaactgttgggctttaaattctaatcttgggctttttgggccctcttgttgtactagaacttttgttccgatcttttaatgaatcactgatcactccattaacaacaacacaatggaattttgttttgctaaaggttaaaagaattttttgtttctaaaacaaaaactatgtaggtcaattaattttcttttagcaaccggtagaactaaagaggtcaaagtcagaattttctcagataaagacctaacatgttagttacaaatagtctcattcctattgttggtaatgtaaacaagttatctttctttagttatagtacattttgggaaaatgaaagattaatcgatataaaaaacaaacaatgactacataagaaaaggagtgctattctatctatatctttagtttcaaaattctataatacgaccacggtgaaaagacaagacgaggatatagccacaagttgatgggattgaacaatgaacatccctgcaatatgattgcacatttctaaggtacaaagtagtggatttgaacatctctctataatttggtgaccttttataaaaagaaaaatagatttcacgttgacatggttactataatttaatatgctcacgcggtttgcctttgccctaaactactaaaggtctcataaattgtttcatggacaaggcgatggtataagtgggtgtgaagtaagacgaaaaaacttaacaaaacctataacgaaaataataaagatgaataaattataaataattaattagaaatattcgtctgtaacgattttatattggtcaatggtaatgaataatgtacataaacatgtattagtctattacatttgtaattaaacattattctcggccaatgagcttgagagacaaaatctttcgaaatgttgttgggtggccactatgttatatgttaatgtatcgagtatcgacaccagtaaagtttatatttttgtgcataaagttaatgataggtatgtctatttcagagtcatttagctgaactaaactgaattattaatagagaacgatctaaaaagagtagaaaactgagtttcgttggaattaaaatatttcgttttttttggatataaataataattcggttttcattttcaaaaaaatcgaataaaactgtaattgaaccaaatgtatactagtacaatttaaaaatctcggacaacgctatacacataactacatgcctgtaatactaatacatacctactaatctcaaagaaatgacacaacacatgagtggattagatggataagtattattctttcccataattatttaaatcgataagactttaaaccgtgagattgacactgccgaagaattatttgtccatgagaatgacagtttagaaaattcataacgatccataacaataaatatattaatcacaatgcttacctatgtttaatgtaaatgagtggatctaagcatcaaactattattccaaattttgttttcgcctatacaataatcaataatcattcaaaacgttgttcatagaagcaaccatttcttcctaaagcaagcaaacgttgttcatacaaattgcattattagtttaaagaagactttaggtcgtaattcataaacaaagatgctcgacgatgatgatggtactcttgcttctggacatcgtatttagtgagattgctagacaacatatatttcaagacaaacaaaacaatccaacgtattgtgatactcaaaagctaaaattagtctatatagcaaaagaattcaataacatttaaataaaaatttgggtaacgcaaacctaatcaattattgttcaaatagtattaataattcataatgcacgaactacaaaaaataatatatattatcccaagacgaacttgtcattttatgcttttttctgttaaaaacttcataaaataaaataaaaataaagtaaagtcacatcatttcagacaaaaggatgaatcagatattaaattgcataacattaaataaataataaagtatattgttgtcttaatttctttttatataatagaggaaaatacaaagtcttatttttccatcgagagcaaaatctgtcgttttcctctgagagcaggtctaatggcgaaccagtttcttcctcttctcattcgttttcttccaatgcctcttcttcactaccgttgctgtttctctggaaacgatgccgttctgtagtttctttcaggaaatgcagaaactggtttctctacaaacttcttcttcttcttctccttcgtttttcttctcctaaatctgccgatttgaatctcgcaacgacgccgttttaggtttcttatccctttccttattttaagttttgaataatccaagtaacggtttcttgtttatttagctaataatgttgtgttatcgactggctcaattttgatgggctgttaatttctctgtgaatgcgaggaaaataatctgtaaatttttccagattttctccgaaaatgtttaattttgacaacactggacaccaataaagcttaaatcttgcatgttttatgaggaaagattcgatttttacgactgggttatcttactctcttttttttttccaagttttttcatcataagaataattagtgttcgtggctaattatcattaaggttggtgggtcgttttagtcccaaaacttttagaagaatcgaagaaagaaagtttaaccttttccgttttattgactacttttgctcattctatttgatattttagttataatctccagaaaggtacggttttgtattgcttacaagaacaatgtttattaaggatatattgatcttacaatgtgtcttgtatcatcatttggcttcagattttatagacgaaattaagaaggaggtgaatttcagagtttgtcaatg

SEQ ID NO: 21459 - DNA, 3000 bp, Unknown
  misc_feature (1)..( 3000): 2750-1469P.txt file - cDNA_ID_1989293; gDNA_ID_1971948; Annot_ID_58605
tcctgatgtttacttgagtggtcctatcaaacaatatatcacagatagaggtggcaggtgtgtatctgctataactacaagaactgattctcgcatttattatgtcattggcttatcgggtatttataatattgtcttcaaacagaatccatctaaggtggggttgcagggagatactttatgataaatcagcagatggagaaacttatgtcactggactagcaatttctaaggtgaaatttagcttcagacgtaggattttagtggactgcgaaaatgtatacatacattctgaaggttgcagcttctgggtagagaaaaagcacaaaactttgatatgaaagtaaaggactttttttgttttttggtttgctttcaggctacgaacaagaagattgtgaaagctgatgtatatgttgcagcatgtgatgtgccgggaatcaaaaggttacttccaaaagaatggagggaatctcggtttttcaacgatatatatgaactcgagggagtacctgtggttacagtacagctcagatacaatggttgggtcacggagttacaagacattgaacttgctaggttggtaatctagaatcctatgttttgggatgatcgtgatggatctattctgttttggttttaagtctttgtttttgtgttttggaaaatcgtaggcagttgaaacgagcggttggcttagataatcttctctacactcctgatgctgatttctcgtgctttgcggatcttgcactagcttcgcctgcagattattacatcgaaggacaaggcactttacttcagtaagaaagaataacgtttttctttgtttacaaaatcgcatgcaggtctctcagtgtcttgaaactgaattctgttttcacaggtgcgttctaacaccaggagatccgtatatgcgaatgccaaatgataagatcatagagaaagtagcgatgcaggtaaagaacatggctaaattcaactcttgagaaaacttttgtctagctggtttgttgttgattctcaaatcttgttcaggtcactgagttgtttccatcgtcacgaggcctagaagtcacttggtcgtcggttgtaaaaatcgctcagtctctgtaccgtgaagcacccggaaaagatccattcagacccgatcagaagacgcccataaagaatttcttcctcgccggttcatacacaaagcaggtaacatttttcacttactatctttcagccagatccccgatagctacaaatgcaagcaagaacagcctccaaattgtgtctgagaaatccgaaagatcagtgagaattttgtttctggacttgttacaggattacatagatagtatggaaggagcaacattatcagggagacaagcttcgtcatacatctgtgatgctggtgaagaactagcagagctaaacaagaagctttcttcttctgcaactgcagttcctgatgagctaagtctggtctaatgatgaaaaatgtttgaaagtagttaccaatggctaattgatgaagatttgagacactatgggtacatgaagaagaagcatatgtagaaaccctttatatagtgttcataagagaaagtatttgtaatattacaccatcttttgaaatcaaagattcttacaaagtacatcaatttaagaaagtttactctcagaacttacaacattcaaaagaagagagtactacacaaagtttacaccttcaagcttcttcttcgatggctttctttgcagtttcgaggtcttcgtcaaggaatatgtcccaatggccatcccaagtgatgaagaactcagtgtcttcgtgatatttgactcggtgaacatcaccggcgggagtgaataggtaatcgccgtcaacgagatcagctctctccttcttgctcagattccacacacttttctttccctttatgactacaaggtcatggccgaatgtgtggtgatgcgccggttccacacttcccgctttgaatcttacaatcgccgacgtcggcgtctctctaacgatcttcatcgagcctcccggcatgatgtccactggagtgaactctctgttcttcgccaagcagcaaattacgcaagacgcggttgtttcatcgatcttcttggttgttgaatcgccggcggttgactttccaatctgagacatctcggagagagaattgtcgaggaaggaagagataactgagctccatggttcggatccggacgcaggacaaggagatttgaaaggagttttgatccaagcgtcgaagatttccaaggcggtttccggggatgttttgatgccggagaatgcgaggacattgcaattgcttattgatcgagcgttgacggcgtcttcgacggagagacaagtggctgcgtagacgcccgggaacttgttggcgaacatcgcaactccgacgccggtgccgcagcagactaagccgcgaacttcggaagacgatgaagcggagacgcggcgaccgacttcagatccagcagagtagtaagaggacactccggtatcctccacgtctatgccgagagagcggaggtgtgttaccatcgcgtccttgaggctcgctccaaagtcatcagctccggtgatgattttcaacggttgatcgacggcagaaacagctccggccatcttttcagagctttgaaaccttaagctgtgaccagaagaatcttaaattggaaattttcggaaaaaagagaaagacataagttacactactcttccacatttcaccctattaagttattttaacacaaaaggaccctccaattttaaatgaaataaggtactataaattaataaataaaagttttagggtggaaacaaaattataagggaacaacatgccgacaaaaaaaaaaaaaaaagggaacaacataaacatttttaatataaacatgcggcggagtcgtggcggcctttaaaataaaattgccgccgacgactattgtaagtcactcggctaagtaagaatg

SEQ ID NO: 21460 - DNA, 3000 bp, Unknown; identical to SEQ ID NO: 8947
  misc_feature (1)..( 3000): 2750-1469P.txt file - cDNA_ID_1989295; gDNA_ID_1971948; Annot_ID_58603

SEQ ID NO: 21461 - DNA, 3000 bp, Unknown; identical to SEQ ID NO: 8947
  misc_feature (1)..( 3000): 2750-1469P.txt file - cDNA_ID_1989295; gDNA_ID_1971948; Annot_ID_177304

SEQ ID NO: 21462 - DNA, 3000 bp, Unknown; identical to SEQ ID NO: 8942
  misc_feature (1)..( 3000): 2750-1469P.txt file - cDNA_ID_1989301; gDNA_ID_1971948; Annot_ID_58593

SEQ ID NO: 21463 - DNA, 3003 bp, Unknown
  misc_feature (1)..( 3003): 2750-1469P.txt file - cDNA_ID_1989302; gDNA_ID_1971948; Annot_ID_58591
atagcggtaaaaacagaggatcaaaaaacaattttttggaatcagcaccacagaggataaacgattctgttttcatagcatgtcagattctatacttgtttaccgttaaaacactttcatgagctcttcataaatctcaccttcagtggtgctgattgcagcctgcagctttaagtaatatggtgaaatctttctgcagcttctggccttctgctttggctatgtcatgcagcatgctagttcatccgaggaatatgtgctttcaaaagtatcttctgtggctgcacagctgatgaaaagaggctggtaagctgcggtgggcttcttctgcttctggtatctaaatttttaacacatgcacattagatgttggacgttagctttcacttctgatgctatgcatatgagaggattcatgaaaaggatgttgtcgttcacagacaattatgatcggtagcttctggaaaaatagacaaaattagttagctacttctgttttcttgcttgctttgttcctctaatggaacctctaatctgaacaaattactcttacaggcttgagtttactccagcccagaaggaagtcttttttttatcaggtatctacattgtttgtaatttttcggactttcatttttagtttctgtatcctatagtttgactagcattaggtgcatatatgtttctctctgatactggccatatgttctaagaaatttacctggtacttcaaaatctttttaactgtaccttaatatatggagaagaaaggatttagacgctaacctatatccttcatgtggtccagtccatataacacactgtttcattctttgacaaagcactcaagagaagtggctacagaaaaagcaatttcctctgtgaaaactccagcttcacatgctatggctcatcatctttacatacttatagccattacacaatccacatacggacgaggaatctctccccgcaaagctttcatgtcataggcagaagtttttgtgctatgtatgtcagtctttgaacaatcggtgaatccgtgattttacaacggaaaggttggagtctttattgtcaaataacgtactagaaagaaactcataaatatgtatgtagtaccttctactagtagtatgtaagtaatatctttctctttaacttcttcaacgtggatttttatatgatgattatatttaactaagaagaacgttgtacttgtatattattatactcaattagtcacgtagatcgaatcatcgtttcattttgaaaatgaaataagtactgtatattatattcacgtagctcgaatcatgagttcattttgaaataattgtttaccatgcataaaaaaggcaattggaatcccgtgggtaagtgacgacaataattttgacaaaataaataaacaagtgacgacaatatacatgtgcagtgtaaaagttttggtaaaaaagaaagttgtttctaattcactaatatagtagcacatagtatgaaacctgccaacaatacatgtttcatagaaattttgaggagtctcacatattcttttactcgtggaccgatattgaaaatcatcgaactcaaaagatcacacactagctatgttgtccaaaatgaaggaaacaaaaaaatcgagaaaaacaatgaaaccgccaagtacaaaaagaaaaagaaatcaagagaaatggtgacaacgcattgatattattaaagtaaagctgtaagtaaattcatgagatctccgttgaacacaagacccatgaacttttgtcaccttcttggcttcttctaggtgcatgtccccaaatcaaaaatcaattattattatttataacgattttttcttcttcttgttatttaattattatgattacttatgaatctgacgaaaaaataaagattgcttataaatcatatagtatatttttctttgataacacaaaatacatatatttgttcaaaatattagcatctagtcttaaaatagaaaagaaacaacacgatttatttactgtttttcaaataatgattttcgtaatattttttcatcaaataattaaaaaaattcttgttttgtcccaactgatagtcgttgatacttatcaactgctctggctatgtgctctggagatcatacaaaataaataagaaaaattgttagaaaaaaagaaaatctattgtccttgttattcaggagaatacttgtctacgacgaggtccacagtaactccgaagacatctagagtctagagtgatctagtgaatctataaagccgccaaatcgttaaatctttccttttaaacatttttgatttcttttacgtttgcgttacgaatcatcttctgcctctctctcaacgcaactcaatccaccctacacgtgttcctctcttttcccgtctaaatttctcagtctcgccgtgaattttgttcttctcttgttttccgggcgaatcaaaatccgtctcatttccaatcgcgtctccgttggtattttacatgaacgtttagcggaatctcgggtttagcttcggagctttgcatttgatcttcgtcgtctgtgttgtcctctctcggattttgttttttcgccgctgcaaatcagagaaatctattcctggaagtgataagatcgcttggaagcgtttcaggtttggaaatcggattcactgttttgtgtaatttttggttaaggacttaaggtggtgtttgattgttcggaaacacaattagtgacgattaagttcgacctaattttgtttagcatgctctgataagttaagaaaattggataaatttgccattctagattccgatttggttacaatgttagatgcttacgtggtttatagggaatcttttgctgattgtaacacagggagttgttggaatggagggtccggaaagatgagagattttgaatacgcagttattctttgatttcttaatagattttacacgtcattggtgaagaaaaagggaaaaagaaagatg

SEQ ID NO: 21464 - DNA, 3003 bp, Unknown; identical to SEQ ID NO: 21463
  misc_feature (1)..( 3003): 2750-1469P.txt file - cDNA_ID_1989302; gDNA_ID_1971948; Annot_ID_177290

SEQ ID NO: 21465 - DNA, 246 bp, Unknown; identical to SEQ ID NO: 8939
  misc_feature (1)..( 246): 2750-1469P.txt file - cDNA_ID_1989303; gDNA_ID_1971948; Annot_ID_58590

SEQ ID NO: 21466 - DNA, 3000 bp, Unknown; identical to SEQ ID NO: 8976
  misc_feature (1)..( 3000): 2750-1469P.txt file - cDNA_ID_1989304; gDNA_ID_1971952; Annot_ID_58640

SEQ ID NO: 21467 - DNA, 3000 bp, Unknown; identical to SEQ ID NO: 8967
  misc_feature (1)..( 3000): 2750-1469P.txt file - cDNA_ID_1989307; gDNA_ID_1971952; Annot_ID_58636

SEQ ID NO: 21468 - DNA, 3000 bp, Unknown; identical to SEQ ID NO: 8967
  misc_feature (1)..( 3000): 2750-1469P.txt file - cDNA_ID_1989307; gDNA_ID_1971952; Annot_ID_177361

SEQ ID NO: 21469 - DNA, 3000 bp, Unknown; identical to SEQ ID NO: 8965
  misc_feature (1)..( 3000): 2750-1469P.txt file - cDNA_ID_1989310; gDNA_ID_1971952; Annot_ID_58632

SEQ ID NO: 21470 - DNA, 3000 bp, Unknown; identical to SEQ ID NO: 8963
  misc_feature (1)..( 3000): 2750-1469P.txt file - cDNA_ID_1989315; gDNA_ID_1971952; Annot_ID_58625

SEQ ID NO: 21471 - DNA, 3000 bp, Unknown
  misc_feature (1)..( 3000): 2750-1469P.txt file - cDNA_ID_1989323; gDNA_ID_1971953; Annot_ID_58667
gaaagaagagtaacacggcgagaagtacggcgccggagttggtgagggcatgcatcgtttgagagagagtgtgaaaaaataatgaccgggacgtagtgtagttaaagcaggagagttgaccggcgtttaccggtcatcagttgacggaggaggttgggttgatgatgattaatgatgttggaatttgttggcagggggacacatgagcaacttttttacaggtagcatcagctttttaaggatcataattatcatatagatgcattaaagaaagagaaatgatagttttataatttctgtcctttggtttttttacaggtcctttaatatgactagcgtatatggtagaacaatggcttctctgtgctatcaaagaagatcacaaaatggtcttgatttttaccattaatatgtacagtgtacatgcttaggtaagtgatcaactgaatatgaatttgtaggcgtaacacaataagacttccattaacggaaaaagttttttattataattttggggacaaagtgagaatcaaacaaaggattgttttagcgtacaagaaaaaaaactctgctcacatataacaaagattgtacctttttgctatcatagtagagtttctaaatagctgagaagtactctttgctgagttttgggtcgggtttcattgacttctcacccggcttccatcctgctgggcagacttcatccgggttttcctggatgtactgtaatgcctgcaacattgaaaacgtattaagcataccggaaatcgagtgaaaggaaagagcggtttttggagttgtgtgtatttatttgtatctttacctggagggttctcattgtctcatcaacgcttcggccaataccaagattgttgatggtggaatgttggatcactccttccttgtcgattatgaaaagtcctctcagtgctattccctgttcttacacaaacaaagttcttgttttcatttatcccaaacacttcgaaagtttaaaggaaggtagccaagatttaaaggctaacaattacctgatcatggatgagcactccgaacgactttgagattgatttagtgacatctgaaataaggggatagttcagatcaccaagccctccagatttcctgtctgtttggacccatgcaaggtgagagaactacgaggacacacagaaataagaatgaatcaaaaatttgcaaacagataagaacatggtgatgtcaaccaaggatgaggaactgagtaaaatgagaacatagtaaatgtatagtgatacttaccacactatcgacagaaacacctaatacttcggtgttcaacttctcaaattctgaatgccggtcactgaaggcagtaatctctaaaagacataaggaaaaaatgagaaagattaggactcaaggatgagggaaccttggatattcaattttgatatacttctcgagcaatgctaacctgttgggcagacgaaagtaaagtccaatgggtagaaaaagagaatcacatacttctttccaatgtaatcagagagcttaacctgaaaccatacattcatcagttaccaattagtttccaatcacaataagacatatactcactaaataaaaaacactaaagactactcattcagcttcaaaactaaacttaatctcagattaactagaagcagcaactgtgattgataactgctgtaagtaccttgatgaactcttgatcaaacacagcctctgcctcaaaatcaggcgccttgtttccaaccagtggaagatcatcctataatcaccaaattaaaactcgttaacacatcaaatctaaggagaaagatcagtcaaattgacaatcagataaccatggtactataccaaaactacatagacctcatccgaacatactaatcagtcaatgagtatagctcatatgtcactcaatttcacttcaccagagaaattaacaaccctaaacgaaaatgtcactcaaatttctgaacttttcgagtaatctgcagaaacacggtcgcataacctataaatcgttaactatttccccaaaacctatagggctaacaagtaggaagagagtgaaatctataacaggctaatgaattcagatttcaatgacatcgaataagaaaagtatcgacatttagataaacttacggcctgggctttgacagcaaagctccgacgagaagtggagctgagggaagagcgtcgagcaaatccggagcggagagaagcagatgcggaaggagaagaaagggttcgaaggaaagaaacagatggagaggaaagtgaagactttgctggaaaaaccctagaagagggagaagagatgagagtagttgaagaagcaacagacgccattgctgctacacacactttgtgactctctgagtctgagctaccaaacactcttatctatctgtcaatcacctctctttgtagtggaagtatgaggtggagataagcctgacgacacccaaactcataaaacgacgtcgcgttactcaaaacgaggtcgtattactattgctgcaaatatgcgtcttcttcttctaccttgggtaactccgtctctccgttactttcttcctccgatcggtggttcagttctccaaagtatctaatctactcctgttgtttcaggtgcattgttgtgctctcttcacttggtttactttaaaaggcttcttcacttattttgcaaagttttgatttttagtggtttctctgttgtctcattaattctctcgatcttctcctttcaagtgttgacagttctgagagaagatataagttgaatcgcgtgaccggagacatggagactcaaaacaaattgatgaatgaaactaaaagacatgttaaatccagattgtgcagagtttctgggtattgttacattaatcttttacgaaattttctaatttctttgactatagttacactttttgttttgttttttgtatttgtgatcaaagttcgatgacggagatgatg

SEQ ID NO: 21472 - DNA, 3003 bp, Unknown
  misc_feature (1)..( 3003): 2750-1469P.txt file - cDNA_ID_1989324; gDNA_ID_1971953; Annot_ID_58666
acaaaaaattattgtattttctaatttttttttttaactttattttctttacgaatgaaagatgtgttttaataaagaacttacattatggggataaataataatagaaaaataaaaataatgaaagcctatatatatgtatccctctaatgatgtgtataattaggattagacatctcataactctcaacaagttgacttgttgacttagctcttcgtcaatgagagcgaacatgtttgttggaacacatcattagtggacaaatgaatgcagattaaaagaaaaattataatcaaattttctagaaaaacatatgacagatactttgagagataatagagtttttgtttgattgaatataacatattgtggtttgttttcacgtggtttagaaaagaaacaagagtgggcttttaaattgggcccacagagtggcagaagcagggctgagagagtaatgggtcctacaaaacgcccatgatcccaaaatttccaaagaaaatggagacaatcttctgtgtttatccgaaagctaccctcacgctttggattttcttcttcttttttttttctctctcttttcttttttaatactacttatttttctataaatttgtatatctagctataaaggtaatagaaaatggtaagttattttttccttccggtacaaaagatgaaaacatgcaatagtcggcaaaggtccacactccacacatttgtctgcacatctatccaatattcattcataggttcaaccacaactttatctactacatatatattttttattttattgaacgaatttatattcgttttccatttctgtcatatatcatagtagatgttgatagttgggtaatggagcaagtgaaagattgatggttggtagaccatagattcatgcattcataccataaggtatactgatggtgattgggtaaatttttgagtcagctattacaattgaaaagttcatcaaatgacaaaactattacaacttagatctttgacagccaaaagaaaaaaaaaaaaaaaagagaaaaaaaaaactaaattgttgttagaaattagaagtcagaagtaagaagactcccataggaatacagttctggcaaccaatttcttagttctttattgggcattcatatcttagttgggcctgactcatatatattttgaactttttgtacgcaattgtatctaacactatagtcttacattgttcatatatttaatgttttatattgattgctacctatatattttgatatgatgtagatccaactatttctaggttgaattgtcttttcgaacagattttgtttccggattcaccataaaaaaaaaaaaaaacttatgtgacagaaagtactatagaaagaatcgtgtttacaacaataaagagacttgacccaaacaaaaaacgtttacaacaataaagagttgaacaataatacggtacgattgtgtatgttgaatcatctcctccacttggacgtgtccatttgacaacggaaaaaagtgtggccgtgttatctttctttgtaacgtttacagtttcaattgtttagtttgatcaaataattaacttgtgaattttatggatgcaatatcttgaaaactaggaaatcatatctgatcatcctgctataaaaaaaataatacatgcattttaatattcatggtttcacatgaatacttcggtcatccatttttcaattacacgagtgtaaatctgtaatatcaatattcatttataattataacgggttgtgatttgtgaaattgtgggtatagataaaacttcaaaacctattgaaatgaatatctatatacttggaatagtagtagacacattttgtaatgagtaacttaagcacaccggttctcactcacactcgtctaatggagaaaaatggtatattatatacctcatataggaacatgatcatatgatttaggagtcataagcatgagattaacaagatattttggtccacattaggaatctactaaaggaactattttcttataacctaaaaatcttggtttggtaaaaagaacaaccttagattatttggtcttttatcgattcatgtaattgtgtatcaaatgattaaaatctaatgcatcctactcaaacacgtcatttaagaaaccctatatagtacaaacacgatccaatctccaaattaacccatagtatatcatagacgagcataatatttttggtcaaatataaaattagatgcactagttccctttatttaggcagatggactttcttctaatcgaaaataattgttctcaatgagccgtcaaactttgtgaaatatggatataaattcatgacatctacataatttttggtttaacatgtgaaattgaacttaggatctatttcattcgaattcttaccatatactaaccaaatataaataatgtttactgctaaatactatttatataagtttgttcttcactaaagaaatttgttgattagtttgtttttctaattgagaatctcttatttcaggaccgataaaaaggaagtgatttccggttttcgattcaattatttcggtttaagtcggtttacaaatcatccaccctgtaaatcacggagcaacatccataatccatacagatcaaaccacgtggacatgttacagtgttccttatcacagaagatgagtactcctgtcatctttccccttttcactttaacataacactctgtacactagtctgatcaaaaaacctcaaaacacagcaaccgccatttctttccaaattcccccaattcccattccaactttatcttctgaagtagaagaagaagccatagaaatgctttgaagtttctgtaagtgttcttactcactctaaaaacttcaattttggtctttgtgcttttttctaacagatcggtgaaattttctgaatctgctttttgtttttccaggtaaagagaaagatctacaattgttttgaatatg

SEQ ID NO: 21473 - DNA, 3003 bp, Unknown; identical to SEQ ID NO: 21472
  misc_feature (1)..( 3003): 2750-1469P.txt file - cDNA_ID_1989324; gDNA_ID_1971953; Annot_ID_177414

SEQ ID NO: 21474 - DNA, 3000 bp, Unknown; identical to SEQ ID NO: 8996
  misc_feature (1)..( 3000): 2750-1469P.txt file - cDNA_ID_1989325; gDNA_ID_1971953; Annot_ID_58665

SEQ ID NO: 21475 - DNA, 3000 bp, Unknown; identical to SEQ ID NO: 9009
  misc_feature (1)..( 3000): 2750-1469P.txt file - cDNA_ID_1989326; gDNA_ID_1971953; Annot_ID_58664

SEQ ID NO: 21476 - DNA, 3003 bp, Unknown
  misc_feature (1)..( 3003): 2750-1469P.txt file - cDNA_ID_1989327; gDNA_ID_1971953; Annot_ID_58663
atatttaatttacatttattgcagtttggacacattcccttatgctggaactaccactacctgtgagtctctctacatgggagttccatgtgttacaatggctggctcagtacatgctcataatgttggtgtcagtcttctcactaaagttggtaagctcttagcaaaatttttttttttttttttgcaaaaattgttgttagtcggacatcttttagctaattcagccatttcttgattcaggattaggacacctggttgccaaaaatgaggatgagtatgttcagctatctgttgatctagcctctgatgtcacagctctttctaaattgagaatgagtctccgggatctaatggctggatctcctgtttgtaatggtccttcctttgctgttggtcttgaatccgcatatcggaatatgtggaaaaagtactgcaaaggtgaagtgccgtccttaaggcgaatggaaatgctgcaaaaagaggtccatgatgatcccttaatctcaaaagacttgggaccatcaagagtcagcgttactggagaagccactccgtctctcaaggccaatggttctgctcctgtaccttcctctttaccaacccaatccccgcagctctcaaagagaatggactccactagctagataaccagcaaatcgagctgctgcgaaatgccggcagagagtcttgacccatctggaaaaggtgtgaaagaaagagtcgatgagcttttcctgctatttacttccaagacaataggaactagactttagattactgcttgtgtagtaaaaagaatagtaaaaccagctctttcttttgttgtatctctttctactcttagtttagctttacatgattcttgggaagtcgttaggtggtagtggatttggagtttttcttctcatttgagagatcaagttgttgtgtatcgattagggttttaaggctttttaggatgttttcatgtgttggattttgactcatatgatagtaaatatagttatagaaagcttttcggtgcctttacctatttcataatataattatctaaaactcctgcttaagcttaatcccataggtgagacccaatgaaagacttttgacttgtatgattatgttgccaactccatatctctctttaattaattaatatggagagagtaaaaaggcaagcaactaactactcttcaattcaacacttcttctgctccattgcttccaccagaaccctaaagaccttataaaacccaatcccaaatccctttgctcattcaccaccaaagcatccaactttctttgcttcctctttcaaagcaacacaaaatattaaatctcaagaaacaaagtaaagaaaaatgaagaacgaatctaccttcattgatgtccctgcagaatccagctcagccatgaaaggcaaagctcctctaatcggtgtagcaagagaccacactactagtggctcaggtggatacaacagaggactcgccatctttgacttcctcctccgtttagctgccattgttgcagctttagctgctgccgccacgatgggaacaagcgacgagactcttcccttcttcacacagttcttacagttcgaagctagctacgacgatctaccaactttccagtacgactcatagatgcttgattgatcaaacagatgcttgtgtttttcttgagaaacacgtcacctaattaggtcatattttttcttcaggttctttgtgattgccatggcccttgtaggaggatatctcgttctgtctcttccaatctccgtcgtcacaatccttcgccctctcgccaccgccccaagactcctcttgctcgttcttgacactgtatacactcaaaactcttcaaattatattgctttaaaataaaactttagtatcaagtaaaatactaagaattgtgttgggaacagggggtcctggcgttgaacacggcggctgcatcatcggcggcagcaatatcatatctagcacacagtggtaaccagaacacgaactggctccccatttgccaacagtttggagacttctgtcaaaaatccagcggagctgttgtctctgcctttgtctccgtcgtattcttcaccatcctcgttgtcatctccggcgtcgctctgaaaagacactaatcaaaaccttatatgtgtgttcatcattattgtaaaatttatgtcaccattgtgtaattattactcatccatggccttgtgaattgtgttgtattaatctttttaaaaaggaaaatgaaagtgtgattgtagctctgcttttctggaaaaaaattgaaatgagtttctcaattttttgtccaccaaagcctatgagattataaatgtctcctatatttgtctctacgaaaatacccggtaatgataatgttacagtgagtagcagagaaatatcttacgtggtgttatcttagtggacgttcacggagttgtcgttggtcataatgtttctgtcttcctttttttggtttaaggataaacgagccttcctggtgccacgtcaccttttcgtcttctgctacttcgtcttcttcactaaatgattcagtattttctcctcaatcttctccattttctcaccaaaccaaaatcgtgaaagaatattttcccgcttcatgtagatggcagctagactacaacgacctgggcttgtatcctcaaggtaaatcaaactcactacaattttcagatcattcccagaaatttattagtggaattaatcaaatttggggttttctccgtcgtccatcttcaccagtgttcaattttcgattccgtttatacactcgcttagctcaatcattagagtaggtgcagcttagtttaagtcaaacccagaaaagggaaacttagacgaatgattcaattttgtactttgttcacggtagatcattcttttgattttagtggctgcttaataactgaatctcgccttttgtagctctacttcaaaaccatgtcttccaaggatg

SEQ ID NO: 21477 - DNA, 3003 bp, Unknown
  misc_feature (1)..( 3003): 2750-1469P.txt file - cDNA_ID_1989328; gDNA_ID_1971953; Annot_ID_58661
cagaaacgtaccaggatctgtaggaggatactagatgaaaacatgaaagcaagtccagcaagtctgtgcaatcaagaaaaataaaatctgtaagatcacgacacacgagaatacactggcagatgtaacaacaagggtaattaaagagcatcaagtcttagaacttacactgtaccaagaaagcaatttgagcattccagaagaaatcagcatcggaaaaaatttagaaaagagcaaacaatgagtgagtttgaacaatgcaaaacccagaaaccctagctcacaaaattaaacaattcacgaagcacaaaataactataatctgagtaaatcaataccaatctctaatacgtatggaatatatgaacatagagcaagggagaaaagtaaaaggggaaaatcgacttgaatctgattcgattccgtcgggaaatgatacagttggaagataggtgattgattaccttcgatggtcatcgccatgtcggcgaatgaaaatgttctgattaccggagatcgagtcttgaatgatcgccggtgacgataaaagagaaggtgatgatttcgttgttccccttagagagatacagaaggagagagcccagagaggagtcgcgatttgagagcaaaatgaaaattagtgaccggtcaaaattggttttctcaccgttcatcgatttcatctttttggtttggttggtttattttggttataattggtttccaggattgtggttttgataatacagctagtagtcgattttaaaatatcacaaactaaatgacatgaaaaaaaaattacgatcaaaatttgggttgcaaggaccacataaaactcattcctaaatcatacgtaataaaaatgattttataactgaaatttttaaccaaagttcataccaatcatcaaaatatgtgaaatgctaaatatttttttcttttcattttttgttatttaaatgcaatcaactatgattgaaactgcatcaacgaaaaagtattattaaactattaagcaaccataagttgagttgattcgtttccataattttagttagagtacgtaaatctccatcataatacactatctatgctatcattgtttgttttttttttcttttttttgctaagaatgtaaatatcattagaaatgaaatgtttggtattacaagagacgtattacctaaattaaattaaccttggcaaaaagaaataaaaacaaggttaagataaagagtagttaatcaggagagattaatggatccaaagtagcataagttgtttccaatgctttctatgtcttcgagaagtaatggtattgcgcacctcacgatctatgctatcatggttggtgcgtttatgacatgctgctgctggtgacgattcaaaagtgtttatcagttgttcattatgatgccattgtgatgtaccattactaatttcttacttaaataaggtgttgttttttgttttgctccaaataataaggtgttgtttaaaaggggctctttcgttttggagtaaaagtctctctgagtagctgtatattatttaagtagcatagtccaattatttgacaatgaaaaaaagtgtatagtccaatgaataccaaatgaattgacgtcaccactagttgagacctgagacaagcaagtgatcgttaaatcaaggagaacgcaagtggacgaggccgacatgatcctaactattggactcccacttgtgaaacttacttgatccatttcccacttcataatttcgtaaaaaaattaagacaatgagaatgaatttatttatttatttttcggtagaacaatgatttttattttgtccaaataaaacaatcgtgaaaaattatgttttggacattatcaactttgtgagtaaaacaaattttgtagtttcttttaaccaatattttcgaagtcaacttttttctacgtgtgagtgtattgagtaaatgatagatatgtcaataataacataactcatcaatcaatctggcttcaatagaactagagaagttataacgtttttttttttttagacaagagggttttataactctagactagtttcatagtccatgaaaaaaacatcaaatctcctaaatggctggacataattcagatgattttgtatgaaataaaacataaaacatatattttcttgcatatctggagatttttgtttctttattacaatgactaattaatttaccttgttcctttttatttttgcaaaatgattactgttatctattttgtccgtttctaataaaataaaataacaatctgagctgtggaaagaaaaaaaaaggaaaagcgaggagagctaatctgagtcgttgcctctgtccactggctcggaccgacctcgtacctctttcatttgtcctcgagcttataatagaggctacgccgtcgccgccacctccgctccatccattcacggccaagcgacgactccaccgcttaggcttggcgtctgaggtatactgatcaacgctttctgttttcggaggagcgaggcggagatcagcttctcttatgtctactcaaacatatcattcttctttagccactcgatttcttctctagcggctccagaggtttcgtcgctacagagtcaagttcctcttttcaggttttgtggtaagtaatcgttaaaccctaagtatcggaccttgttgtttaatctgttcgtgtttactctcaattacatatgcattcttctgcttaatcgtttcttttagtttaatttctagggtttacatcccaaaggtctgatctttttgcatatttgtgtgaatcttagtttttttttttttttttggaattgaatgtgatgagttgggtttgatactgttaaagatcaaatctttagcttcgttgaagcttcatatttatgtcaacaatgcaaggtttatttttcttccacctttgatttgatatttataattgtttctttgaaggtgaacaagattttagttacaaaaaaatg

SEQ ID NO: 21478 - DNA, 3000 bp, Unknown; identical to SEQ ID NO: 8990
  misc_feature (1)..( 3000): 2750-1469P.txt file - cDNA_ID_1989330; gDNA_ID_1971953; Annot_ID_58659

SEQ ID NO: 21479 - DNA, 3000 bp, Unknown
  misc_feature (1)..( 3000): 2750-1469P.txt file - cDNA_ID_1989332; gDNA_ID_1971953; Annot_ID_58654
gaagtttttgcaattcatataaagacatttaaatattatgttcttatatgtaaattcatttaatatttgatattgacaattagttagttcatgttcagtttttacaattttatcataattaaatgattgtaaaaatgtttgtatcaccagagaaaaatctgaacattaataatttgtttctgcttaaaccctaaaagtaagcgaagatattgaagaacctgaaggcgagaattggcggagtaactgttggcaccatctccaccactcatacatagagctttcacaaacgcatattcatcatcacacttatcatcatcatacctgcatcgcgacatacatgcatatattgttacataaacagctgcatggatatatatcgatctatatttaaataactaaatcaaattaagaagcattaactctatatacagaatatttatgtgtgtgtgtgtgtgaatgtgttgcattaatgatacatgaattggagataagaacctcaaggaaggaatggtgttgatgaatcttggatccatttcaattatcgtacttattagtgattataagactaaaggagaattatcggaagatggaagatgttgtgtatggatgatgcatctcacacacttcaatttatagagagagggaacttcatcaaggtagcacattatttataaaaaaaacatgaaacatatgccaagtgtactagttgcaaagtcgttcagcttgagacccaaaaacaaacaacgtctgttaaaaattattggttctgaaataatgttatattattgactttaggctcggttttacaattgaaatgcacaatgatctcagatctgatcttaaaaaacgaattaagcgatagataaaatgagatgttatagtggtttgatgtgatagtcacgtacgtttttctttgctagtgatttcacaaaataaataaacgaaaattacgaaaaaaaacttttctttcgatctaaacagtaaaaaacaacgacattagtttgaataaggaatacaaactctaatcaaaccaacatgcctaaaatattcgaaatacttttaatgaactttcgttattaaaaatgtggtttttatttctaaggatgtcgaatccaagacaaacaaaaagaacaacaaacaaatgtttgaacttacgtgtatatattatatatgtatgaccccaaaaaatgacaaaaacaaaaagcacgatattttaattattgctggtgttgttcatgttgtaatgaaaaaagacaaaaaggtaatcgaagagaaaaccacttggtactagaagattcaaaatactaggatacatttgtacatgtaaaatcattacttcaattaaatatacattaaacacgaatattaacattttaaatgaacgagaaatcgcctagttgtgatatacaatggcgagtatcttcaagttattaaaagactaacaagtgcgaaggtcagaatctatgataaactagtgagtttcttctgctagtctcaaataataagtgtgaacagagtgtgtgctgacgaagattcgtttaatcaaaccgtgtgagattcaaagtaatctccattaataacattaacaacatcaaagtccttttcaattataaacagacagacgaccatacatgaacatgcattttttccctttttttttgtaatgcatgttcttatatggagcattgtcgtaaaatctgtggacgacgcttaatttatccccgatgtaaatgttccatgccacgtaattctaaaattatatggaacacgaaaaattgtttttctaacaaccacacattaatatcaaaaggagggtcctaggttagtgaatttgaagcaaaactgtttacgtatgacaactcaacaaatctatagttgtagaagctttatctaacaatccggcctacaatttaataatcggagatttacatatatcgaaaaaaatgagaaaatctgtctatgaacaatccaaactcatttaaaagagtggagaaaacaggccatttatgatcagaaaggactatttcaatttacgtaaaccatctcaaattacaaatagtactcgacaatttatgttttgcggtcgagaaaaactccgttgtccgtatcaacagttccatttccgagtagagagggatgagagaccatgtggaacacgaaagtctcatttaaatttatttatttctttggtagtactagtaactaatttctgcggcggccccatccaattgatggtacgccaccttttatcctagaaaatcggcaaagcatgcatgatgaatcatacgttcaaatttcctcgtacgataaaagattcttttataatctagtccatgtttcataaaccggagatattggatgggtggtcggacctctcctacaggccaaactgaatttcgaatttactaaaattttgtttttattagataagttaaagacaaaacaaaaaaatgttgccctaatcttgtatatcatgagattttccttaactatggaactttaaggttcacaagttagaagtagaagtgtagaactctgttattaatcaaaacaaaacaaaaaatgttgtaattctaatatccggttaaatgtaattcccggtatccagcgaacggaactgggaaccaaagtatttacgggttagtttggtttaaggataagtaaaaccgtttggttcaaaataaaattcgatttggttcgacactgttagtacttttttctcaaacagaaagtattaccatctccgttcgattagagtatctttcctccgtcaccggcaagggacctcgccgtcgtttagccggagtattaatttccgtttgggtaattcatctgaataattgattccaagtccagttgattacttgttcttagaattctagatcgattctctaaatttgtcttgtcactgattggattactgattcttgtttgaatgttgcgattttgggattccaatagaataagaatttgttggagctgatgagaatcagagtcatg

SEQ ID NO: 21480 - DNA, 3000 bp, Unknown; identical to SEQ ID NO: 8986
  misc_feature (1)..( 3000): 2750-1469P.txt file - cDNA_ID_1989334; gDNA_ID_1971953; Annot_ID_58652

SEQ ID NO: 21481 - DNA, 3000 bp, Unknown; identical to SEQ ID NO: 9003
  misc_feature (1)..( 3000): 2750-1469P.txt file - cDNA_ID_1989334; gDNA_ID_1971953; Annot_ID_177396

SEQ ID NO: 21482 - DNA, 3003 bp, Unknown
  misc_feature (1)..( 3003): 2750-1469P.txt file - cDNA_ID_1989335; gDNA_ID_1971953; Annot_ID_58651
gacttttatatatatgaagcgataaagaagagcctatttggtgttttctccaatgatgtgcataaaatatatataattaacaaattaaaaatacgttaactgagatctcagatactcaggtcattagtacaaagtacaaacgtctaatagaggccaattttgtcatccatattcaattcaaaccatatcatttgccataaccgtacccatatatagatatttgttagtctacaaaagactgtataaatcgttttatcttgtgttcaagccatcaactatgatatcaaattaccagatcactcatgctaaagaatccatcgaaatgtattaagtttgtcgaagttcgttactctatatggtggattttaaatatttgatttggttagataatttttagttataccgtcaaataaatttccaactatttagtcagcgaatttaaagatcaaacactaatcatcagtaatggtttgctgaaaatcgtcagaatttcttttactagtgagcaagttttaagatgaaataaaaggtgtgaaacgaaatagagaaaaggtagagagggaagagacaagcgtgagacacggagaagtggaactgatctctttacgttcctcgtacgtttaccaagttacactgctttccatatttctatattattattccctccatccctttcttcacatactttatgtaacttctttttaaaaaccaattatttgtattctaattgattgaatcaaatagtttctataagactataaataaacataattcgaattcaaattcggcagcgttgaaagatatatgttgaacaatacattaccacacttattagtagaatatatttatttctagagtctcaaaacataagccaaaaagccgaaagcacctttttatctttgtgggtttggtgcaatggatcatatatatggtacattagcatttttatcatctttctcttttatcatttttcttgtattgtcgggcttgcgtcaggcctgtacttatcttcatacaacattatttatgtacataaccagaattcaggccacaaacaatacgtgagctattcaggatcacgaggtccacgcgctcgctcaccttcctctttcctcaaaggctttagctaattgttaactagatggaaaacagtgctatggttgaattttaacatattggttactactatctcaataatattttgtaatacaaatgtcggtagatgaattgatataccaccttcatggatgatgaagatccacttttaaagcccaattttttgtttttcttcgatgccgaaatcaatatgggcacatgtggatcctactatagcagttcctcaatttgagttaaaaatctttgggttttaggcttttagcccaaggaaaaaaaaaaaaaaaagaaccaatttttattttttataatttaataagaaccaaattattcatcattatatacttctgacaacaaatatttactatgtatattatatagtgaagaagctgtgacatgaaacagattcaagccaatcgtctgattagctagagaatcactgtcataatctattagttgacaaagaatgaatgacactagtacagtagttaatatgagtgcggattctcgtaatctcaacgtatctacgtcaataagctcatttatacatcattaaattaaagtacaacattccaatttatgtttggtgggttcctttttatcaagacgtatacgattataccaaacctttatccataattatttttaaatgatacatttcgtaaatattaatattacgattattatttttaaacctaaaatctttgaattttataaaattttaaaattgataaaaaagatacgggattttttttgagttaattgattttctaataaagatattggattcttagtgttttttttattctataatttatttataacgcggaaataaaaagcaaaataattaattaagtgaggagagttttaatattttgatgtttatttctaaattcatctcttttttccacttctgttcagctctgatgaatcttcttcctctgttactttgatctctttctccatccttgtctctgtcgattctctgagatatcttctctcgagctttttcccgcgttatctctctcccactcctggtaatattttcttcttcttcttcttctagattgttcttccgttactagctcttgaatccatttccacggatctctgatcttcaatctctgttttcattctctctaatcagttgttgagcttgatatttttagctaacgtttttccgattcaaatttacgatttgtgtgttttccgataaccaaatcggatatcttcagctcaaactcgagctccgatttcgtctcatgttgtagatctcgacgacttcgtatttgtctatggtttgctgattgtattcagattgctagatactcaatatagagcttacttttacctcagctagggttcgtctttgttgtacctttagttgctgctttttgattcttgtatatatggattttgattgttcaatcgtaatttctggttcattgaaaatcgatttattagtattcgaaattggaactaagatttagagattgcgaatttgatacagaagtcatttcaaagtatcagagctataaaatggtgcttagctagtttctggtttccatttctggattttcattcaaatacgaaatctattcgtcaaaatggtgtcactagtgttctgtagaaatttcattacagacttttagttgttgcctagtatcaactcatatctcagcggtagatatgatgaatctactagacatatttttcaattatcgcctccttttacaagtttatcatgtcattattttgttgataactacatgaatgctggctgaaatattaatttgtctctttttcctcttaattggttcaggttggagcttgatgtctaaattgttattgaactgctggagtctgtcttgctttaagtagaaagagatg

SEQ ID NO: 21483 - DNA, 3003 bp, Unknown
  misc_feature (1)..( 3003): 2750-1469P.txt file - cDNA_ID_1989336; gDNA_ID_1971953; Annot_ID_58650
gtgttagtctgctagaaaaagcatgttggagtggatttattgaataaagtcacaaaattgttgaccaaaaaggaaaatattagtcattcaattatggacattagtacctttttccctctattcgacttatatatgttaagtactcttagttgattgcagttacagtttttacgttaagtactcttagttcattgcttgatataaatgctctccgaccgttttcccaaattttataagtttatttagttttagtgagtggttcttgtttgttgtggtccatgaatgtggcagaaaattgtttctaaattcgtgggtttaatttattggtggagcacatgatactgtcatgttcagatacatagcttttaatcatgtctagctactgatcagctttctgcaatgtgcttgttttaatctttagtgtccgctaaaatcttatactatttgatatttgttaatcatatctgtggttcttaagatatttatgtttattgttttatctctatgtgcgtgtcattatcactaagatcacgtgtagtgtctaaagggaaattccaatttatatgtctattgataatttgatattcattataacatggtagtacagtcgtgtttggactcacattcattctttgttttgtgttctgtgatggaataattatattgcagcttgacataagaggagatccatacgggtttctagcggcgcatccattggcaccgcttgtatcgttgcatcaccttgtttacttagacccaatgttccctaacaaaaacccgatcgagtcgttacagaccctaatgaaaccttataccttagacccgaatcgaatactccaacagattaattgtcatgatcgcaaacgtcaatggtctatatccatctcttggggatacaccattcagatatacacttacttcttgactgctacggagctgactacgccgttgcagaccttcaaaacttggcggtcttccagcgatggacctttcgtgtttaacactcggcccttgaaacctgacccctgtgagcgtccggtcacttatttcatggatggtgccgaggatgtacgggatagtgggacgaaaacttggtatagcataggggataagaactatggtcattgcggaaagattgagcatactcgattaactaaagtgaagaggatattggtgacttcaatgaagacggatcctgagtattggaacaaggtacttagtgtttgtatatttctcatattgaatttaacattttgggtgagtttaggttacatctttttttttattttttgcttttgttgataggcaccgaggagacagtgttgtgaggtgatggaaggaaaagtaggaaaaagaaaagagaaagaaatgttgttaaggattagaaaatgcagatctttggagaagatataaaaaaagcgttttaattagagagatttttgcacatacagatttagattcgatcattagttatttgtttctaaattcctcaattcctagtaccaagagaatgacgattttctctagtaatactggcactcttcgtttttcaacatgtaaacattactttgtataattagtctatatcaaataaatagttacaacatgaacgtaactatttatacacgagggtaaatttttaacaaatttaaaccgaaccaaaaagatttcagttaatcatagttttgttacaagcgaaatctgaaatattcaccctcaagtttgttacgtaattgtctaatctgtgtttttttgtgctagtgttataattgtttcctcgaatgttaagcaccacatagaagtatacacttttcttttattattttcgttcttcttccatttagaaacttttattaattctactgttaaatccaacgttattagtttattttctctgatgaagttctaattttttttgtttgttggaaaaagggttacttttctgatgaagttgccgatttgtttccaaccaaacctcagctaatatagttagggagacggataagaaattgcataaagggagaggctttgtaaacacgcaagtttacgtcaacttgacacatataaactcgtatataggaattgtgtaaaatgttaatcaatatatgtttatgaatatagtccttttatttccttaatctatagtcatgttatcatcatatcggcaagaaaattactattacaacatatgtttccgtgcttcgatttgtcgatcaggtaggcaaccaaaccgggccagattagtcacaaatgaaattaggctccactttggcaagttttttcacaattaaaaattagaaagtctaaccaaactaatagaaactgaaccaaacaaaaatgttcacgcaattacgtagcacttctctatgaaatactgtggataattcgatttgagctaatctatggtaagtcgtttctctcaaactgaattaagctaaaccaaaccgaaaataaaccgttgtagaacacccataataaacatatatatgttctctactcttatttggctatttttccatttgcagatacgtgtgacaacattccaaatataggcacatgatacaaattacaaagccagaaattataatttataaactatacataataaggtcagtagcctaattacatccatatatttagttgggcataataaggatagcctaattttggtgcatcccgccaaaaattcggacaaatggtgaatttcaaaccatgaatttctttgttatacatacattacgtgcactattacatcaaagaaaaatagtgacgtgcataaacgtattttcttcacataatctatatataatatatacagccatgtacatttttcaacatagaaaaatcatgtatacaaatacggtaggtgcaatactgataaactgccattcccattgcattagacgctagtcaatccaaaccttataacataaaaagttatagtccatttctttcatatccaatcgagtcaaaataatattcgagcaaaaaacaaaagaaatg

SEQ ID NO: 21484 - DNA, 3003 bp, Unknown; identical to SEQ ID NO: 21483
  misc_feature (1)..( 3003): 2750-1469P.txt file - cDNA_ID_1989336; gDNA_ID_1971953; Annot_ID_177393

SEQ ID NO: 21485 - DNA, 3003 bp, Unknown
  misc_feature (1)..( 3003): 2750-1469P.txt file - cDNA_ID_1989337; gDNA_ID_1971953; Annot_ID_58649
tctccacgtttccatcatattttctttttttgtttccctatttgttctttgaatcctcgaaatattttctaatcatcaattatagcctctatcttttggaatcttaatttatacccatttgatcattcgatgaaaagtttcttatcgaatgtttttgacagatttttatggttcagtagttttacaaggttataaatatttactttgctaaacgttttacatgtttgagatcctaacattagttccatattgtaaatatcaaacatgtataaatgttcgaatcgaaaacatgtacattagctgttattattttgtctcaataaattttgaatctggaagaattgataacatcctataaatgtggtgacaatatgcaaagattgaaaacaaatttctctctgtttatagattctatggtagcatataatataaatatataatatgatactaatagaatattgaatttcttcttttcttttcaaaaatagaatattgaatttcatcttgatattttttgataagctataggatgtttacacacgtcctctttggttaaagagagcagttctaatctcaccaagcttggaacagctataaagcacgacaatcgaactatactacgacacgttgcagtttgaagctgtcatgaaacagacctaccactagtaccgccacgtgacggtcatacccaaagaaacgaaacttgtaagaagagatcaccggcacgaacctaacacatcgcaaattcgaccggtctcgctagacacgttatgcatgttttttgttcgtttaatgaatgacgactcttcactttcgtttttgtattagtcaataattataagagttggccagttaggttgattacattaaatattcgattaggggagactaaaatatttgtactattttgtacacgtaaccttacattagatgtcttcgaaacttctttccatatgagtcatgacaaggaaaacttctttctatgcgttctcttacccaaaaaaaaggttctcatttttataattggagattccacatatatattattaattctcggcttagtaggattctaccgggtaatattgtaaactaaattttcaatattcaaaattattgttattgaaatctcaatggaatgactcaattaagataacaaaacattgaaccaatagatcacttgtgaatagttaacgacgattttgatattttgaagataaattaataataaataaataaataaaactgttacctatttaattgcgtctgctttttgacatttgcgtgcgtaaaatatttttatatttccgtggattcggcatgcacgatgacattttcctaacatgcaagcaaacgacacaattttttaaaaataattattcgatttgttttctacttaagaacttgggacggtgtaggacctaccccattctctgtaaattctattccatgatcaataatgtgaatctcttaggaatagatcaattgcttaaaccatctaattagcgacaattcttgcattgatcgataatatttggatatatagtgccggctttgaggtcctataagctcaaagcaaagtttaaaatgcgtgcacacaaaagaagcagacagatattttaacttttcgttgggccataaaagaagcccctaacaaatatgcacctaagtcaagcgacataagagatatgagacgatacagacccacaaggatgaagtaacaaacatcgatttggatcaagtttgttaaagataaacccaattcggagagagtccactcaatagtgaaatgcctacaatgggctcttattaagcaatggactctaagagacgtgccttttttcaatttaggcaactgtagtctattgggtataacaaatgctattctttgccatgtatattaaatactttactctttgctgcttctttaatttcttcttaaatggtttatctagtaaacgatggcaaggtatactcttttgagttattacgagagacagagttagttacatgagctagttcagtctttaattagcctttctttatgtacattatctcataaatctacatgtgaaaactttatttactctttgtggagagaaaataaattgtaaagcagcagcacaagatcgatttactgttgatttcacattttgaatgtagtactgggccttgagggacatagaaaagctaagattgcactgcagtactgcacccattcattttgtgactcggcccctccccattttgtacgtaaacaagaaaacgcgttcgtgattcactttaactttatggaaaaaaaacaatttggcgacttgcatcgacgtgcgcgtttatattatataaactgattttcaaaagaaggcatgattcatcaaagcatgtatattagcattcttaattatatctttgtttcaatcatgatccaaaagatgtgagttgatctattgttgttgtttccacgtatgttcgtctatatccaattttcagtgtattttattattctgctacatatttaattttagctcaaacacacattttaaccatattctccttggcaatttatttattagtcgatagcaatttggttgcaataatcttctgttatacttgaaaaacgatctattaacaaatatattcgaaagagtttcaaaacaatctattaacaagtattcgaaagtcgtcacatcgttgactaaagctgaggacaactctgtcatttttatcttattcacgtggctacctcttcttcttcgtctctcattttatgtgtaatcccacagagcttgtcactccaaaaaaggcaaaacaaaaaaaaaacagcttctaaaaataaaaaacaaaacaataatccagccaccgtaggggtaattccgtaaatttgtaacagaaactccattcccgcggcgtatgcagagggcaatcccgtaaacttaacccatctccggtgatgaataatatcaattccttcacgccggagtgattttccacaaaaaataagatatg

SEQ ID NO: 21486 - DNA, 3003 bp, Unknown; identical to SEQ ID NO: 21485
  misc_feature (1)..( 3003): 2750-1469P.txt file - cDNA_ID_1989337; gDNA_ID_1971953; Annot_ID_177392

SEQ ID NO: 21487 - DNA, 3000 bp, Unknown; identical to SEQ ID NO: 8982
  misc_feature (1)..( 3000): 2750-1469P.txt file - cDNA_ID_1989338; gDNA_ID_1971953; Annot_ID_58648

SEQ ID NO: 21488 - DNA, 3000 bp, Unknown; identical to SEQ ID NO: 8982
  misc_feature (1)..( 3000): 2750-1469P.txt file - cDNA_ID_1989338; gDNA_ID_1971953; Annot_ID_177389

SEQ ID NO: 21489 - DNA, 3000 bp, Unknown; identical to SEQ ID NO: 9021
  misc_feature (1)..( 3000): 2750-1469P.txt file - cDNA_ID_1989344; gDNA_ID_1971973; Annot_ID_58688

SEQ ID NO: 21490 - DNA, 3003 bp, Unknown
  misc_feature (1)..( 3003): 2750-1469P.txt file - cDNA_ID_1989354; gDNA_ID_1971973; Annot_ID_58674
tacacgcaagttatacatatgttttcacatatacgctctgcctcttccaaagtcacatccatctttcaatggctttctcttcagctcacctcaaccaccaccaacctttgatcaagcacggtggagccacggcggcgcctcctccgaccccgtcatgctcacatctcaacaccaccagcaaatcggagacagcagttgacgctctctccagtcttttccaccgtctccctcctttgctttcactccccaaccgtcgctccatcccttctcttccgatggtatctctctccgccggagatagacttgaatgggacgatcttatctccgccgtgactgatttcggctatttccaactcattaacgatgactccgatattcttttccctcctgggatcgctgaagcagccgagtctgactcactctcgctcttagagctcagtgaagagaagaaggaatcatcgtttccgaagaaatggccgctaggctacgaagccgatgctgaaacgccatcgttttgccttgacgccgactgttcaaccgactcgagcgagttaaatctgagttcgctccgtgagttcactcggactctagagaaagttggactgaagacggtagagatgctggcgaatgcacttgggtttggatatgattcaacccggtttaatactctgatgtgggttaaccaaggtgttcctgatgatgaaccggaggtaaccaacggattttatccttttgttgtttgtttacagtatcagataagggaacagaagtattgtttgctaaccgagtctggttgggtgtccgttttaccccgagttgactcggttcttgtgacgttgggtgacattgctcaggttagttctcttttgcttttgacaattgacagaacacatatatctcttttatttatctataattaattggttagttgtcttccttaaataattatcaaattatcatcctttgtaatggaactttattccactataccgttaactggctgttttaatgtattttaaacattatccaaaataaatgttttccaacgcatcgttcaaaaagagaacaagaatttggatatttccgatatttattgttgacaacaacaacaattgtggagcataaccggggaatgtgttttcacttttcgtttgaaacagatttatggcattgggaaagaaataagaatttggaaatttccgatatttaaatacttatacacatcacatcgcaattgtacttagtgtcctatagaattcaacaattcttttttttttaggtcaaaacctaacagctttctacaatatagttttcaacttttgaacagctaacaaacaacttaaaattggcaggtttggagaaatggagaggtcaaaagagtgaaatatcgaccagtgttgtgttcaggacaaaaagatggtccagtaaagtgtgtaacaatgacattgatgcttacacttcccatggacagtatggtttcatcattgaaggatatgatcagtgacggcgacaaagaagaagagtatgcagaggaggaggaagaagatggaggagcaagaagtgatgagagaagggcatttaggccttttagtttcaaggagtacgcatggagagtgtaccaagaacgtctcttcttcagggatccacttgacagatacagaatcaaatctttaaaagattgacgaaccgatgtttgatttgtttgtttctttcttgggttgaattggtactatagttcttgttgttactttttttcccccataaaatcttttgattttcagcggattgttagcattttagcattgagatatttttgtttttgttcgattcagttcagagaatgttctattttgatagtcactccatcattcaactaattttttcatatatactcatatcaaaactgtcactatttcaaaatcaaacttttaggttacaccaatgactctatcacactaaactcaactcctagattttatatagaagaatctatgactttgatgatgtactttaaaactgagtcttttgagatcataaccaaattctacttcataacttttgttttccaatgttgattatttgttataattagaaggtgacacaaacgcttatagcatcctgtttttgaaaatgaggaaatacagtgttggcttttaatctctcattgaggcagaatatcaatgaatgacttcaaatctacgtatacatgtttacttatttagtgatccatattggtgttgctctttaattttcttgtgagaatgaattatatacatcaaaattgattatatcatttaattcgagttaaaattataagtaatacaatcttcactaaacactaattaaatcgacgtaaatttcttatacgattttttcatgcaacacttaaatcgacataaatttaaatattttggtcttcataccctaattttgataagatataatagaaaatttcgtatatctttttttttttttggtaaaaagtttttttttttttgtttcatctccatatttagaaaatttatttcaaacttcgttctcgtttgtgttcatcttaatttttaaccatgattgagtcattgaccattgctcaaaacatacgcataaaattcccaaaaagtagtgtgtgtcgtgacaaaacccgacccgtcgatttacgcggtttgaaactcgacccgaatactatccgaacccgtaactttggcaaaagcacatcgtacagctcaggcacttgtagcacgtcgtctctcctttggtttctctccttatattcgacgagtgactccgattggatcgctatttcgtcatttctcactttccaaaaagaaaaaaacgaatctctctccaccatcatcacctttctccttcacttgcctcagatctggctgcgatttcaaatcttccttagtttctctcgcatcgctcggccgttgacggtcccgtcctttccgtggatctgattctggccccggattctctcgccgcgatctgaggtcaaacatg

SEQ ID NO: 21491 - DNA, 3000 bp, Unknown; identical to SEQ ID NO: 9015
  misc_feature (1)..( 3000): 2750-1469P.txt file - cDNA_ID_1989356; gDNA_ID_1971973; Annot_ID_58672

SEQ ID NO: 21492 - DNA, 3000 bp, Unknown; identical to SEQ ID NO: 9015
  misc_feature (1)..( 3000): 2750-1469P.txt file - cDNA_ID_1989356; gDNA_ID_1971973; Annot_ID_177492

SEQ ID NO: 21493 - DNA, 3000 bp, Unknown; identical to SEQ ID NO: 9014
  misc_feature (1)..( 3000): 2750-1469P.txt file - cDNA_ID_1989357; gDNA_ID_1971973; Annot_ID_58671

SEQ ID NO: 21494 - DNA, 3000 bp, Unknown; identical to SEQ ID NO: 9014
  misc_feature (1)..( 3000): 2750-1469P.txt file - cDNA_ID_1989357; gDNA_ID_1971973; Annot_ID_177490

SEQ ID NO: 21495 - DNA, 3003 bp, Unknown
  misc_feature (1)..( 3003): 2750-1469P.txt file - cDNA_ID_1989358; gDNA_ID_1971974; Annot_ID_58727
cagttcttccttctcacgttgcagtgtctctgggtctcgtttctcattctgatctcacaaatataattttgaaagtcaaagagggagggctaaccagatataacagctcacacctccacaaacacagctaacctgattaagagttatctcttgagccttcaagattatatccgcaaatcgatttttcaatagagcagccctgtaacgcttttctggaggtagttccttctcttttggagcactatttcctaaattattaatgggtcaagagtgagatgccaccctcagatattagagcacagatatttttctgctacacttctgagcttaccatcttgatgaccatctgccccctcaataagacttagcttccctctggatgcatcttccatctgattcaatccaccgacggaatctgcttttagaaagggaataagaaaaccaaggtttattaattaatatcaacaaaacttaacatcttttgcaccaaaagaggagtaatcactgattagagataatatgatcactatagaaaatagcaaacagcgacctgggagtaaaacaagcagaaaatgtaacaggtctatcactatcatactaggtgtgtaatatgagttgctatcagtaaggtcagtaagtttcactccaaaaaaactacagaagtaacattgagtattctagatggacggccacttctgacaagagggaagtaaaatggttccgagggttaagtacatataagaattgcaaacatcaaacgtctgcaaaagctccatagagaaaaagacaaatacaatgtagcaagattaaacaaaccactgtagttctctaacgccatacctttttctgttctgacagttgagatgtgagatatagggtgctcataattaccaatgtcaacatcctcgtcctccaattcactccctgcaagtaacgaggaggaaatgacagcttaatcatagagtaggacatgcgaattagctcaaacaacaaaaccagtgtatgctaaccatcacagtgttgcgtcaatgaatttcctggccctgacccatgtaaaagctacatcaagaaagttttcgctgtttatcagtcatgttaacaaatggatcaagaatgagatatagaaaggtgattacctctaacacacagggttcaccgtttgaatctttcttttgattttctcgcagaaactcatcaaagagatcccgcaactggaacaaggcatcatgactgagatcattgatgtcaatctctatctcatcatctccagatctctcttccttggagctgtgatctctcaggaaatttattatctgtacagggaattctgtcaaggaccccaaatctctgccaagctttactctatcctcatctgtcataacccgcttagcaggctctaagaggctgttacgtttcacagcattcatctttctcttcttagccacaggctcaggtatcgcaatatctttgtgagcaagagtagccaagttacttggttcagatttggttccggatgacttcttctcgatagttttccatctcacttcaaaaaacttgctgagagtatcagcgaagcgatacacattattatctgacgggttataagtcatagcattgcggaaagtaagacggacatcagcagaaaactctgaagggcttgaatacgtgccggaagttaacttgcttttaacagttcctaaatccataggatgtttgataatggtgaaataatcaggaatgttgagcttgacgacgtccacaggggtattaaagagccaacaatgctgctgcgacatcaatcgtttaaggaggctctcacattgcttcatccgaagcatagtggaagtggtgactggctctggtttggttgctgtgaaggggagcaccctttttccagggccagtagagcatcgtgacattccaaaactcttggggcgagacacattacttgcaggtgtactagtaacaatcttagatataggaagaaggtccccaacactcttctgaaaggaccgtagttgttccagctcctgacgaagcgtatgaatccactttctcctttctgatgatgacaagtcagacaagggtaaaactattctcgggacaccaaaagtttcatcatccttggaagcattggggctatcatcacagccgccgggagagtcaaaactgttacgattataatctcctgggaaaccaccgttcctcacagtcatgatatcgcccaccgaagtgcgaacctgcacaaatcaaaatatttaagtcagttttgagaaaccctaactatgaaaacctgaaagcaattcaattcttagagccctatagtattgctggaggagagcagtgaacactcaatatgcataaaaaaggaaattcggaactaaccaactcgaaacacttagcaagcgatcgaaccggagcagaagtaagagaaccgaggaacaagcgtaaatcttctccagcagaaacagattaacgctagagattggtgtagaagatgatgatgaagaagaagatagagtaaaaccctagagtggagacgaagaagacgaccgagaagtagagagagaacaaaatcgctctctgccctcccttctctagtgtcccgtccctaacgaatgctgcgtctaacgccgttttgctactgggcaggactcaatctggaccgtcggatctgatccctcgaattaaaatcgaatgcaaatacttcggtgcataaaaataatatcctgggcttataatgtaaagcccaatgaactttttaatgtgcctttattgggtctacggatgactcaacacggcacgctgtgaaagctcgaatcgcaggaacggcacgcgcttttttccttcgaaaacaatttcttctccttcttcttcaattgatggtttgatttacacatccttcttcttccagttccatgtcgcatacgtacacagattgacagcgaagctagttagctcagattttggatctcgaatttcagttaattcgatccggttatg

SEQ ID NO: 21496 - DNA, 3000 bp, Unknown; identical to SEQ ID NO: 9056
  misc_feature (1)..( 3000): 2750-1469P.txt file - cDNA_ID_1989359; gDNA_ID_1971974; Annot_ID_58726

SEQ ID NO: 21497 - DNA, 3003 bp, Unknown
  misc_feature (1)..( 3003): 2750-1469P.txt file - cDNA_ID_1989361; gDNA_ID_1971974; Annot_ID_58724
attcatgggtttttggtcaccgaaacagattcagacacgtcaacatgttcgcaaagtgcactcattatccctcgttgacttctatttaaaactgacgagtaattattactatcaatattgggctctcgtatatggtatattatcgggcccaacccaaaacatatttgggccggattagaaactagtgagaaaaagggaatgttactatgttagtattattgttgactgttagagtttttttcgctccgcctctctgaaactcgccgctagtaagcttcttcttcacttgtgctcttcttcgacgtaagttttctctctttccttctcaaaggtttctctctcgattgacaatcctaagtttcctcgctcttgtggcaattttaattttatttttctggatttggctaaccctaatttcgtctggaaacaatgatattcaacgaaatggcgatttgtgatttaaaaagttgctctgtttttggtatctaaaatttgtgtaggagatgaaccgtattggattgataaggggatcatcatccaaggatgtagtccggagaacgtttgcagcagcagctagtaaagccaagaaaggtggcaaaggaggtggagccagcgatgctcctaaaggttccagcttgaccaaagagatcaaatccaccactgttgttggtgccaatactctcaaagacggatctgatcccaagatcttgcctgattctgattaccctgattggctctggcatctcctcgataagcgaccagctctcagtgagcttaggaggaagaacgtcgagactcttccctacgatgatctcaaacgttttgtcaagctcgacacacggggtaaaatcaaggagaacaactccatcaaggccaaaaactgagagatgtaagatgttttcaactctctcactgttgctgttttctttgtatgtgggaactatgcttgctaataagtagattcttccagttagattacatttccaaggcgttattatgctcttgtatgttctcagacactcttagtatatccaagaaattgctgcttcatcttttctctgcatgattctctttgaaaagttggaataggtttattcttacttgctctaagtatattctttcagttatcttacttttccgagtcagtaacattatgcccttgtaagttcttgatccttaagactctttattagtgaatccaagaaattgctgcttgtgtgagtgaaactcttggctcttgtttaatctaccgaatgatatgtccagcaagtgtgtaatacaaatccttctccggatagaggagatgagttggtcggttcttaaagacactgcaggtgtaactgatccatttaacaatcagatttattgtttactgtatgggacctggctcattgatattgcatcactattctgttggtggataccaactcttgttgtctatctctttgtggggtttgataccttcaaaagaaaggtaaagcaaatgttgcatcattatctcccctttgtcttccattattgctcttctttgctttgattgttacttgtctcctgtgatttgcccagttacaatttcatattgctttgtgttaatactagttaggataagtttcaatttaaatcggttttgatttaggtcttattggtctgatattatggcttttctctctctctctctatggtattgtatctgacaagtgctgctacttatttgctttatggttatatcctcccatgcccatgaaaggtttaagagtttgaaaaggagacaccactcatcacatgcttttgtgggtataacaaaaaataaagctaacttttttctctgctcacatgcttattttcctcttttgacaccttaacaatatcttgctttgtttttgtttcgttttttgcatgttccttcttaactatatgtactaaatgtatgatttagatatgttatggatataattatccaaatctgtggtcatgattgatagaggccacgagggcggacattttaaatcgctgatccgaatttgttcttatagtctctctactataatgtaatgggacataggttgggtgtagttgcccatccttatttgttgtctgaataaactcttacctatatttatttatttatatataagtgcaacggtactactatttccagaaagaaattttgatggttcatgtttccttctactcttttattttgctcttaagaggctttatcgacatataatataaattcaaacactgctgcaattctaacggatataaatcatccaataaaatctcagaaataaaaacgagtaacgaattttgagatttgcaagaatctcaaaagatgtcatattaaaaaattcttcgatatccaattaaagactcgattatacggacttgctttggagaatccacaccaacactcaattcgattacctcgaaaacaaaagtagttcaacttttgataccatctcaaataatactaaacaagttcttgatatacatttattcccgatgggtgaaaaaggccacttttctccatgtgtctctatcattactatcaagtatcaaccctttttcactttatagaattaggcatttctcacgatcagttcctccttccaattattattctgtaacttttgaagtcatttctactccctaatgttacgcgttaaacatttatttataaaaaaagatctaagattttttccaattattccttcaaatttggtatttaattcgtgtaatgaagacaccagatttttccaagtacggttacatatataaactggggagttttctttgtttaggctgattaaagagacccaagtgcctcctacgctattcttcattttctccggtgaccaatccttttctttttcttctcctctccgtccttaaatagttatataggagcaggcattgttccttgatcaccaagaaatcgctttgacccctatctccttcttctgcaactctttttcagttttcctcaacacaatttctatg

SEQ ID NO: 21498 - DNA, 3003 bp, Unknown
  misc_feature (1)..( 3003): 2750-1469P.txt file - cDNA_ID_1989361; gDNA_ID_1972047; Annot_ID_178242
ttcatgggtttttggtcaccgaaacagattcagacacgtcaacatgttcgcaaagtgcactcattatccctcgttgacttctatttaaaactgacgagtaattattactatcaatattgggctctcgtatatggtatattatcgggcccaacccaaaacatatttgggccggattagaaactagtgagaaaaagggaatgttactatgttagtattattgttgactgttagagtttttttcgctccgcctctctgaaactcgccgctagtaagcttcttcttcacttgtgctcttcttcgacgtaagttttctctctttccttctcaaaggtttctctctcgattgacaatcctaagtttcctcgctcttgtggcaattttaattttatttttctggatttggctaaccctaatttcgtctggaaacaatgatattcaacgaaatggcgatttgtgatttaaaaagttgctctgtttttggtatctaaaatttgtgtaggagatgaaccgtattggattgataaggggatcatcatccaaggatgtagtccggagaacgtttgcagcagcagctagtaaagccaagaaaggtggcaaaggaggtggagccagcgatgctcctaaaggttccagcttgaccaaagagatcaaatccaccactgttgttggtgccaatactctcaaagacggatctgatcccaagatcttgcctgattctgattaccctgattggctctggcatctcctcgataagcgaccagctctcagtgagcttaggaggaagaacgtcgagactcttccctacgatgatctcaaacgttttgtcaagctcgacacacggggtaaaatcaaggagaacaactccatcaaggccaaaaactgagagatgtaagatgttttcaactctctcactgttgctgttttctttgtatgtgggaactatgcttgctaataagtagattcttccagttagattacatttccaaggcgttattatgctcttgtatgttctcagacactcttagtatatccaagaaattgctgcttcatcttttctctgcatgattctctttgaaaagttggaataggtttattcttacttgctctaagtatattctttcagttatcttacttttccgagtcagtaacattatgcccttgtaagttcttgatccttaagactctttattagtgaatccaagaaattgctgcttgtgtgagtgaaactcttggctcttgtttaatctaccgaatgatatgtccagcaagtgtgtaatacaaatccttctccggatagaggagatgagttggtcggttcttaaagacactgcaggtgtaactgatccatttaacaatcagatttattgtttactgtatgggacctggctcattgatattgcatcactattctgttggtggataccaactcttgttgtctatctctttgtggggtttgataccttcaaaagaaaggtaaagcaaatgttgcatcattatctcccctttgttcttccattattgctcttctttgctttgattgttacttgtctcctgtgatttgcccagttacaatttcatattgctttgtgttaatactagttaggataagtttcaatttaaatcggttttgatttaggtcttattggtctgatattatggcttttctctctctctctctatggtattgtatctgacaagtgctgctacttatttgctttatggttatatcctcccatgcccatgaaaggtttaagagtttgaaaaggagacaccactcatcacatgcttttgtgggtataacaaaaaataaagctaacttttttctctgctcacatgcttattttcctcttttgacaccttaacaatatcttgctttgtttttgtttcgttttttgcatgttccttcttaactatatgtactaaatgtatgatttagatatgttatggatataattatccaaatctgtggtcatgattgatagaggccacgagggcggacattttaaatcgctgatccgaatttgttcttatagtctctctactataatgtaatgggacataggttgggtgtagttgcccatccttatttgttgtctgaataaactcttacctatatttatttatttatatataagtgcaacggtactactatttccagaaagaaattttgatggttcatgtttccttctactcttttattttgctcttaagaggctttatcgacatataatataaattcaaacactgctgcaattctaacggatataaatcatccaataaaatctcagaaataaaaacgagtaacgaattttgagatttgcaagaatctcaaaagatgtcatattaaaaaattcttcgatatccaattaaagactcgattatacggacttgctttggagaatccacaccaacactcaattcgattacctcgaaaacaaaagtagttcaacttttgataccatctcaaataatactaaacaagttcttgatatacatttattcccgatgggtgaaaaaggccacttttctccatgtgtctctatcattactatcaagtatcaaccctttttcactttatagaattaggcatttctcacgatcagttcctccttccaattattattctgtaacttttgaagtcatttctactccctaatgttacgcgttaaacatttatttataaaaaaagatctaagattttttccaattattccttcaaatttggtatttaattcgtgtaatgaagacaccagatttttccaagtacggttacatatataaactggggagttttctttgtttaggctgattaaagagacccaagtgcctcctacgctattcttcattttctccggtgaccaatccttttctttttcttctcctctccgtccttaaatagttatataggagcaggcattgttccttgatcaccaagaaatcgctttgacccctatctccttcttctgcaactctttttcagttttcctcaacacaatttctatg

SEQ ID NO: 21499 - DNA, 3003 bp, Unknown
  misc_feature (1)..( 3003): 2750-1469P.txt file - cDNA_ID_1989364; gDNA_ID_1971974; Annot_ID_58717
acattaaccaggtcgggatcaacgtgctcacccaaaagcacgttctgcttctgatatcagacctagaaaacatcgaaaaagagctctacatcctggaatcgctctacacagaagcatggcagcagtcattcgagattctttgggttccagttcaagatttctggacagaagctgacgatgccaagttcgaggcccttcacatgaacatgaggtggtacgttcttggagagcctcggaaattaagacgagccgcgataaggtttgtgagggaatggtggggtttcaagaacaggcctatactcgttgcacttgatcccaaaggtcaagttatgtcaaccaacgcctttcctatggtctggatctggcaaccctttgctcacccttttaccaccgcaagggaacgtgatctatggagcgaacaggagtggaatcttgagttcttgattgatggcactgatcctcattccttaaaccaggtttcttgattgaataaaaaaacagagtactaataaatttttctttctcttgtgttacacgtaacctgaaaatctgtgtgtgtttcaaatgttttttatcagcttgttgatggaaaatacatatgtctctacggaggagaagatatgcaatggatcaaaaacttcacgagtctctggcgtaatgtagcgaaggccgcaaacattcaacttgagatggtttatgtcgggaaaagaaaccctaagaatggaatccagccgataatcaacacaatccgggaggaaaatctcagccatactttgccggacttgttccagatctggtttttctggaccagggtcgagagcatgtgggaatcgaagcagaggatgctgaaagcccacggaatcaaggggagagaagggtttaaagaagaggaaaaggaccttgttctgcaagaagtggttgctatgttaggttatggaggagaaggagatggatggggactggtgagtaaagcatcggacatgatggttcgagccaaagggaacttgttttctaggggtttggctgaatttaacgaatgggaagtcaacatccccacaaagggttttcttacagcgctcaatgatcatctcttaatgcgtctcccaccacatcactgcacaaggttcatgcttcctgagactgctggaattatacctaatgaggttgagtgcaccgagtgccgtaggactatggaaaagtattacttgtaccaatgctgccttgagtaagatcccataatactggggaacaagttgatttggaagccaacaacttgttcctataaaaccaaataagtttgcgtcttttttttcctccttgttgtgagtttctctactcttcatgttgttgttgttgttctgctctactaaaagcagagagtctttgtaataaaatttgtgtgtttgagatttcgaaataataaaggtttatttatcggaagcttctagaacaatgaactgattgaacattgcttctttgttgatttcttgatccttaagctcctagaacactagtgaactaatacacaagtaacacaagtgaccgtgacatttttttaatgtgacagtaatatcttttgacatttagccttttgaaatgaaattacttaatgctagtaaaatataggcaaagtaaaaggatggatcaatcaatcaaaagatgaacagtcttttgagtccaaatcacatatcgtaatatatctaatagaaagttaaaagtgttagtctacattattgaaaaaataaaccatgagactgattgctgtattacaaagggggaatacaactttaaacgacaaatcagcggttcctagcctgtagttaatgtaaaagttaaatcttccaaaccatcaaatactttttaaatattgcatatatcggattcgatttcgaagaagctcttatacgtatttctaatgatgagatattaaaatttgttgcgtatagaaacaacaaatttaatcctacctataaacgttatgctaaagttaatagaaaaaaaaaaaaacatgcatagaataaacccaaagcataacaatcttatttttagaaaagtgattgtctttagataaatatatccttggttactcttttattgctttttttagccttatccaagatatatcattgagcttaagaaattctttagttttacccaaaagagagcaaagaatcttaacttcacacccttttgttcacttcactcttgatgctattttctgaggcatgcatgagataaaatcaatgtaaagtaacttaaagtaaatgacagaagccataaattataatattctatggcatgaggtgaagtaacataagaatataagcaaagtagcaaacaaaatgtgtcttatcttttaatgtcctttagtaacataaaaatgcgagaattaattagtagtccagtgatcatcattatgatggagaaaagtgaggaattcgtctccaaacctcccaagaaaatgacaaaaatctgtatattttaggatctaaatttctagttggcaatgaagttaatatcattagtagcaatattaaaatagtgtagtttttgatccacttttagtcttatatgaatttgaattcagtaatacacacataaagaaagagtactagctctaaagatttacgagtaaaactcgcaacatttcagtgaaccattttcttcccattatgatttagttcttatttactatatatattcgtgtaaagtaggcctatactttattgtgctaacgatattcacgtggacgggaactatatatctcattaaaacttctataataagccaccaaaaaaagaaaagcaaaaaagaaacaagattatataattgatattctttgtatgtttaatttaattgttgcagaagcaaagaagtcgattctcaatttccaaccgtaactaagggggagaaacgagtatttaaggctaacctcacatagcaaaactacaaaccaataaagacagcctcttcttctaacaaaagcaaactgaaccaagaatg

SEQ ID NO: 21500 - DNA, 3003 bp, Unknown
  misc_feature (1)..( 3003): 2750-1469P.txt file - cDNA_ID_1989365; gDNA_ID_1971974; Annot_ID_58716
taatcagtttcatcctctctattacagtacccttcctttgtcaatagtcttagttggggtcggggatggaccatgggacatgatgcaggaatttgatgataacatacctgcccgagctttcgataacttccaggtaagcttctttttttcatatcatgacattgaagattgcttcttttcttcagtttggaaccatttttctaacatgtttgctctgtttctagtttgtgaacttcacagagatcatgtcaaagaacaaagaccagtctcggaaggagacagagtttgcgctgtctgctctcatggagatccctccacagtacaaagcaacgatagagcttaaccttttagggtaagggacccaaatcaaaactctgataggtgtagctgcgagaaactgctatattgttaaacaaaatgctcacctttctctttcccttacatttttgcagggtaagaaatggaaatatcccacagagaatcccacttccgccaccggtgcagagtggatcatcattctctagttcccggataccgaattttgaaccgagtgtacctccttatccatttgagagcaagcaaatgagtagtgcagacgatattcaggtaattagtagaaacttaggaatctgtttgaaatgttaagtgaaataagagctttggaactttttgttgttaaactcgtttgtgttattttccccttgaacagctatgtccgatatgtctgagcaacccgaaaaacatggcgtttggttgtggccatcagacttgttgtgaatgcggaccagatcttaaagtgtgtcctatttgtcgtgcgccgatccagaccagaatcaagctttactaacaacaccattgacatgcagctttgaccagcccaaatcccatttcttccagagattttcagatctttctgtagaaaattaaagtgttcttttgttctttgattgaattcctaaactttatcttgttcataaaatttctttgattggattgtaagaattatgtatttgtctgttggctttctttgatttttcaagattcgattaaaccaaagttgattgcttaaacactttaattttgatttgttttgtcgacataagcaatgagaaataaatggatgaatagcccaatagaagcccattagcctgaaattgggctacaagcaaacataccaaataaatagtagggaagagcagaaataatcacaccactcatcagttatccattcctttctttttacataaattttgtcactttttctacaaacgattcttcgcttctgtgaaatttgataaagcgaaagtttttttcttatggattctcttcgattcaacctccaacaatctccatttcaattgaaacctagaattctccgaccaagaatcaccaacatatcaaaccgaatcgatgaaaccgatcctcgaccatcatcctcggccggtaggatccaaaggttagtacttaacaacgaaggtcggaccaaactaaacgccgatcctgaccgtgaattctattcatatccacggttcgtgaaccacgtagatgatagtttcatatcctccttaaccgaactatacagaaaccggttgagacccggttcgactgtacttgacttgatgagctcatgggtcagccatcttccagaagaagtgaagtacgagaaagtagtagggcatggtcttaacgcacaggagcttgctcgtaaccctagactcgattacttcttcgtcaaggatcttaatgaagatcagaagttcgagttcgaagacaagtatttcgacgctgttttgtgttctgttggtgtacagtatctacaacaacccgaaaaggtacgttaccgtaaaccaaaaccgatttcggttatgtcaagaagattcctaaaccgggtctttattatataaaccgcaggtgtttgcagaagtgtatagagtgttgaaaccgggaggagtgttgatagtgagttttagcaaccggatgttttatgagaaagcaattagggtttggcgtgatggaaccgaatacagtcggatccaattggtggttcagtactttcagtctattgaagggtttactcagccggagatcatccggcaacagcctggagctcagatatcggttttgactcggcttatgggttttatcggtttagcttctacgcccgatccttttaatgctgtcattgcttataaaaatttcaaacctatttatgagtaacacgcacataaaaaaaagtgtataagaattggatgggaagtttttgaagaaaaggaaaaaacctctcaaccaagtccagctggagaaacttacaatacaaatttttaaaaagtggagaatgaaattacagatttcaatcaaattggaagaacctgtattacacaagaaataattgacagaaagattacacactttggaaaatataattaatatatagttttcaattagcatgcattgtatgtgattcgttttgttcgaagattcatggacaatatccaagcaaggtagccttgtccctcttcaaacgagtatcacgagttgcttactttatggtttagattctataataacagtatatatattagaaggaagtcttttatattaaaacaaaaatccattgtatatgtacactatctatgttccatgcatgtgtcttcttaaatagctatgaagtcccttattttactatgtacatactaaatttagttatgtttatcaggataactcgttgtaccatcagtatataaactttgaaatattaaatgtttctcactactagtattagactgttgcagttgcgttagagacgtttcatatttagaaataatattatccaagacctgaaattcttattattatgaaaattatgaaatatcgataagggaaaaactgtatggaagtgtaaaagacaccaaaacagatattgaaccaaaggtgaagcaaagaagttgattcaaagttgccactttatttaaccttttgcaccagtatatatacacacacatg

SEQ ID NO: 21501 - DNA, 3003 bp, Unknown; identical to SEQ ID NO: 21500
  misc_feature (1)..( 3003): 2750-1469P.txt file - cDNA_ID_1989365; gDNA_ID_1971974; Annot_ID_177573

SEQ ID NO: 21502 - DNA, 3003 bp, Unknown
  misc_feature (1)..( 3003): 2750-1469P.txt file - cDNA_ID_1989366; gDNA_ID_1971974; Annot_ID_58715
atacccattttcaaggacaccttagaaagtttcgagttttctattaggtaattgcatgttgaatctgttacgttcttcttgtgattccccttttttctggcccaaagaggataagattctaaaaatctgaatctttgtatgcaggtgtattgatcttgaagccttaaagtttgtgtctttttgttaatttgaataaagtttgatgggaggagggaattccaaagaagagtcgtcatcaccatcttcatcatcatgggcttctcatcaaagttatcctcaatatggacctgatagctacaactatcctcctccacccacttatgctcccgctccatctcctgctcctgctcctgctccggtgcctgctccatctccggcttccagttatggccctcagtatagtcaagagggttatgcatcacagcctaataatcctccaccacccacttatgctcccgctccatctccggcttccagttatggccatcagtatagtcaagagggctatgcatcagcagcatcacagcctaattatcctccacctccttcacagagtcaagttgctgacaggaagaaatttgatcggaggtattccaaaatatcggataactactcttctttactgcaggttagtttaagacaatgcatatgctatacacttggattttcccctcaaaggttctttggaaactgaatctagcatgtgtctgaattgattccaggtgtccgaggctctaggccgtgcaggtcttgaatcttctaatctaatcgttggtattgatttcaccaagagcaatgaatggacaggtttgttatattattcttattcttacgttttgaatgtaaaggagaagccaaactaattggttttggtactgcaggggccaagtccttcaataggaaaagcttgcatcacttgagcaataccccgaatccatacgagcaagcaattactatcattggaagaaccttagccgcctttgacgaggataacttaattccttgttatggttttggagacggtatgcactgttttctctcttctcgattctcataagaatgtatatcaatcggatcatcattgacttgctttcatctctttgcagcatcaactcatgatcaagacgtgtttagtttctatccagagggaagattctgtaatggatttgaggaagtattggctcgttatagagaaattgtacctcagcttaagctcgcaggtttatttcctgctctgacctgcactggccaattctatatctccttgtgaaacgcaagttataaacttaaaactgtgtttttttttcctgcgaacttatgtatttcaggaccaacttcttttgccccgatcattgaaatggcaatgacagtggttgagcagagtagtggccaatatcatgtgttagtgattatagctgatggccaggtactgattaatattttgactgcctaagctgtgtatgatcttctggttttgtgtctagggatatcaaagtggacccattttgttgtttcaggtcacaagaagtgtcgataccgaacacgggcggctaagtccgcaagaacagaagacagtagatgcaattgtgaaagcaaggtgcgaatatttcaatcttttgactaatgtttcttccattttaaagttctttactttgagtgtaatgttataaagtgttatggtatgtaatcagtttcatcctctctattacagtacccttcctttgtcaatagtcttagttggggtcggggatggaccatgggacatgatgcaggaatttgatgataacatacctgcccgagctttcgataacttccaggtaagcttctttttttcatatcatgacattgaagattgcttcttttcttcagtttggaaccatttttctaacatgtttgctctgtttctagtttgtgaacttcacagagatcatgtcaaagaacaaagaccagtctcggaaggagacagagtttgcgctgtctgctctcatggagatccctccacagtacaaagcaacgatagagcttaaccttttagggtaagggacccaaatcaaaactctgataggtgtagctgcgagaaactgctatattgttaaacaaaatgctcacctttctctttcccttacatttttgcagggtaagaaatggaaatatcccacagagaatcccacttccgccaccggtgcagagtggatcatcattctctagttcccggataccgaattttgaaccgagtgtacctccttatccatttgagagcaagcaaatgagtagtgcagacgatattcaggtaattagtagaaacttaggaatctgtttgaaatgttaagtgaaataagagctttggaactttttgttgttaaactcgtttgtgttattttccccttgaacagctatgtccgatatgtctgagcaacccgaaaaacatggcgtttggttgtggccatcagacttgttgtgaatgcggaccagatcttaaagtgtgtcctatttgtcgtgcgccgatccagaccagaatcaagctttactaacaacaccattgacatgcagctttgaccagcccaaatcccatttcttccagagattttcagatctttctgtagaaaattaaagtgttcttttgttctttgattgaattcctaaactttatcttgttcataaaatttctttgattggattgtaagaattatgtatttgtctgttggctttctttgatttttcaagattcgattaaaccaaagttgattgcttaaacactttaattttgatttgttttgtcgacataagcaatgagaaataaatggatgaatagcccaatagaagcccattagcctgaaattgggctacaagcaaacataccaaataaatagtagggaagagcagaaataatcacaccactcatcagttatccattcctttctttttacataaattttgtcactttttctacaaacgattcttcgcttctgtgaaatttgataaagcgaaagtttttttcttatg

SEQ ID NO: 21503 - DNA, 3003 bp, Unknown
  misc_feature (1)..( 3003): 2750-1469P.txt file - cDNA_ID_1989366; gDNA_ID_1971974; Annot_ID_177572
tcctcctccacccacttatgctcccgctccatctcctgctcctgctcctgctccggtgcctgctccatctccggcttccagttatggccctcagtatagtcaagagggttatgcatcacagcctaataatcctccaccacccacttatgctcccgctccatctccggcttccagttatggccatcagtatagtcaagagggctatgcatcagcagcatcacagcctaattatcctccacctccttcacagagtcaagttgctgacaggaagaaatttgatcggaggtattccaaaatatcggataactactcttctttactgcaggttagtttaagacaatgcatatgctatacacttggattttcccctcaaaggttctttggaaactgaatctagcatgtgtctgaattgattccaggtgtccgaggctctaggccgtgcaggtcttgaatcttctaatctaatcgttggtattgatttcaccaagagcaatgaatggacaggtttgttatattattcttattcttacgttttgaatgtaaaggagaagccaaactaattggttttggtactgcaggggccaagtccttcaataggaaaagcttgcatcacttgagcaataccccgaatccatacgagcaagcaattactatcattggaagaaccttagccgcctttgacgaggataacttaattccttgttatggttttggagacggtatgcactgttttctctcttctcgattctcataagaatgtatatcaatcggatcatcattgacttgctttcatctctttgcagcatcaactcatgatcaagacgtgtttagtttctatccagagggaagattctgtaatggatttgaggaagtattggctcgttatagagaaattgtacctcagcttaagctcgcaggtttatttcctgctctgacctgcactggccaattctatatctccttgtgaaacgcaagttataaacttaaaactgtgtttttttttcctgcgaacttatgtatttcaggaccaacttcttttgccccgatcattgaaatggcaatgacagtggttgagcagagtagtggccaatatcatgtgttagtgattatagctgatggccaggtactgattaatattttgactgcctaagctgtgtatgatcttctggttttgtgtctagggatatcaaagtggacccattttgttgtttcaggtcacaagaagtgtcgataccgaacacgggcggctaagtccgcaagaacagaagacagtagatgcaattgtgaaagcaaggtgcgaatatttcaatcttttgactaatgtttcttccattttaaagttctttactttgagtgtaatgttataaagtgttatggtatgtaatcagtttcatcctctctattacagtacccttcctttgtcaatagtcttagttggggtcggggatggaccatgggacatgatgcaggaatttgatgataacatacctgcccgagctttcgataacttccaggtaagcttctttttttcatatcatgacattgaagattgcttcttttcttcagtttggaaccatttttctaacatgtttgctctgtttctagtttgtgaacttcacagagatcatgtcaaagaacaaagaccagtctcggaaggagacagagtttgcgctgtctgctctcatggagatccctccacagtacaaagcaacgatagagcttaaccttttagggtaagggacccaaatcaaaactctgataggtgtagctgcgagaaactgctatattgttaaacaaaatgctcacctttctctttcccttacatttttgcagggtaagaaatggaaatatcccacagagaatcccacttccgccaccggtgcagagtggatcatcattctctagttcccggataccgaattttgaaccgagtgtacctccttatccatttgagagcaagcaaatgagtagtgcagacgatattcaggtaattagtagaaacttaggaatctgtttgaaatgttaagtgaaataagagctttggaactttttgttgttaaactcgtttgtgttattttccccttgaacagctatgtccgatatgtctgagcaacccgaaaaacatggcgtttggttgtggccatcagacttgttgtgaatgcggaccagatcttaaagtgtgtcctatttgtcgtgcgccgatccagaccagaatcaagctttactaacaacaccattgacatgcagctttgaccagcccaaatcccatttcttccagagattttcagatctttctgtagaaaattaaagtgttcttttgttctttgattgaattcctaaactttatcttgttcataaaatttctttgattggattgtaagaattatgtatttgtctgttggctttctttgatttttcaagattcgattaaaccaaagttgattgcttaaacactttaattttgatttgttttgtcgacataagcaatgagaaataaatggatgaatagcccaatagaagcccattagcctgaaattgggctacaagcaaacataccaaataaatagtagggaagagcagaaataatcacaccactcatcagttatccattcctttctttttacataaattttgtcactttttctacaaacgattcttcgcttctgtgaaatttgataaagcgaaagtttttttcttatggattctcttcgattcaacctccaacaatctccatttcaattgaaacctagaattctccgaccaagaatcaccaacatatcaaaccgaatcgatgaaaccgatcctcgaccatcatcctcggccggtaggatccaaaggttagtacttaacaacgaaggtcggaccaaactaaacgccgatcctgaccgtgaattctattcatatccacggttcgtgaaccacgtagatgatagtttcatatcctccttaaccgaactatacagaaaccggttgagacccggttcgactgtacttgacttgatg

SEQ ID NO: 21504 - DNA, 3003 bp, Unknown
  misc_feature (1)..( 3003): 2750-1469P.txt file - cDNA_ID_1989367; gDNA_ID_1971974; Annot_ID_58714
gtttggatgcattttcaatattaatattatgatttcactgaatttcaggctcatcttttttcattagattccaaatcatttgtttattagtttgaattgtgtaaaacatttttcacgcttcatggctctaattctgagattttgtgtagctgaatcgtttgcaaaatgaaggatactacggtggggtaaggttgctaatggcgatatgtaaagtattccgtaactattgcaaagagaatgacattcaacttcaccaagccaacttctctctttcttatgataccaatatccctaggcaggtactgatcattttccttcccctttctctctatgtttttttcttttctctgccaccaacgcttatcttttcaactttgatgctccttccagacagggctttcgggttctagtgccatcgtatccgctgcccttaactgccttctcgacttctacaatgtcaggcatttgatcaaagtacaagtccgccctaacattgttctcagtgctgagaaagaacttggcattgttgctggtcttcaggacagggttgctcaggtctatggtggtcttgttcacatggtcagtgtctcccctcctatctcatacattgccgttggttccatcggttttatgactttttatcatcttcttcactttgcaggattttagcaaggagcacatggataaattggggcatgggatttacactcctatggatatcagtctcctccctcctctgcatctcatctatgctgagaatccgagcgactcagggaaggtacttacacttattcaatgattctggtttatgcatcaatcaagtgaaattcctcaaaaagcatttatgacactagaactcagatctttggggcataactcagtagaatttagaagtatctctctgttagatgtttcataatattagcattgccttctaatgcaggtacatagtatggttcggcaaagatggttagacggtgatgagtttataatctcatcaatgaaagaagtcggaagtctagcagaagaaggtcgaactgcattactcaacaaggaccattccaaacttgtggaactcatgaaccttaatttcgacattcggaggtaaatataattccagacaaaactcgaacctatacacaacttaagattaaactccaagctcacatgatgttgaaatagatgggaatacacacatataatagtgatgtctttttttcccgataggcggatgtttggggatgaatgcttaggagcaatgaacatagagatggtggaagtagcaaggagggttggtgcagcctcaaagttcactggaagtggaggagcagtggtggttttctgccctgaaggtccatctcaggtgaaacttctggaagaagaatgcaggaaagcgggatttacgcttcagccggtaaaaattgcgccttcatgtttgaatgattctgacattcagaccttatgaaagccttgatcaagtcttcttattcacacgatagagccattttccagagaaataaacatgtgagctttaattgggtggttgttctgtttctttttcttgcccatttttgttgtttgttccttggcttatactaatatgtttgttttgtttctttttccacattaaggtccaattttttatattatattaaaagaactaaagaacagatgatcaaaattgaagtagtaatgatatttatttgccatatttgtgctcttttttgttttgttgaaactgtatatacagaagttggcagatatagtgtggagaaaaaaaaagaaatatagaattcagagatcattatttggcagaaaatgaagagaaatcgtgccagacatgttcaatttctaatctatactattactagtaccctacttgatgaaatctgaacaaaacatgtgtgtgtttcagaatcacgaattcgaattgctactagtgttttttacaatcttaatggaaataaaatggttatttgatcgagtaataaatattaaaattttgaaatcggtctggacttggacttggacttggacatggtgggccaataataaacaaatccaactaatcttttccagatttcatgattgaaacgtaaagtgaaagattaaacaagagaaaaaaggttagatagctttctgaacaaaaggagagaatttggggatatagatagaatccgccatttaagatcccttccctttgacctgttgagtgttgacaacctgaaaagaaacaaaaaaagaagaagaccgcttcatcttctcaacaccacctctgtcttattgctctcttttcttcttcgtcgacttctctcacacatacaaaaggtttgggattttttttggtagaatctttttaagttatctatcgaaatcagtttgatctgttttgtttttccctcttctcttctgggttgttggtgaataaatctacttttcatcttaattaggacaaatctctctaattaaaacgcctcagattttgtcttcagttgttttgttttaaaccctaagttacttgtaagttaaatgaaatctacaattcttaatttcttgtttccaaaattgtgaaaaaatccaaacatatatagaatagacacgtaacggctcaaagtcggtaattggaggtaacgtgattgaatcttcttcatcaatcataaatcttctctcttaagaattaagacgccgcctcattacacctgttccataatcatcgtcaatatattcattctgcaaaactattcttcttcttctttcaaagtcgtaattgctctctctcacccctaggttcttaagtcatacccattttcaaggacaccttagaaagtttcgagttttctattaggtaattgcatgttgaatctgttacgttcttcttgtgattccccttttttctggcccaaagaggataagattctaaaaatctgaatctttgtatgcaggtgtattgatcttgaagccttaaagtttgtgtctttttgttaatttgaataaagtttgatg

SEQ ID NO: 21505 - DNA, 3003 bp, Unknown; identical to SEQ ID NO: 21504
  misc_feature (1)..( 3003): 2750-1469P.txt file - cDNA_ID_1989367; gDNA_ID_1971974; Annot_ID_177571

SEQ ID NO: 21506 - DNA, 3003 bp, Unknown
  misc_feature (1)..( 3003): 2750-1469P.txt file - cDNA_ID_1989373; gDNA_ID_1971974; Annot_ID_58705
gatgaacaaaaatatcaacatttttcgcataaataataaactaagagcttctatatacaaaattcaagacatttttggatttggtttgacttggactcgtttggctctgctgtacaaatatactccagctagtgcagtcgcggtacctgtttatttaacaagtgattatatattgcttcaataaaatgaacaagtgtaacaaatcctttactaatatatactactagtagttgtttacctatagagttaagaggtgagactggagttttgaagaaaagaatggatgatgtaataaccaccacacgcttcacgcagttccctacagagtgtgttactggagacaccatctccaatatcatatacgatacctacaacaacaaccccaatttttatgtgttgattagaagcctaacactaaccgactttacaaaattcagtacagtttttctgaaacggaggaactagacggaccaacctgttggtagctatgcaagcaaacaccagcaagtagagacatgatgcaaaactcttttaccgacaaaccctggcttgtctgtcaagcaaccacatacaaacacacattagttctttctcttttagatcatctagctatatcggtttatgcttttccacttactgctacttgtaaatgcgaaggagtaaccttgaacccatcgatgaggattgctaaaggaaccagtaagataaaggagataatggttattatagagaaaaggttgatgttgtccaaagcgtcctgtttcaatatacaaacattaatagatttcgattactagtttctttcttgagatcataaggataacttatattcaaactcttttacctttccaaccatgaattttttactgaggacattgcgtgattgattcgtcacattagaagccattgcactgcagaaaccaatcctggtttatcccaataccatgaattaatcaaatcaattaaaacttcatcaaaagtttatcaagaatactattttttttgttcttgttcttgttgttcataccaattgaaagaagcttctgtgaaagatgctaaagagactccagcgacaataggtaacaacgaacaaacaatccacagactcggccactggacattaatcaaaatttcaaagattatgtctgaaaatataactctcttgtataatctaaggttatagattaagtctgaaacagagcgtatctttgttttgcttacctcaccgagcaagagaacagaaagcaagacggtgaagaaaggctccattgctttgatagtgtgggtgaaagagacatttactcttcctaagctcacatttgttaacaagttccctaacgtgtgagctactgctagttgtacgatcaccgtaaactggagaggattacaattgaatgaatctctctgtttttagggtttgacggaatcaatatttgatttacctgagaaggagaaaatttggggcgtggatggagtttaaggagccacattatagcaatcatcaacgttccacaccctaattgaaatgctgttacagtcgctggatatggataaaccctaagtacctggatcgatgaatgaacaagtttcatacttgtatgaagactgataataggttcgagtactgcttcttgcattgaaatggactgtttaattaaatgaagcaaagaaggaacctgtttgttgaaaatgttgtagtagatattgagaaggtaccaaactccaaacatgcctcctagcttcaaccctttaaccaaacttccagattccaaatctcctccttccacattctccggaactgtagctgacttgagcttgaagccattaaatctaaggttcggtctccaaggataagagttagaagatgaaaaagctctgcttcttctgctcaacgctgattcaggagtagacttggcaaggaacaatggagatggaagtcttggatttggatttagaaatgtgagagcgaacataattttttcctcttatcagatgctccaagatgtgcataaatcctccggcatttgttggaatttctcacaagtaaccgactcttgctaactttttcttcttcctctattggtaagagttatgttacatgagtctacctcctcattttcatgtaagaagaaaaaagtttgttttgtttttggatatactgcaaacttgatattagtattatttagaagagttgtctttattatgtgacttttctctcgttctactatctgaatgtttttgagtatgataaaaataactcacatgccgatgccgacatttttttcaatataacattggctcgattttatttatctttcctcataagagccagtggtatttgccggtattgtttcttctcatgttctccattccatgtgtgttctgtaaataatgttatggaaatgatttgacatacttggtcactcatttctttacaaaggggccgtggttttcttcgtttataataatatcaaaaagttggtaacgctataaataattatttaaaataaagtttacgtacgaacatgacaaattactgaccacaacaccaattgatttttagtgtggaatttgaaaatgtcaggggagaattgtatggatgatatgaaaggggccgcgttgaaacatgtggatgttgtattgtatgctcctgagtccacccttttctttccgtgttatttcatactattacaaataaggttggtcccattgctttgatcacattattgattataccatttacttattatgtcagtgttggtacaggtcattgatcacaatttgggctttaaacggagaggatggaaactgaattctaaatacatttcggcccatttagggtccataaccttctacgccaatcagaaggtacgtcgacatgagcaacttggtcaattttatgacataaataaaataaaaataaaaaaataaaaatcgatctgaggggttttagaaagaaaagaagaaattcgggagtcggagaaattgtcgggtggatcgatg

SEQ ID NO: 21507 - DNA, 3000 bp, Unknown; identical to SEQ ID NO: 9043
  misc_feature (1)..( 3000): 2750-1469P.txt file - cDNA_ID_1989374; gDNA_ID_1971974; Annot_ID_58704

SEQ ID NO: 21508 - DNA, 3000 bp, Unknown; identical to SEQ ID NO: 9042
  misc_feature (1)..( 3000): 2750-1469P.txt file - cDNA_ID_1989375; gDNA_ID_1971974; Annot_ID_58703

SEQ ID NO: 21509 - DNA, 3000 bp, Unknown; identical to SEQ ID NO: 9042
  misc_feature (1)..( 3000): 2750-1469P.txt file - cDNA_ID_1989375; gDNA_ID_1971974; Annot_ID_177557

SEQ ID NO: 21510 - DNA, 3003 bp, Unknown
  misc_feature (1)..( 3003): 2750-1469P.txt file - cDNA_ID_1989376; gDNA_ID_1971974; Annot_ID_58701
agaccgttgggtgtgtgcgtacgtgtcactgacatactgacagttggacggtgaaaactttgttacctaaagaattaaagaggagcatcgacgtggcggcctttgagcccggcgcacgtgattcttcgcagcatcgcacgtgcatgggctcaagcaaagtgcttctaaaggcagcaaacataagagggaaaaaggcgtcaacgccgctgcttattacagattttgaaaaccacgacaaataatacagttaatttgagaaactgtttatttagtctacgtaaagttatgcgcaagtacataaaatccatattaaatttttagaactcctaaatactcctactaatctcgttgacatatatgatcattctacatataaaaatatccaagtggctcacataaagttcagtttttactatatatgagactaatttaaagagagtaatttggagtgtcatgttactataaattgtaaattgttcaaaagagggggtcttttagttcgtttatcaattgtttatatagaaaaaaaaaaaaaaaagaataaagaacgaattgcataggaatgcacatgatcaggggccgagttcccataagttgattctctctgtcttcgggactcatcaaacacaaagttacgatatttcctgtaaacccgtttccaactaattactgtattatgtaattttgtattgttttatacccggtacccacttgaggattttaatctgaattgtttaagaaattttaactgtaaatttcataaaattactactcattagttgtacttaaaaaaataataatttttatctttcggaggatatttatctactaaattcacatgatatataggtatatgttcatatgtgtagaatattgatgctttaagagagcttttgtagctgctctaactggattaaaatattcatgtcagaccattatacatattagtctgtatagtgtatgctcatgagaccagagagagagagagagaaatgattttcaaaagataaacatagaaaagagaagctctaattaatcgaagatataatataatgtgtatttatagatcagatcacatctttcttcttcttcttcttcttcttctttcttgatctttttggttgttacgagcttcttcttctctttctcttctcaagctcattagaacatcaatttaaaacagaaacttttactatagaccacgataacaaatctgggtttttgttgttgttctctccatgcagagaagagtttcaaaaaggaatacaggatctgtggcttttgagtaggttaattaattagtcgacaagaaaacaaaggtatgtaaccatttgatcattctccattgcttgttgtctcgcttagatccttatcatatttaaatgctaaaatggatgattttttttgagacttttttatatatatatatatatttataactaaactttgatagataatctagtttagttagtagttgcacaaaatacattttgaattctccgttaaataggcgtttcaatttataagaataagatttatgataattttcgggttcaaacttacatattacacgttttgttatatgttacacctagttaaacatatagtgtttcatctagctatgcataagagtgtctcaccataaatcaaatgggcagtttgtgtttttttttctttatatagactacacagaatatatagtgtgcactatcttacgtttgtccggtgtgtcaatgttgatttttgcatcaagttctccttcgacaaaacaaaatgacgatatatatctatctatatatatatatacaaactgtattggcttcgtactatatacatacgtcagtcttattaattctacaacgcagatcaaaatttgaattttgactaggctttaatgtgtacgattaccttatacaagtgaaaaagggtcaatcgtacgtttacccttaaatttctttttgttagtaacatatcgaaaaataaaccgttttatatatattttcaaaatacttattcttcttgttaatgctgtcacatattataaatcattacaatgttttgacaaataaaagaaaaatcattattacaaatctaatcgttttaaaatcctagggaatcctactagattattattactattgtagaccttgtttcttttgtcacattaattaataacaataaaataatatatatttttaaaaatatttttgttttgttttgcattgtatattatttagctgtagatttgtaatgggccacgtaattgggccatgctaagacccggcaaacccatgtgagatatatgatctcccgcactatagtccacgttatctcactgatatctcattattttaacaataagaccgtctcttaattttattacaagttttcttttactcttgtagccttaaattttaggctgaaaattaaagttttgaaaaaagctatagggagggactatgtaaaataaaaaaatgtacgttaccatcagattttaccataaagagccaaaaataaaatatgcaaaactccactaaaaataatattaattcccctagccaacaaaaaagattcagattcatatcccacgcgctcgttcaaatcctctcattcgccacctgatcaaaccaatctcaatttgaaaattgaaatagacaaaatcgtgacattgggacataaaaaagcactaggacaaaattctagtcgacgcaaaaaaaattcgaaaaacgtgagtcagcgtatgtggtttacacgcgccaaagtgggagcgtgagtggggtttgaatgcacctgaaactgtctggtcaataagttaaagtgcatgggaaaaatcttggttgctgtttcctatatatctctctttttaccatcaacatgttacatatatatatggacaaaaatctgtatatgtgaatgcatataggagtgtgatgtatttatataagttagtaagctttgttctctttctctatttttttggcaggtatataaaattttaaaatg

SEQ ID NO: 21511 - DNA, 3000 bp, Unknown; identical to SEQ ID NO: 9039
  misc_feature (1)..( 3000): 2750-1469P.txt file - cDNA_ID_1989377; gDNA_ID_1971974; Annot_ID_58700

SEQ ID NO: 21512 - DNA, 3000 bp, Unknown; identical to SEQ ID NO: 9035
  misc_feature (1)..( 3000): 2750-1469P.txt file - cDNA_ID_1989378; gDNA_ID_1971974; Annot_ID_58696

SEQ ID NO: 21513 - DNA, 3000 bp, Unknown; identical to SEQ ID NO: 9035
  misc_feature (1)..( 3000): 2750-1469P.txt file - cDNA_ID_1989378; gDNA_ID_1971974; Annot_ID_177546

SEQ ID NO: 21514 - DNA, 3003 bp, Unknown
  misc_feature (1)..( 3003): 2750-1469P.txt file - cDNA_ID_1989380; gDNA_ID_1971984; Annot_ID_58754
atcacaagtgaaaatttacagctactcctgagttttaataagcttcatatgttgattcgctatgttttttcatttacattttattgttgaaaatagcacaatcaattacaaaaactaacagttagtttacaatcatctgtgcatggtttcagttctgtcagaagggaatcaaggttaccgtcgtttgtcctggtccaatagaaacctggaatggtacaggaacatcaacttcggaagacagcaagtctcctgaggttggtacttattatgattgtgattatttgattaagttgtgagcagcaagtacttctcccattgcttgattcattatttccttgtagatacacgtagaatcatattctttgtcaacatttggagattctaacttcagctccttgctcaacttgatttctctcaagcatctattctctttgctacgcagaaacgtgtgtcatctgaacgatgtgcagagctgactataatcgctgcatctcataacttgaaggaagcttggatttcatatcaggtacatctttataaatattgcatatgtgatactcggtttagatgtctgatatataagtttctttttcactgtttttcagccagtactactcgtgatgtatctagtgcagtacatgccttcccttggcttctggctcatggacaaggtactttgctcatccattaattttcttcaaaagttaccggtatgagatgtcgttttgtttccattataatgtgacaaacacatctgacaaagagaaaacaggggcagttattactctgttgaaagcagtcttttgattaaaatgaacggcttgcaggttggaggaaagcgtgtggaggtcgcggaaaagaaaggcaacacatactcgtgggatttactgttcgggaagaagactaaaacaaactgaagctgattctctagaagatacacatagatgtggttggttgagccttagtccgtaaatgtggttggtgtttgtttgctagtttgattgttaaataactaccaaagcgtcgaaaaatgttttgttgccttgtgaggtgctcaataagtaagaaaagatgtgatcttctgtgatttagctactcgtacacacaaacaaacacaaatttaacatcatccgagtgtagagaaatcaaaacccttcaaattgagtagtttctctgcgcacaaaggttttcagatgcagctacgaggtaaccccagctgtgtattcatccaacaggcttttgatcccactggacttcagttcctacaaaagaagaaccgaaaagaaagctatatgatgcatacattgaagactaacgaaagcttctggagtttgacttgctgccagaaactcacagacaatactcctgccaaagctgcagaaggctgattagctggttttgcaacacgaatagctacaacaccgttcattctttccttctcttcagaataaaagtttcggtaaacttgaacacctgcagatagaacatcatttcaggttagaacaaagtccacatagcaaaagagacgctttccaaacgttctatgttatggtaaagatcttcaaaccttcttctatactttcaactccaggaagaactttggcaagaccctccactttcagcatttctgagaatgaagtataacggtgaacgtcctgccctcatcaaaatggttagtaacaagaggtatagtgtttgcctcacaaggaagaattgacagagatacaagattgatgactacctgaacttcaagcagcaagcatttattgaacaaaagaaaatctcctgaactaattctgtgagtaaaccaattttgaagtcaataagacaatctaaagctattggaatcagcaaaacagaaaacccggaaaagcaagcacaagagatgaatgtgaattaacatttgcacaaagataaaaacatcagacctcatgtagtctcccactgcgcatcttccttcaacagttttcaaaccatctgacaaattgagaggcacccggaaataaaagtgagattgagcaaatataattgtaatactacaatcaagtaaccagaaaatgtacctttcaattgggtgaagtaaggctcttggacatgaagctcaaagttcacctccttcaacatctgaaacaaagaaccttttctgtgtaaaaattccaaaaactaacttttcccactctgttttgatgcaataatagttgagaactaaagttttcatatagacttacatttattaagtcatatcccaagccatgaatcagtttgctgtatttttccaagttagaatttttatcaccctcggaagctagacattcagacaaagccgttgctagaagcttgtacaccgcagatttttctgttaattgaaacatttatgagaaaatttcagttatttctctccagcattcaagtttcataatttgcttcctaattagcaaaacgtacctgttgaatctgtagcttccccaaggagatgaagacaaaaatctctggtcaggtcaagatcgaaacttggaacagattcgtttaaatgagatctcagactaaaacggagaagtgattccatgcattctcggagatccaccgacttcgttcccggcgacattggttgctccattttcgtcaaaaacgccaacgttaagcctcttaattaagaaatattcgtgtaaaacaccctcaagtttgtagatattacaagatgttctaacccaatctgaaattggacagtaacaccttgatgtcgttttaaaacggaagatcagagatcagacgttgtcgtttgaagacggaagatcagagcgataagtcaggtatctagaaggtgacacgtgaggagcacgtgaagcttgcgtgtagacagtcacagtcacagatggcatattctcagaaatcctcattgttgactaatgtacctctgataagtcccacttaccattttctcctgaactctgtagaaagatccgaattgaatatttcggacccgaaacctgacccgctttgatg

SEQ ID NO: 21515 - DNA, 3003 bp, Unknown
  misc_feature (1)..( 3003): 2750-1469P.txt file - cDNA_ID_1989381; gDNA_ID_1971984; Annot_ID_58752
gcgatcactgtagcatcacaaaagttccaattagcatagccaaatgctaaacatttgacgatagcatattaaaacagtataacgttaaaaactccattagttaatctctactagtaagatccttcaagcacaataaaatcaagaaaagaacgcacatttattatagctgcaaaagtaatcctgcccaaaaagcctgctggtgaaaggaggaggtacaatagccggagtcaaaagactatttctaccttttttctctttcaatccaaaagggaaacaataatgcagaaagtttgagcaaggaacttaacctgtcatagacgctcaagaatgctccacatatgtcacatagacgcaacttttggtctgtctgagaagatataggaacaataagtgaggttagaagatgaaaccaatgtgtagatacattaaacaggggatgcgaagatgttatacttttggtccaaatagtaacttttatgaaagcaatcaaacgggtttactcaaataaactattactctttacctaaacgttaatatatgactgttgtcattcctatattcaacggtactttccaaaacaaactgataaatatagaaggaatgtgaatctttaaggcatcattgggaggagtgatggtaacttacgatgcgcacatcaacagcggtgtacttcgttgaatctgctggaggttctcgtctaactgtaagctgaaacaaatttaggcccaacaattattagtgactaataaaagtagggggaaaagaaaaagaaataagaaagagaacacaccttcttaagagcttcagcctcttccagggctttctgggcttcatcaaccattccttgttcacctaaaatatcaaataaccatacaatctatataaaacttcgtgaagtccagtgtttccttaacatagatatagtaacatacaacgggaagaaatttccttatcttaggtatatacagtttaagcaatttataggttaggaaatcttagattagccagtagaaattcccagccggcagggaatactagaccgtggatatttaagcagtttcaactttccactacaatgagctctaaattaagatgaccatagacaaataaccaaacacaaattagggttatttcccttaccaagatcttctgccttcttcagtttctcatttatcatttcttgagtgcgaggatccggtggaggtaattcggaagatggtggttgagctggaacgggctgtggcaaggatgctctatctttgttgaaggcttccaacagcaacaccgcctacatgaaaaaacaagacaaaggactttctagttgacataggtaaagtaaaaaagcaaaaatgctcattaagccaatagcgaaagcaaattcacctgttggtcagctctcttggtcctcatctcttcgactaactcaagagctctaatcttaagatccattttgccttcaagatctgcaaagtgacatcagaactttgaaagactaccaataaccagtcaagaattatttgcaaaaacaaagccgaaacagcaaagtaatatttgctgggcaatattcttttaatttttaccgtggatatctgcttccttcatcttctctttgattttctccgataactcgagaatttcaggcgactgcagttaaacaatgtaatgatgataaacaaacctgagtgttgcaaacttagaagacacataaaccaaatttcaaaatcaaataatcacctgagtgacttcagagacagaaatggcaatggcagctttggcgtcctcttcttgaagacgcttaagggccctaccaatcttcctatcacactcaacgataagcctgtctatggcatcttccaattccctgtcgtagttatcaacaccttttgcccttgcttctcggtatctaagggcgagttaaagcaacacaggagtggaaagagaacaacatgccactgtagaatcaaactaaacataacaatgacaccaacttttttttgtaactaatctgcataggctagtcttatatgcactatccattcatttaacgtattatctcaagcaaaaaccaggaagaagagcaaaaacatgagcaaaaaacagatatcaacccaattagtaagtatgttcaaatgtcaaattcaattgaaagaggccatggaagtaggcggccttcatggtaaccgtataaggtaaatactaaacttactgtaaacaaaggatactctttccgaagctgcaaagagtgcacctttgggcatggtcccatatccattttctgataacaacagaaatgtaaaaggagcatcagttattaggcaaaccaaagtagccatgcactaaattactagacagatactcatagaaaacagtgaagcgatacaagtttcagaattcagatatactctataagatacaaaactgcacactgtatcaagtaaccaaataccagttatcaattcgagctaaagcagaaacacaaaagattagctcaaaagtgaaattagggtttttttattcaaagagacaactaagtaataaactgaaaaaatataaaggtaagcaccgtcaattggaagagatcgtgagggcagagaccagacaagtaaagacgacacacatcacggtcgtagtatttgcgattcacctcctgaacgtcgccgtttcggttagctcccatgagcacatcaagctgcttccttatagcgtccatagtcgttctctctctctctctctctctctctctctctctctctctctctctctctctctctttcctcgtcctctctgcaaacagagatttggggttttttgatcgaaagacaacacaatgataggaacaatggcattcggatgtaataagattttggtatataagattaattgcatacaggtccctatatattaataatttatgttctactcctacatttatttctgtcaacatattttgcccacgggtaagaagacttggtctctcgctggttgcttcaatccgagaaaatg

SEQ ID NO: 21516 - DNA, 3000 bp, Unknown; identical to SEQ ID NO: 9107
  misc_feature (1)..( 3000): 2750-1469P.txt file - cDNA_ID_1989382; gDNA_ID_1971984; Annot_ID_58751

SEQ ID NO: 21517 - DNA, 3000 bp, Unknown; identical to SEQ ID NO: 9097
  misc_feature (1)..( 3000): 2750-1469P.txt file - cDNA_ID_1989384; gDNA_ID_1971984; Annot_ID_58749

SEQ ID NO: 21518 - DNA, 3000 bp, Unknown; identical to SEQ ID NO: 9099
  misc_feature (1)..( 3000): 2750-1469P.txt file - cDNA_ID_1989389; gDNA_ID_1971984; Annot_ID_58743

SEQ ID NO: 21519 - DNA, 3000 bp, Unknown; identical to SEQ ID NO: 9099
  misc_feature (1)..( 3000): 2750-1469P.txt file - cDNA_ID_1989389; gDNA_ID_1971984; Annot_ID_177688

SEQ ID NO: 21520 - DNA, 3000 bp, Unknown; identical to SEQ ID NO: 9094
  misc_feature (1)..( 3000): 2750-1469P.txt file - cDNA_ID_1989391; gDNA_ID_1971984; Annot_ID_58741

SEQ ID NO: 21521 - DNA, 3003 bp, Unknown
  misc_feature (1)..( 3003): 2750-1469P.txt file - cDNA_ID_1989396; gDNA_ID_1971984; Annot_ID_58733
agtttaaccggctcggtgttagggttccgactttcttcatctctccttggattgagcctggcacaggtgaacataattactagtcataggcattaatcaaatttagtggtcttatattttctaatcaagatattaatgtttaaatcaaagtaaatgacaattttggtaaaatgtgtagttattcatgggccaaatgggccgtacccaaggtcacaatatgagcattcgtcaattcccgcaacggtcaagacaattttcaaactcaaagatttcttgtcaaagagagattcatgggctggcacttttgaatctgttattacgagagactcaccaagacaagattgccctggtaattacatttttttctttcatcttctctatcaatttaggtaggataatatcgactaaaacttcagttttttttctttaaatagaaacattatcaactccgattaaactaagagggacaatggcaaaagaaaatgcacaattaagcgaatttcaagaagatctcgttataatggctgcgggattaaaaggagactacaaaaacgaagaattaatccacaagctatgtaaagaaacttgcgttgcagatgcatccaaatacgttacaaatgcgtttgagaagtttctggaagagtcaagaaaggcaagagatagaggatgtgatgagaacgacatcgtttattgcgttgatgatgatgatgatcatgttgtgataccaccacaatcacattcagaagcatcaaatgctgctgctcaaccaaaaacgcaaacgtcttttttcaataagttattctcttgctttattcgccatgattgaaagagactaagagaataaatgttataataataatttgtagtcacttctcttgtgtgtgggtggaatttatttaagacaaaaaaaaagaaaaccttactagtctcttgcatatttaatttcgttgtataagaacttccacaattatttgcacatttgatattcttgtataaaaattatatgttagatgagatctactctaactagttatttgtttttcattttttcttgtcaacagctatattaaattgactaaaatgaactaataatgagagatattatttacatatgtaattatatgcgattagattcaaatttttcataccatgactgaaataaacatttaaagatttcgtgtgttcctttccactatcgttcttaccccgactcatcatgtacaattattgaatttgaattttcaagcataactcccataagacttttgatcaattctaagtctctgattcattgtagcatcacaaccctgtcacgattcaggttgagaagaaagtgcagttgtcacccctcctagagtccatattacgttaagaaacttgtgttgcagatgcttcctattacattacaaatgcgtttgagaagtttctagaggagtctagaaagcaagtgaaagaggatatgataaggacgacatcgttttttgcgtgtatgatgatgatgatgatcatgtcatactagcacaatcacattcgaacaacttgtagtaatttgtctgtgtatgtggaaattatttttgtcgtagaagaacttacacgattatttgtatatttaatcgtctttttttgttgttgttgtaaaagttgtatatttaatcttcttgtgtataaaagcaattatatcttagatgagatctactttaattattcgattggtgagtagattataccaaaagactaaaaactaattaaagtcactaaaggcaaccaatctagctactgggtcccaaattttaattgtaatgattataagaaatactgtactaactaacaccgtatgtatgcaacattctgtcataataccacatattattagttacgctatttaaacattagttagtacacagtaatcaacgaatgtatggttagttttttccctgaggaaaaactctatttaaaacgactcatgcggagacgtgctatagactatggttttagcaataataattggtcaacacctaattcaatctactccattgttattttcatagatagagagattaataagtaataatattcaatgtatatcgccaataaccttattaattttcttataataatggactaatggtagaaccgtagaaatagttatgagaagcacttgtatctatataaactttcattttggagaacgtttttcatatgcactaaataaaagatgagtaatttcttctgccacctcaccgaacgtgagagtaaacaaatgtgacgatatccaaaattcaccgtctatgttttatttatatgcaaagatcactgagttgattcgaatgtatatgattgatagtatatagaaaaatagttttttaatcttgaggcagagtttttaaggtgacaacaaaaaatgaaacaaggtgtattcaatcaaatatttaagtgtttttgtgttaaaataatagatctaatgttattaattatagatttttaaaagttttatgaaatctaatgttattaaatttgtgattttaaaatctacattaatttttttttattaaaaatattttaaaaattagatttaataattttaagagacttaaatgaattttagtgaatttccttaattaaaaaatacagaattttaagtctcatgattttaggtaaattttgagaaaattttataataaatcataacaacttccttaaattcacccaaattcttcaaaattatataaaaatttaaaataacttaaatcattcaaaatagaagattgaatacactcccgggcccaagagttttgcaaacaatcatatacatgtaaaagtttaagactataccatttatgtgatttactaatcatataaaataaattaaatacacatcgtttagttaccagtatataataaggctaccatttagacggacacagctaattatgagagatagacagagagggaaaacaactacacaagtcaaaatttctgttctaaaaaagtaaaagaagtatg

SEQ ID NO: 21522 - DNA, 3003 bp, Unknown; identical to SEQ ID NO: 21521
  misc_feature (1)..( 3003): 2750-1469P.txt file - cDNA_ID_1989396; gDNA_ID_1972049; Annot_ID_178344

SEQ ID NO: 21523 - DNA, 3003 bp, Unknown; identical to SEQ ID NO: 21521
  misc_feature (1)..( 3003): 2750-1469P.txt file - cDNA_ID_1989396; gDNA_ID_1971984; Annot_ID_177679

SEQ ID NO: 21524 - DNA, 3000 bp, Unknown; identical to SEQ ID NO: 9088
  misc_feature (1)..( 3000): 2750-1469P.txt file - cDNA_ID_1989400; gDNA_ID_1971984; Annot_ID_58728

SEQ ID NO: 21525 - DNA, 3003 bp, Unknown
  misc_feature (1)..( 3003): 2750-1469P.txt file - cDNA_ID_1989401; gDNA_ID_1971785; Annot_ID_57996
tattagtttctgttaatgttatcaatgtttttataatttcacttactagaggttttgatgcttaatttataaaagtgtgcaaattaaaattttagtggaatcctttaaacaaatcgaaaatattaataattcattatatccaattgttgtatgttatttacttttgtcattctttgatagtataagaatttatgacttttctggtattttagaagaaaaaataatcacatgattttttttaatcacatgtttggtgctacgtataatttatatgaattatttaccgtcacataaattatagtaaagttttgttttgtaatctattttagaaagacaaaaacttcataattattaagatctctcttatgtatttttaggtctacaaatctttgtaatgtaaaacaacatttaataattaaaaaaaaaaaacatttaagtaggaattagtaatgaaataaattattatgtaacagtcgtgatgattctatcccaaaaaagaattaaaaaaaaatggtagtgatcaatatctggaatagagatttgtcttattttaatggagaaagaggcgaggcagagactggtgaggccattcctcgagaactacacttatgctttcccccataaatccatttcttgtctatctctctacttttcttcttttcatttatttaatagttaatacggctttgctttttagttgaaaacagtaaaaaccgaaataaaatgtgtttcgtcggccgatggagattgagaaagttagttaaaccaatgatgccgacacaaaacaaaaagttaatccgatgatactattttcactactgtatcaatcgattcgtcggctacgtggtatgttacgaatcttaagagttattttaatcccacaatgttgaatgatatgcaaactattgttaaaatgtcacttaattgttatattaacctgaccgaatagctataaccaagtcttcgtcaaggctgcgtggccggttttgggaacgtatgaaaattctttaattcttatattattaaattaaagaatttatttcttgttgctatttatttatttagtgttgtaaatagtgttgcatcaactatgtaaatgatgctatatcatcacattaaacttgtgtcatctttagtgtttcataagagagttttgagtgtaaactcacatcaaaattgtgttttagtgtcccatctgcttttgagcctaaaaatagaggttttgattggctaagtcctattccatttttatcctaattaaacataaaaacaataccaaagcaatataagaaaaaatcattttcacttttttatactgtcatcttgcactgctacagtttaacgttttaattatttatgtattgtttactgtaccgttaaagacttataccgctttgagttaccaatatgatttgcattttggttgaatactagaaaatgatattttctatgtatgaaaatgatattttctgtgtacgaaaatgatattttagtttgttcttatcattaacatttatttgtctgttataatatttatatttagagttcaatgttcagacttcagagtataatgccaaaaagaagccaggtgaggaatgcatctgaaatacaaatttggatctcgtgaatcattcacatcaatacagcgattaatttgtgatataatttacgattatattatttgtatagtgaaacaaaataatgtgatggtagtacttgtagacaatgtgcaactccggaatcgagatgttacatgcatgtatgaatatcgatcttggaaccttcttcatttttaataatttttcatgccctaccttaattacgcttgtcgggagtccaaaatccaaactccaaactaagattttgcatctcgttgtatcttgttaaattcagttttattgtcacggacacggagtatatattttatgcatggacaaacattttcttgaatacttcaaaagatgttacttgttagtaaaaatatggtaagggctaaataaacgtagaaattgagcatagagaggaaattagtttgggaagcgagaatcacgcttcaatttagagaccgaaatgtatggagccacgttttggaacatatcacctcctttgattttctttgtttttattaattcaatcttttttatttttgacattaacaataaacaatctattggtcatcgcattaattctcaaacaacgtaatataaagatatctggtccatgtgagcataatttttcaagatattgttataaagactagttttcaatatttattttgatgccccaaaaaaactacttgtatccaagaacaatacttaattagttaatagtttaatgatgatggcaaaatatatacacaatacacttgcctattagtgtttgcaaatattgatgataaaagaaattagtgtttgtcatgtttcatataagatagatgatagatcactacaatactcatacacacataattcttaatcacacatatacctgttgtttatgtaattattaaaaagaagagaatttactctattccactacttttcttcaaaggtttttcatttctatcacttttgtttattatttttgaatctatcatatttgtatgatagaaataagacgatttcattattctcattttcataatataatattatatattgaatgtatagttgttaaaaaaaagattatctattgagaaagagaaaaaaaagatgttacaacagtattaataaaaatgatatatgtaaacaaaaagaggataatgtgatagatccaaaagatttagggaacaaaatagtaaaaacaaaaagaaatttgtaatttgtagtagttttgttaattttccttaaaccgcaaaatcatattctactatttatatcctcgtttagtgttcacaaaacttatcaagaaccataagctaaagagggttcggttctttaaacccctccatctctctctccttcattacactgtagagtgttaaagtaccactctatagccatg

SEQ ID NO: 21526 - DNA, 3003 bp, Unknown; identical to SEQ ID NO: 21525
  misc_feature (1)..( 3003): 2750-1469P.txt file - cDNA_ID_1989401; gDNA_ID_1971785; Annot_ID_175459

SEQ ID NO: 21527 - DNA, 3000 bp, Unknown; identical to SEQ ID NO: 8366
  misc_feature (1)..( 3000): 2750-1469P.txt file - cDNA_ID_1989410; gDNA_ID_1971785; Annot_ID_57981

SEQ ID NO: 21528 - DNA, 3000 bp, Unknown; identical to SEQ ID NO: 15026
  misc_feature (1)..( 3000): 2750-1469P.txt file - cDNA_ID_1989410; gDNA_ID_2684254; Annot_ID_193084

SEQ ID NO: 21529 - DNA, 3000 bp, Unknown; identical to SEQ ID NO: 15026
  misc_feature (1)..( 3000): 2750-1469P.txt file - cDNA_ID_1989410; gDNA_ID_2684254; Annot_ID_138084

SEQ ID NO: 21530 - DNA, 3000 bp, Unknown; identical to SEQ ID NO: 8366
  misc_feature (1)..( 3000): 2750-1469P.txt file - cDNA_ID_1989410; gDNA_ID_1971785; Annot_ID_175433

SEQ ID NO: 21531 - DNA, 1123 bp, Unknown; identical to SEQ ID NO: 8363
  misc_feature (1)..( 1123): 2750-1469P.txt file - cDNA_ID_1989414; gDNA_ID_1971785; Annot_ID_57977

SEQ ID NO: 21532 - DNA, 877 bp, Unknown
  misc_feature (1)..( 877): 2750-1469P.txt file - cDNA_ID_1989415; gDNA_ID_1971786; Annot_ID_58018
ttcagaaaactcattactaaattctgatactacattttcattgagatgatgtttttgctacagatcataggaatttgcaatacatgttgctatgcgatgcgacggcgcctagagaaatctagagatctcctctgtttcagtgctttggctgcctgggggaatttgaatgtgattcactgaagctgtattttaagtatttgactcatattagacttgttccaagtaaaatagcaacaaggcaacaatggtcatctagttatttaaaaagtggttgacgatcattaagacattttcaaaattctcatctaaaatggtaaacaaccatgaaagattcgactcccaatagagagtttcaagttctctctttctctttctctcctttcctagttttttcttgtagcaaaaggtaaaccttatgcttcttcttcctctgttgcgagtttcccttttggtactttgcttaaatatcaaacaaccttttcaaaaaggatcttcctttcgagggttagaaaggagttgattgtttctaacttttcatgtttgaaatccgtatccctatgttatatctcgttgacttatgaaaattctaggtttagggaacataatgtctcagttgttcgtgtttgacaatttaattgcttgagtaataaagagagataagatcattgatcttaccattttactctcttctctttgtcttagataggcaaatcttgttttcaaaactgtttgttgtctatattatcttacactttcataagtaggagatagaagcttaaggtgctatcaaaccctttttttataccttttgtcacattttgtcttctgtactattacagttaagttagctcgtgtgagaaaagggtgtaatataatg

SEQ ID NO: 21533 - DNA, 3000 bp, Unknown
  misc_feature (1)..( 3000): 2750-1469P.txt file - cDNA_ID_1989416; gDNA_ID_1971786; Annot_ID_58017
aagcagccagatcaagaatttctttcccaggtagatactaaaattaaagtacatcatttcagtttttactaaccttagcttagaccgtatatatggatcatttgtttaaatggtccagcatcaaaaccactcctttggaaaatgttctgttttatgatatagaaaactttaacaggtatcaatggtttcaagactgcaccacgaaaatgttgtagcacttatggcctattgtgttgatggccctctccgtgttcttgcttatgaatttgccacttatggaactcttcatgatgttcttcacggtgagtgtggttaacgtaaaccattgctcggataccggatcactcactcaataaaaactaacatacaagagggaaaaaactatgcaatgtggtgtttctttggtgcaggtcaaacaggtgtcataggagcactacaaggtcctgttatgacgtggcaacgaagagtcaaaatagctcttggtgcagccagaggacttgagtacttgcataagaaggtgaaccctcaggttatccaccgagatatcaaagctagcaacatacttctgtttgatgatgatattgccaaaattggtgattttgatttgtatgatcaagcccctaacatggctggtcgccttcactcatgtcgtatggcactaggagcatctcgttctcactgtccagagtaattccttttaaatatgttctctatcttgaacagtttgtttgattcagattaatctagaggctatatatagacgtcttctttgaacattttgagttatttatttcagacatgcaatgacaggaatattgaccacaaagagcgatgtctacagttttggcgttgttctgttggagctccttacgggtcgtaaaccagtagatcgtaccttaccgcgtggacaacaaaatttagtgacatgggtattgttaagcgtaatcttctttgtttctgataatggtttgcttgcaatgacaagagaagcttttaagatcagtctgtaaaaataagtaaaaaaaacttcaagaaatcttggagtaaattaaaacccttcttaggcatatagaaatgtaacttaggacgttaaagttaacaagaaagtagctggaatttgtgcaaatggataaaacttttatcataaaagtgaaatattgctgctcaatgataaacatgttgtgtgttgtctcaggcaacccctaaactaagcaaagacaaagtgaagcaatgcgttgatgcaagactacttggagagtaccctcccaaagctgttgccaaggtattaatcgcataacattgttttcctcacattgtttcattgcagcaaaaatgatttaacttagaagactagtttatctgctggcattagaatcaaagtagcgatatttgttgtccgcattcatctctctgacaactgaaacatttcatgagcctgatttcatttgctatatgcatatggtctgatacaatgatcagctagctgcggtgtctgcacgctgtgtgcattatgatccagattttagaccagacatgagcattgtggtgaaggcacttcaacctcttttaaactcttctcttcctctcctcagactccacattggaatccttattgaccaaatattcaatcccccatatctcatctacgactacttcatgatgattatcaaagtgtattattcactttgaagtatatttatgtaattttttgggaccttatctcattaaatcttcattttaagacccacttttcgacatttgtgtatgtctatattttatcattattatgttttatgtattttgtgatgtagtttgcaatacacatcaaaataaataagcaccaaattttgtttgttcaaggtaaagtcatgagttaaaaaaaaaaaaaactcgtttctaaattctgatactacattttaattcagagattataataggaatttgcaatacacatcaagatatataaaaattaacagaatttactcactgttgttagtgagattataataggaatttgcaatacacatcaaactaaataaaaagtaacagaatttactccaaattgaaacagaatttactgtgcgagacaacaaaaaatttattataacagaatctaatccaaattgaaacatcaataaaatgattttttttttttttcaattttttgtttgatactttttaaaaataacatttaagtcctcgtcaatgcacgcatcaaatttgtattatacggtattatctaataatatttcgtattaaatacgtatataattttgattttgaaaagttgagatatatagttttggaacataatgggcccattaattctaattatttcataactaatttaaaaatatgctgaagtaagtcccccgtcaaggacataaaaccataaccgttagatcaaagatttacgtcctgcaaattcatctccaccgtcgttagtttcaccaatttcattatttctcttatttaatattcttttcttaataataaatctctctcttcttccgatatgcagagagcattatatgcacacagtagcaaagctctctccaagtttctgactcacttcacctgcttcatcgattcgccattgaagctcttacgcatttatcatcggcaaaacttcttggagttatcggaaaagtttcttcatcaacggtggttgaagtatctgatccctctcgctatgttaaactagattcgaacgtttgttcccaaagccgagattcgcatttcggcttctcatttcgaggtaatggtttctctggatctgatttgtgatctatcgatttctcctttagtgattttaggatttttgggggtttttgtgtgtgtaaacttaaatctgaagtttccgattgattttgttttggatttcagatttcgtttatggaatctctggatcttatgttgtgtgtgggattatacttccctatattgtaactatcgaaagaaaactgcatctacggtgattgcggagaggagaaaaaaatg

SEQ ID NO: 21534 - DNA, 3003 bp, Unknown
  misc_feature (1)..( 3003): 2750-1469P.txt file - cDNA_ID_1989418; gDNA_ID_1971786; Annot_ID_58014
tttgggataatctcttttagggttttggagcaatagaagtcatatgttattatgttgtcagattttgtttcttcttattgtgtgggcctcatttttttattttatttttgggtctcacgtttttttattttatttgtttttattttatttttacaaaataaaattaattttaaatgctaaaaatatcagaaaaaatcagaccaagggtttttggttactatacacaaaatttgtgtcaatctagttctctaatcaaatagagagttattctagttgttattaactacatttgtgtcaatttaggtaattttctgttaaataaatggtagaatttctgtcattcaccgtaatctaacaagttttctgtaaacttttatattttagtaattaaaaattataagaaaaattaaagaaaagttatactcaaagatgcgatcgtatatattaattactaaaattgcagtggttagtcaaataaactaaaaattacaacggtttataaaacaaaaccaaatgatttgtcaaataagccaaatattggaacggttcagttaaacagttgtaattttattgaaatatatattagtaactaaaaattataatttataaaattttcgccaagagacgtgactatagataattaaatgttataaagttttatagaataaaccaaagttacaatagtttgtccagtaaagtaaatattgcaataattcaactaaatggttataatagttcgtttatgaaaagttacgataaaaagttgcagccatagaaaaaatttattttggattgcaattttctaaaaaaactcaattgtaatatatttttgtagtttatatatattttcatcgaaagacggtgatataaagacacaatacacaatacaaatatatttattgagattgttatattatatagattttctttctatttagatttgagtgatatatcttacatctagaaaatggccaaaatcaacctcaactctatctatagagtctttttagaaccctaactcttatttcttttattcacacaattttaattacaaacctcaattatgtaactgttagccaacctcccttcaccgcctcgtgacttccttggattctcgatctgatatttacaatgatccctctgatagccctttcgtcgtgtcaatttcaacgtctttgctttgaattagctgaagatatatattgttttttgccctaaggctttaatttgtttattgttaggtcggggcggtcgatgaagcaaacaattatggaaaaatgtagatgttagatctctcgaatcctaacagagagaatctgctaacaagaaaggcaaaatatctcttatatatagacagatgctacaccaagagcttgaagtcaatatgatcgaactgatgaaactaaggaagcagaataaacaagcattaaagatatgtcaaagaagtggaaattgtgtcatgtttctcataaattattggggttgaatccccactccttcaccttaattatcacttcttaagtttcttaaacgtagatgtacagtactccctccgttttatttcgaatgtcgttttaattttcaaattttattttaaaataagtcgttttgtatttttaatgtagatatttggtaagattttcagttttatccttactatttcaatgtattgtccaatgaaaaaaatagtatgatatatatattaatcaaaagtaaagcaataatttaattgttttcttaatatgcttgaagaaatcttaaactacatttataatgaaagggaggagtagctactttctagtttcatactatttaagtatcaacaataatggatgtgatcccccaaaaaagtatcatcaataatagaacgaatgatagagggaaaattgcattataaaagtcttgttttcttattgatttgggattctattattttactatcaaaagcattgtatttttcatttttttaatcgagagtgaaacatgcatccatcttggagtgtttttaatgggactctggctctgtcgtttatcacttccaaacttaaaaacaaaaataaagaattaacacaaaaatccttttctatgggtagttacaactatctttcatcttttatgtttgtttcgacaaaattcctttgtttcataaaaagtgttgttttggtatttcttttttcacacatttttttatgaaacacagggacaaaactgaaatttagtataaaatctgtatcaaaaaaacctaaacgacatttttgtcaattgaaaaatacaatgcatttaatatacaaacctttatatagattttttcttatttaaaaatgtgggatatttaattttggtaagtttagttaataaggataagtatatagaattaaaagtgtttgacaagatggatagtagaatttaataaatgaaaacaataaaaaagatgagaataattgtaggcttgatatacataagcatcaaaactctcttttaatatataagaggatacattatgagtcggaaataaaagtgaaataaaatgtttaatatcactaaattaagatatcaaaggaaaaaaaaaacatgatgaaatagctattttgatcatatttctagaaataaaaagacatatatctgttcataataatcatatggactatatatgggataaataattttaaactaaaaacatagataacgttttatctgtttctaaaaattgttaaggaaggttcttttcattttgttaattatggaaatttcgttatccaaaacaaaaaaaatcaatcaatctagaaaataataagtagagaagaagggagaaggaggaagcaaagagatagtggcgtgttcccctctccatattcagccgccactttttctcttcttctcctctaatctcgttcttgtatatatatatatatatatataaacacattaccataaacttatactctcttttgatccatctattgattttgattctctgttttatccggaagtctaaattggatg

SEQ ID NO: 21535 - DNA, 3000 bp, Unknown
  misc_feature (1)..( 3000): 2750-1469P.txt file - cDNA_ID_1989420; gDNA_ID_1971786; Annot_ID_58011
aaacactcacaccttatatcaagaccaaacactcacattcacccaagaaaaataaagaccaaacactcacaagttttattaagacagcaacaaagccaacattacaaagtcataaaagtcacaaatactacattgtcattacaagcttggcgaagacaacaagataaatagacttacactattaagcaacaccaaattcatttctttttgccttaccaagcatcatgtaaagaatgaaaatgctgatcaaacaaagccacaaaaaacatattttcaaacacactttccacttgcagatttcttgtttactcaacattgcttcttcttttagttcatgtatcatcacatttagctcatttgcctcggatttggctttgttaagctcatttgcaatgatcacaaattttggtaaaacatcttcaacctcttcgtatacagcatcctcaacccatttaaacaaatgactctgttacacaatcaaaccaaatccgatatgattagctgctaagttacataacataaacacaaactcaaactcaaactcaaactcaaacttacatctcttttgtttgtccacgtctttggatctcttttcgtttcacaacgaaaaaaaggtctgcccggattatcaacactcttcgatgtgaagattgtcacatcatctccacaccaacacttcaccggaaaaccacggttttggataacacccgatgacgctgaacttgaactcattgcgtaggaagatccaattttcgaaatcgatttcaattctgtcgtagaagaagagaactgagaaattttgtttttttagggcttgtgatttcttcgatttctgatcgaattgggggaaaacatagcaagtcgttttgaaaaaacgacgtcgtttactaaaaacgaaactgtgtcgtttgcaaattaagtctctgttaacgcctaattaaccctgtcaattaagtctgttaacccagataacggcaagactaaaatggcgcggtcaacacaagtttaagatttattagaaaagtcaacaaaagttcgatgtttttttcgtttcatctaaaattcgggatttaaatcaacgttttagcaaaattcgggattttaatgaaatttttcccttttttaaagcaacatgcatttgtcatttgtgcatggttattacttgcttcaaaatatcaaaaataataaaccaccatatattcttcaaaatttataatttaatttgaaattatcttaataagaaaaaactaaaaaatatttaaatcaagttgctaaaaatacattataaaaaaagaaaaacaagttctccaaaaattccaatatacaaaagttaataatattagtatacgagtggcatattcagtttagattttaatttaatgcacatcttatctctcccaaatttatgactacgtggtagagccggcccttagcataaacaagggaagcagctgtttagagcctctacttgatattctattgtctcatatttttgtacgtaaatgtttgtgtattttgtaagatatttatcaagtttttcttacatattaaatttagccatataattatttaagggatcatgtgaatccaatgttatttgtttcttatactgaagtacgtgtggatgtatgaagtagtttaaacaaaaaaaacttacataatttgtcgtgtaattataagggtaaacatatacatatagattcataattttagcaatcataatatctagttagcatctcttattcattcgtaacaactaaattatacagctaaatttgacaaaatagtattatttttttctataaaaattttaaagtatattttggtcctttctctcgtattttttaaagagaggaacatttcatagttttgtcgaccggatttttccggtgaattgccgtcccgattgactcggattcccaaacgacatcttctggcttcgttagtggaaatggccgccctcgtccagcgacatctgatttcttctagaagttggctcgcttttatctttccttgtcgtggatcggttcttcttccgatctctttatgcttttatatttcaataattgtttggatatgagttggtatttatctatcatgatggatccatctaatttgtctcttttgtgcaacttgtgggttgcatgaatcgtttcaatttcacaaaattgaagagatttcagtctaaaacttaatttgcatatgttcaagagattacatcttaggttaaaggatcgaaagtatctcgatgcatattacaattccctttctgctgtaccttttaactagagttttgttcaaaattttccggtaacacaaaagggatttcgtgcgattgtttatcgtcgatatcttcttcgcgggaattggagctcaacagcggtggttgatgtcggtacacttccgatgactcttcaacacgtgttgcaatcataatttcagtttgacacgtatttttggatagagtacaaacgctaaaattccttcgctttcggtgtaaaattagtgaattcttattgagttttactctctgttctttataattttaatagatttttaggtattgtaaccttatgtttaataaaatattcttgaaaaaaaaattatattttggtccggcactgctacgtggcaaagtttccacaaaattttccacgtggcaatccgacatgtacccttgtcgtaactttagtccgttcatctcaaccaaactcttaatcaacggccgagattcatcacaaggcgcgtgtcaggggcgcgggaaagtgtggaactcatgagaccacaggtggagagcctgagtgcaactcacgacacctttaaccaaccaaaacacgccacgttatctctcactgttaaattctctcctgtaaaagaactggcaaatctccctcaacaaagaacttagccttaaaggatttgtataacaaatattatcgtaatcgcttaaggctcaagtcacacaagttcattgattccacctttctaattacgaggatg

SEQ ID NO: 21536 - DNA, 3000 bp, Unknown; identical to SEQ ID NO: 21535
  misc_feature (1)..( 3000): 2750-1469P.txt file - cDNA_ID_1989420; gDNA_ID_1971786; Annot_ID_175486

SEQ ID NO: 21537 - DNA, 3000 bp, Unknown
  misc_feature (1)..( 3000): 2750-1469P.txt file - cDNA_ID_1989423; gDNA_ID_1971786; Annot_ID_58005
actatacttaaaagtttacataccaaagcaaacatttactttctagttaaaatattgtaagttacatgggtgataggtctatgtaaaaatttctctaataagctcattctgccatataaaaaaaacattttgagtttacgcaatcaataaatgtatatcacaaacttggaactggagaaatgagttggagaaagataaaatgctccttaacacatggcattgcaagtgaagggatatggatcaatggggtttattattacttaggtgacatgtctaagaccatgactgctactgcttttgtgatagtttgctttaatgttaggtctgagaaattcgagtttatttatccagagggctatcatgaagctataatggtaaattaggtttggtttattatgatgataacgttgatgataccgttgagttgcgtgtgtgtgttctagaagactaggagaaacatgaacagtcaaaatatgcttacactttgagggatgataaattctaggatcattacgtttccatcgttggagtgattgctactggtgaaattattttatcgatggcggattatacatctaaacaatctttcctacttcaatcccgataaaaacactctccaacgtgttgaaatttaaagttttgaataatatcatgtagtgttctgactacacgtttttgtagacgattgttgtagattatattgctttgtagaccatgtagagtatgttaacgttaacgacccaaacctcctcaagtcaaacatctatagttttccatacatgaggacaaaagaatcagaagaggaagaataacttcaatttttacatccttcagtacgtgtttcaaaacaccattcactcattgtggcgggaaagaaacaacaggaggtatggggaacaaccatcaccaactgcaacactagtcaagatgatcgataagaacatccgaaaccggctcagcacacttcaaaggggaggtaattcaaagtatgaagaaggcatagtcctttggtttgcaacaagaagaaatcatgtctagaaattccaaatttcttgtaaataattttgaaaagtttttacattcacttgtaatacccagtaactttttcttttgagtataatttaacatcatattcaaaaaaaaaaaataacttcaatttttaccaatttaacatcattttatctttttttttttttttttcttttttaaagatttttctgaacatgaggttttaaggataaattacggccataacataaaacaatcccaaatttttggttggacaaattagtttttttttctagtatttgttttgtagatgagtttgtatgctatattgctataaaagataaaagtgaaatctctaaaaaaaaaagaagaagagattggctacttagttaataatagatatacacactaacataaggattaagagtttatttacagaacaatagtcagtgaattaaaagaagttaggaaagttagggtccaaaagagaaataaagcaaatatatacagaggaagctgcaagaagaaaaagggataaggcaaaaaggatttgcttttacgaacagagagcgagccagagagagtgagtaagagagaatgacgagcgtgagtgggtgtggttcagtgagtctgataactaaccgcagtgcgttcttgggaaacggacttcaacaccgtgccgttttccttaaaccatggtcgtcttcttcgcttcagtctcggtccatggttgtcgaagccaaaaccaaaaccagcagcgaagacagaatcgcccgccactctcgtatccgtaagaaggtgttctctttcttctcgcttttaatttcatctccaatgtctctaatattctcttgaagatagtgtttaatgtagaattgcgatgaaatttgggtgtttcattagagttcgaagaacacattgtaacgataattgaaatcgtaattcgtaaccacttctattcaattttaagcttatgtttgggttttgcatttattcaaagttgattgtaatttgacaatgaaattagaaatgtgattcatcagtttttcttgatgttggtgctattgtggcatgtttgatgtgtctctatttgttaccttgagttctgtctcattaccgttactcgatgcacacataggttaatggtacaacggagaggccaaggctatgtgttttccgatcaaacaagcatctttatgttcaagtgattgatgataccaagatgcacaccttagcttcagcttccactaagcagaaaccaatctctgaagagttcgactacacctctggaccaaccattgtaagttcatctttgtaatcaactttggtaacacacttagcacgagtcacttggcactcaatttgatgatatgcttcggtttggtattgtgtaggaggtagcgaagaaagttggggaagtgatagcaaaatcttgcttggagaaaggtatcacaaaggtagcctttgaccgtggtggttacccttaccatggacgtattgaggctcttgctgctgcagcacgtgaacacggtcttcagttttaaccgtcgttttctttccttgtttctttccgatgaacagcagtgtatgaatgtagagaacccattttccccaattgaaatgttgagatttttctataactattctacagcctaaaccaaggccctgaacaaaacatttatccaaacatttcactaaagtatcactaggtgcataagaactctgcaacttcagtgaattaagcaagagtgtttccagaacaactacaaatttcaaagaaacgtctctgaatcgctttaaagatttttgcatttaatatttttcttacatatatatatttttaaccaatgaaaaaatagagaaaccttgaacaaaaagacaaaacagaaaaagaattctccgaccaaaaaatatcaaaatggtaaaccaaaagggcaaagaaagaaactgtagcgccaatctaaagatttcccgcgtcatcggcaggaaatg

SEQ ID NO: 21538 - DNA, 3000 bp, Unknown; identical to SEQ ID NO: 8395
  misc_feature (1)..( 3000): 2750-1469P.txt file - cDNA_ID_1989431; gDNA_ID_1971789; Annot_ID_58032

SEQ ID NO: 21539 - DNA, 3000 bp, Unknown; identical to SEQ ID NO: 8395
  misc_feature (1)..( 3000): 2750-1469P.txt file - cDNA_ID_1989431; gDNA_ID_2926198; Annot_ID_141392

SEQ ID NO: 21540 - DNA, 3003 bp, Unknown
  misc_feature (1)..( 3003): 2750-1469P.txt file - cDNA_ID_1989432; gDNA_ID_1971789; Annot_ID_58031
ccaaaagtggcaaaagaaaacattagttgactagtgtgacacacaacacacacaaaaaagtaataatatatataatagcagagttttctctcctctaaaagtgtccacgtcactacatctttttaatgtggagcccacatgtttttactcgccttcacattttttctatgcgtgaaatagatttagtgatgtttatggggccacgatttggtcaaaaagcccatgagccaaagaaccaaatagacttagtgatgtgtatcgggccaagatttagtcaaaaaacctatgaaccgaaaggacctaagaaaacccagttaaaattgcaaacccttgatttcattttctcctattcgatcgacgcaattcagaggacgacgaaagagaaaaagagtgtttcagtcactgccctgttgatgcacgaatttcaacaaagtatatttgtaagttctttgataagggaaaaacattctcatcgcgttgaaggtcgggagttaggtcgttcttgcgataaacatagagtttattagttttatagctgcaccttgtaaaaggctgcctacgtacccttagaaaagggatcaagccatacgtagttcatattataataagtgagctaggtcatcgttggaggtaggtcgtatattgagataggcagtttagagatgaggtggcaggttggtgacgagctggcaggtaggcgaagagctggacgaacttagttacgaggcgaactggttgatagacaacgagttagacgaactgagtatttgagtgacgagctggtagccaggggccaagctcgacgaaatgtagtagagagacgagtcggacaaatcgagttgtctggtgaaaatctagacgagctgggagacgagataggcggactgtgtagtcaatggacgaactgacagctaggcgaggagatagatgagttaacttgagggacgagctgctgactaggtgaggaattggacgaactgactagctgacagctaggcgaggagatggtcgttgagtcatgtggagcttgaagacgatctgaagaacttaaagacgagctgtagagcttaaagacgagctgaggagcttgaggaccagctgaggagcttgatgacgagctgtggagcttgaagacgagctgaggaacttgaggacgagctgagtagcttgaggacgagcagaggagcttgagaacgagctaaggagattgaggacgagctgaggagcttgatggcgatctgagtaccttgaggacgagctgaggagctagagaacgagctgaggagcttgaagacgttttaatatggatttcttcctccttttttccatgcctctctatttatagaaaaactaagctcactacataaaaggtataatatggtactttaaccttgatcattgtgacgttggtctccaccatattggcatagcagctaacggaggccagcaatctacatgtatgtcatgctattattatgtagaggaaggactgaagagggaaaaacctatatgagccaacttgaatgggctaaagacaccaccatggctgaaacgtgttggaaacaaatcaaaacttcactaaatgggattagagtggcgagaaaaagattgtacatgatatcacttcgcaacatgaaaccccccgacgtgtgccatccaagagatttggacaacacatgtgagaaatgttttttctacaaacaaatgtttaagtttatttttatggtataacttaaacaaaacatttagagagttggaaactgtttttaaaaaattccctataatgtttgagcagtgaactatcacaaagactcaaaacaaagttattactcttatttcttttgctttaatgtgtgtctttccttgctgttgtaaggaaatttatatttacaataaaatcaaacttttaattaattatctaagcatatcgtactttcaatgttaatattgttataatccaactctttttggctaattcgcgaagagacgttgaaaagtgaaatcttcccaaaaccaaagagtagtttctaagattttaacagagacacaaagagaaaaaacaaatgggcgggttcatattgggccaaaattaacaatggcaacgatgtgtaaaataacttcgtcgttagtctctgttcttcgctatcctctgcagcaaccgcttaatacgagagagagagagagatttccattgtatttttaatttaaaataaaatatataaaaacaagaccaatgtaacaaatgcattgcttagatatatataactctaaaaaatattcttacaagatagtaagtttggtctattgtcctataaattctagcatataactggtaacaatatgaaaaaaaaatgtaaaactatacatagattacaaaaatgtagaaatcaaaaaataagattagcaaataacaaagatattcaccttttaatcaaagatcagtaaaaaaaatcgaagttataattacatactaacaaaaccaaaaacaaaccaccaacgcgcgtgtctcctccctagttaattaaaggcaaaaggaagacgagtaacacgtggcaaatactctatctgtagccgtcataaaaaaaattgtgggaccctacaccctataaatcaagaactactggttgttcgccagcgaattaactaaaatatttaataaacataagaaatgacaagtttagccctctttccataggcataacatggtggctaatttgggaatttcagcagcattcggagtcaaaataacgatagcgcgtgtcggtgaaatcgcggtatacgcgcgtcgatagccgccaggagaatcctttttttacacaatcaaagagagagatcccgtaaatgttttatactctgatttctagggtttgcttttgattctctttcgcgttccagataaataaatccttttgtggaataatttcgtgatttcgtttgtgggttatccgaattttgtctgaatttgagtttttgagaaggaaaggtttgttttttcgggggatg

SEQ ID NO: 21541 - DNA, 3003 bp, Unknown; identical to SEQ ID NO: 21540
  misc_feature (1)..( 3003): 2750-1469P.txt file - cDNA_ID_1989432; gDNA_ID_2926198; Annot_ID_141391

SEQ ID NO: 21542 - DNA, 3000 bp, Unknown; identical to SEQ ID NO: 8384
  misc_feature (1)..( 3000): 2750-1469P.txt file - cDNA_ID_1989435; gDNA_ID_1971789; Annot_ID_58025

SEQ ID NO: 21543 - DNA, 3000 bp, Unknown; identical to SEQ ID NO: 8384
  misc_feature (1)..( 3000): 2750-1469P.txt file - cDNA_ID_1989435; gDNA_ID_2926198; Annot_ID_141385

SEQ ID NO: 21544 - DNA, 3000 bp, Unknown; identical to SEQ ID NO: 8383
  misc_feature (1)..( 3000): 2750-1469P.txt file - cDNA_ID_1989436; gDNA_ID_1971789; Annot_ID_58024

SEQ ID NO: 21545 - DNA, 3000 bp, Unknown; identical to SEQ ID NO: 8383
  misc_feature (1)..( 3000): 2750-1469P.txt file - cDNA_ID_1989436; gDNA_ID_1971789; Annot_ID_175514

SEQ ID NO: 21546 - DNA, 3000 bp, Unknown; identical to SEQ ID NO: 8383
  misc_feature (1)..( 3000): 2750-1469P.txt file - cDNA_ID_1989436; gDNA_ID_2926198; Annot_ID_141384

SEQ ID NO: 21547 - DNA, 3000 bp, Unknown; identical to SEQ ID NO: 8383
  misc_feature (1)..( 3000): 2750-1469P.txt file - cDNA_ID_1989436; gDNA_ID_2926198; Annot_ID_201625

SEQ ID NO: 21548 - DNA, 3000 bp, Unknown; identical to SEQ ID NO: 8381
  misc_feature (1)..( 3000): 2750-1469P.txt file - cDNA_ID_1989439; gDNA_ID_1971789; Annot_ID_58021

SEQ ID NO: 21549 - DNA, 3000 bp, Unknown; identical to SEQ ID NO: 8381
  misc_feature (1)..( 3000): 2750-1469P.txt file - cDNA_ID_1989439; gDNA_ID_1971789; Annot_ID_175511

SEQ ID NO: 21550 - DNA, 3000 bp, Unknown; identical to SEQ ID NO: 8381
  misc_feature (1)..( 3000): 2750-1469P.txt file - cDNA_ID_1989439; gDNA_ID_2926198; Annot_ID_141381

SEQ ID NO: 21551 - DNA, 3000 bp, Unknown; identical to SEQ ID NO: 8381
  misc_feature (1)..( 3000): 2750-1469P.txt file - cDNA_ID_1989439; gDNA_ID_2926198; Annot_ID_201622

SEQ ID NO: 21552 - DNA, 2058 bp, Unknown; identical to SEQ ID NO: 8411
  misc_feature (1)..( 2058): 2750-1469P.txt file - cDNA_ID_1989441; gDNA_ID_1971791; Annot_ID_58043

SEQ ID NO: 21553 - DNA, 2283 bp, Unknown; identical to SEQ ID NO: 8403
  misc_feature (1)..( 2283): 2750-1469P.txt file - cDNA_ID_1989441; gDNA_ID_1971791; Annot_ID_175573

SEQ ID NO: 21554 - DNA, 3000 bp, Unknown
  misc_feature (1)..( 3000): 2750-1469P.txt file - cDNA_ID_1989441; gDNA_ID_2926197; Annot_ID_141340
ggttcttaagattaaactgaatatctacatgtatatctcagtggttccgttttttttaaagtaaaacatacaaatattacgtatataattcagctttactttggttcatattctttttttctttgggttcgtattctttctcatacaaaagtttacatcaacaattatatcatttaataggattagaaagaaaacaaataaagtagacctataggtatggttgcacatattgattagtgattaatatagttttgtagtattttgcaatgaaacatcttaattgactcccatcattaattagtgaccaaccaaaagaaattgaccttttgatttagaagaaagagaaggaaagcgtgtgtgtggttacttgcttgcaactttgctaacgcaatcaaatcttttaacccatacactatactcatacttttcttcgttgcatctattctcatttcatttcacacaataatatggagtacaatattattttaatcacatcgatcatagattcatgataatattgccaaacaaaatgtaagcttaaaaacttttaatgttaaaatgtccaaagaaaagctcgacgtgagtcaaagcaagttgtttttattccaaaaccatggtccagttacgaccccataataggatacatacaaacttgaaaagttataaaaaaattcaagaaaaaaagatattcacaagacatattctcttcatatttcaaccaaattcgagaatttgaagtcgaacaattccacacgtaatatccctctagacctctggtttcttctttccttcctataggtctcgccgtagtgatctaagctttatgaaaacatttgaatttcgagattcgtgtaaatacataaataaataacaaaagatgcaaccaattatatagcaaacgatattattaataaagattattaaattataacacaccaagaaaaattattaaagtatatcctagcatttactaatagaagagtctaattttaattttgttattgctcaaacacagtatataattttagagatttctttggtttacgtcaaaaaagtctgtctcaattttaatattttagtcggtcatcagtatcgtccaaacaatcattttacttttgttatgataaaatacggaattcctcccctaatgacaatcaaattcgaattcaaaagagctaaacaacatatttctaacaaataatatgctcatgcatgctaatatttactgtaacatttaaaaaaattaaggatggtaaacataatctgcttaccaaatgatggagatactcaagagtccagctgtaatacatcttgcatgcaatatcttgatattagcctccttttgttcacccactctcttctcttcttcttctcatttatttatatgttaaactctctcccactatatatatctctcccccttcttctctcttcctcacattcctcaccaaaccctctccaaaacacacccacacgtacgcacacacacaaagacaatgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacgtgagtttatatattttctttaggagttttaagtgattttggatttggtttttatattgagacttcatcttgacatttttgtgtatttgcagctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatgtaaagacaacaatctcacctttcttgctacacacgttaataaaccctaactaggttttcgatttttcttacccatctcttatctgttctgttttctatcagattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatagaatctcaaattatattctatttatttatctacacttcctctctttcttttatgtgaaaattgtgaatgctctgtttatagcttgtctattatgtccgagaatttctttttctgtttttgattcttttcgttgtatatctttgtccaataaaggaaatgatgtgtctttactcttatagatatgtataaaaagatgtccctgttttatttgttaaaaaaaattgtttatgataatgatagttctttcttcttcttcttctttttttctcataaaaaaaaaatgatagtttcatttgctttatatatatacataattaatttacttacattgtaagaaatatgataaacgtgttgaatgcttctttttcaaatccaattattgaaaaaggtcaaaatatcaaattttatttattatagaatgtatcaaaaacttacaataaaaaactctctacctgagttttatctcaattttattaaccaatcgcatgctttcatagaatg

SEQ ID NO: 21555 - DNA, 3000 bp, Unknown
  misc_feature (1)..( 3000): 2750-1469P.txt file - cDNA_ID_1989441; gDNA_ID_2926197; Annot_ID_201557
catattgattagtgattaatatagttttgtagtattttgcaatgaaacatcttaattgactcccatcattaattagtgaccaaccaaaagaaattgaccttttgatttagaagaaagagaaggaaagcgtgtgtgtggttacttgcttgcaactttgctaacgcaatcaaatcttttaacccatacactatactcatacttttcttcgttgcatctattctcatttcatttcacacaataatatggagtacaatattattttaatcacatcgatcatagattcatgataatattgccaaacaaaatgtaagcttaaaaacttttaatgttaaaatgtccaaagaaaagctcgacgtgagtcaaagcaagttgtttttattccaaaaccatggtccagttacgaccccataataggatacatacaaacttgaaaagttataaaaaaattcaagaaaaaaagatattcacaagacatattctcttcatatttcaaccaaattcgagaatttgaagtcgaacaattccacacgtaatatccctctagacctctggtttcttctttccttcctataggtctcgccgtagtgatctaagctttatgaaaacatttgaatttcgagattcgtgtaaatacataaataaataacaaaagatgcaaccaattatatagcaaacgatattattaataaagattattaaattataacacaccaagaaaaattattaaagtatatcctagcatttactaatagaagagtctaattttaattttgttattgctcaaacacagtatataattttagagatttctttggtttacgtcaaaaaagtctgtctcaattttaatattttagtcggtcatcagtatcgtccaaacaatcattttacttttgttatgataaaatacggaattcctcccctaatgacaatcaaattcgaattcaaaagagctaaacaacatatttctaacaaataatatgctcatgcatgctaatatttactgtaacatttaaaaaaattaaggatggtaaacataatctgcttaccaaatgatggagatactcaagagtccagctgtaatacatcttgcatgcaatatcttgatattagcctccttttgttcacccactctcttctcttcttcttctcatttatttatatgttaaactctctcccactatatatatctctcccccttcttctctcttcctcacattcctcaccaaaccctctccaaaacacacccacacgtacgcacacacacaaagacaatgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacgtgagtttatatattttctttaggagttttaagtgattttggatttggtttttatattgagacttcatcttgacatttttgtgtatttgcagctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatgtaaagacaacaatctcacctttcttgctacacacgttaataaaccctaactaggttttcgatttttcttacccatctcttatctgttctgttttctatcagattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatagaatctcaaattatattctatttatttatctacacttcctctctttcttttatgtgaaaattgtgaatgctctgtttatagcttgtctattatgtccgagaatttctttttctgtttttgattcttttcgttgtatatctttgtccaataaaggaaatgatgtgtctttactcttatagatatgtataaaaagatgtccctgttttatttgttaaaaaaaattgtttatgataatgatagttctttcttcttcttcttctttttttctcataaaaaaaaaatgatagtttcatttgctttatatatatacataattaatttacttacattgtaagaaatatgataaacgtgttgaatgcttctttttcaaatccaattattgaaaaaggtcaaaatatcaaattttatttattatagaatgtatcaaaaacttacaataaaaaactctctacctgagttttatctcaattttattaaccaatcgcatgctttcatagaatgagatattatgaaacgacgtcgtttagggtaagaacattacgtcacacgtttattttaatattattttatcatcgccctctttgtaatttcgacttctcttcttcgtcagatctgaatcttaatttcccccaaatcaaagcttttgacctaaatccgtttcccgggaaaaataaatcaacaaaccatcaccggaatcttcaatatctctccggtgaagaaaaaatg

SEQ ID NO: 21556 - DNA, 3003 bp, Unknown
  misc_feature (1)..( 3003): 2750-1469P.txt file - cDNA_ID_1989445; gDNA_ID_1971791; Annot_ID_58038
tagactgtaattggttgtatattatgtctatactaatatactgttttttgctcacatatgtatacagtttttcatttctacagtagaaatgctttaattttgtttttattacttaaaccagtcgacatatggtaatttttggtgtcaactctgatagttgtcaaaatgaaaaaaggcaaaaaaacaaaacaaaaaactgatcttcgcaaacctatgaaggagttttggcatttttaattttttctgcattaagaaaaaaatattgatacttgagacttttttttcttcaaatttccaagtatttgcctcaactcaaaggacctcaaaggtctaaaaagaaacggtagggtcaagttcaatacacaaattcacaatcgaattcaaatatattgaaaataaaatgagaccaaaaaggccggtcattttcaaacaattgcagagtacaaatattttatgttaataagatgttttttcttgggcattacaaactttattttgttgataaaataacaacaaacaaaacaacaccaattgattaatacataaagtttgatgggaaatggatgaaccaagtgattaagatctgtccacgcgggaagtgttggattcatatgattcacagtttccctatcaaccactgaaaaccatattgcttcatcaatctcactacgtgggttttttattgcctttctctcatttgcattttgagcccaaccaagtctatttattaatcactttttttgtcgatatttattaatcacttttctctcatctataaaccactttgtagttatatttttttttgtcgtaaaaaaaaaaaatagcaaacaatgattgatgaaaattgtcccaaacaaaaaaaaagaggattgacgataataaagatgcaaaaacagctttctatttctgtcagcatataaggattttatagaattcaaacttatatttctacactaagaaattaaagacttataggtgtaatctattacttcacagttcacacttttgatttcttatgggaatgtgttttcgtaaagggcaatatggttttaggcattcatgtgttttggatgagacgctactaccaaaagaatatgtcgttactaaaaaactatatttttgacacatgctgttaattttggatacatagaaggtctaagagattaataggaatcgtttttatctagtttctaatttagttcaaacgttgactactccaaattttcgttgtagagttatttattgaaatagtcatcgattttaaattgggtaatactatatccgatcgaactttaatatgaaatatgaattatgctacttatgagatgcgataacaaatttctatagtttagcgatcttttgttcatgttatttagagtttggatttaaaaaagttatgaaacaaagacacgtgtgttgacgggttgtggtgtttgatttgccttgctttctttcttctttgtgatgaagaatctctttggagatccaatatattgtttttggaagtatcacgacggtgacatgtataggtcgatcgaggaaacgccaatgataaccaaattgaggctgtcgcaactaaatgatcagtcgatagtcattattaatagtatagttcgattaaaaaaaaactttccaagattattgttaccttgtattttttttgaacattttctaaaaatgatatcttctaaacttagataattcaacctatttgtggtatcattaatttgaacaactttgacatgcaagtggttggccatactccatactacaagtctacaacatgtctgcgctaggaactttcttactatacttcatttttagaccattaatgttattgcttggtcttttaaaatgatagtaaattattattttatagtatctatcgtatattattatttacatcgatcataaagtgctggtttacaaaaaatatttttaaaaagaaagagtcaaagttccttccatatttgaccaaccaagcttgaccgactcgattcaatgggtccaaagtcatagtggtcgaggtaattggtcaatcaaaacaccacgggctatatgaatctcgcttaattgctaacacgacgtattgacaaattttccattcgtaatggtgcaactattcaaaaacaacaaatacttgattttattttgaattttattagtgtttgccaaatgattttagtccaccaactaaaaaatatagaaggagcaatagcatgccgctaacaagaaaaaaatagacatcttacaaaaaaatgttttttggtttgaccttagaataaatgtatttagttagcaattctaatttaattaaaaaaaacaacgaaattatcaatatacaaaatacaaataatgctacataattcgcttaagaagaattcaactattttattttacccaaacaagttaattcttacttttttctattttgctcttaatttcccattctgattaagaaacaaatctcatatacttttctatttttgttagacatgaatttcaaatatatatcttacatttataaaattaattttcaatcaaaaatcttgtagtattatacaaccgtgatgttcctaaaaaatacctgtcatacagctgttatgcttcttaaaataagataaaattatatttactgtattaagctagattgtcaaaaattaaacagcaagataataacgtaattaaccatcgttaatatcaaacgcgttaggtcggtttgaccggtctggtttggtgagcgctggtaataatttcaccatcccaatcaatcacagacaaaattgaaaaccccaattaataatacataaaatgaaaaacatgatgaattataaattaaaactctgttctgtctcaaaaaactcaaaaggagtctctctctcacctacaccacacctaaccaaaccccctacgattcacacagagagagatcttcttcttccttcttcttccttcttctttcttcttctttcttcttctagctacaacatctacaacgccatg

SEQ ID NO: 21557 - DNA, 3003 bp, Unknown; identical to SEQ ID NO: 21556
  misc_feature (1)..( 3003): 2750-1469P.txt file - cDNA_ID_1989445; gDNA_ID_1971791; Annot_ID_175568

SEQ ID NO: 21558 - DNA, 3003 bp, Unknown; identical to SEQ ID NO: 21556
  misc_feature (1)..( 3003): 2750-1469P.txt file - cDNA_ID_1989445; gDNA_ID_2926197; Annot_ID_141335

SEQ ID NO: 21559 - DNA, 3003 bp, Unknown; identical to SEQ ID NO: 21556
  misc_feature (1)..( 3003): 2750-1469P.txt file - cDNA_ID_1989445; gDNA_ID_2926197; Annot_ID_201553

SEQ ID NO: 21560 - DNA, 3000 bp, Unknown; identical to SEQ ID NO: 8398
  misc_feature (1)..( 3000): 2750-1469P.txt file - cDNA_ID_1989447; gDNA_ID_1971791; Annot_ID_58036

SEQ ID NO: 21561 - DNA, 3000 bp, Unknown; identical to SEQ ID NO: 8398
  misc_feature (1)..( 3000): 2750-1469P.txt file - cDNA_ID_1989447; gDNA_ID_1971791; Annot_ID_175562

SEQ ID NO: 21562 - DNA, 3000 bp, Unknown; identical to SEQ ID NO: 8398
  misc_feature (1)..( 3000): 2750-1469P.txt file - cDNA_ID_1989447; gDNA_ID_2926197; Annot_ID_141333

SEQ ID NO: 21563 - DNA, 3000 bp, Unknown; identical to SEQ ID NO: 8398
  misc_feature (1)..( 3000): 2750-1469P.txt file - cDNA_ID_1989447; gDNA_ID_2926197; Annot_ID_201550

SEQ ID NO: 21564 - DNA, 3003 bp, Unknown
  misc_feature (1)..( 3003): 2750-1469P.txt file - cDNA_ID_1989449; gDNA_ID_1971791; Annot_ID_58033
aactaacaccacaattattgagcacattcaaatgctgtcatttttattactcgtacgtacacatgaataaggtggaaatgtcatatttgggaaaacaccataaaacaatatgtatgtcgttcactttggtctcatataaacgctagccaaatcatacagaggtaatggtaatgtttttttatcgacggcaacgaaagtttatgctaatatgtttataaattacttttattgattaatatgattatctctgtatagttgtggacgtgtgtatataactgaccgtctaattaaagaaaaatttatcacatcacgtacctaaaagacgttcttcattaatccataattgctttagtgtataactaatcatctatttagaagttttttgttttacttttcctattgttaatgtttgaaagattagaatatatttataagaagaaatttataactttttagcaaaaaaaaaaaaaaaaaacttataacttatgaagtctttggtatgtatattaaatttgacctgatcacaagtaatgcacgtatattcacgatttgaggtacgaagcagatgaaaattgtactatttaacaaaattactaaactataccaattaccagacacataaaatctagataaagtggtcctaatttctgagaaagaatattcctgtgttcgttctttctatctctttccttttctgttgttacatttcccacacacaaaaaaaaaaaaaatctatttactgatctatgttaaataaaaatcaaaaggaaattgttttatgatttttattactttatattaatttaattgatgtaataaattattaaattaattcttggaaaattaatcaaattaacttaaatcaaacaaaatttagttaaactaataaacactttaaaataaaaagtttaatttgattaatttagtcagttatttattaaactaataaacactttaaaacaaatttagttaaactaataaacacttcagttaattattaaatatttatgagaattctaaaagattaatccttatgaaacagaggaaatatattttaagatagaaaagagatattaagaaatctcaaattaaaatacaactcatatttgacacccataagcaaaagatattataatactaaactacttatcaaagatatttcagtttattgatatgatcagaatttggtcaatttttctgtcaacaaagattggtctaaattaatgacctaaggaagcgaattaattcattaagaagactttttttctttctcaaaacttatgaaaattaacccacttctaattaatcatcaaaaagcttgaaattatttgtaaacgaagactagaaagagagaggggaaaaaggtatgacaaacagccttaaagttaaaggtaatagtaccttttgtttgttcttctttttttgcaaacaattttttcccttatttaattacgtttataaaccttaattcagattccttaaatacattgttaggactccataattagtaacggcattaggagcataaacaaaaattatgataaaagttttgatattatggaaataaccaaatatcttacctgtaaataaaataaagagatgtgaccaaatttaattgtggatttaattacattatctaacccttgaagaaactcaatgttttttgtgggattgttgtcctaaacctgaggttacatgtaatcaaaacattaatgggatttgaagtaaataaattagatttgcgccaaaaaaacaaaatctccattgattacagtgttttaatatggtcagataaaaccacagaagtggtaacgacataaaaaatcaccaccaaacataaaaccgtaagaaaagtttcgatttttattttctgcgatccaaaggtctagtgatgaattgaatttggtttttgtttttataattgaagaatgaagaaataaacagttgatgggttcttcgcttcttctcttgttgggttagtgataagcacgcctggcttctcatcattccctccaacctttctctctctaaaagacttcaattgttttatcagcttctctctctaaataaagctctcaattcaattctctctctttcacttttttttcctctgcttgcttcttctgttcatctttttgcttcgtcaaaattttgaccaaagttttgtacttttttgttgctgcaatttttgtgattagattggatctgggcttggagctgaatagcggatttgtataaggtaattgcttgaaacgtaccgaattgattcgtttttttgtttctctgagatttttcaatatctgggtcttagagtttggctgatctgattggttctctgagattttcatgtagataagtttgttttaaaagccaaagccttagtttttaattagtgagatagatttatgtagagagcatcaatgatcaatccttgagctttatcttgggttttgttatgttgtttattgaaaaatggtttgttcggtgagtatgatgattatgttcaatggaaatgttcttccttttctctcgaatttctgagttttgctttggtttcatataactttgtttgtttgtctggggaattgtgaaatttacataaccactacttccgatgtaatataaatatcagagcttttctttattgacagagattttttgacttgagatgaatgatgttgacccttgtggattctgagttgatttttgattctttctaattggtttctggtttctatttctattgatcagctgaatccaatcatggtcttttcagtagtgtatgctattggtgaaaatcaatattggtttcttcgccttgcttgtgatgccttgtctgctatcaaaatgtgtcatttgattggtttttgatagaattgatttgcatttgttgattcttgagattttaatcttagttgatgttgtctcataggttattattagtcttctctatcgttgcggcgttcataagttggagaaagtggtaaagactgcttaagtatg

SEQ ID NO: 21565 - DNA, 3003 bp, Unknown
  misc_feature (1)..( 3003): 2750-1469P.txt file - cDNA_ID_1989449; gDNA_ID_1620679; Annot_ID_48324
aaactaacaccacaattattgagcacattcaaatgctgtcatttttattactcgtacgtacacatgaataaggtggaaatgtcatatttgggaaaacaccataaaacaatatgtatgtcgttcactttggtctcatataaacgctagccaaatcatacagaggtaatggtaatgtttttttatcgacggcaacgaaagtttatgctaatatgtttataaattacttttattgattaatatgattatctctgtatagttgtggacgtgtgtatataactgaccgtctaattaaagaaaaatttatcacatcacgtacctaaaagacgttcttcattaatccataattgctttagtgtataactaatcatctatttagaagttttttgttttacttttcctattgttaatgtttgaaagattagaatatatttataagaagaaatttataactttttagcaaaaaaaaaaaaaaaaaacttataacttatgaagtctttggtatgtatattaaatttgacctgatcacaagtaatgcacgtatattcacgatttgaggtacgaagcagatgaaaattgtactatttaacaaaattactaaactataccaattaccagacacataaaatctagataaagtggtcctaatttctgagaaagaatattcctgtgttcgttctttctatctctttccttttctgttgttacatttcccacacacaaaaaaaaaaaaaatctatttactgatctatgttaaataaaaatcaaaaggaaattgttttatgatttttattactttatattaatttaattgatgtaataaattattaaattaattcttggaaaattaatcaaattaacttaaatcaaacaaaatttagttaaactaataaacactttaaaataaaaagtttaatttgattaatttagtcagttatttattaaactaataaacactttaaaacaaatttagttaaactaataaacacttcagttaattattaaatatttatgagaattctaaaagattaatccttatgaaacagaggaaatatattttaagatagaaaagagatattaagaaatctcaaattaaaatacaactcatatttgacacccataagcaaaagatattataatactaaactacttatcaaagatatttcagtttattgatatgatcagaatttggtcaatttttctgtcaacaaagattggtctaaattaatgacctaaggaagcgaattaattcattaagaagactttttttctttctcaaaacttatgaaaattaacccacttctaattaatcatcaaaaagcttgaaattatttgtaaacgaagactagaaagagagaggggaaaaaggtatgacaaacagccttaaagttaaaggtaatagtaccttttgtttgttcttctttttttgcaaacaattttttcccttatttaattacgtttataaaccttaattcagattccttaaatacattgttaggactccataattagtaacggcattaggagcataaacaaaaattatgataaaagttttgatattatggaaataaccaaatatcttacctgtaaataaaataaagagatgtgaccaaatttaattgtggatttaattacattatctaacccttgaagaaactcaatgttttttgtgggattgttgtcctaaacctgaggttacatgtaatcaaaacattaatgggatttgaagtaaataaattagatttgcgccaaaaaaacaaaatctccattgattacagtgttttaatatggtcagataaaaccacagaagtggtaacgacataaaaaatcaccaccaaacataaaaccgtaagaaaagtttcgatttttattttctgcgatccaaaggtctagtgatgaattgaatttggtttttgtttttataattgaagaatgaagaaataaacagttgatgggttcttcgcttcttctcttgttgggttagtgataagcacgcctggcttctcatcattccctccaacctttctctctctaaaagacttcaattgttttatcagcttctctctctaaataaagctctcaattcaattctctctctttcacttttttttcctctgcttgcttcttctgttcatctttttgcttcgtcaaaattttgaccaaagttttgtacttttttgttgctgcaatttttgtgattagattggatctgggcttggagctgaatagcggatttgtataaggtaattgcttgaaacgtaccgaattgattcgtttttttgtttctctgagatttttcaatatctgggtcttagagtttggctgatctgattggttctctgagattttcatgtagataagtttgttttaaaagccaaagccttagtttttaattagtgagatagatttatgtagagagcatcaatgatcaatccttgagctttatcttgggttttgttatgttgtttattgaaaaatggtttgttcggtgagtatgatgattatgttcaatggaaatgttcttccttttctctcgaatttctgagttttgctttggtttcatataactttgtttgtttgtctggggaattgtgaaatttacataaccactacttccgatgtaatataaatatcagagcttttctttattgacagagattttttgacttgagatgaatgatgttgacccttgtggattctgagttgatttttgattctttctaattggtttctggtttctatttctattgatcagctgaatccaatcatggtcttttcagtagtgtatgctattggtgaaaatcaatattggtttcttcgccttgcttgtgatgccttgtctgctatcaaaatgtgtcatttgattggtttttgatagaattgatttgcatttgttgattcttgagattttaatcttagttgatgttgtctcataggttattattagtcttctctatcgttgcggcgttcataagtggagaaagtggtaaagactgcttaagtatg

SEQ ID NO: 21566 - DNA, 3003 bp, Unknown; identical to SEQ ID NO: 21564
  misc_feature (1)..( 3003): 2750-1469P.txt file - cDNA_ID_1989449; gDNA_ID_2926197; Annot_ID_141330

SEQ ID NO: 21567 - DNA, 3003 bp, Unknown
  misc_feature (1)..( 3003): 2750-1469P.txt file - cDNA_ID_1989454; gDNA_ID_1971793; Annot_ID_58049
tgtactgtgaacacaatgaataatacgttaattctacgcagttatatctagagatgttgtggtgggtaaaaaagcccaacccgacctgaacccaaaataaacccgcccaccaaaaactcaactttagaaaactcagatgggtttttgattaagtgcgtaaagcccgaaaaaactgattattccgagactacccgtgggtacccaacttggtttttatcatttttttagagtttatttttaactgttaatatactattatatgtatgttgtatctatattttgcttattaatatattttaaattatatttattttctgtattacatatatatttgatgggaaaaaggttgaattgcgtttttggcgggaaaatgttaaattgcgttttttggagaaaaaatgttaaattgcgtttttggcgggaaaatgttgaatatcttttttggcgggaaaatgttaaattgcgtttttgaccggaaaatgtgaaatctttttggcgggaaaatgttgaatgtcgtttttggcgggaaaatgttaaattgcgtttttggcgggaaaatgttgaattgcgttttggcgggaaaatgttgaatatcgtttttggcgcgaaaatgttgaattgcgttttggcgggaaaatgttgaatgtcgtttttggcgggaaaatgttaaattgcgtttttggcaaaaaaaatgttgattatcattttttggcgggaaaatgttaaattgcgtttttgaccggaaaatgtgaaatctttttggcggaaaaatgttgaatgtcgtttttggcgggaaaatgttaaattgagtttttggcgggaaaatgtgaaattatttttggcggaaaatgttgaatagcgttgttggcggaaaaatgttgaattgcgttttggcgggaaaatgttgaatgtcgtttttggcgcgaaaatgttgaattgcgttttggcgggaaaatgttgattgtcgtttttgacgagaaaatgttgaatgtcttttttggcgggaaaatgttgaatgtcttttttggcggtaaactgttaaatcgcggtttaggggaaaaaatgtgaaatcttttttgacaagaaaatgttgattcacctgaaaaatgacttaaaaaaaaccgtgggtacccataacccaataaggtaaacccatatgggttttatttatttgggtacccagcccattttaaacctgtattttttttctagaaaaagtagatttatgggcttaaaattttatgtgggttttgggtacccagtgggttttaacccatcattaacatctctagttatatcaaagtgatcacataatttttaaataactatatatataatggtcaaacgcaataaagaatacgttgattctactcatttatatcaaagtgatcacattacttattgactaactatataatggtcctaagtcctaacacaatgaataatacgttgattctacacattgattctaacaaatatctaaatatcatatatcgaatatgagtatatgaaaaaacagaatggatcatgatatgctaaagaacatgatagtgagtttaagcactgtatctctgtatcatgaagaaaaaaatcacgtaaatatatatatagatctattatgaatgaattatcacgatggtatcatcacccaatcaatgtgacctttgttctcgatgatttggaattatacgataaattaaagtttaataggtctagacattcagatacacatacccaatcgttttttttttgggtttcgggtctctttgggtaggggttgacaatcttgatattctaaaatttttgtttgggttcgggttcgattattttagtaaaaaaataaataaaaaagtccaaaaataaccaaaaattccaaaatagttttgggttcggatcagattttttattcatatatactaaaatctgaccaaaatacccgattacgagaaaatacattggttactctttaccaaatgtaaacaaaaatacttaaattacttaaaagaaaaaataacattgattacttttatctcaaatatatccaaatatatatgtattactacaaaatatatagtatatccaaatttataattgtaattttgagtatttaaggtattataaatataaatataactaatatttttaaatgtatatttgtattcgggtatccacgggtattagatttggtttaggttgagttcggttttttttttttgattgtagacctattcgggtaattttaaaaattagactcggggttggctagtttttttttttgggtcaagtagtacgacatatgtaagaaaaataaagctaactattctaacattaccgttccatttttgacagctcactgtaacattataaacagacattacaaaccaaataaattctttttacaagcctaaaagtcatatttgcaagcccaacactaatctgcccagtaaacaataattagggtttcaattaaaatttggaaaaatcacggtgtcaagagtcaagacataaccaaagccgagatttggagatgaaagaaaactagatcgagtgatagaggagaggagagaaagaggagaaaaagagagaatagaaattggattaggaagtgggtttgcttttagcccacgtaagttagtttgaaagtcaacgtgttgtaatttgtaaacctaattggattagaaagtggggtttggtttatcccataacttagcacctctatttatataaaaactctagtcctaatcctattaggaaagcacttatttagataactcctaaagagatttgagcttatcacttcctaaaccataactcggttaggatctaaaccataactcggtttaagattacttttattcttatgctttctttgaagcttaatccatgttgtaatttgtaaacctaattggacttgggtttcataatcctagatagatagtcacatcaaatcattcgatttaagagagatcagttcgaggaaccaaaacctgagagacaaacatg

SEQ ID NO: 21568 - DNA, 3003 bp, Unknown; identical to SEQ ID NO: 21567
  misc_feature (1)..( 3003): 2750-1469P.txt file - cDNA_ID_1989454; gDNA_ID_2926143; Annot_ID_139019

SEQ ID NO: 21569 - DNA, 3003 bp, Unknown
  misc_feature (1)..( 3003): 2750-1469P.txt file - cDNA_ID_1989455; gDNA_ID_1971793; Annot_ID_58048
aaaactattttagttgcgtaaacaaagttaatatatgagaaccatatttaaccaaattcatgttagcttcttatgcatgtaattgttattaattaattgatgaagcaaacaatgaattagtgatatgattatggagaattatataattttcgtgaatgacgatgtaagaattaaagataatgatctatgcatatacatggttatatataaaatttgagttatattgttttttttagtaggataagatgagaacaatttgaattataatggtgaggcagaggttcaatatttatttgattataaagaagctaacatttgcaaatacaataaacaaataacaaaatctaactctttgactatttaattgattagaaagaacactaaaaattaaaatcatataatttaaatgtaggattatatatcggtaaatatatagtcacaatattttataaacataaattatcatgcagtgtattcagggctggtccgacatgtttaaatgccttacgcaaataaaaacaaattatgccatataatattttttttacaaaataacaaatgatatatagtaatatatgaaggtcctactaaaattgtagagagatttgcaaaagttcaatttttctactaccttttgcaataataccctttctttttgaccatttttaaaaatatccttttatttgaacaaaatgaccaaattacctatcatctaatgagaacatgtaatttgaaactgaaattttcccgcaaaaaaaagaatgagaattttttttcgaatttattttggcggaaaaattatatttggaatattttaggtgggaaaaatcaatagttcactttgtaaacctaaaacattttcaaaatagggataacatgttcattaaaagttaaaagagggtataaatgaaaatggtcaagaggaagaggcataattaaaacaggacagtcttgaaagagcattcttattaatttctcaaaattctatacaacatattttaatttcataaaaagtctatgagtaaaaacattagtttttaaatatagctctattttagatttttgcctgcaaaatcattgatcagactcatgtaatcgagcttttcaactataatttttttaatggatagcaaagccaacacatttacttgattaattattttttattttaaatcaaaatctaggcaccataccttacaatgtcttctatttgcaagcaatttaatgtttaacttttagaaaacacaatatatcactaaactatatccattaacaatatatttaattaacttttttattaatttaaaggcttaaattccacaaaatatggtgaaaagaaagctcaacaaaaaataaatttattgtaaagacctataatatttttattaaaatataaaagacttaaaagaaattctaaaatatacttttttttttgatgtcctaaaccatgacttcactaaatgaagttgatttgctgacggtgcaaaaaaggaaccatggctctttaacaactggtttgttgctactcatagatgggaggctgctcctattttgacttttgtcactactattgatctttgggtgcagattcgtggagttcctcttctatatgtgtgtgaagagactactttggagatagctcaagaattgggagagatcatcatgatggattatcatgatgctacctcaactcaaatagtctatattagagtaagggttcgttttggtatcactcacaaactcagatttttccagaggatcatctttgaatatggtgaaactgcaatcataagattccagtatgaacgtctcaagcgaatatgtagcatgtgtttctggtttactcagagactattgtccctatcgtcagtgtcctcacaacatagcaagagaaagggctctcttccgagatagtgttttcagatcaagtttgaattctcagtctcatatgacttagactttgtttccagctcccttgacaccgcctccaagagtagctcctcctccgctgaatcatgaagaattggcggctgcaattccatattttgccacaacaagagatgctcataacatatatggtgggagtctagtactacaagacaacaagggtcatcaaactctaacaacactccaccacgagaagcggcaaacttatctggtagtagcagagtctatgaagttggtcaatcatcaagaaggaatgaagctggagaagtacgaagagctgtaggggatccacgacttcagactcatcaacaaggtgctccaaggatgggaggaattctgaaacctccgaagaaaagataatcactctaaaaagaattatgtcataactttttgtttaaagactgcagtggaacaagtatcgtagcttcaaggcttgaataacaacacatagtttcagtatggtttttgtttaggacatacccttggcttggttatgtttgatgtttggtgtttcagtttaaatttctactaaacaatgttttttgttctgtttaccttaatcttgtaagtggaaagtccactgttacactttttgtaagatcacagtggtatgaaaaacaacttttcaggaaaaaagaccatgactttacttaaattttaattgttttataatttaaaaattaaatatattgctaattaccatttacccactcccgttcaagttctctttctttttgacacttattttttctacaccaaccagttagccacccaggttcataggcgaagcatcatgaaatttgatttaaaccattaaaccggtaattgcaaaactttccggtttagttctttcttacagaccaaaaacaaatcaattaaccgtaattgcaaaccaatccggttaaaatccaaaaacaacaccaccctcttcgaaaatcgttgagagtcctttttcacttcttcagatttctagggttcgctcaaacaaacgaagagaaactcaaattctgtaatctatagattttggaaatttccagatcggaaccctaaacgatg

SEQ ID NO: 21570 - DNA, 3003 bp, Unknown; identical to SEQ ID NO: 21569
  misc_feature (1)..( 3003): 2750-1469P.txt file - cDNA_ID_1989455; gDNA_ID_2926143; Annot_ID_139018

SEQ ID NO: 21571 - DNA, 3000 bp, Unknown; identical to SEQ ID NO: 8357
  misc_feature (1)..( 3000): 2750-1469P.txt file - cDNA_ID_1989457; gDNA_ID_2926143; Annot_ID_197560

SEQ ID NO: 21572 - DNA, 3000 bp, Unknown; identical to SEQ ID NO: 8357
  misc_feature (1)..( 3000): 2750-1469P.txt file - cDNA_ID_1989457; gDNA_ID_1971793; Annot_ID_58046

SEQ ID NO: 21573 - DNA, 3000 bp, Unknown; identical to SEQ ID NO: 8357
  misc_feature (1)..( 3000): 2750-1469P.txt file - cDNA_ID_1989457; gDNA_ID_2926143; Annot_ID_139016

SEQ ID NO: 21574 - DNA, 3000 bp, Unknown; identical to SEQ ID NO: 8357
  misc_feature (1)..( 3000): 2750-1469P.txt file - cDNA_ID_1989457; gDNA_ID_1971781; Annot_ID_175405

SEQ ID NO: 21575 - DNA, 3000 bp, Unknown; identical to SEQ ID NO: 8357
  misc_feature (1)..( 3000): 2750-1469P.txt file - cDNA_ID_1989457; gDNA_ID_1971793; Annot_ID_175586

SEQ ID NO: 21576 - DNA, 3003 bp, Unknown
  misc_feature (1)..( 3003): 2750-1469P.txt file - cDNA_ID_1989467; gDNA_ID_1971801; Annot_ID_58077
gccaatcaaagatcccacttatttgcgttttttactgttggcagatagtgtaagtcactgtatccactatcctctcaccttttggtgttacaacttgtaacttacaagtccagtgcatgcaggacaatgagactatcacacatccaatattagattagacccacatgctgagatccatcagtcataccaatttttttagaaagtagaatcctgacctgtaacaacctcagtggctgtgccttggggattactttactttattgagtggtatactcttcgtggatcacagaatgcagaatagacgagaatgaaagtcttcaagcctggctatagattgacactcactgtctacttctgcacttgcttccaccgtttctgcattttttcactttaccagccaagaaagcaaatacaaaagaacaaaaaaacaaaaaaacaaaaagtttattatgaagacaagaacaaaacccttacactcgtccaagaactaatccgatcattaagagccaaaattcgattgtttatctaaagacaaatctctcagagcggattcttcactttctcaagatgtacaaggaaacaatattctcaagctcaaaacaacctgagaaagtggtgaccagcttacatctaacattaattcaatgagatcctggttcattggtgaaacaaacttgaaactactaggaaggtttcaatcgaatgaaaacattaaattagatgtgaaccatatggcaccctatgaatccagattgtcaacaagttaactttatacacacagacaaatatgacaacgatagacagtttttactttttaataaaacagaggcaagaagatgagcatatgctagtggtggggcgtgtcattcttagattctcgggtggaacataggtttgaccagcaaaatggtgaggccaattattgggctcagtaggttggtatgggtttaaccattttcagcctatataaggtttaccttgccatattacttcaaaattattcaaaatcaacacaaatactcaatccattcttgttttatcacaaatcagatgatcttactactgtgttctaggctgaatttatgcgaataaaaatgtaccttccttcagctttcacaatgcatgaagatagatatgaaatttgtaaaactatggatcttttgatacaatcctggacaacaaattcataaaccaataatcattggaagagattaaaaaggggacataggaagaggttgtgacttacggatttacatcttgggtctgccaccgaaatgcttcaaagaaaatctggagggaccactgcgacactcgggtccttttctggaaactccccaacgtccagcatatggcaaccatcctttaattaagttaactagtctggattctgctgccggtaactcgtcttgtgctcctggataacacttctcagctacatcatccacaccgttctggttttggttttgtatttggatttcgttgacaatggatgacacatccaacctaccatacaaggattctttagcagagcattgaaatgcagagacgatataggaagattgttacaaagtacttactcgaggtaccgcttgcaactcgggctcttggatcttttgttcataggagagtggtctatcgacaaatgccttacgaaatgtaactgaaatagagtgaaagggatgttaagactttcaaaggaatgagattgcgtgcatacgattcttatatagaagtgagaaggagtttaacgaacttggtctccatcattgagaccgagataacggatgctagtcttgtcattgactaatctctggtctcgataacacaagcaaaaatgaccccagacgtgagacctgtaggcaaagatcaaagtgaacgactgtaccagaaagcttaagctgtgagaattttcatatgaaatgatgatataccatgaaatcatgccgtgaccttccagaggagaaatggtgaatacttgttccacagctcttttgagctctgccactgagcaatcctttgcaacttccacatctattgattcgttggaaaccatttaacttcttgagaggccaaatcagaaacagtaaccaaaaaactagttgatacttcatccaaaattatgtctattaaggctcttaaacaatgatttctaacagcaacaaaaaattccggattagagatcgattagggtatcaccaactgagggaaccgttgagcttgattgtaaactaaactcttaaaattgctatttcggaaactggataagcaaaatcgtaccgaaaagggagccgttgagcttaacgacggaaagcttgatacgaccctgaggaggaagtttcaggtaggaagatctccgtccagaaatcgaaccaccgtcgtttaaagcaaacgatgacaagaagcgtggatctatcaacgacctcagtcctccacttcgacgaccgtccctaaccggactatgctcttctcgcattgccgattctcccggattttcaccgacaagattctgctctctttgctcttcttcttcagccttcaggtgactgttgaggagctgagcgagcgagcgagagaatcgggagagtttgttttccggggaaaaaccgcaattactgctatatagctccccaataaatgccaaaacaaaaaatcaaattaaagtttgtcaatgggcatcacggcccaaatctaataatcaaaggcccaataacttgattcgacaatacttagcgggtttggataaccgcctaagcatctgttcgacaccgcctattttttttttttacttactcctcctgatctgctgatataaggccgaacgggaataaaaaaaaaaaaaaaggaagaagcgactcacccgaaaatgttttagggtttttctttactcgattaagctcactagttcttcgcaacgtagttagagatcgacactggcgcggtggatttagggtttttttcctccgcgactacgctcggcgtttcgatttggaaccctaagctatg

SEQ ID NO: 21577 - DNA, 3000 bp, Unknown; identical to SEQ ID NO: 8430
  misc_feature (1)..( 3000): 2750-1469P.txt file - cDNA_ID_1989468; gDNA_ID_1971801; Annot_ID_58076

SEQ ID NO: 21578 - DNA, 3003 bp, Unknown
  misc_feature (1)..( 3003): 2750-1469P.txt file - cDNA_ID_1989472; gDNA_ID_1971801; Annot_ID_58071
gtttttactcgattcttattttttgacaggacattgctgtagaggcacaaaatgaatctaaatggaagcaacttggagaattagctatgtcaagtgggaaggtgaccattttttagctgcaatcagtgttctaggattcttacaaaggttaaagctaacatgtatttttcttttcattttccttcccatgcttggactacttagctggatatggctgaggaatgcatgaggcatgctatggatttgagtggtctgctgctgctttattcttcattgggagatgcagatggaatgatgaagctggcagcacttgcaaaagagcaaggaaagaacaatgtcgcttttctttgcttgttcatgttgggtcaagtagaagactgcctgcatctgttggtggaaaggtacattgtttactatttcttacatgtggaacatatattcccgcaactaattacgtctatgctgatattaatatggttacagtaatcgaatacctgaagccgctctgatggcgagatcgtaccttccaagcaaggtctccgaaatagtggcattgtggagaaacgatttgaccaaggttagtggtagacacatccgatgcaccttgtgattgaatttcaaaccttgcctgttgagatatccacaatttttcttcatcctctgtcaatctggatatagataagtccaaaggctgctgaatctctggctgatcccgaagagtatcccaatctctttgaggagtggcaagtcgccctgtcccttgaaaatagagctgcagagacgaggtatcttttcgtcgttgccgtcattagcttattcttaaaaacagtgcttatgaggaaacctttttaattgaattgtgggacttaagccatttagagtcatgtgtctgtattacatagcaaggtagccgtcatgtatttgcttataatttgaatttatacccgtataaacataagccgaatgtcgatttcattttttcaggatcctcataaacaaagtatttttgttgacttatcttgcaggggcgtccatcctcctgctggggattattgtagtcatgcagacagagatcatacaactttagtggatgcttttagaattatgcaaatagaggaagagggtcgacttgagcaaggggatgttctcgacgaggtatgcatgtttacattacatgcattgaagaggattgtcttttacccatgatatccaatccaatggtcttggccatggtggacaatggtaggatcattaattctactgtcgctgcttcatttgttgtgaacaggttggggaagagggggaagatggagaggaagaggaggaggaggatcgtcaggaagagagtagtgatgggagacagcagaatgtggaagaagaggctgttgtggtggacgctgactctacggatggtgctgtgctagttaatggtaacgagtctgaagaacagtggggtaagattagtgaaggaaccgcatcagccttatagcatttgtggttatcaattgattataagatgtcgctgcaccaaaatatccttttgccatctgcacatatatcataggatttgcgtttgcatctgtccatcaatgtttcctcatctgtctgcctcccatcttcgtcttactgatcatcttacttttgatgttgactgtcttttaaatagtgcttctctatgccattaacttttttatcaatccgtggactgattaaatatttgtttgttgtacagttctaacaccgccacaagagtagggttggtgaagagtgaagacatacacagatagatattttcttggctttgaaacttgatacattcagcagagaaatgaggcagcacagagagagattagtttccattgttaaaaaactgatctattgatagcttccgctttgtgcttttaatacagatacatattaaaaaaaaagggggttttgggactcttatgtagctttaacttatgagagatttcacctgtagaatatctgttttgaactgagatttcacccatataatatgttttgactttcgattcaataggttatgtagttgatatcttttttttttttgcaaaactcaatagcagtagcaaaaaacttaattggaaataatcaaagtgaagggataagttgggaaagagccagaggataacgcatggtgcattattattagtattgtggaggagacgcatctcgaaacatctctcaaagcaaacaaggacccaaaacaaagttccttgcattcttccactgtccgtaatcaccatcaccatatcattattcttctacccattttgtcttggaaatgattttaaattttcttgttgcttcttactgcaaactgtgtataggttcaactactccattgagttacacacttgcatgcacctatggaagttaattttccggttttgattgatattcaagttgttgaccaatggagttatatacccttgatttatatagaaaccacatgttttatttatattaacatggtcacttttgtcaggattaatagacaacaatagttgagagaaaaagtgataaggtagagctaatttgtattaaacttatcaattagtattgttggttaaaaaaaagttaataaagtagtcaagttggataattcccaaaaactgggaaaaaagaactcaagcgtcaaatgttgtaggtgcatcatcatcagtctacaagtagtaaaaaacccattcgatttgataagaagacccaacggaaagagtcttcccgtctacaaagtaaacccaatcaatcttaataatctttaagaggttttttcttattataattatctatctctctatctatctatctgcggatctctcatgaagaaacactgaggagattctctcgctctgatctcctggtatcgtcgtctctctccgtagagatatactagtttgtcccatatccgattgattgctctattcaatttattcctcttctaggttttcggtttggccctccgatttagagggattgatg

SEQ ID NO: 21579 - DNA, 3003 bp, Unknown; identical to SEQ ID NO: 21578
  misc_feature (1)..( 3003): 2750-1469P.txt file - cDNA_ID_1989472; gDNA_ID_1971801; Annot_ID_175689

SEQ ID NO: 21580 - DNA, 3003 bp, Unknown
  misc_feature (1)..( 3003): 2750-1469P.txt file - cDNA_ID_1989473; gDNA_ID_1971801; Annot_ID_58070
ccttgattttggagtctttggtggcctctttagccccaggtcttcttcttcttcacccctccaccgaaacaaatggctttctcacaaagtcgggctttctcttctgagctccagcttcgaactaggcgatgatccattcagaagggactacattgtgcttgcccctcaggtcaaggtcaacaatgttaatacagcaactcccaagctttccagtgatccttgtgtcattgtggaggaaccaaggagatcaagctcatcatcccctatggatatcatctccacgtactctcgctccctctctgggcgtgagatggctctctctgaggactatacctgtataatttctcatggaccaaacccaaaaacaacttatatatttggcgattgcatcctggattgtgaccccaaggacttgggaaaagaagatattgagatacacgaagaaggggatgattcttttagcacagaaaaacctcaaaatcacaggttcttctggctccaacttacaaagcagcattgagtggtctttttaaccttgaactaattacatctctgacattttatttccgtgaatgaacaatagggaagtatcagcagaaaaggaaagtgagaacgctggtgctgaagaatcatgttacgaagaggaggatctgtttcctatggcaatgcctcttaacccgtaatgagatggccagagtgaagggggtttattgtgtgggcctctccctctttgagtgtgacatttagtgttgtaaggttaggtgtggggatttttgtgtgctcaataaaaagctttgattcgggtgagttttgctgtggcctgatgccccggctcatcccttttcttcgtcttgttttttttttcttcttactttgtatgattgcgttgttactactgatcctcatttgatggacacacttgtgttttctctctatatcaattgttttagtggctcacgttgctgaataaaaatggatattatcgatagggcatcttttattctattttgggatacaagaatgattgaaacacaatattggaaagaaaagctaagttgcaaaaaaaaaagaaaaaggaaaaaaagtcgaccacagtgggagtcgaacccacgaccttttgatccgaagtcaaacgcgctaatccactgcgctatgcggtcattcttgttacttatatcatgaacaacatggtaagccaaaacttcttctttcctctttcttctttctgttttctggtcgctcgttaccaccaagacctcgtcgaggtttctctctctctgaaaaagtgcttttgctgcgtttccatgctctcggaaggaacttggctgaatcgttggagaattatcgatctggcgtcgttggtgcatctctagctgcgccaattcatcggatccggtttgatttctccctttcgcgaatctagccttccgtgatcttaggtgggttttccgaattgatctgtaattgaggatgtaaatcgaaactagggatttcctagatctcgttagctgtgtatttgattattgcagcagagtttttgtttaggtagagatatagggaattttgatatagggacacttaaattttggtgtatcaatttgctgcagcagccatgttctatggcacagctgtatgggacccttggcttatcgttggccagattatttgcctccaatgctcttactatctcactcttggactcttcaccatggtctttcttggccttcgtgttcctcgccttagtcttgtctacttcttcgattacgctactctcactacttccaccttcaccggttggtctgttattgcctcattcctcttctcttcactcgctgggtattttgctttgccccctagtaatagtatccatccatttatttccctctttattactagtcttttcagattccttgtattcattttaattggcagggctgtgtacatgatatttttggtggagcgagcacggaaatgcttagatttctctgcaactctctacatcatacatctcttcttttgcatcatgtatggaggatggccttcctctatggcgtggtgggttgttaatggaaccggactcgctgttatggctttgctagctgagtacttgtgcattaaacgcgaacagcgagagatccctatggatcgcttccactcaagtaagatgatcattctttcttgaaatctctctgtgtgaacaagcatatctttaccttttactttctcaagactgacttaacatgaaattaaatttggctgcctatgctgctgctgcaggggtttgaagattggtgaaagaacaagtgatgaagattcttgtgggttagcagcgcgactcgtagagcctagtagagcctagtactcttaacaattgtgatgtacagagatgaaatcagaggagtagaatgggcgaaaggaagttcagctagccaagcaacaatgttggacactggtgcaccaactctgactgcaatttttagtgacttcaaatactaagactttggaatacgtttcaatttgttcttttgtatgaaaaaaacattagactcgaataggttattgatttcatgttgcttcttttttttgtttatactggattttctcttctatcctctacttggtgcagctttgtgtgttttaaaaccagtgtctcattcatcatactcttttaccaccaattgaatccttccaatttactgttttttgggggggaaaattactgtgtactaacaagtaaaaagggccgtccgtcaaaatgtaacatctcctatatacggtgcggtcaagttaaaaaaaagagcaaaaacgcgtgataaaacgacgtcgaattagagatcctactagacccagattcagatccaaatcgccaacgcgcactggaagtgggatcaccaccactgcgcttcttcttcttcgtcatctctgatcccccctgcgatcaggggccatttccgtcgataatccgatctccggttcagacattcgtttggacttgcaaagatg

SEQ ID NO: 21581 - DNA, 3003 bp, Unknown
  misc_feature (1)..( 3003): 2750-1469P.txt file - cDNA_ID_1989476; gDNA_ID_1971801; Annot_ID_58065
aacaaggcaattctcgtttccaaaatcaaacccgactacactcattgtcaggctgtgttattcaataatactgggggctcccaagtatttgatagcaaccttctcagatcaataaaagcaaaaaaaataagtatcagatgaacaaggatggaatatcaatgaaagcagactaggagaagactaattggtgttaacacaggtcagataactagtcttattactgaacctaaatcaaatcaacattttagattacaatcaccaatacgggagaacacgcgagccattcatacaaatagatcaaacctaaaaatcaaatctacgaaaaaatagaagaggagcttcagatctggaagatctgggaataaagattgggaaacatacctggatcgcgagaggggtttaaagttatggaagcttgaacccaaatctgggttttatcgtcgtagagagaaaacgaagagcaggagaggttgtcgtaaggaagagacaagagagcgagaggggtttattaagaagcccccagggttgcgttcctctctacttttccttttttcttttcacactttcttttcctttttttttttaattactacttttatgtccttttcttctaatactatatcttatgatatttatttttgcctctctttcataatttacgtaaacaaatcgagtctacaaataaaaattatcaaaaccaaattaatacatttgcgtaaagctcttccgtccaaaaccaaattatttataagttgaaagattatacaactaactttgtatgcgttaatgataaacaacaataataattctaaactatttgaaaaatattattagctagtaaatgatttctgagttggattttttcgagataatgtcactgtttactggcatttcaatcctactgttgcaaaccttattttgtgaaatattcttagtgtggacaaaaatcttggatcgtaatcatctagtacagtactttctaatcgtcaattagattgaagaactatattaaatgtttacatatatttttggtatcacttgcttctttatttgcatctttcctacctgatcttaagtttactcggtttaaaactactgtatatagcaaacttgcaatgacatgcaatatgctatgattgttttcttttgttataaatgttaatatcatatataaaatgaaagaaatgtattacaaaagagcattaacctaatcaccagattgcgaaaaccttttagatgtcttcttgaagatatggtattgcaaatttcacggtcaaaattcttgaaaatgatcgaagaaagcagtgactgtgaattatgtaagacattatttacttgttttcaaatgtggtaaactccaccgtgtgctgccatttttttgagagtggaaggaacatttggtgaacgagtttttgtccaagagagaagctcaaactatgtggaaggcatatgcgtgtgctgccagtttcttgagagtggtaggaacatttggtgaacgagtttttgtccaagagaaaagctcaaaccatgtggaaagcatattcgtgtgctgccagtttcttgagagtggtaagaacatttggtgaacaaaagctcaaactatgtggaaggcatatgatgcgagaaatgcttaaccgagaaaaaaattagcctccaaatctcacaagcaaaatctcaagttaataagcattttagcagtggtgtctatgtacaacaatatcataatatgaaagccagtaataaaatttaaatggtatgaaaaacgataatagctatataataacattttctttgtttttaatatctatattttgttttagttatatataatattaacatgtcaacaaagttttcaaataactgattatttaatataatcaaaacaagtaaaattatacgatatttggctagatttaaaacgactattttagtgaatcgaataaccaaatcataccaaactcattcaaaatcattattagctttcgttacagtagataaaaaagtattggtaaccatgctcttataaatttaattgaattagacagtttatgattaaatcgataataataacgaagattgatgtattttgcaagtagaacaatttatttctggtcgaaatataaatagttacaacaaaacagttttcttaaaatcattaaatatttgttttgtttaaatctctattttgttgtaactatttacaatctctagatcacattaaatctctagaacatataagagatttgttgcaatccctattacaatatctggatcacattaaatctctagagcatataatccctctttgatccatatccttttctctttttcctttctaatttataaaaaatgtgattttttttgggaaattcgttttcgttcaccataaaaactttgctattaataattactctaatttaatggaaaataaataactcgtaaaaatgtaaagagagaaatgaattgcgaaatattttaattgagaaggtaaagaaaagtgaataagcaagtaaagaagaaagaactcaccaatcagaaatcagaaattagaagagaagagaagcataaagaaaaaaaaactgcaacgccgtttgttgccgatctgcagcagcgcgatctctctgattatagagagctatcatcctaggtgagcttcttcttcgatttcctcttctacaatatcctttcaagttcgatttcatcttctttcaccaattattggttttgcttccttcccgtagtttcgtttgtttgttttctaaggttttgtgtcgatctcaaagtgagtccagggattcatatacctttagactagattagccgagatctattagtgttgatctccgtcatgtagaatccctaattaatttcagtggcctcagatccagcttttcatgttattgataattttgtatccttgaagctttttggatgttgtgagattataacagagcttttcctttcagcagaatagaatctctcagtttaaaggctccaaagatg

SEQ ID NO: 21582 - DNA, 3003 bp, Unknown
  misc_feature (1)..( 3003): 2750-1469P.txt file - cDNA_ID_1989476; gDNA_ID_26992; Annot_ID_146587
aacaaggcaattctcgtttccaaaatcaaacccgactacactcattgtcaggctgtgttattcaataatactgggggctcccaagtatttgatagcaaccttctcagatcaataaaagcaaaaaaaataagtatcagatgaacaaggatggaatatcaatgaaagcagactaggagaagactaattggtgttaacacaggtcagataactagtcttattactgaacctaaatcaaatcaacattttagattacaatcaccaatacgggagaacacgcgagccattcatacaaatagatcaaacctaaaaatcaaatctacgaaaaaatagaagaggagcttcagatctggaagatctgggaataaagattgggaaacatacctggatcgcgagaggggtttaaagttatggaagcttgaacccaaatctgggttttatcgtcgtagagagaaaacgaagagcaggagaggttgtcgtaaggaagagacaagagagcgagaggggtttattaagaagcccccagggttgcgttcctctctacttttccttttttcttttcacactttcttttcctttttttttttaattactacttttatgyccttttcttctaatmctatatcttatgatatttattttkgcctctctttcataatttacgtaaacaaatcgagtctacaaataaaaattatcaaaaccaaattaatacatttgcgtaaagctcttccgtccaaaaccaaattatttataagttgaaagattatacaactaactttgtatgcgttaatgataaacaacaataataattctaaactatttgaaaaatattattagctagtaaatgatttctgagttggattttttcgagataatgtcactgtttactggcatttcaatcctactgttgcaaaccttattttgtgaaatattcttagtgtggacaaaaatcttggatcgtaatcatctagtacagtactttctaatcgtcaattagattgaagaactatattaaatgtttacatatatttttggtatcacttgcttctttatttgcatctttcctacctgatcttaagtttactcggtttaaaactactgtatatagcaaacttgcaatgacatgcaatatgctatgattgttttcttttgttataaatgttaatatcatatataaaatgaaagaaatgtattacaaaagagcattaacctaatcaccagattgcgaaaaccttttagatgtcttcttgaagatatggtattgcaaatttcacggtcaaaattcttgaaaatgatcgaagaaagcagtgactgtgaattatgtaagacattatttacttgttttcaaatgtggtaaactccaccgtgtgctgccatttttttgagagtggaaggaacatttggtgaacgagtttttgtccaagagagaagctcaaactatgtggaaggcatatgcgtgtgctgccagtttcttgagagtggtaggaacatttggtgaacgagtttttgtccaagagaaaagctcaaaccatgtggaaagcatattcgtgtgctgccagtttcttgagagtggtaagaacatttggtgaacaaaagctcaaactatgtggaaggcatatgatgcgagaaatgcttaaccgagaaaaaaattagcctccaaatctcacaagcaaaatctcaagttaataagcattttagcagtggtgtctatgtacaacaatatcataatatgaaagccagtaataaaatttaaatggtatgaaaaacgataatagctatataataacattttctttgtttttaatatctatattttgttttagttatatataatattaacatgtcaacaaagttttcaaataactgattatttaatataatcaaaacaagtaaaattatacgatatttggctagatttaaaacgactattttagtgaatcgaataaccaaatcataccaaactcattcaaaatcattattagctttcgttacagtagataaaaaagtattggtaaccatgctcttataaatttaattgaattagacagtttatgattaaatcgataataataacgaagattgatgtattttgcaagtagaacaatttatttctggtcgaaatataaatagttacaacaaaacagttttcttaaaatcattaaatatttgttttgtttaaatctctattttgttgtaactatttacaatctctagatcacattaaatctctagaacatataagagatttgttgcaatccctattacaatatctggatcacattaaatctctagagcatataatccctctttgatccatatccttttctctttttcctttctaatttataaaaaatgtgattttttttgggaaattcgttttcgttcaccataaaaactttgctattaataattactctaatttaatggaaaataaataactcgtaaaaatgtaaagagagaaatgaattgcgaaatattttaattgagaaggtaaagaaaagtgaataagcaagtaaagaagaaagaactcaccaatcagaaatcagaaattagaagagaagagaagcataaagaaaaaaaaactgcaacgccgtttgttgccgatctgcagcagcgcgatctctctgattatagagagctatcatcctaggtgagcttcttcttcgatttcctcttctacaatatcctttcaagttcgatttcatcttctttcaccaattattggttttgcttccttcccgtagtttcgtttgtttgttttctaaggttttgtgtcgatctcaaagtgagtccagggattcatatacctttagactagattagccgagatctattagtgttgatctccgtcatgtagaatccctaattaatttcagtggcctcagatccagcttttcatgttattgataattttgtatccttgaagctttttggatgttgtgagattataacagagcttttcctttcagcagaatagaatctctcagtttaaaggctccaaagatg

SEQ ID NO: 21583 - DNA, 3000 bp, Unknown; identical to SEQ ID NO: 8424
  misc_feature (1)..( 3000): 2750-1469P.txt file - cDNA_ID_1989477; gDNA_ID_1971801; Annot_ID_58064

SEQ ID NO: 21584 - DNA, 3000 bp, Unknown
  misc_feature (1)..( 3000): 2750-1469P.txt file - cDNA_ID_1989477; gDNA_ID_26992; Annot_ID_146586
aaaaatgggaaacaatgcgctattctcttctgacgccgccatctttggagcctttaaactgagagattctattctgctgaaaggaaaagctctgttataatctcacaacatccaaaaagcttcaaggatacaaaattatcaataacatgaaaagctggatctgaggccactgaaattaattagggattctacatgacggagatcaacactaatagatctcggctaatctagtctaaaggtatatgaatccctggactcactttgagatcgacacaaaaccttagaaaacaaacaaacgaaactacgggaaggaagcaaaaccaataattggtgaaagaagatgaaatcgaacttgaaaggatattgtagaagaggaaatcgaagaagaagctcacctaggatgatagctctctataatcagagagatcgcgctgctgcagatcggcaacaaacggcgttgcagtttttttttctttatgcttctcttctcttctaatttctgatttctgattggtgagttctttcttctttacttgcttattcacttttctttaccttctcaattaaaatatttcgcaattcatttctctctttacatttttacgagttatttattttccattaaattagagtaattattaatagcaaagtttttatggtgaacgaaaacgaatttcccaaaaaaaatcacattttttataaattagaaaggaaaaagagaaaaggatatggatcaaagagggattatatgctctagagatttaatgtgatccagatattgtaatagggattgcaacaaatctcttatatgttctagagatttaatgtgatctagagattgtaaatagttacaacaaaatagagatttaaacaaaacaaatatttaatgattttaagaaaactgttttgttgtaactatttatatttcgaccagaaataaattgttctacttgcaaaatacatcaatcttcgttattattatcgatttaatcataaactgtctaattcaattaaatttataagagcatggttaccaatacttttttatctactgtaacgaaagctaataatgattttgaatgagtttggtatgatttggttattcgattcactaaaatagtcgttttaaatctagccaaatatcgtataattttacttgttttgattatattaaataatcagttatttgaaaactttgttgacatgttaatattatatataactaaaacaaaatatagatattaaaaacaaagaaaatgttattatatagctattatcgtttttcataccatttaaattttattactggctttcatattatgatattgttgtacatagacaccactgctaaaatgcttattaacttgagattttgcttgtgagatttggaggctaatttttttctcggttaagcatttctcgcatcatatgccttccacatagtttgagcttttgttcaccaaatgttcttaccactctcaagaaactggcagcacacgaatatgctttccacatggtttgagcttttctcttggacaaaaactcgttcaccaaatgttcctaccactctcaagaaactggcagcacacgcatatgccttccacatagtttgagcttctctcttggacaaaaactcgttcaccaaatgttccttccactctcaaaaaaatggcagcacacggtggagtttaccacatttgaaaacaagtaaataatgtcttacataattcacagtcactgctttcttcgatcattttcaagaattttgaccgtgaaatttgcaataccatatcttcaagaagacatctaaaaggttttcgcaatctggtgattaggttaatgctcttttgtaatacatttctttcattttatatatgatattaacatttataacaaaagaaaacaatcatagcatattgcatgtcattgcaagtttgctatatacagtagttttaaaccgagtaaacttaagatcaggtaggaaagatgcaaataaagaagcaagtgataccaaaaatatatgtaaacatttaatatagttcttcaatctaattgacgattagaaagtactgtactagatgattacgatccaagatttttgtccacactaagaatatttcacaaaataaggtttgcaacagtaggattgaaatgccagtaaacagtgacattatctcgaaaaaatccaactcagaaatcatttactagctaataatatttttcaaatagtttagaattattattgttgtttatcattaacgcatacaaagttagttgtataatctttcaacttataaataatttggttttggacggaagagctttacgcaaatgtattaatttggttttgataatttttatttgtagactcgatttgtttacgtaaattatgaaagagaggcmaaaataaatatcataagatatagkattagaagaaaaggrcataaaagtagtaattaaaaaaaaaaaggaaaagaaagtgtgaaaagaaaaaaggaaaagtagagaggaacgcaaccctgggggcttcttaataaacccctctcgctctcttgtctcttccttacgacaacctctcctgctcttcgttttctctctacgacgataaaacccagatttgggttcaagcttccataactttaaacccctctcgcgatccaggtatgtttcccaatctttattcccagatcttccagatctgaagctcctcttctattttttcgtagatttgatttttaggtttgatctatttgtatgaatggctcgcgtgttctcccgtattggtgattgtaatctaaaatgttgatttgatttaggttcagtaataagactagttatctgacctgtgttaacaccaattagtcttctcctagtctgctttcattgatattccatccttgttcatctgatacttattttttttgcttttattgatctgagaaggttgctatcaaatacttgggagcccccagtattattgaataacacagcctgacaatg

SEQ ID NO: 21585 - DNA, 3003 bp, Unknown
  misc_feature (1)..( 3003): 2750-1469P.txt file - cDNA_ID_1989478; gDNA_ID_1971801; Annot_ID_58093
aacacgcttcttcacagcagtatccgctggaacaaacacaaatcaaccccatcgtcatatttttgtttaaaactacagaaccaggttacacaattccaaaacgtagtagtatcgtatatgtcaaatccagagaccaaacccattcaaaatcaaagacaagcacacaataaatcatcaaatagcaatctggatctgtaaattacctgcagcggagccgattaaacgagagaatatggaggaatatgcgggaatggaggatgcacgagtcgagagagaaaggtgagtggactctacgacggcgtgcctgcacgacggagccgcgcaggacccgacggcggagatggatttaagatgcgatgaaacgattctcctccacataatggtctcgattcttcgggaaaattaggtttgtcgtttccgatctcagatgattctcagtctccgactacctccttcaaacggaaatgaattgaataaattgaagattgaacaagacttcgactttttggcgacggcctgttgggcctggatcatgcgacttgttgacccattatctaatttgaaacaaaaatcaaaatcaatatgtaacaagattaaagtaaaaacttctgtcgatgattaaataaatttttgtaggatatatattttcttaaaaattaattaacgcatatgatctaatactatctcttattagattttattggctcgtaaagttgagttaagacttctcagaagaaaaaatgaaactccgttatatataatatatgttgaaacggtgattaactagttaataaattttgtgggactagttcgtaaattacatttttattatgtaacatgaattacaattatccattaatgtagtatattcaaccgaatgagtcaacgaccccaactttcatcctcggagtttcccaaccgctaccagcctaacatcatcgatcaccggaccacatagcgagccagagtgatcgcttttcatgtggtaaaacgtgctcaagaaagtgacacgtgtcctggccgacactgccttgaacacaagcctcccacgtctaaacccgccttttcctttagaagcgtagtccaccatgaccttgccctgtccagcgaacgcttccacaatcattggtccctcacaaccgtctctggcgtctcccacgttgaacgtgagggcgtagaatttgttcagtgacgtcctcactatctgagaaatggcgctctctttgcctccaacaagctcgatggctcggtgtccttcggggacagcgaagtgtgctttgtctacgtacttaacggctttgagagactcgatcatccaaccgggcaatgggctgttatcgtcctcgatgaacggtgggatcagtactccccattttgccgtgggaaacacgtaaggtccttcttcgaaattcccattctttatcagattatctgcaaacagaggtcaccacttaatcaccgaatccggtttactctaaaagattaaaagatatgaatatggtcggttccggtttacttacatccagagaatctgggagggaacaaagccttgatagccacggcgtcgatcaaaggtccgcaagccgggtgctcttcaacaccagggttatggaaccggatctcgatttcgggaccaccagctttaaaagcccatgagtatgagtcccaaccatcgctgccgtacatcgtctggatagggatcacacctgactcatgcgtcacggatatattgagcctctcgtcttgagcgcaggttcgagcggcgctgaacgttattgagtacagacggccaggtaggacggatattttctgggagattgaggcttcgttgcctagtctaacggcggaggaaccctgcggtacgaccaagaccatgtcatcttgtttctgaccggatttaatgaactccacaaagccgattatgttccagtttggtacggcggttcgttccttaaccacggatcctttcatttgggagggtttaggacccaactcgaagttgccgtttggtaataaacctgaaacaaaaaatattaagaaatgttaatttataatctcggatttgagttgaaatgagctttaactagagttactaccatcgcggactggggccgataagacgacattcgaagagatgaagaggagagctaagaggagtgctgcttcttggtacatcatgacttccttgggtgatagatgaagatcagatggtgagtactatccaaagggtgaagaaaggctgggtttttatgagtttgagaatagaagacgagcactggttttgaagaaaacaacgggaatgccactggaagcatcctgggttctattgtcaggtgccacgcagacacagacagctagctcaggaaacatttgacttcatgattagcatttccatttcttcaatgtattgtttaaggggctgccttaacaaccattatattaaactatatattcaaacgtaatttgcgtttgcctatctaaattattcacataaattttcaaagtattaaaatattttttggctttttcagaaaaacatttttgaagatcagtacatccatgcgtaaacgccaaaaaagttctttttgaaaaaaggtttacgggtaagtattccttaaaaagtgattaatctggaaaaaacatacacactaattaatataaatatatagggtacgtaacaactaatgcaaacaaacaacggaaaactaaaatatgtagagaaaaaaacatatatatcatcaccactcaactataatgccatggttttggaaaatgaaagaaatataatgtatatttgagatgtctctaagattagtcatttaacgccatgcaactcatcccaactctaatcaataaaaaataattatgattttcgtatagaatgcgacaaccaaaagttaatgacgggggaaaatatgtgctgttttggaataaatcaactcaacttaaaaatgaagtcaaaaatggtattgattgatgttagatattgatcacattgggatg

SEQ ID NO: 21586 - DNA, 3000 bp, Unknown; identical to SEQ ID NO: 8433
  misc_feature (1)..( 3000): 2750-1469P.txt file - cDNA_ID_1989479; gDNA_ID_1971801; Annot_ID_58092

SEQ ID NO: 21587 - DNA, 3000 bp, Unknown; identical to SEQ ID NO: 8433
  misc_feature (1)..( 3000): 2750-1469P.txt file - cDNA_ID_1989479; gDNA_ID_1971801; Annot_ID_175720

SEQ ID NO: 21588 - DNA, 3003 bp, Unknown
  misc_feature (1)..( 3003): 2750-1469P.txt file - cDNA_ID_1989481; gDNA_ID_1971801; Annot_ID_58089
gatttggacataacacagaagcgagtccgtgagggatttgtatcggctgatgaaaaattaaaatatatttaatcagaaattagagatgagaaaatggcattggtcctttatcctaggaatgaagaatctgatgttgttgcaactaatttgtcagaatgtcaggctcaggtccactttagccgccgcagtcagctgcccagttttgaattcattaagattatcaaatttaattactcgatggattaatcataggagacgaagaagattgttgatcctctgctttaatcttacttggaaatatttggaattctctcgggaaagaaagagagatagaataaaacaagaatatacatgaaaatctaagatcagtctgcaacaaaaacaaaacaaatataaacatatatatagtctctgagtttaaacagttttaacattaaagcacaaacaaaaaaacacaaacaaaaacagaaagaaaaagattcataagaagcagtataagtatatatactctctttttgttttgttttgttttctcatctttgtgtgtgttcttcttctttactttagactttagttcatgcctatctggatctacgcttcgctggccttttcctctgattaaccttcttccccggctgtttcttcccgaaggcagagcagcacccaaacgccgacagtctcggcgacggcgggtccaccgccggagacactctccctgtgtttcgatggtggcggatggctcctcctccgttggatcgactcctctccatacctccgtcagttctgataggtttgagtccttctccggcgataggtttggttgtctgatcctgtacttccgacgtaatcagcttggcctgttcgtcctgttgtagagtctcgcctttccggtcgttggccgcttgttggcttagctcggcgatgagacgatcgtcccagactatacccgaagagccctgtcgacggaaagagatggtggatctctgaagacccgccatggacggcgctaactgttcctcctccgtttttttcttcttcttttactctgttttcgtcgtttttgatgtgtgttgctaaaagtggttcatcattgtgtttcagactagttcatttcttcctcctctttcttatctctttattagaaggcacttgtgtcttttctaattaattttcttttgtcgtcttattatttcaattttatatgttttttttcttctggttctcgaattatccaaccaaatataatcgcgattatcatgtttagatgcgtaatcattgtattttatttgttacgtattttaaacgggagagaaaaaactgggtcaaagcagcgggtaattatgggagtagaatagtacaaacaacgtttttgggtggtatgtgttgaaatttcaattatctttttttttaacattaaatttagctatagccacttaattatctgccaaaaatgattatttttcttttcacgtttcaggcaaagatcatcgcatagcatatagttttatcaaccataatccagcatggcttaattttttttaatatttcttaaggaaatcaagcgttggtgactcgtcgttgttcatgcttgatttggttagttcaaagttgaaacttacaagtattagtagatgactgattcatcgagttttaaaataataatcacgcaaaactcgaacctaatatttcctgaaatataatggctcaactttgagaggtgtggattattttattttgtaagatatcttgctatatggcttgctggaccatcccatttgtgtaatgtggagacaatccattcatgtgctacttttttcatatggacaacaaaatttgcgtgttcatatcgtaattaatccccaattaaatctacatcgcaaatctaatatacccatgcatttcaaatctcgctacaattatggaagtccttgagttgattattgaagcagctaaaacgtaagcatgcgaagaaaacggcatttagctttaaaaatttgatgattgtcagaaagagaaagcaaataattggaaaaataagagcgtcttatccgtaagtgtagatttgatggaacaccaaatattttctatcaattttttttggtgatggttattttggcaaaaccaacatgatcaacgggttttttttttgttaattgttagccatctaaagatatagtgcatataaacaaaacaaaataataagaataaaagaaagtgacacaatgtcaatcgcatcagtaccagtcaaatggatcatccttatcctcagacccaaaagatttacttacattagggagtagtattcggatacatgtacacgcatataacttccaaatgttgaaagatgtataaaaacatgttagacatttaccagtgacttaaaaaaatataagtgatttatggtagtatatatcacactatattatgagtcatgacactcaaattcaaaatccgtttagtacaaaaggttacaagtctagaatcgatttttgtaatttttttagtatatatgacattggtttgactgtgttacaaagtcaaagtaaaatcccaaaaaaagaaagaggaatattttggttctgagaaaagacataaaaaaaacaatagagaaaccttgtaaaatcccgccaaaattttcacagaacccctaaaaaagtttgagtgttgccgccatccatagatttattccaccatcttcatctctggaaatccttcgccgccgcgagaattgacattgttttgattgcatataaatctccgcaacagtatggtacgttttgtttagatctacggttttgttatcatccgttaattcggcgacatcagcaacgatttgcttcatccacaaaccgaataggttcggtttaaacataagcctgggatttgagtcaattatttgcatttgcctacttttttcaattttctgggcacgccagatgtttgatgaattgctcgaatagatagatgtcaaagtgaagcgaggagacccgccgattcgacatg

SEQ ID NO: 21589 - DNA, 3000 bp, Unknown; identical to SEQ ID NO: 8450
  misc_feature (1)..( 3000): 2750-1469P.txt file - cDNA_ID_1989482; gDNA_ID_1971801; Annot_ID_58087

SEQ ID NO: 21590 - DNA, 3003 bp, Unknown
  misc_feature (1)..( 3003): 2750-1469P.txt file - cDNA_ID_1989483; gDNA_ID_1971801; Annot_ID_58085
ctgcgaatcctaaagtcatttttgctgtggttcttggattgagtcaagcaatgtaaaatgcggcgggtgctgattcttgaatcattgatcttcatgctaaacaagacacgttattttttgtgataagagataaaacagagcaacttaatatcatcatacttcttgattaatctttttattaatttgaaatattaacttcgatttaaaaacaaatgcctatttcctttattgctggaaaattcattgaactttcaagaatcagtacacagaatccttggatggcactccgatattagaggaaaattaagtctacaaatgaaatacattcagagaatatatccataaatagatacctaaaaatttaagaaaaccaaacagagtgcatgcatttatatccaatgctgttatgttactaatgtgatatttgaatcaatcccttatgttgtgtgtttatatataccttaagacaatctgaaagtaatccactattcaactctgcttagatcgatccatttctcgttaaaatggtaagactcgttgcctatatctactaacattgaacctgatttttaaaatattaatcctctttttgtacatatgtgtaggattggtttttgatcgtactcgttgcaattttaggatttcccgggttaagctatagtgaatcagtgatgaaatatggagcggtcggggatggaattgtcgatgatacatctgtaagttattggtgtatatatattatatatcagtacaagcagcataattgtttagtcatcatataaaaaaaattaaacttttgcatggtatatgtgggcaaaaaaaaacaaggcgttccaaaaggcgtgggaggatgcttgtaagggaagctccaaaatgggaagtgtaaacgtaccagcagggaaggtgttcctcctcaactcccttcacttcacgggtccttgcatacccaaacctctccttttcattgtaaatccctccaccactttacttgattgatattacatgaatactcgaatatgaacctactcctccaagttaattataaagttacttttgctgatatatgtatatatagatcgatggagagatgatagcgcagagtgatccacagaagtggggaaatggtgagaacggggtaataccatggctcatattcgatcaagtagatggacttgcaatcgtagggcgcggcttgttggacggccaaggcaaatcatggtgggatattcattgtagagaccatcccggacccgtaagtttccttttttttaactttttatttttcttgggttataatgtatcctaacaaaccatctctatgtgataatacattttgtaacctataacgtgtcacagaattgcatctgccttgcaccaacggtaagtttgctatttacaaaaggaagtacgtagtatgtatataataacttggacgtctctataactatagatatatttctcgcagatgatgacatttagcaactgcggaaatgtaacattaaagagtttgagatttagaaatagtgcacaaacacatgttcttgtgatgggaagccaaaatgtgtatatcgatgatatcaaaataacatcaccggaggctagccctaacaccgacggtattcacatcacatcttccaccgccgtttctatcaatcattctgacatcgccactggtatatttccttacctaaccatataaaagatcaaacaaaagtttaatttgtttatttattctcacaattaattaaacaggtgatgattgtgtgtcgatcggagatcaagtgaataatttgaatgttacttttatgaattgcggacctggtcacggtgtgaggtgattaccatctccttatcgacctcgtaatcttatatttttcataataaaaaaatgagaactaataagaaattagagacagcattgggagtttaggtagaggaggaacagaggtaacagtggaaaacatacgtgtgtcgcacgttaacttcactggaacaacaaacggagctcgaatcaagacttggcctggaggaactggttacgtccgaggaatcgagttcttcgatatccgtttctcgtctgtacaaaaccccatcatcattgatcagttctacggttgtgcccctacatgcgttgagactgtgagaacctttttctttctatctttcaagttaatattaaatgtaaatgagctaatgtttgaatgtaatgtatcagatgaagggagttcacatagagaaagtgagatacatgaagatgagtggaacatcggcgacaaaggtggctatgaaactcgagtgttcaggggagagtgttccatgttccaaccttttcatgagagacattgacttatctccggccgatggtattgattctgtctcctctctctgctcttttgctcacggctccgcacaaggcatcattcgacctttatcctgtttctaactattttagtaatttgtaaagttttggggtgtaaattgaattactatgtaaatgcaggggtcatattggaataaacaacaatgttttagttaaaaggcctgtataacaatgcaggcccaaacaaaaagatatgagcccaatagtcactgaaattgttttctcaaacccaaaaaacctaaaaccttaaacctccgtatgtgttccgtcgttagcctcctgctaatctccatctcagatcgcaatttctcccttttccggtcactgctccggcttacgactatagcgttccgagataaagttcggctgtgttaattaaattcgccgtcggagggattttacggatatggctgttgttgaatcgcatggggatttaggttattgtcgattgaggtaaatggatgtcgagggtttgctcaactcttcgctctccttatctttgaagctggttctatagattggttagtagatcttacaaattgcaaagattggagatttgggggatttgaataagctacatgttattcgggtatgtttaggctcgagggaggccctggatcatg

SEQ ID NO: 21591 - DNA, 3003 bp, Unknown
  misc_feature (1)..( 3003): 2750-1469P.txt file - cDNA_ID_1989485; gDNA_ID_1971801; Annot_ID_58082
ggccttgaatattgtttggggacatgagcaaagatactggcactggatctctctccctaacaccaggtctcctttttttctgtgttacaaactagacttcctcttctgcattgctttattataagatactaaatgtttttgtgtgcacaaacaaacaggttcggagaagtggctgagctcatcatggtctggtggcttgagatcactggcaagatcaacattacccttctctctgatgacaccctctacgccgcttacttcgtctttaagtggaaccatagtccttacggttttcgccagcctgtagaaacctcccttgtcttggctgacaccgagagcactgacaatgttgttcagccttccatgattagtctcatgcaagattcaggcggcgaagaaggtcagtcccctgtgctgagaagagacggttggtacgaggttgaattgggacagttctttaaaaggagaggagatttgggtgaaatagagatgagcctcaaggagacaaagggtccttatgagaagaagggccttattgtttatggcatcgagattagaccagtgccctaattgtatcctactcctaaatacctttgcggtttccagtgttctcttgattctcaaccctgtgttgttatcttctctttccctgccttcttcttcttttccttttctatattgatgcagaagaataatgtttttttgaaaaatgtttttatatgatcagctttttgattatgacattactatatatgcttgaatttttgtcttggtttgcaataatgtctgattgaaagagaaatacaggcaaataagacggtagtttagcagtttgtgtttatatcgttgttgtattaacgcctaagctaaaaaaatcttcatgatacatgcatgttaatatgttatgtgatttgaagaagaagaaaaatatgatattggcacggttctaattttgagaaaattgagagcacatgcattagatatgatcattctcatagatagtgctggaggttagagaccgactttaccaacgtgttcattacgttttctactcgctttccatttttctttactcaatcaggtcagatcgaaacgttggactcatagttccaaaattagctaaaattagatacttatttattaaaacaatcctgtacttttgacctaattagatatttcggcaaaatatctaacaaatatccccttctgatcttttggtattttctcaaaataaactaatccaaaccgaaactaaaattatttgatggaacgtacattcgttaaatgaatttcgcagacataaataactttactttattaaaagagagtaataaattggaattcaattatataaaacttctaactctttattattaaatgaaagttataagattttcacaatccatgatactgcttaaaaaatttcactgcactgttatcatacaaacaaagaagaaaatactatgcaatttctgtaagaattgatgactgatgggaacgttatgattatgttatcttcaactatggagtgaggatctttatttccatactatacaggccactcgatgggtctatttgaaataatgcaatagatagatagatgtatatatacacacacaacaaatatgtgtattgtttatacgctccgggataaacacacattttccacacttttaattcgttaccgtttcaggaccaattttaaaaagaaggttggtactatactattgactagctagctggtcagggaccttgatggtacatggaagtttcatattttatacagaaacaaaataatagagagtataagaatatcaacgacgagatctgagaagatttgttttctcttttttttgttatcaaatatgagaagattttgtaaatctgtaagttttaatttataaaagttgagatgcaatccagtgactccattcttttaaaatccactagtacttagttaccctaatgttaaacgttgaaaaatgagatttagattagttaacaagactttatagttaactaatcatataggggaatcaataatatatatgcaacttttgatgaccacactgttagatgctttgtttaaataaaactaaagatagaaagaaaagtacccttttgatctgtactgattgtataatcgttctataatatgtggaatattgtaaagaatcgaaaaaaggagtgaaggagaaacagtgatcggaaagaaataagtaatgtaaggttataatgttgcctaagaccgtcaaacaagaatcttcaaaagtatacacgaatatatatgtaacaactcaagtgattaatatcaaaacggaaaaacaactaaatgttgtaaatatttatgttgtttgtcaacatgcgagtttaaatatggatggtaccacatggatgataatgacaacacatactaatatatgtcttggccaaatgtatgtctcctaatagattgggagtaattgagcaattattacctatatttgataagatatgtcattatgtgtagtatcatttaacaagctataattaacatactttatatatactggttagagtaataaaccaaaagctcacttcacccaataagtgaaacagaactttaaatacgtataagccaattcaaagaagaagaatgaaaaatattgatagttaaaacacgaaatcatcatcccctacgtttgttaaactcttgaattgtatcgcacataagatatgtttaacgtgacgtagtaaaaaataacggtgaagaagtgaagcgcatctatatgtacttaaactttttgaacataagttgaagcgacgagtcagcggcacgtgtcaagttagcattagcttaaacagtaaaattcgcgagtcgtcgtcttataaatgctgtactcgttgtcttcctttccccaaccttcactttcctctcaaatctccaataagtaaactctctcatcgaaagcttaaaagcatcatcaccacaagaaagaaaagaaaagagtagaatcgaacatg

SEQ ID NO: 21592 - DNA, 3003 bp, Unknown; identical to SEQ ID NO: 21591
  misc_feature (1)..( 3003): 2750-1469P.txt file - cDNA_ID_1989485; gDNA_ID_1971801; Annot_ID_175703

SEQ ID NO: 21593 - DNA, 3003 bp, Unknown
  misc_feature (1)..( 3003): 2750-1469P.txt file - cDNA_ID_1989486; gDNA_ID_1971801; Annot_ID_58081
atttacaataatatttagctattttcatatatcattctatactagctcacaataattacatatgagcacgcttttttgtgttcaaatattataaatcttcgttagttaccgctgctttttataattatgtatactttctggttccaggagactaattaaggaagattattagaggcttcttatacgtgccatatgattatttatttatgtactgtcatggttcatatatagcgatgtgataccaatataccaatcaccaaagttatgagaaaatcacgtaaccagaggtgttggtacatacattttctgttaaaaatagttaagaggacttgtaatcttttgtgtttaactattgataattttttactttattcggtgaaacaatttacgcatgtttctgtgttgtgcttgtgtttcttgtattcttcttgtgtatagctttccttataagaaagaaaaagaagaagattaattgattagatcgagaaagagaaaggccttttgagatagaaatggagaaaggatggattgaatttgaagcatagagaatagcgaacactcactgcaaagttagtgggaaagtcgcgcgtcatacgagggagcaacaaagtgtgggcttttcttttacagtctcagaaactaatgcatgctcacatttaaaaaaaaaaaaaaaaaaaacaattcttgtgttaaatcaagagtggattaattatgagataatctaatgtacattactgttatatgattataacttgacagaccaaataatcatcttaatcagacctgataaaagaaaagagattaatttcaacagtgagaaattaaagatagaaagtacatattattggtgtaaaagttgttgatttaatttaaggcagatgtattaagttaaatatgtaaatgtagaggctgcgggaagggtgaccagctggtctgacagggtacgccggttgtcgggaggaagaacgccgctattggcagagtcacgcggggtaaccggctggcggctgtagccggtcacagagtgtattaatatggtcgtacaatacttgtagagtgctttttcctgtgacggtcccgtttattccccacaccctcctcgattctttcacttaaaagtgggggaaaaaggtaacctgactcttagaaaatttgaatacaattgtgggtcacctcatctcatgtagtcatgtctatacaattataaatacctctcaacaaacccaaaatcgaattataagccttctctagctagaatttgaagcaagacctgttcacattagtaaaaacaaatatatagaaagaggaaagattgaagcggaaaacgggacaagacgggtgtgccgttgtggatgttggggttgggtgtggaccggcttcaagccgacatcaaccggctcctagcctctcttttccaccagggagtgctggacgagcagttcttgcagcttcagcagcttcaagatgagacttcaccaaactttgtgtatgatgtcattaatatctactttgatgaatccgagaagttactccgcaaccttagattattgttgtgagtttcttcctttgttaatgtgttccatagttgtatgttgtttggttccaaaatgtatacgtatatatatgttatgaatgatgacgaatgtaaataaataaatgaacaggatggatagagaattctcggactataagaaaataggattacacctgaatcagctggtgggaagcagttcaagcattggtgctcgtagggttcgtaacgtctgcgttgcctttcgttctgcttccgagcttagcaaccgcccagggtacaaattaaacgagctatatatatatatatatatatatatatatatatacttctttgtattaatatataggtcaatatttaagtcaatataatgcttcataaatgtgacgatgcttcaggtgcttgagaggactggaggtagtagagcatgagtatcattacctcaagaacatgatgcatgaactcttccaggtacttacttgttttgttaatatattactcacattcacacaaacagaaggcaaaaacgtgagctaaatatacacatatatattgatagtaatatatgttaacaattatgtgggatttaatattttgagtggttgcagctggagcagcagagaatattagctgcaggagtcagatatccaatgtaaaattagaattttgtcataaaaatcagagaaaacctaattagtgtgtgatgatagtgtgttataagctaccgaagcgaaaccctttagtttcttctaatgatgttttgttgttaatctctccataaattcgagatacattaccttttgtattttcaagtgagatttacccatgtcaaaagtatctttacatgaacataaaacatttagtacccaaaaaaacagaaaaaagaaactgggctataaaatgaccgacagaaacggaagaaagtaggcccaatgtacggcccgttcatctcaaataaatgatttagttttgtttttgtttttttcattttagcaaagataacgatttctgagcaaaaagaattggaaaatgatagaatataaagccgaaaaaatattctgtgtttattttcaaaatcttagaatcataaatgtgtctcgaatgtaaccattaactgattttctggattgtcccaaaaaaaaaaaaactgattttctggataaaattagtaaagagaaggggacaggtgggtgttgcttactctagtagtcagtcatgaggaaagtaatctgaaaaaaacgagtaaggaatagacacgtgtggcttcatccctaagtatccgtttttacttaactaatcaatgcacgacttccacgtctctcttttttttactagtataaaactcattaaatgtgagcgatactttgctcgatcgaacaagtcgtatctatataatcgagaaagaggaaaagatcttttaaaccccaaaataatcaatcaagcaaataagcaatcaatcggaggaagcaatg

SEQ ID NO: 21594 - DNA, 3003 bp, Unknown; identical to SEQ ID NO: 21593
  misc_feature (1)..( 3003): 2750-1469P.txt file - cDNA_ID_1989486; gDNA_ID_1971801; Annot_ID_175702

SEQ ID NO: 21595 - DNA, 3000 bp, Unknown
  misc_feature (1)..( 3000): 2750-1469P.txt file - cDNA_ID_1989496; gDNA_ID_1971814; Annot_ID_58176
tggacgttttgcgtagattacagggcgctgaatgaagcaaccataccagacagatacccaattccggtaatagaagagcttctagatgagctaaagggagccacagttttctccaaattggatttgaaatctggatatcaccaaatcagaatgaagatgagtgacgtggagaaaacagctttcaagactcatcaagggcattatgaattcttggtaatgccctttggattaaccaatgccccctctacctttcatagtgttatgaatgacctctttaggccatacttaaggaagttcgtgttagttttcttcgacgacattcttgtctatagcccggatatggagtctcacctgaaacatttagagatagttctgcaactgcttaaactccaccgactctacgcaaacttgaagaaatgctcttttggcagtacacagatcgcatacttaggccatataatctcagctgaaggtgtctctgctgatcctgaaaaggtggaggcaatgttgtgttggccattgcctaaatcagtcacagagttgcgtggatttctaggccttacaggctactatcgtcggtttgtcaagaactacgggcagatagcaaggccactaacggatcagcttaagaagagcgggttccaatggaatgaggcagccacaaaagcgtttcaggcactgaaggaagcagtcacgaatctgccagtattggtcttacctgactttaatcaagagtttacagtggagacggacgcttctggggttggaataggggctgtgttgtcccaaaacagaaggcctatagcgttcttgagccaggcattttcaagtcaaggtcggattaaatctgtgtatgaaagagaattgttggcgattgtgagagcaatgactaagtggaaacattatctgtccagcaaggagtttgttattaagacagatcagagaagtctaaggcatctcttggaacaaaagtctgtatcaactattcaacaacgttgggcttctaagctaagtgggttgaagtatcgcatagaatacaaacctggagtcgacaacaaagtggccgatgctctctctaggaaaccaccgcaggaaaggtttgctcagttcaccttaacggctccacaaacaatagatattggcgctttaaaagaagaaatcatggctgataaagagttgcgtcagttggttgatacttggcaacaagggcagagtacagaatctgaattttcagtgaaagctgggttggtttacaggaagggagccttggttatccctacaggatctcccttcattccaaagctactagagaagtttcacactagtgcaatgggtggccacgaaggagcgttgaagactttcaagagactcactagtgaggtctattggaagggcatgcgaaaagatacagtggaatacattcgaggatgccaaatctgtcaagagaacaagtactccaccttgtcacccgcgggtttgctctccccattccccattccacaacagatttggagcgatattagcttggattttgtacaaggattaccgtcttcgaaaggattcaactgcatcttggtggtcgtggataggctaagcaaatacagtcactttattccgttgaagcacccgtttactgcaaaggtggtagcagaggcctttataagagatgttgttaagttgcatgggtttccaactacaatggtgtctgatagagacaaggtcttcctcagcaccttctggtctgaattattcaagatacacggcactgaattgagaaagagtactgcctaccacccccaaacggatgggcagacagaagttgttaataggtgcttggagtcatttttgagatgctttgcaggccgacgaccctcttcttggatgcaatggctaccttgggccgagtactggtataacacctcttatcacactgcaacaaagacgaccccattcatggcggtttatggaagagagcccccagcaattctcagatatggggacacacctacagcaaatgcagtcgtcgaagaattactcaaggacagagatgggttgttgctagagctgagagaaaacttggagctagctcagaaacaaatgaagaaagtcgcggacaaacacaggagagatgttgagttcaaggagggcgatttggtctacttaaaactgaggccgtatcgacaagggtcgttggtacacagaaaaaacgagaagctctcgcagcgatactatggaccctaccaggtgattagcaagattggtaaggtcgcatacaaactcaggctaccggattacagtcaaattcatccggtgttccatgtgtcccagctgaaaccagcggttcctccctctttcactgctcaagaactgcccaagattgtgactccttctttagagtgggcgacggagccagaaaagcttctggatatcagacagagtagaacaacagacggtgccgacgtcttggttcaatggagtggcatgtcagctttggaggcaacgtgggagccattagtgactctagtgaagcaattcccgagcttcgatcttgaggacaagatcggtcttctgcgagggagcattgataggctaagggttccactagctactatgagaaagagaatgagaactggcgggagaaaagctaaagctatggagaagtatttgaaaaaggtcttgaagaaaagtggctaagagacgaaggaaagaagaaggcatagaaagactcttgttcatctagagtctttcaccatctctctatcttttattaaactcagcattttgtctatttcgagttgtatttaaaggtctttgcctctttagggcaaccttaccaaaaacaatcatcaaaacttataacattaaagttattaattctcttctcatcttgttctccgtcaaaaacggcgcaatagaattagtttactctgtttttactcttgttcttagtatccgttgagtccatatctatcagattagcgtttaaactcatatcttatg

SEQ ID NO: 21596 - DNA, 3000 bp, Unknown; identical to SEQ ID NO: 21595
  misc_feature (1)..( 3000): 2750-1469P.txt file - cDNA_ID_1989496; gDNA_ID_2926180; Annot_ID_140509

SEQ ID NO: 21597 - DNA, 3000 bp, Unknown
  misc_feature (1)..( 3000): 2750-1469P.txt file - cDNA_ID_1989502; gDNA_ID_1971822; Annot_ID_58336
tagaatgaaagtagtgcttgatacattattatgatttttttttcattaaatgtttttagaaaatcatttaagagtaagattaatagagaatttaacataacaaaagacttttgatttttcctcaattagttttgttaatcattttatttaattaatgtagcatgacacatgccattttcttgtgtgatgatatgttacttatatggagagagttgaccaatttttatatatatgattaattaaaagacggaggaaagaaaaacaagaaaagtcaatgtgattttcatttatattaaattttttgactgattaattaaggatgtgatttgtagtaaaatgtgatgattttaaagtagtgaacgaaagatttgtggaagtaagaggtaagttgggttaatggttaaagagtgagggaagaaagaaaaaatgagttacttagtagaaattttgttggtagtgtatgttgggatataatttggtttgatgtggggatatgaaagtatgtaataaaaatatatgtaaatcatctaatatcatatgaataagggtattttgaaaattgctaacaaaacaaatatttatggttattattgttatttatgttcatttttgtgttattgtgaaaataataaactcaaatctatctcatatagctgcaaattttatgattagattcatctttgattcgaaatatcaattatacgttttatgtacaaatctaaatttttatacatctaaaatcctaaatttttactatcatgaatacatagaataacattataagatatattgatacaatagtatataattatgttacttatatggtttgaaacttgcataatttgttctgaacaaacatttttttgttccacgtactcttttctcatctactactctaaccatatcctgatatgctattaatttaagtcaatactttagatctctccctttttatgtctagaattttcaagtatatctaacatctcaaatgtgcattacgtgcaaaaacttgcatgtctttgttactaacttaccataagacacataaatgaaaagagaaaaggtcatatgataaatcatatccacaaaacaaataataagaaaatattcactgtaaaattagtaacttaataagaggttaggtagcaaacatctaaactacaacacaagtaattgttttagcaattatcaagtaatgatcattaataaataaaaaaaactaatgaaagaagaagagtagaatgaaagtaatacttgatacattagcatgattttgtatttttttagtatttttaacaaatgaattaagagtaagattaatggatgacttaattcacaataggagaattttggtttttcttcaattaatgtagctaatctttttatttaaataatataaaacgacaaatgtcattttctcatgtgataatggtacacttatatggagaaaatttaccaactttcatatatatgattatataagtaataatatgtaaagaagaaaagaaacgaaagagtgaaagagtgagcaagagaaacttgtataattaacttgtatatatgcgttaaaaaaatgagaaccgactcttttactaaatcatttattaagcagagatttagctgacattatacttctccatctatatgatagaaaagtataattttattcaatccagatgattggattttcaaaaatatattttgaaagttttcgcaaaaagtaagtcgaaaacgttatcaaccaattattttgctagtaggaccaaattaaaatgattcacattccgaaatcctattccacttttcgatttactattgcataatttcttctaaactatgtagtttatacccttcgatttaccatttttactccactaaaatttagtaaccgcatttaaaagtttagaagtaattatttttagtactttgaagtaagaaatcacataaattgataatggcgcagctatacactttattagcacttcttttttacctttcaaaaaaacttgttatctttttatctgtataataaaaccggtagtttcttgtaccaaaccaaattcttagttcaaaattttgaaaacataatacaacgaactttatttatttattacctttttcaaattcttcccttccaaaactttctgattttattattctttacatatactcttataatgttataacaattccagagaaaacaatatgaaaagaagaaaaactaactaaacaaaatagtagtgtggacctggatctattcttctattaaaatttgctttccactagattttagatatataggtttaaaagctaaccatagcttttaacctcataaatttcaaaatgctttccaaaatacggattatactattcccaataattgaataatcagtttattttctacgtaatttaacaatgggaaagctaattcgtagaagttatcgttcaaaataaaaccaaaactttttaatcattatgtaggaatcttttccaaacaaaacgcctaaaacttaacaaaaagaattcacaaaaaccagccacgtgtcaccttttgttaagccagtcgtcactttaagtaaccgcttgtcactttaagaagcggtcccaagtcaactcgcgccactcaaatcaatcatgcttatgtaaataacaactaaacgcagacgcaatcaccattttctttatagaaatgctcaaaatcgtgccttttaaggaaactgttgctttgcagaatcacaaaatctatataccaaccataagtttccaaattttgttctaaaaatcaaaaaaattcatatcatctttttgtctttttttaccagaatttcatccttatttcgtgctaaatcattttccaaacattcataatactttttgttggtttatggccaactaacaaaatatcctctagattttcttctttgtgttagtctatataaagcaataccacagtgatcctcttttttaattcattctgtgtttatgtcaataatcacaatg

SEQ ID NO: 21598 - DNA, 3000 bp, Unknown; identical to SEQ ID NO: 21597
  misc_feature (1)..( 3000): 2750-1469P.txt file - cDNA_ID_1989502; gDNA_ID_2926156; Annot_ID_139517

SEQ ID NO: 21599 - DNA, 471 bp, Unknown; identical to SEQ ID NO: 8627
  misc_feature (1)..( 471): 2750-1469P.txt file - cDNA_ID_1989503; gDNA_ID_1971822; Annot_ID_58335

SEQ ID NO: 21600 - DNA, 471 bp, Unknown; identical to SEQ ID NO: 8627
  misc_feature (1)..( 471): 2750-1469P.txt file - cDNA_ID_1989503; gDNA_ID_1971822; Annot_ID_176202

SEQ ID NO: 21601 - DNA, 3003 bp, Unknown
  misc_feature (1)..( 3003): 2750-1469P.txt file - cDNA_ID_1989503; gDNA_ID_2926156; Annot_ID_139516
atcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcactcaacacaaactctttacgaatacttttaagtatggcttcttcttctgcaaccaagtttgttgatctgttcccatgtcttttcttagcttgcctcttcgtgttcacatactcaaacaacctcgtcgtggctgaaaattccaacaaagtgaagatcaatctttactatgaatcactttgtccctattgtcaaaatttcattgttgatgatctaggtaaaatctttgactccgatctcctcaaaatcaccgatctcaagctcgttccattcggtaacgctcatatctccaataatctgactattacttgccaggttagtttcaaattttctcactttttgttgataaattactttgactctagctctagttaaccaaatttgggaattttgtgaagcatggtgaagaggaatgcaaacttaacgctctcgaagcttgcggtataagaactttgcccgatccggtatagaaaaaatacaattacctactatatttatactattttgtatgtgtgggtttgttagaagcttaatatgaaaaatgggatggttttggaacacagaaattgcagtacaagttcatacgctgcgttgaaaaagatacgaatgaatgggaatcatgtgttaaaaaatctggacgtgagaaagccatcaatgattgttacaatggtgatctctctcaaaaggtaggtctatatacaaaaatataaaaatatacacacatttatatatatatacatatatatatataaattataattatataaccttataaccaatttttttttttgtaattgcagctgatacttgggtatgcaaaactgacctcgagtttgaagccaaaacatgaatacgtaccatgggtcacactcaacggcaaaccactctatgacgtatatataactcttcctttcattttcattttaacgaattttaaattaatatctttattttggggatgcagaattaccataatttggtcgcacaagtctgcaaagcgtacaaaggaaaggatctcccaaaactatgcagttcctcggtcttgtatgagaggaaagtgtcaaagtttcaagtctcctatgtagatgaagctatcaattaataagttaattaacaaacttcttattgaaactaagatggatctaatctttatgctataagtggaatgataaataaagacgttttatctgaacttttatatttacgcgttcatgaaccttctgattatccatttttccttttaaatgaagaaggcctatattgaactatatttagactatttctacaagtacttagttgaaggacggcctcataaaaatttcaggcaatatcacggctgataaattttagaataatgagatgaatgaaatttgtcaatacccttagctagataataaagttaatagcatttgtctccaaagtttgttgaaaatgtttattaataccaaattctgccaagttatataaaaaaaaaaatcaagcaagaattgagaaacttgatgatgcaacaacagtttcaacttcataaatgaggtagtgacatcctaattaagcttgcggttacacgtagtccaaataatcaatgcaagtgccaaaatctcagccatagtgtgttaaaatttttaatttagaagaaggcatgcattctgctattagaagaggactctatgatcatctattaatgatgaagaatgaagaatacatgcaataaattaaatataattgtttcacgtaaccaaagagcttattgtgtatgagtcagtgagtgtaaaatgtccattatgtctccacgaagcatggactcgactcttaatagtgtttttattttactttacttccagttttcttttgttttcatttaatctaaaatataccaacttttatttcttatcatcatttgaaaacatttatattctatgttgtatagatattttttttgaaggagtcctcattataaattgagcattgtcactagctaactctttttttaattcaaattttcaaaaagccataagaaaaaaaaaatatgtttaagtaggtgaaatgtgcacgagatttttcgatattttatatatctatattttcttttcaatccgctattttttgaataaaatgatattaaatttatacattattctcgttatttatagaaatcgatacttaaaccgtttcccatataaatattttaccactcatttttaccatttttgagccaaaatttgactatctacatatataattaactcttacaaaaatcaaattacaattgctttgatttaaatgaaaaatattattacccataaaatttagacttggatcccccaccggtagactggtagaggttactaggggagtagggacaaaaaaaatcaaaaatatcttatctataaatggatacacacacacacaaagcaactagcactcaactcaaattctattaagaacaatg

SEQ ID NO: 21602 - DNA, 3000 bp, Unknown
  misc_feature (1)..( 3000): 2750-1469P.txt file - cDNA_ID_1989569; gDNA_ID_1621166; Annot_ID_57857
aattagttaaggtaaataacaaatatggttagtttagagatattatatatattaaatttggtaattaaattaatttcgtttttagttatttgtttttgtagaaaatggtaataaaaccaattatggaagatctaattgaagatttgcgggtcaaaatcaaataaaaaatccgacccaattggattccttaaaatgtacttcaaaaatgttaagtagatatcaacatattttcaacgcttaatttatgataaaattctaacaactaaatcatcagaaatttttcacaaatttacaagaaaaaatatcaataaattttcaacaattaaattatcatgaaatttctatgaagttccaacaaataaggcgtcggtaatttctcacacgtttccaaaaatattttttaacaaagttgcaacaaatatgttattagtagtttcccataaacaaaccttcagaattgttgaatatttgtggcaaattatcaatgacattccaacaaaatataggttggaacaattcgttagaaacttcacggtaaattccaacaaatgtccaacaaaaaaatatcagaactatctgtaacgcccccgaaccgttctaggactaagaacgaatccggaagtgttacttgcgacgtctgtagacgatccgaccgagttctcaaaacacatcagttaccaaagtcagctcatccgcgaatatcgttccttacgaacacgacctaaggcttttcaacccataccaggtccgtaagttgtgttagtccatacaagactaatatcagaagtaaacaaggcttttaaagaaaatcttctttattcaataaaaaatataacacttacaatggattgggtacccgagcctaagagcatgtatgggggatactcatatagtatcataagtattttttagtattatttataatatttgtttattatcagagattttttatgatactcctactaaatatgtttgataagtgtgtattttgcatgttttgagcatccgtttgtcatcactttaacatcatatcatcactgttttatacaatctcatcatttgttatcactttacatgtttaggatagatttgtatgcatgttgcatatttgcgttgatttcaggtgatttggagctgttgacgagctatctggaagatgcgggcctgatcatgtcaaaccactcgaccacgaggtcgagtaggagcttcaagatcttaacagataactcgaccccctggtcgagtagaggacatcactacttcaccacatcagtcgaccccgaggtcgagtgtcttcatcccatcacctgaccatcactcgatcacatcactcgaccccgaggccgagtgtcttcacctttattgccagaccactactcgacctcatcactctacctggaagtcgagtatcaccatcaccaccactcgactgcatactcgatgacaagcttcaaagccttcttcattccgcactcaaccagacactcgagcacaaggaagaaaagaagactccagctattcactcgacctcccactcgaccacatgggtcgagtacagttcttaatccgtcctaatacttcgtcgttttaagtattagggtttcggaatatttggctataagtagcatgtacttcacattttcgcagcaaagtttttatctagttttattccgcagaccttgtgttctataccttttgtaatccggatttctcttaatcaattcagtattcagtattcagcttttgttcttgatttcatttactgttgttcattctcttatcatcctgctgttacactgttgttatcatgttttcaacttgttcaacgttaatgctttctgttatgatgtctgagtagtgaataggtttctgaggatgggttagagtagtgtagaattctcagtatgctaggtgattgagtattgattgatagatcccttctcgattagttgttcttaatgcctattgctttctgatcaactcgaatttgagcccagacatttccgcacccaaaaagtgttcgatgaaatttctgaaccactaattccagagattcgtgaccctgcaccaaggtattggttgcagggagcgttttggctttaacttgttgattcgtaatgcttgttaggttagctctcgtcaatggtgattgagtctgggactaggttaacttgatagtctcggttgcggtggcacttagatttggttaatgaacttgttgtctagggttaatttattgagcatgtcaatcacctgtaaactgaggaaacgaaactactcaattaccccatccttgggaattctttatctgattgaattctttgtttgctctactgttgtttactgcatcttgttatctgtcgcttaatttttgtaattctttctggttactcgacctcatactcgaccacccagttgtctggcaacagactgtgcagtcgagtatctgtgttttattttctgtctgttactcgacctttcactcgacctcacccagtgctctgcaaagagctgtgttggtcgagtgttttactgtttctgtttaattttctgctttctgcatgttcacttgggattgctagaacacaccaaaacctgttattgcttggcttgacttagtaacttctgatcacatcttgattgttagcatcacacccatttggattgacaaccttcagtactacaacgacatgatagtgctttagttttaattgaataaaaacctattattaatttggcgccgttgccaattgggtgtttgtttgttacatttgagatttcagacttgcttagatcaagctctttttcaattttcttttcggttactaactgtgtgtttttcttgttgtcttcttgatccaggtacacctctactgtatgcgaactcgatcaacaggcaatcagaacctccttttcaacaaaaacatcgaccgcatagctcgcaaactcagagaaaggagaaacacagtcaaccttgtacctcagcaaccactcgaaatg

SEQ ID NO: 21603 - DNA, 3000 bp, Unknown; identical to SEQ ID NO: 21602
  misc_feature (1)..( 3000): 2750-1469P.txt file - cDNA_ID_1989569; gDNA_ID_2926141; Annot_ID_138990

SEQ ID NO: 21604 - DNA, 3003 bp, Unknown
  misc_feature (1)..( 3003): 2750-1469P.txt file - cDNA_ID_1989573; gDNA_ID_1621168; Annot_ID_57818
ttccagtgattaacttctatgtactgtttattttgttaaatcaacctcaacttctcggagatgccctccgagactagtaatcctgttattgcacattttgcttaatttcttggatttattatatatgtttttgttgcttgttgcattgacatcccttcagataattgttatctcaaattttcttctaaatgcaaattctttgaatttgagcaggcatcgacatgcagcagccagtgttggcacaaaagtatacatattcggtgggctttacaatgataagatagtttcctctatgcacattttggatacaaaggaccttcagtggaaagaagttgagcaacaaggtcaatggccctgtgcgcgccattcgcatgctatggttgcatatgggtcgcagtcattcatgtttggaggatacaatggggaaaatgtactcaatgatctatacagctttgatgtccaaagctgttcttggaaacttgaagtgatttctggaaaatggcctcatgccaggttttcacactcaatgtttgtttataagcataccattggcataattggaggttgtcctgtctcacaaaattgtcaagagttgactttgctagatctgaagcaccgattgtggaggagtgtgagattggaatttatgaacaaagagttgtttgttagaagtacagccagcattcttggtgatgatcttatcgtcattgggggtggggctgcttgctatgcttttgggacaaagtttagtgaaccagtgaaaatcaacttggttcaatctgtgactatgagtgaaaatcatcttcctccccaacctgaagatgtttctctagaatcgaataaaaacaatgcagatttgaagactgagacgtctctgtctcaaccatgggtgatacagctagaaagaaagtatgcaaagttcggcaaggacatacttaaaagtttcggatggttagaccttgagagaaaggtttactcaaacgaaaaaggtctttgtatatgctttcctgtgactgaaaacttttctgaacttttccatgagaagcagctattgggcaaggactttgaaaggtcagaggaaaataatctaacaaagggtctatcgttaaaagatatatcctgctcagcggctttgaatctattgaaggaacatggtgccaaaaaactcattaatgtagcttttgaagccaaaaaagttgcaaaatcccccttacagagaatgagagaagatatcacatctatacttaaacagaaaggcctaccagaagagcttttggatgagctcccacagaagtaagtgttccagaatcctgattttataatactcggggactaaaatggtgagaatctgattgcgtgcatgttgtttttgcttccatctgataagtaattggtgttttatctactattagatgggaacggcttggggatattgttgtggttcctgcaacatcctttaaagatccaacttggagctctatcaatgatgaagtttggtgtgctgtttctaaatcgcttagtgccaaccgccttgcacgccaagtatgttacttttagaagcttacaccaatattctataagtggaaacgtttacatcttttcatcttaaagccactcaaaacctacaatattgatttattataagctgtgagaatgctgagaactttacaaaccgttgtcttacccaattgcatctccttagcagtaagacttataccatcaattttgtgtctttttcagggacgagttgaacctaatggtacaagggatagtacattggagattcttgtgggagacaatggatgggttaatcaccgtgaaaatgggatcttgtactctttcgatgctacgaagtgtatgttctcatggggtaatctctcagaaaagcttcgtatgggtaacatggcctgtgaaaatgaagttgtcgtggacctgtttgctggaattggatattttgttctcccatttcttgtgaggtatatgccattattgaataaacgagaagagaaagtggttttatacaatcaaaagtcaatactttattagatcgcatgcaactacaatgcattcttaattgacatttacagggcaaaagcaaagctagtatatgcttgtgagtggaatccccatgctattgaagctcttcgacgtaatgttgaagcaaattctgtttctgagcgttgtatcattcttgaaggggataaccggatcaccgcaccaaaagtacggttgatgatattccaaacggctcaccgtctatttaattctatgcaaatggttctttttataactgttggatcgagtaaatcgctgaagtaatagattttgcgtttcaaatcttttgattctcagggagtagctgacagagtcaatcttggtctcatcccgagtagcgaaggaagctgggtcacagctattcaggcattaaggtgattttactttccttaaaacttattcttaactacaagaaccaggagcataaaatctggaacaagttttaaggttcagtctctccaaaagatataatctttaagacgattcaaactcagagatgcgaaaatcttaagccacactgctcttggaacctctgaatatgatccaaaaatgtaatcattagagagagcaaccgctcgattgaatgtatattcactgatgtctctgttcttgttattggaatttgtaggcctgagggaggaatactccatgtgcacggaaacgtcaaggactcagatgagagcagttggggcgagcatgtcaccaaaacattaagtgatatcgccagagccgaaggtaataagtttatgaacaaaatcgaaagctatttggactaaaaaaagagcattggttttttatcaagactaggagtttactaggacttatatttttttggggttttatggtttaaggtcgtagctgggaagttacagtggaacatatagagaaggtgaaatggtacgctcctcggattcgccatcttgttgccgatgtgagatgcagatgatg

SEQ ID NO: 21605 - DNA, 3003 bp, Unknown; identical to SEQ ID NO: 21604
  misc_feature (1)..( 3003): 2750-1469P.txt file - cDNA_ID_1989573; gDNA_ID_2926132; Annot_ID_138782

SEQ ID NO: 21606 - DNA, 3003 bp, Unknown
  misc_feature (1)..( 3003): 2750-1469P.txt file - cDNA_ID_1989574; gDNA_ID_1621168; Annot_ID_57817
cagtcgaagatcatattcttatgtacactctctatttgttgcaaaaattaaaagttgggaatgggcattagagagtatggatcatctacattatgataaaataacctttgccgcctcctctcctaatattattaaggctttgaataaaccaaatgacgggcatcggtcatatttctgaattactcaagttcactaaggataaaccacactggtttatgatgatgaaaacagattattgtaatacaggtgcttttgaaatagctaagagtgtcatcacaggaatgcggtggcaatcttatgtagctcacagtttcccctattggttgagaagtctttttgataaggaattgacttatcaatagagtatttgagttttcacaaggaggttaggattagattttaggtttgtcttttataagagtagaaatcaaagttttttttaagtaatgtaaaatttgatacaaatcgataaattaataagagaataatttttttgaaaatcttatgtaaatatatggtcccatcaatatcataaattaataattgtataaatatatcaactatatatatctattatatgtaagaaacttcaatgatatataattctagtattgtttttttcatcttaaattcatattagttcttgtttgaatttagttcatttatttttattgtatcaaaaacttttggttttgttttttagacataataactgtttttacttgtatttggttcgaaaaatatattttatatatagagagatatattatattgtcatagaaaaataaaaaattaggaaattaagaaaatttatctataaattaatacctctataaattaatagaattttgcggtcccaacattattaatttatagaggttttacactatatgcgttgtgtcttaggtttgtgtttagtatctaaaactcccttgtgtttctcttttctctttggtatcatggcagatgagttatgggatgcattacaacacttagagttaggaagggaggatcctgctctgtttattccgcatgctacttatgcaactgttgaatctaggaatagacttagcttgattgttaggcctcttaatcctcgatctcaaaatctcaatgttgtggttgctgctttgccaagggtttgggatctgacgtctagagttcatgggagagtgattaatgcaacgtttgttcagtttctctttcagtttgaggtggatctcttgtctgtgctaagaagggaaccatggctctacaacagttggtttgtcacggctcatcgatgggaggtaaatatggcttttgagtacttgtctaatattgatctgtgggtgcaaatgtttgggatccctctcctctatgtttgtgaagaaaatgtggtagaaatagctcatggtttaggggaaataatatcattggattttcatgatgctactacaactcaaatagcttatattagagtgagaatccgatttgatattactgattgcataagattcttccaacgaattacctttgattctggtgagactgcgctgataaggtttcaatatgagaggttaagaagaatatgcagtagttgtttcaggctgactcatcataggaatttctgcccttatcaacaacctgagcctaggtctcttgttcgtggtcctactaacaaccttacaaggactagaagagaaggagtgtgtacccataatgaatatcatcgatcatccctgaactctcaatcgcatatgtctgaaaactcctttccagcgcctcttgaacctcctccaagagtggcagctccttctttgaatcctcatgaattggtggctgcttattttcctcaaggaagagcagtgtctttaccaaatataggaacactgaatctaatcttaatccatcatttagcagacaagcggtttcaaggaattttaacattcaaccgttttttggtcctgttattgctacaaatgttcctcgtgtggttgaagtaggtgagtgttctagacaaggagagtttggagaaccagtaaacaagatggataagggagactcaacaaaaaggaagaatatgggaagtgctagaagtgatgaagaagaaagaactcatggagttgttgggcataaggatggaggtattctgaaacctccaaagaagcgctaaacactctgaaaattttgtcatattttttgttttctatgctgcttaggatccatgatcgcagcttcaaggtttatataataagcgctgcattgggttcaagtatgcaggtccaaggtttgaataaggtgaagagtgggtatggccgttggaacactttttggttaaggctactctttgtgtgcagtttgttgtttcagtttacctatcactttttgattttacaacatgggtaacattgatgttttgttaggtcatgtttctttacttgttttggtgtttgtcttcaaactgaaagtggaaggtctactgatgtactttttgaactatgagagcagccccaacggtaaaatacattctcagtccattgtttctattattttaatcatttaagtataattttattatttatttatatttttagttacaaataaaaaaattgatcaattatactttatcacatataaagtgagtttttaagtacagtaaagcaaatccgtctttttaggactttctttctttctttcttacttctctcttactttttccaattaactatcattttttttctttttaagggacttattaaaaccgaccgctggggctactctgatcttaatatatatataaaaaaaagttgctccatgagttagcattgattacatttatcaatgtcttacatgggctacactaatgatagtatgttgggctttttatgtgtgctctagtagtattgtcgtttgtttgtatttgtactatgactcatcctcttgttcatcggatctaaagcgccactcaaaagggtttatgaaaaggttagggttttaacaacaactcaaaaaacagagatg

SEQ ID NO: 21607 - DNA, 3003 bp, Unknown; identical to SEQ ID NO: 21606
  misc_feature (1)..( 3003): 2750-1469P.txt file - cDNA_ID_1989574; gDNA_ID_2926132; Annot_ID_138781

SEQ ID NO: 21608 - DNA, 3003 bp, Unknown
  misc_feature (1)..( 3003): 2750-1469P.txt file - cDNA_ID_1989577; gDNA_ID_1621172; Annot_ID_57813
aagtgtccgagtgttgtttagagatttggcgctgacttgatcagtgtcagaaacagagatgatggaacataggtgtgatactacattgttgttataacatatgtgtcgaacagagaacaaaaacatatttgcttaatggtactttattctctgattttcaatgattgtctctgatactttttcagaatgagactacatgaatctgtagaagaagaaaaaaacgtaattgcacccatcaaacccatcgtctcattatgtcctacaattaaaacagaaattgaaatccccaaaccgtgtttgaattattcttcaacattgggtgacaataaatgtatttattgcttttgccctcgtgaagattaattagggcataaattgtatttgtaacttccacttcttcttatttcatagatctgacaattttatttaccctaaaaaaattgcttcgtcgtcttcgttgtcgtcaactcccttaccttcgctgatgaaagacaaaaagttgagaaactgggcggagcttccgtccaagttgacgtcatcgattctacttcgtcttggcgctattgagatacttcaaaacgctcaaaaagtgtgcaaaccgtggcatcgagtctgcaaagacccctcgatgtggcggaagatcgacatagataaccgcaatgatagggcagccttcaagtacgacctcgagtcaatgtgccgtcacgcagttgatcgtagccacggtggtttgattgagatcgagatttggtactacggtactaatgatctcatcatgtacatagctgacaggttctgtttctccctagctctctttccatgttaaagagaatttggtcggtgctaatactagggttagagtgtttgctaactatagggctaagagtgatcggtgctaatccaagggttcgagtgattgctaattctgaagttataagtgattggaggattttgtgtcactctttttaaactagatttatttttatctgttctatatccttctactgaatctctgataaagcaccttggtttgcttagtggttttgtcaacgaagtgttctcaataaggttatgtttttgacttttttagtaacaattatttgcaggtcaagtaatctgaaaagccttggacttgtaaggtgctttccaataacagatgagggagttgccaaagcagtttcgaaagtaccgttgcttgaataccttgaggtttcatactgcttgttttcaggagagtctctgagagatataggccggtcttgtccgaatctgaagacactgaagctaaaccgagcccctgaaatcatgttttcaaatagtgggtttgatgataatgccaaagcaattgcagaaagcatgcctgaactacgccacctccagcttttagggaacgggctaaccaataagggcttgaacgccattcttgatggttgtcctcacctggaacaccttgatttacgccagtgtttcaacatcaaccttgttggggatctcaagaaacgatgttttgagaggatcaaagacttgagatgccccaatgactcagatgacgattcagatgatggctcagataatggtgcggtgacaacatttgggtcacaatttaatgaaaccgactatcattggtactagatattgaatctttctgaatcttgcggaaatacctttgttgttgttgctttgttttttgtttttgacaattgacacctttgttgtttgacttatgaatagtttcagtttcctttcttggtagtttcagtgtctttcctttgaacttttttaagaagttttgagggcgtgattttaagtcgttcgagaacgatgtcatgggtctttatattttttttagttggtacattactttcacgattgtttagttacatactatcaaaagtaataatattataattaattaaatttacttatgaaaaccactaattttagcatcaatccaaagccttgcgattgatagcttaaaaaaaatgttgagtagacccgtagctatagagagaatataatcgtgtaacacttttcccttggtgtttcatcaccaatttcatttgatctttatatcaacaatgtccaaaacacaaggtatggtgtccccatgcaaatcacaacatcatcaataatcactagctagtagactcttaatgattgtttacgtgatcacctaactgtataattgactatcagtagagccggaccataacacatgaagatgaaacattccaatggggctcccattttaaaagggcccaacaaaaattttattttagttaaatatgcatatattaatttttgataataagagaaaatagttagttttatacatataaatcacaaataattgtgtgatccaaaatatttataaatctaatatacaattaaataaataattcaaaattttgtttaaattggttttctatttactctatagtttttaagacaaaaatattttgttttcgtaatttaaatggggccccggatttcattggtccgggactatcacaagaacagaatataaggtgataaaaagaaataagattgtaaataacttttccttttggtaatattttttttttttgttcaatccttttggtaatgtgtaaaaattcacaaattatcaaaagaaaaagagtggatattgattttactctttacttttggtgaatgcacttttggaaattgattttactctttactgtatttgggaatatatgcattgcaagttacaagtcaatttgttaataaaagtgttgaatgttttgtttcatctacattattattcttcacctttgttctaccgggtttaggagtagaaaacaatcaaatggattctcagattgttaatcttctgaggtctaaacagtattgtgggcctaggcccaatacattatttcagtatgcttggcccaaattagtttcgtataaaataagttttaccgtgaggaactaaattgtaaaacagagacggatacggcaattgtatcctttagaatg

SEQ ID NO: 21609 - DNA, 3000 bp, Unknown; identical to SEQ ID NO: 7896
  misc_feature (1)..( 3000): 2750-1469P.txt file - cDNA_ID_1989580; gDNA_ID_1621172; Annot_ID_57810

SEQ ID NO: 21610 - DNA, 3003 bp, Unknown
  misc_feature (1)..( 3003): 2750-1469P.txt file - cDNA_ID_1989580; gDNA_ID_2926134; Annot_ID_138866
aggccattcaaaaatatgaataagaataaaaaaggtttaagtgctattcagaaaataaataattcttcagaatattaacaattattttggaaataatttgtgttggaaacatgggaaaaatcgtttggatagtttgacgaagcaaaacaacatatatcataataatctcgaaacaccataattttctcagtttatcccacttcttaatgtaatttttggttactaagagaataaatgaatgagtaagacatatgtattttgtttgttgaggatatttatttcgtcatttattttaaaaaatgttgtattttaattttttattattattaaaatatatgttttgtcactatgttacaacataattcaattttgatatcatttatatttataaatatatttaataataataaatataagtaaataaaattcacagcttctacaactttttgttaccataattttctacaacataattttttaaagtcgaagtctctacagccaaactttctacaacataattttttaaagtcgaagtctttacagccacccttattgtattaagtcttaatatagtataaaaataattactttatatatctaaacagaaaataaaacatagaaaatatagtatatctattttattacgtaaaaaagttagaatatgttttgttgtacaataaaaaatgtaatgaaactcatactaaaaatttactcttttacatgtgcaaattgcaggaattatatcgagaatcattgttgcttttaaaatttaataatcaatgatatgtttttaaataaatttaactctcagataaattaacaatttatttttgaaacttatggttttaaatgattggttttgataatttatatgtttgttgtgtttattcattatatgtgaatacttagctaataaaacgggatttgtaaaacaaatatttactaatatatacacgtttataaattcttccatacactaaccgacaacgtatatactaacacatgacgttttacaaacacacaacgtatacaactatacatactataagattcatttatactataagattcaaatttgatatagactttaatactttgtaaattgggaaatatgtcagaaaaatcgccaattttcaaaaataggacgaaaaaatctccaactcctcaaacgtcgttttaatcacaaacttttggttgacttttccagaaaatacaaaagtttggttgacttggccaaattagtcatcacgttaagtctccgttaggacgacgattacagggttaataagccgttaagggcttccgtcttagcaaaacgacatcgtttctataatgacaaaatgagccataatcgatagaaacgtcgtcgttttgattcagagagatttgagaaattcccaaatcgattagaaaccctaaaagagagaaaattctgaaattctctcaatctctttccaattgatcccgatggcgaagacgcggggaggaaactggaatcctcgtcggtcgcggaggctaatggctattgcaggcgaagctaacagagcaaacataacgaatcgaccaccgaaagttgttgagatctcagaagaactggagacaaatcaaaacccagaagaaaccgcgatgaatcagatcccagaagaaactgcgacgaatcgaaacccagaagaaactgcgacgaatcgaaacccagaagacaatgtgggtgggactgttggtgaagacaatgttggtgaagacgatatggatggaggtctagaggaggaaaattgtgatgattttgaagcagattttggtgttggtgcaagagaagatggagatgcaagcaacactgatgctgacagtggaggtaaagattgtgatccccaatccacacacacttcgatggcacatcacattctccggtgactccagatgtaacagagcttgaactcattgttagagagagagagatcgaattgaagaatagaaattttagggattgaaatctgaaatcgatttgggggtttttagagtctcatctgtcattacaaaaacgatgtcgttttgctaacccggaagccgttaacggcttattaacctcataatcatcgtcctaacagagacttaacgcgatgactaatttggccaggtaaccaaactttggtattttctggaaagtcaaccaaaagttttgtgattaaaacgacatttccggagttggaaatttttccatgcaatttttgaaggttgaagatttttctaacattttccctttgtaaattatagaagataacattttatccacactaagaatccatcaaattagtataagatattaccaaaataacagacgaattaaaatgttatctcgtgcaaagcacatggtactgacctatattaatgagaatggtatgaaatttttgttattttaattacttttacatattaattattctacacaatttatgaaatactaactgtttttccttttgtatgtgcaggttgcaagaattattatatgaatactgacctactctataaaatttaacagctacatatgaccgagatatgctgagctgagattttgcagaagtgacgctttttcaagttttcaaatttagtaaaaattaaattaaaataaataaatctggcgagatatcaaatcacagccgttgattgctagcaaaaaatctgacctctttaaactgtaatagcaaaaaaatctagttaattaggctaattatctattagatcgaactttcacgttgtttcaaatttaaagagttacacagcgtgtcggccacttaaaacgatgtcgtaatgttgtttcccctcctcgacaagcgccaagcccgttaaaatccccaatttggatatatatcttttctctgtcgacgctctctctctctctctctctctctctctctctatcttaactcaactattcagtttcaattttcaaatttcagaaaccattttctctctctatctctcttcttcttctttatctcagtaatg

SEQ ID NO: 21611 - DNA, 3000 bp, Unknown; identical to SEQ ID NO: 8037
  misc_feature (1)..( 3000): 2750-1469P.txt file - cDNA_ID_1989587; gDNA_ID_1621185; Annot_ID_57876

SEQ ID NO: 21612 - DNA, 3000 bp, Unknown; identical to SEQ ID NO: 8037
  misc_feature (1)..( 3000): 2750-1469P.txt file - cDNA_ID_1989587; gDNA_ID_2926133; Annot_ID_138820

SEQ ID NO: 21613 - DNA, 3003 bp, Unknown
  misc_feature (1)..( 3003): 2750-1469P.txt file - cDNA_ID_1989588; gDNA_ID_1621185; Annot_ID_57874
tttaacttgttatttattaaagatatggagtgactaaaaaattttcaattgttttatttatattaaagtggctaggaaaacagagaaattacataatcaattgttgaaaagttgaatttgaaaaagtgaatctagaataagacttgtttttttaagtgtcgtcaacatctgtgacgctgataatatcagcgaaaccaactttcttgcgaagccggacaactaaacatgcggcgtcgacaccttctccgatcaccaccactttgtctttctcttctccttctattcccacaaacgtcactcctgctccgttatttaaacatgagaatatgagatcattccatcaagcgaattagaacgaatataatttgctatccatagcatcagtgccggctctaggggggtgccagaggagcaaaagcacagggtcattaaatttttttccaattttacttgaggttttagggtccaaaattttcagtaattaaaaaacagtattaactaaagccaatttctataaatcagcacaaggtctttaagaagtttgagccggccctgcatagcatagtcaaatgccggttcgatatatatatttggattctaattgatatcttaccagtggttttggctccgatcttgagggcttctgaacgacatttgtcgcacctcatacttaccgacatcaagattttctgctcatgaaaattccaatattacaaataataatactgctacgtatatacttcatcctaaaaccttccgtatatatgttagacttttagaatacaaatgtttttagcgtaccttggccattttggaacctcttggagaaaatgaaaccttattttttttgtccttttggtataaatgattactataatttacgtgtgtaaatatagaagtgcttctgtctttgtctcattttcttatggcacattgcttaacatgtattaatatgcatattttatttgtactattatttgctacgaaatcgcagagtaattttcatgcaactgcttcgtagttaatattagtataaatgttgacgtttaagtggacaatataaggtattgcttgactcataagggttagatttggttaggtaaaggttagatttttatcatgcacatctaaaaagtcagtaccgtgaggaccacgaccggtcctgaattataaaaggcccgaaaggaaactagtcccttatttcgtgtttctgaataaaacaaattattaaccttaaaaccaaataaaatttagcaaactgaaaattgtaaacaaagaaacggcactacatcctacttgcaaagaggtgtcgaacggaccggcccacaatggccattagttttagatggactgcaacggagcagtccgctaggaccgcagacaaaataactttctccaggttcgccctgctaaacccaacaagtttatggaccgatccgtaggcttagtttttatatttaaaaaataataaatatatatattttaaatattaattttagttatttttaatttaatttaatttttaataaatactttttgtaaatattacaatttaaaaaatttaatttcttcatattgttacatattttacatattataataggattcataattaagtaaaattaattattcttacaaattatttatttatttttattgaatatttgtagtctgcaggtcaatccgccaaaccgtgggtcaagtccactaaaatccgtaatccgttttggccgatccgcaagacccgttatttttcggatatataatatagtgtccaaacccgctccatcatggtactagcccgtgagtctttggcccgcttgacactgatacatacatagtttaaaaaaaaaaaagtatattcgggtaggtccaaaaacgggttgatcagttcgcgggtaaaaccggttcaaccaccggttaatggtttaaccgtcgttttaagttggttttgtttttcctcctgaaacgacgtcgtgtctctctctctccctctatcttttgcgactctcctcgtcttctctgttcgtctgccatatgagtccttcccaagcccaacttttctgaaattgaagtgagtttcttcccgaatcccttaaagtttcaaacttttcaattaacttattcctctttctcttgtttctatccgaatcgtgtgagggttttcattttctatgctctgatttggtctcaatcgatgtacgtttataatgaatgtgtgttctaaattgtaataaaaaatgactagtaggtactagttgacagctctccacagttgaaaatctctcttttgtatgaggtaccaattgacagtctttgagtctttccttgttgttttgttatcaagggttctgagctttgtgtctttaggttaattttctatgttgtgttatggaaaattggtcagtgaatagccaaaccaaagattgtgaaatctgcattttgattttggtgaaaaaaactgtatagaaatgtcttaccctcaagaaacttttatattgcataaatgaatagcttagttgttatagggtttggttgtttcaataacaaagaatagaatttggtttcttatactttataaacttccttctttcagtcttttgggacagagatggcattaattcagaaaccagtggtgtgcaaagacactaataagatcttcatgaagcaaatacttgcgtttactgaacaggtataatatagaagtgttcatgtatatctttctaatagtgtgctttataacttgtaaatcaggtcttttctgaatctctcgctttccatatgaaacctctttgtgaattacatttctagtttgagacaatgtcatgtttgaggtggttaagacgataagaacgttgacattttctgattgaaaataaaagacctggcttccattaactctgcattggatgcttactctaattattttctgattaaagaaagacattcccttaatttataggtgaccattacacagaacagtaagctctcgccacgcacatg

SEQ ID NO: 21614 - DNA, 3003 bp, Unknown; identical to SEQ ID NO: 21613
  misc_feature (1)..( 3003): 2750-1469P.txt file - cDNA_ID_1989588; gDNA_ID_2926133; Annot_ID_138818

SEQ ID NO: 21615 - DNA, 3003 bp, Unknown
  misc_feature (1)..( 3003): 2750-1469P.txt file - cDNA_ID_1989590; gDNA_ID_2926133; Annot_ID_197042
taccgtcgtttcaccttatctatcatgttttgatatgggggaatgtctcttttatttgcattttaaactttataatctttgtgttattttttatatatttggtttgatttaaatgaataaaaacaagtctttatctaaacacaaaaggacccaaaaatggtcaaatttgggtaggtctaagagtgggttgtcaatctccaactaaccatgttttgatgtcccaacaagctcttgccttcagatttgctagtcctaattattctttgaaattataattcataataactaatgacctaccaacttcatcatcttccactaatctaccgagtaacatgttaggatttagccaaatgtcatttccttagttttggttacaaccacaataaaaattattatagtaccctatatatatattatcattcaaccgtagaacatgcacaacgttgacaaaataccccaaaaatgtcatttcctttgttttactcttattttctaaacaggtgattttggattaaaggttacttaattttggattttattataatcgtcatgtaaattttctaatggtcaagagaagaagacttcaacgagaaacgacttttttggcattgaccaacaaaaaagtgccactaaactaccatcatgggagtaattacaaaagctttgcgtagtcaaacattcggacatcaaagacaaaaagtacacaatataacaattttaggtggaaaaaacaaccaaaaacaaaaatttgacgcgttttcttgttaacaggagtattggttaatacttaatagctttaactatgcattgtaaaaataaatcataaaaggatcaatgacgatcttgattgtttagaaaaaaaaattatttcaaaaagatttattttttaggttttcaatgcaatagttattagttataattgataaattgtaaactttaatacaaattattgaatatcattggtttagagttattgaaaattgtaaatcacaaagaacaatacatttaaaaacaacatttaatatgttttcttaatatttgtgtttttcctaaaagattaaacaaaaaagaacagaaagaatatgaaataagaaaaaatgcactagctttttttgtttgagttaaaaaggactatatttattaagaggtaaatagtatatcatttttacatgttttaacgctatgtaaacgtgattaagttacttgttatcaaataatcaaaattttatgattttcatgtttttgaaaaatgatattgccgtatactgtgaatgtgtaaaaatataggtgaaaaaaacaaacgccaacaatctattatgcttaataatgactcatatataagaatagtttgctcatttcttatgctttgttaattgttgttgtatgctaagagaggattgatgtttctagtgatgtgctaggaatgttctcatgtataggatgtatcggatcttgaggttaagaaatagagattcacatttccattcttaacacaacataaataaggattaaggctaatgaaaaagagttcacatattacacattttactaattaatcatggtgattagataaaggtaacaactaaaagtcattttaaccgcactcaatattacgagcttgttagaacactgtaacacaagtgttctcttccagtttatcaatggaggaaactggtaaaatcccatggacgatcttcttctctcatcctctgttctcttgtttcatttcactctacactatatttcttctttatttccctcaagattctcttcgaattcttatttcccatgtccctctcctcatcggagctttcttaatctcctgcctccatctcgggtcgacccggaaatccattgcccgacccggaagcaatgaggattcgataggacctgaactcaaaacgggtctcggtttaaacccggattttatggaatggaactttaaattgggagctccattggaagttattcacaaagaagaagaagaacagtcgatgacgggtgtaaaagatccgacccggttcgtgatgatcaagaggtttccatcgttatcgatgtttaacccggaatctgattccgaattggaccgcgatttcccggttatgagtgaaaatgatccaacccggttcgtgaggctggaaaggtcaattaaaccggaatctgatatggattacgactccgaattggacaacaatttggttattgatgtaaaagatcgaactcggttcgtgaaggtggagatattcccatcgttgtcaatctttaaaccggattcgaattccggttcgccggagaaattgcgttgtatatacgaaatcaaaacggaaacgctttttgtagttttatattcctggagaacaatattctaacaacttgttttggcagcaatattctgatttctgagtataatttgattcgtcaagtaaaatctaattttataattctcaacaaacaaactcgaatttgatttctctaatgtgtaatgtcgtcacgatttacgtataacatattaaaagttgtcgacaaagaaaatgaaatacatttccaccaaatataataagtaacaacatggtcagattcagagaggacgatctggcttggccaccaagattgtttgacaagtatttatttaactactatactttctcttccacaatattaataatgttttaaatgtcattattaatacgtgacgaaactgtagctctgaaataaatatattaacaaaacaaataaatattctcaaccaatcataacctcgtatttgtttttgtttccatttaaattttattttgactcgacttttacacgcatgccacgtggtcaaccaaaacgtatgacaaactctacttctccaccgtcacaatcatctcctggccccctctagatctctctctcttttcctccttagattaaaatttctccaggtttcttggcgttactgtgtgaaaaattcttcttcttcttcttctcagcgattgaatcgaaccaagagcgaaaatg

SEQ ID NO: 21616 - DNA, 3003 bp, Unknown; identical to SEQ ID NO: 21615
  misc_feature (1)..( 3003): 2750-1469P.txt file - cDNA_ID_1989590; gDNA_ID_1621185; Annot_ID_57872

SEQ ID NO: 21617 - DNA, 3003 bp, Unknown; identical to SEQ ID NO: 21615
  misc_feature (1)..( 3003): 2750-1469P.txt file - cDNA_ID_1989590; gDNA_ID_2926133; Annot_ID_138816

SEQ ID NO: 21618 - DNA, 3000 bp, Unknown; identical to SEQ ID NO: 9314
  misc_feature (1)..( 3000): 2750-1469P.txt file - cDNA_ID_1989590; gDNA_ID_1972068; Annot_ID_178500

SEQ ID NO: 21619 - DNA, 3003 bp, Unknown; identical to SEQ ID NO: 21615
  misc_feature (1)..( 3003): 2750-1469P.txt file - cDNA_ID_1989590; gDNA_ID_1621185; Annot_ID_174396

SEQ ID NO: 21620 - DNA, 3003 bp, Unknown
  misc_feature (1)..( 3003): 2750-1469P.txt file - cDNA_ID_1989594; gDNA_ID_1621185; Annot_ID_57867
agagggcaaggaagagagcgttgatggaggattgggagatggagtattggcctcatcggattccgtatgaggagattgaatccggcactaaggggtttgatgagaagaatgtgattgggattggcgggaatgggaaagtttataaaggtttgttacaaggaggggttgtggaagttgcggttaagcggatttcgcaggagagtagcgacgggatgagagagtttgtggctgagatatcgagtcttgggcggttaaagcaccggaatttagtttctttaagaggatggtgcaagaaggaggttggtagtttcatgttggtttatgattacatggagaatggaagtttagatcgatggatattcgaaaacgatgagaagattactacccttagttgcgaagagagaattcgtattttgaaaggtgtagcttcaggaatattgtatttgcatgaaggatgggagtctaaggttttacatagagatattaaagctagtaatgttttacttgaccgagatatgataccgaggcttagtgattttgggttagctcgggttcatggacacgagcaaccggttaggaccacgagggtggttggtacagctggctatttggctcctgaagtggttaagacggggcgtgcatcgacacagaccgatgtttttgcttacgggatattggttcttgaagtaatgtgtgggagaagacctattgaagaagggaagaaaccgttgatggattgggtttggggattaatggaaagaggtgagattctaaatgggcttgatccacagatgatgatgacacaaggcgtaacagaagtcattgatgaagctgaaagagttttgcagcttggattgctttgtgcacatcctgatccggccaaaagaccgtcgatgagacaagtggttcaagtgtttgaaggtgataaggctgagatctttgaagcagaaagtagtgaagatgtcgagtcatggatgttgatgaagatgggatctcgtggaagctcgcgagagttttggtatggaagctcatcacatccgacgatagagcagattagacttcagtctttgtctgtgtctctttcgtcttggaacagctcaattttagaagggaggtgatgatgatgaagaaatggcttgaggaacctaaagaatgtagttatttttgtggctttactttgttacttgttttgtacatatacgtatttgtaaacgcatttcattatacatgtatttttttattttaatttttttgttgtgaattgaaactagttttcaatttattatattttgatgtgtatataaacaagttttgcatccgaagttaaatgataaataatttaagagaagtacttataataatgctaacaaagtaaatgtgtagattactataaaacatacttttttactaaaataggatttatgttcttaagtattgaacatgagaaacatgttttatggtttttttttttttttttttttgtcatcatgttttatgttcttaagtattgaaaaaagtagtactagtatctggttgatgaataaaagattactctaaaacatgtttttactaaaagaggatttatatcaataaagcttggttatatatatatgaaaatatatatatatttttttaaaaaccttattcctaactacacccttatttatttatctaaatttttatttatttcaaaaaagaaaaatacaatacaaggctttgtacatcattctcttattaaaaagtttagatctcacataagaagttctatcgaaatttacaattttaatatacaagattacaataaaaactaccaggtttccgatcataaatttcagataatactaacagaaagaacgacaatcacatccgtcgatcaaagtttttgtaaaagatccttcgatttttttgtatacataatgatattatttaaaattcaaatatcatatacatatttacaatttttgtatgtccgcctatctatggggatcttatctagttaatcaatgaaatttggttttatatataccaaaaaacaaacattctgacaaggtctaatttgcatattaatgtaaacacatcatataaaaattcctaattgtcacgagttccaggtaatcattcatatactataatgcatatggttgccagagaggtatatttaaaaagcttttcatctttggaaaaagcataaagttatgttcatgaatcttataaaatgttttaaagatagtccttcacaaaacaagacaaatcaaacgacacaaagattcgatgctgcggtgtcctaaaaagttctctttatttggagtctcaaaatctaattcttatttgttttcctcaaaacactttctgtgaaaatttcgaaatgtcactacactgtgagtttagcaaaagagtttttgttcattacgttctaattctatgattatctaatagattaagtgccatcactttcattcatgagcacaccatcactagttaaaaagatcaagtgcctttctcagttaatcctaaatcctagttaatgtggtgtcgttttgaccaatccattaatacgttgccgttttaaaatcccaccacgagcataatataacggatataatgctatcttgtcttgtttctctctagatttcagagattctctcgagtttctgacacgcgcgtactcgcacgtgtctcatcactacactaaccctacacgtctccctttcgtggacgctccgtttacttaatctccaccatcagatcacatcttagataaaagcctaaaatcaatctaacggtcactagctcaaggagtatgtattattgtacgacgagacacacatcgttatctctctttattatttggtaatatcataattattatctctatgcacagtttttgtttcgtcactgtctttgaaacttaaaagaaaagagaagaaatagaaagaaagaaaaaaagatgaaataattttgaaaaaaaaagattcgaagcaaagaaaccgttagccggcgatg

SEQ ID NO: 21621 - DNA, 3003 bp, Unknown; identical to SEQ ID NO: 21620
  misc_feature (1)..( 3003): 2750-1469P.txt file - cDNA_ID_1989594; gDNA_ID_2926133; Annot_ID_138811

SEQ ID NO: 21622 - DNA, 3000 bp, Unknown; identical to SEQ ID NO: 7280
  misc_feature (1)..( 3000): 2750-1469P.txt file - cDNA_ID_1989607; gDNA_ID_1621136; Annot_ID_57797

SEQ ID NO: 21623 - DNA, 3000 bp, Unknown; identical to SEQ ID NO: 7280
  misc_feature (1)..( 3000): 2750-1469P.txt file - cDNA_ID_1989607; gDNA_ID_2926136; Annot_ID_138889

SEQ ID NO: 21624 - DNA, 3003 bp, Unknown
  misc_feature (1)..( 3003): 2750-1469P.txt file - cDNA_ID_1989609; gDNA_ID_1621136; Annot_ID_57795
agcaagtgtgtaatcttgaaccatgagctgattcaaataatccgagaaaagatcacgctgctacaataaatccgtagtagctttctcactctccttaccaacagtttcctcatcaccatgaaacagatttttacgcaccgtctttactgcgaccgcttccagccccaaggtggaggaattgttcgcagcaatttctgaaacatcaacccccaaatcaccagaaactgcttcaagcttacctgaatatgatcctaggaaagcatccatcatctgttgatgatctgagaggctatgactcgtctcaccaaaatcacagtaccaacccgtccagtgggacccagtcggtgctgcagcgcatcaaccctaacctctctcatgtgggcccttctagcccaccatgtaaattattgttgcgcttgacgtttctcaaacccaagacctcaccctttaacaatcttcccataggacaagttgttaccaattaacccacatgagagagattagggttgatgcgctgcagcgccaaccgaatcccatagagtgggttgttacaatcaccatcttacattttatatttttttaattagaaaattttcaaataaaacaatttgctgcaggatttaaattttataaccatcataattatctttttaaattttacatttttaatttaaatttccacataaaaatatttgcagcataatttaaatttagttgcaagtttaataaatatacaaaaatgaatattgtcaaataaatatttttgctacataatttagatttatctacaagttttataaatgtagagaataaaacattataacttcaaaagtattaaccgatgaagtggctaaccgcgattggtcgtttaaaagcttagttggacagcctgagaagcttatagcttctacttttctattttttaaatagtaagatgattaaaatattaattagtgagatgggtaatcgtgattgatcattttttgtagaaaaataagaaaaataacaaaataagaataaaaatagaaatttctaattaaaaaataaataaaaattgacatatttgccatctttgtataaaaaatattaaaatttaaaaatattagtcagtgagatgactaaaaatattaattagtggaatgactaatattacatagattccatatatttttctaagtttacataattactatattttaatataaaaagtaattataattgtaaaaatgttaatttgcaagtttctccatcacatgatgcgttaaaacttttaaaataaaacataagtatttataacattattattataacctcattaagtttttaattttgtttttatggttggttttaaagaatgaaaacactatattacaaagataaatagagttttatccaattaaattaatgttaaataagttatatagttattttaaacttcaatgggctttttaattattattattatctacactaaataatttttttttttaattacatgctaatttaattgaccaataacaaatattaaaagaaatttgttaattttccttattgttaataattttttccctcttttatatatagacatataaattagtatatttagacttattacgcttttttagttttttatacggtgattttgaaaattaccctatttttaagtttttatttgaaaaatacacttttccatatttttaattaaaaatacaattttaaatatgtgaaatgacaattatgtccagatttaaaacaaaagaattattttaaattaattaaaattaaatacgaatttttgaaaaagaaaagaaaaaacttaatttaaatcttaattattatttttaactattttttatatatcttaaatattaaattctaacatattttatcaaaaaatattttaaagtttatcacttcatatttatcacattatataaagaaattaatctaactccaaacacataattctttatttcttttgcttcttctttttcttgtaacaatattttcctttaaaaatttattcaagataaaattatatggaaaattgttagttagttattagcaaatatttttaaattaattttttttttgtgtcgacaaataaacaaaactgattttattttaaatataaatgttttcaaattattagtaaattttagtaaggatatttttgtaattttatattccatttatctcttagaaattatattttaaaagagaaaatatggataggttatttttcaaacaaaaacttagaaaagatcaggcattattccaaattttctctttttatatccaattaaattaatgttaaataaattatattgttcttttaaatttcaagggcattttttaattattattattatccatagtaaatgattttctttttaaaattacatgctaaattgaaatgaccaataacacatttagatctaaatttcttaatttttcttttttgtttagaaaaacaatttttattttattttatatatagatatataaattagtatattagatattttttttttttactttttgtatttttttccaaaaaacaaaacttaaatctcttctgacacatgtcaacatctgatcgatttatttgacatgtggtgcaatcttatgattgttttgttaacggaaatttaacggcatgtcttaaacggcccaatcaacgaaacttagctattttattgagaagtcaacaaaaacttcatgattattctaaatttaaaagttgaggctttttttttatattttttcctctatataagaaagaaaattattgagtctattgaaaattgaagcaaaaaaatggaaaaccgagaacgacgtaattgggctgagtaagaggccacgtattaaagcccagattgttatggtcggaaagtttaagattagagaccacttcacgcgacttaaacaacgaaccaaacctctctctgctcagcttttccgaccaaaagatccaagcgcaagatcaactcaaaatcaatg

SEQ ID NO: 21625 - DNA, 3003 bp, Unknown; identical to SEQ ID NO: 21624
  misc_feature (1)..( 3003): 2750-1469P.txt file - cDNA_ID_1989609; gDNA_ID_2926136; Annot_ID_138887

SEQ ID NO: 21626 - DNA, 3000 bp, Unknown; identical to SEQ ID NO: 7273
  misc_feature (1)..( 3000): 2750-1469P.txt file - cDNA_ID_1989612; gDNA_ID_1621136; Annot_ID_57792

SEQ ID NO: 21627 - DNA, 3000 bp, Unknown; identical to SEQ ID NO: 7273
  misc_feature (1)..( 3000): 2750-1469P.txt file - cDNA_ID_1989612; gDNA_ID_2926136; Annot_ID_138884

SEQ ID NO: 21628 - DNA, 3000 bp, Unknown; identical to SEQ ID NO: 5706
  misc_feature (1)..( 3000): 2750-1469P.txt file - cDNA_ID_1989628; gDNA_ID_1620812; Annot_ID_57885

SEQ ID NO: 21629 - DNA, 3000 bp, Unknown; identical to SEQ ID NO: 5704
  misc_feature (1)..( 3000): 2750-1469P.txt file - cDNA_ID_1989630; gDNA_ID_1620812; Annot_ID_57881

SEQ ID NO: 21630 - DNA, 866 bp, Unknown
  misc_feature (1)..( 866): 2750-1469P.txt file - cDNA_ID_1989631; gDNA_ID_1620812; Annot_ID_57880
aagcttttgaaccattcttgaaactttatctccttattttgaccaggcatggaaactctggaacaccggggaagatattgctcttgtggatccggtcatctttgaagagtgttttgaaaatgaaatacgcagatgtgtgcacgtaggactattgtgtgtacaagatcacgcaaatgataggccgagcgttgcaacggtgatttggatgctaagtagcgagaactcaaaccttccagagccaaagcaacctgcatttatacctagaaggggcacttcagaagttgaatcctcgggacaaagcgacccaagagcatcgatcaacaatgtgagcctcacaaaaataacaggacgttagctctgtaagtgagataaacctactgctaaagaattttgatgaaaaaatgtttaagttgtatatctgtatgtaagagtaatctataggttacgaactaaaattcagaatctggtcatgttcttgtatgaagtcacataaatatagaacatgttttattgtagacagagcatctgagcgtacttctttggaatacagtttctgctctttagtccaatcattgcacatacaaatacacagaatgtagatatgtaatcataggagtttctcgataccaacaaaactctccatttttggtacgtaattaatgattattgttggtgttcttttagttagtttcacacttttaagtcacatgaatcagttcttacatctttttgaaagtccaacctttgagatatatccggaactggggcgtgactcacagttaatgactgatccacttggttttcaatacttacacagcatttatacattttcactaaatccttgctctgaaacaaacacaaatatg

SEQ ID NO: 21631 - DNA, 3000 bp, Unknown; identical to SEQ ID NO: 5877
  misc_feature (1)..( 3000): 2750-1469P.txt file - cDNA_ID_1989634; gDNA_ID_1620823; Annot_ID_57848

SEQ ID NO: 21632 - DNA, 3003 bp, Unknown
  misc_feature (1)..( 3003): 2750-1469P.txt file - cDNA_ID_1989637; gDNA_ID_1620823; Annot_ID_57844
tttagtagacttctcaaactgacctatatcactgcctaaagtattcttctttcctccctttgcaccaccaccctcttgacctctcttctccacctttgccttccctctcatctttgcccgatcagctatcttcttccccaatgcacccggtaaaagattgtcctcatcatcaaaaccattcgcattaaaccctaaccctaaacctgagctaccaatacccaatccacctctaacttcaacatcctcatcaatcatatcattatcttcgattttatccctatctttctcatcattatgttctctagaatccttatcaatctcttgattcggcataaccgtacctgtagatacaaaattgacaggcttggttaagtctgctttccttcccgaatcacgatccttacgcctcttcctacgactgccgccgccgccagaatcatcggaatccgaatcgctctcagcgaagattccataagtagcgtcgtttttggtttgtttccgtttctccttcctcttctggtatacgaactcgtcaccttcccatcgacctccttcgtagtcattatccatactgaatctctccatatcttgatactcatccatggcgaagaaactagatctgaaactctgcgaattttccaaactatcggaggtttttggatttacgactgcaaatcgccgacgtcgccgtgtataatcggagggaaaggattaaccgacttgggctttataaataataaaggcccatttatttttgaattatagcccatttatttgtaaacttggctataacaatcagtcacctcatcttcttcattttggactcttggccaaccttatgtcgttttatcgcatctgttacaataaaacgcaaaaggtgatttttttttcaggtaaaaactatgagtttcgttatctaaccataactcaatagatactacgataactaaactaattaaaagggataaaataaacaaaaacacagttttggaaaagaaaacaaaatagaacccaccaaaacagatatagtaggttagaagtataacttataaggttaaccaaattgctcattataaccaaaaacaaaaaattgtgaacccaaaaattacgttaagaaaacgtagattccattatatcatggagttttgagtcttcaatccacatactttcgaaagtaacaaatttttccattaattctactaagatttttagggtgttgtttttgatgttttaagtttttcttattttttgtcttaatttctcctcctcctatctctcttattccaatttcataattatatatttttgcatgactagattattagaaaaaattgtttctgttttatgttatatataattaatctttctctttctgataaaatcataaaagtcaataattttttggtttaaacagtaatataaagtcatgagattttaggaacactttgttttctctaactaaccaacttttcattttgcaacatagaatagaagcattaatatattctttctggaataaatacaacaaaatccccttatttcttgtacaaatcgcataaatatgggatttgaagagtacaacaacacataaagaaacgtcccacctttttagatgttataacaaagaaaagtcggttgtatgactcggacttttctagttggtttttcaaaaatgttacgtaggttttgacgtcatatctcattatttgaaactattttccttggaatggttcactaatagctaaatgtaccattcttgttacattttttaaattagcagctaaaagtgtatacaaacttttatatatgtcgtcatttaattgcacacattggttatacaatgcaaattatttccttaaccatgtctagacttttttacttctatcaatttaattatatacttttcgtatctttatgtacataaaataagtttcaggtagtaatatcagcaaaaaataaggacttaaatgaatacgtctgataaataacttacgggatatgttatagcttcgcgacaaaaaaaaaatcctcgaagcctatagtctattaattacttgttgaacaaaacaattagtacgtactagctaatgaaataagcttacgttacaaattagtataataataaaccaacaacgcccgtagccgttaggtctattttgtcctaggtggaaaatttagtaaatgcctaatgaccctagtctacgcgtaattgcatttatatgaattattaaacttcaaaattaattgatatggttggacgaacattatcttatgaattattattatatcatatatcacatgcgtttcgcaagagagttgacattgctattcatcgtctccaaagaacaacgccacctggttccatatttattgtccccaatttaaatttaatttaatcgtgatcattgtcttagttacataaatgttaaggttgatttcgagttatacgtcaattattcaatggaaacttgtttaattatataagttgagacgaactctcctttctctacctgtttaaagataactacgatacgaagacgcaaacaaaaaaatgcgtaagaaagtaattatggaagcatcatgatcagcatatacgtactagtagatatatgtatatataaaaagataaaatactaaatactctcatgcaataaagccacatgcatgtagcgtaagggaaggaagacaaaattaaatttttggaaataaacaccaaagaacttgttgttataaattcattgccagttgcacatacagcgatttattacatatatatcccctctctctctctctctatagtctctctataaacaagttttttatcacatttcttttctacagtattttctctattcacgcatatatatagatatccagctgcctccaacatatatagtcaactgatgaaattataagcatcatcattatagttttgtctcctttttttcttcttcttttctttttctttctagctactctcttcttcatagctagatcaagatg

SEQ ID NO: 21633 - DNA, 3003 bp, Unknown
  misc_feature (1)..( 3003): 2750-1469P.txt file - cDNA_ID_1989640; gDNA_ID_1620823; Annot_ID_57840
atatctctggaaggtttctcggtttcttcagccatgttagccaccatatcaaaaccagtgtatgaccagtagacaactgcagcagattgcaccacacctttcgctccataagggaaaaaaggaaccaaatttgaggtttttgaatgagtaaaccccacaacgacgataaacacaataatacaaacagtgaccatggaagtaatcaaattcaaccaagaagtcctctttgttccagtcatggcaataccattagcaactaaaagcactgcaacagcaaccggatccaaaagatcaaaccctttagcaaaggaatcgactttaatccgaaaataatcagaatcattcttgaccaaactagctagatacgaagaccatgacctccctaatccagcagcaccaaccatagcctcaagaagaatattcccagcagcaataaaggcaataaaatcccccaattcaaccctaagataagagaaagaacctccagcgacaggaatctcaactccaaactcagcataacagagaactgagagcaatgcagagacaccagagatagcgtaggagagaacaacagcaggaccagctccaactcgagcctcctgacccgtgatcacgaacacacccgaaccaacaacagaaccaaagctaagccagagcaagtcccaccaagtgagacaacgacgcatagggttctcgctttcgcggcgggctgcatcgagctcgtacgcatcggaagagcgagagagaagacgatcggcgaggcgtggacaagtggcggagagagctgatttgtaggtagagaagctctgaaaagagaattccgggaaaaaatcctgcttcctccatctccagtagcttctccgttgacttaggtcatcggatctcgactccagctggtgagcttcctccattgaagcagggatcatctcaaatccacaaaaaatccgaaagagcgaataattggcaatttaaaaacttgagtgtctaaaatatgataataaaatagttatggatcgaaatgtaaatagtcgtctaattgtagttaaaattcgtgcagcgttcactgaaactgaaaggtggtgacagtacaaccctaaaaacgagggacccacctaaagtttttattgaaagtcgtctaataagagttataaaccaacggtcaggattggagatgtgagactcgatatcaccttttgagatgaatcgtacaaaatgcaggacccactttgtctgacatgttttgatcaaatagctaaacgccacgtgacgaatgtctattacgagatcatgccacgttcgtcgatgagcttgactgatttattcatcaacttgcttaccatttttttataaaaacaaattgttttaaaatcatatttctttttttttttgtcacattttaaaatcatatttctagtatttgttatttgtttgaaagaaaatgtattagatacagaacttgtgttttgccattcgtttttgatttgacaataacagattttgttatttagtaccttttctgatttttataattgctttcgatttttttttactgatattctacgtgacgttttataaataaagaaaaagtaaaattaattattagaagattcattattacatagtttcagatttcgtcaacagtcattttcatactttataaaacttacatgttcctgtccaaaggtatcaaggtaaaaatcccataataaaaatattactgttaatgtgacatattattttaggacaatgaaagactatttttatggagtatagaattcctttctggtattttgaataggaaaaaatcaactacatttaataattttatcaatttgcttacataattacgtgtgataaaataatagtattccggaatttattaaatgtctacctatattttggttattacccaaaatgagcttataaaattattattaataatctactttctatatttttggttaattattagtttatttaaaaacagcatcctgaaggacggagagagacagagtatgcgaggagtgtgaaaacgaagagcataaacaacacgggacgaggagagagaaactagtgtgttttagaaagaagaaagagagagatagacaaagagactgtttgtgtcttcttacccattcgaggaatcaaagcatctatttccgagctctcaagacgacgagaagctaaaagataaggctgaagaaatttagggttttttcttccttttgtattcagctcgttaattaaggtatgttcccaaattcttattcttaaagttcggctctttcctttttcttccgacttgtgtcttagttttttttttcaatcgtggtcaaaatttgttcttgagctactctgttataagggtttgtgggtactggaatctttgattcgagagcaatggagactttcaagcacctcagattttatggttagagaagtttttttttttgagctgctctgtagaataatgtgcttaggtctgtacggatttggggtaactagttggatcgcgagtgtttctcaccaggtccttggaaaaggatttgttttatacctgaaatttgggatttttcagactcatcttcaagtactttgctttgaatcggggatttagcagacttgggttcttcagtgagatgctttattcagttttgggggtttgttagatttgagagcttaagagataatttcttgttgcttttgttgaaaaactatgaatggagactagatttaattgggcttcccttggaaaccatcttgagctttattgaatctgtgtataatatgatggaataatgagagtataaactgaactcattctattggtatttgtaaatgcagggctatccatcttccgagttcttcagtagcttcacaagctggacctgaaaatagatcttggcgcatatcaggagtgtgattatggttatctgaattcatgtaatttgaagggattttcacgagctgtgatcgggtcatgaatgcgtgtctgaggacatg

SEQ ID NO: 21634 - DNA, 3000 bp, Unknown; identical to SEQ ID NO: 5875
  misc_feature (1)..( 3000): 2750-1469P.txt file - cDNA_ID_1989641; gDNA_ID_1620823; Annot_ID_57838

SEQ ID NO: 21635 - DNA, 3000 bp, Unknown; identical to SEQ ID NO: 5885
  misc_feature (1)..( 3000): 2750-1469P.txt file - cDNA_ID_1989641; gDNA_ID_1620823; Annot_ID_169593

SEQ ID NO: 21636 - DNA, 3000 bp, Unknown; identical to SEQ ID NO: 5876
  misc_feature (1)..( 3000): 2750-1469P.txt file - cDNA_ID_1989646; gDNA_ID_1620823; Annot_ID_57833

SEQ ID NO: 21637 - DNA, 3000 bp, Unknown; identical to SEQ ID NO: 5876
  misc_feature (1)..( 3000): 2750-1469P.txt file - cDNA_ID_1989646; gDNA_ID_1620823; Annot_ID_169584

SEQ ID NO: 21638 - DNA, 3000 bp, Unknown; identical to SEQ ID NO: 5883
  misc_feature (1)..( 3000): 2750-1469P.txt file - cDNA_ID_1989647; gDNA_ID_1620823; Annot_ID_57831

SEQ ID NO: 21639 - DNA, 3000 bp, Unknown; identical to SEQ ID NO: 5883
  misc_feature (1)..( 3000): 2750-1469P.txt file - cDNA_ID_1989647; gDNA_ID_1620823; Annot_ID_169580

SEQ ID NO: 21640 - DNA, 3003 bp, Unknown
  misc_feature (1)..( 3003): 2750-1469P.txt file - cDNA_ID_1989648; gDNA_ID_1620823; Annot_ID_57829
ctttgcgtgagctattgcttcatttgtttgaggacgaattccatcatcagcagcaaccacaatgattgcaatgtcagtgactcgtgctccgcgagctctcattgcaccaaatgcctagatgaggacataaaagtaagatgagtaaaactatggtatgcctagcaatagatgtgagatagtcaataaacatgctacatgtaagaaagctcatgaagtataattaatgatacttcagcatcagaaatgaacatgcgaagattcaattgcaagaaaaagaatctacctcatgtccaggagtatcaaggaaaacgcaggactgcaactttccatcaacaggcactgacaccttatatgcaccaattccttgtgtaattcctcctgcttctgacgcagcaacctgcatgtatccagcgaagggagattagctgacaacgctacttagcactaatcttgacaataagcaaatgaacaaacattaattgccagtagccatgctttagaaatgataagaaactgaagaggccacaatgaaatttcttaaataataaaaggcaaattaatagctaatctcatccataccttgctttttctgatatagtcgagaagagtggtctgcaaaataggcagcaaatgcattaggaacaacctactgctaaaaaataggactctatatatccttttaagggcgagtaggacatgagaacaaaaaaaaggcaatgcaaactgtgcctacctttccatggtccacatgacccattatcgttatgacaggaggtctgtcctctaacttgtccaaatcttcttcatcaaaagtttgccttttctttgccatctcttctactttaactgaatcagcatcaaggacctcaacatcgtaatctctacaaatcatcttcaccatctcgcggtccaaagtgtgcacaccatcaggtctaatcccttttgaatataggtacccaaggatgtcaccttctccgatggctaggttgtaagccaaatcctcgatggacatgccttcttcctctacctctaagatttcagctttgacaggtgctgcgtcttttgcagcctggagtcttacagccttcctactagctttactccattttctcccttttctacctgatcgagaaatggatgcatcatcgtcgccgtcgtcttcagcaacaattcttcgtcttggactagctgatgcattttttttattacggtgctcaactctgaacttgttagagggaggaccctttccaggcttagtaggagctaacacagcctgagaggccgcaggatcaacaccttttttcttcgaagcaaatttgtcaaccaaaataggcttcctttctttacttttaacgctagaatcaacttcttcagaaactaaaggttttgctgccataccaagatcttttaagatgggtgatttctttacgggtggagctaccataggcttcccttgtaacattggctggggtcttacaggcggttgaggtctaaaaggtggctgaggtggtgccaatggagtgcctgctttggcattcacctctccctcttctctcgttctaggttcggtctgcactcctctattaaaaattttaggtgattccttaacaactttttgcacagcagcaacagcatcgcccttacgccacacactcttcatggttttcgtcttccttgttcctccatcactcgcattcgcatagctaccatttcttgagttactactgttggcactaggctgtgacggcttaacagcctcaccaccctctttgttacccggtttcggaatttccaacttctcagctttatctaaaacttcaccaagagattcaataaccttattcctctcttcttctccatcaaacttacccccattcgacaaatctttactccaaggagcagtattcacccccaaacctctttctacccttgccacagggggtttcaagacaggtttaggagtctgcttcagcacaacctcactatcatccccatctttactccccctaaacgagttagaatctatagaaactgagttgttgttttggtcagcaatgaagtcagcagtagtagtagtagttgaagacgaaacagaatatctacacagccatttcttagtccccttaacacttctccttgacaaagaaaccctcttaactaaagcatacgatgcatccgaagaactcgttccagaaacgcttgcacaagcaccacctagactaaccagagaagccaaggacggcattgtgccgacgagaacaagcatcgatggcatctcaaaaaaaacagaaaacgaataaaacaaagcgatagcaaattcagagactttatctcattccaattgcaacgaatttcgaaccagaaatgacataaaaacttcaactttgtaaagaaattggggttatcgacgaatcaaatccgaaagcatgaagctgaattgagaatcgatgagcaatttagatatatggtgagagaaagagagagaggaagaagaagataagtgaaggaggaagaagaagaagagagtgcggagataactttgaacttgagcttgtgtgggtgtggctgcttctatgcctggaattttcgcggatttccgataaggccaacttacaaaattaaaattaaaatccataaatattttagctaacaaaaaaaaaaaacacttttgtttgtctgaaaagtaaggctattgggctcgtctctaaagcccatttataaaatcagacccggaaacttctgcgtgatagacacacgtggctacatttaagccgtatattgtaaatataggggcaaattcgtcattaacaaattaaaagtatttaatattatcgataagtaacagagcatttaatactaaatttaataaatattaaataacgtcaagagagagatttgtcatttgagacctcaagatttctctttctattgcctactctctgttgaaaaagtgaagaaggcccgatatagagagagagtgtgtgtcgttgacgaaggaggatg

SEQ ID NO: 21641 - DNA, 3003 bp, Unknown; identical to SEQ ID NO: 21640
  misc_feature (1)..( 3003): 2750-1469P.txt file - cDNA_ID_1989648; gDNA_ID_1620823; Annot_ID_169578

SEQ ID NO: 21642 - DNA, 3003 bp, Unknown
  misc_feature (1)..( 3003): 2750-1469P.txt file - cDNA_ID_1989662; gDNA_ID_1620833; Annot_ID_57911
aatgaacttttactaatttagcgagcatatagtgtaagatgctttggtgcattgttctggttagataccagtatttcattttgtttactgtggagtctttaagctcctcgacgttttgcaatagtgggttccttcttccctcctattattttacccagcatcgtctcttacaggttcttgaccaaactgctgactgtggatttgcctcgattatttgtccgaccgaagaaaattgtcttggactttcagaaaggaaaagctgttggacctgttttagaagacctgaaatcaggagaaatgcaggaaggcaataaggattttgtcggggaactatctgttactcttgttgacgcccagaaacttcgatacatgttttttggtaagctatagttcctttacatgtcagtgtttccttcatagttggaaaagtggaatagacagacaatctattgctgaagtatcagcctctttgtgcaagttcagtcgactttcttgggaataaagtagctatactaattgagtctattggtgagatgttttgttttcctcggtaattggtaacaggtaaaacggatccatatgcaattctcagattaggggatcaagttatccgtagtaaaaggaacagtcaaactactgtcattggggctcctggtcagccaatttggaatcaggtgaactgctttggatggttcattcacaatctggtggtgaattatgattatttaaggattgaaatgtaaatagataagtgtgtattctttaactttgcaggactttcaattccttgtttcaaatcctagagagcaagtattacaaattgaggtcaatgatcgtcttgggtttgctgatatggctattggtactggagaggtaaataatatttccttgggtacatatttttttttgtaatctgtagaataataggcgttgagtacgtattctgtggatctctttaatgattgcttgaggaatgttgcttaatatttatgttactgtctgcatagccttattatttagttatatgtccaggttgatctcagatttctgcaagatacggttcctacagacagaattgtggttttgcgtggtggttggagtttgtttggaaagggatctgcgggtgagatactgctacggcttacatacaaatcatatgtggaggaggaagaagatgacaagaccaatgtcaaagccattgatacttctgacgatgaaatgtctgattcagaagaacttggctcatttgtgcggaagggaaagctttcgtcagatgatattgatcaagagtcatttatgaacgtgttgtctgcattgattgtgagtgaggagtttcaaggcatagtttcatctgaagctagagacggtataattgatggtggtgactcacttggggcaccagtaccttctaagccagatactagtaaggggtctgaaagaaacgcagatgtatcaaatttggatttgttagttgcaaattctggtagaggagctggcggtgatggaggtataccgaggctcaatctcttacgatgatttcctttctatgctttcttgacctgaaactgtaaaacctcctaatttcaggattagcattactgtggttcggtattatcacgggtatattggttcttgttgctatcaacatggaaggctcaagtttcttcaacccgtagtatagtactatacatctcgctggagatttctgttgcaagtaagtctcttaatatatacctcgagaacttgaaatttcttcccctgatgtgattggacagacagattctctttttgtcagttgttttccttatattagaacgtggaacaacactggtttgttcatatagtcaagaaccaaacttgaacttcttttttcctagaataattatgctacttgaaacattaaaattgtagattctgttactctttctgctgcttgtagtgtaccgaaagtcaaaactggacatcaggctttgtatttgataaaattatgtgtgaattgaaaatgagtcagttgattcttctaccttgtgtgacatagttcagtccagatattttcatgtcaaccttttgcctaccgtgtgtgataagcttatcaaggcctctttattttgtggcaggtctggtggtcatctcttctcaaccttagatatggcttataacgaggtctcagttttgtaatttaattttgtatgtaaatagccattagaagagggactcttactaaaggcaggaaggtttggatctattctgtccaagctctcactgttgtgttactctttacacttgtggttgatatacagtacataaaaaaagatagaaacttttgtatattttgaccaaaaaaaaaagagaaaattctgacttttcggaaataaaatataatcatcgattgtttcaataggattggtagtaggagcagaacttggttcgtggaaccatccttcatttccattcccttatggtaagattgtggtatttcatgattctcaaataaagtttgacaaagatagactgatcgaaaaggtggagcctcttgttaacatgggacagattagttgtgtcgccgctgaattccatgatctcactgatggcagactcaataatggttatggtattgaatgaagctctcacgtccatgttctgttgaggcttacaagactgttctagttggtggggaagttgtccgaaccggaacataatccaaaccgaactgaattaaatttttaaaattaaaccgaactgtccgaccactacaaagttttttcgaatttgcacattaaattaattaatttttgtggcattttgcgatcagttaacgagtggatatgaggtagcaaacgtagaaaggactcgagaagtcatggcttctgcttaatctcctcttccttaaaaaccagaagatcctttgttccacgtttctcgtttgtagcttcttctctctcagaattcaattcgaattttgacaagtcttgacgaagaagaagaaacagagctgcttcaatg

SEQ ID NO: 21643 - DNA, 3003 bp, Unknown
  misc_feature (1)..( 3003): 2750-1469P.txt file - cDNA_ID_1989663; gDNA_ID_1620833; Annot_ID_57910
caaactaagttttaatataaaaccgaaaatgtatcaaagaaaagatttgaagttttttgagattaacgtgtattaataatatacacacatggatgtatatatatgattaagaagatttggagtcatcctttagattcttcactctgtcttgttactgccgtggggttcatgtcagacccacaaggccacaacagtcttgactgtatgtttcttcttgtttttctctgtaatactattagtaaaaatatcttaaaaaggaataattctggtaaggtactatcagttacacttgaaatacatgtcaaagactaacaattattcatgtacttttctattcacatgttttactggaattaacaatagttcatcattttcaaaaattgtagaaataatgattattatgtcagtgtatgattgattcctttataatttctgttgttttgttattgtacagtctcatccgaatctaacaccccaagatcgaacagagatatgtcgatgtctcaactacaagaaactaacaatggagacgtgcaaacagctcgccagaaaccctaagatccctccagaaatcgccattgaagcactcaagtccagatgtgggaatcaagaacacacaacttcagatgttaaagttgcaaacaagagtttttcttgtagatattcagaagagaagaagaagcctgtagtattgcatctcgagataacagagaaattagccgagaggttgaagactaaaggaggatataatttgaaggttatggatagtttcagagaaggcttatgaggaaaatggtaaacgtcccaagtcatgattcagcagtcacatcttccaattcatctggcaatctcatttgcaccccaacagtgtcgagagtcttgtacaaatcatcagattcaaggggtttcttatcatcgaaagctatgaattcacaaagcttgcctttcacttcgatccaactaaatcctggcgatttcaccacctgttgatctttcatttgctttcttacccgagcgacttcatcccagttttgggattccgagtacaaattagccaagagagtgtatctcccactatgactaggttgcagcttgatcacacgggaggctgcgtatttacctaactcatagtctttgtgtaacaaacaagagccgaacagagctccccataccacatttgttggctccattggcattctttctatcaaagctttcgcctcttctagcaaaccttttcttccaaataaatcaaccatacacgcatagtgatccgcttttggctccatattgaaacgtcccttcatgctcaggaaaagccttcgaccctcttccacaagacctccatgagcgcaggcacttaagacagccatgaaagtaacttcatttggtgaaacatgactactcaacatggtataaaagagatcaaatgcatctctagcatatccgtgtgctgcaaatccattaatcatcgcggtccaagtatacacatttttctcatgaagtctctcaaaaacaagtatagcttcctctaaacacccgcacttgacataaagatcaatcaatgtagttccagctgtagtgtttatctcaatcgaattcttaatcatataacaatgcacccttcttcctcggtgaagtgccccgacatgagcgcacgccgaaagaacactgcttagagtcttctcattaggcgcaacatcactctttaacatctcctcgaaaaccaacatccctttatcgaagcaacggctttgcacatatccagcaatcaacgccgtccaagtaaccacgtttctgctaggcatttcatcgaacactttctgggcatcatcataacaactacatttcccatacatatctactagagaacttcctatgaacacatcgcatttcactctccctgtttctaagtaaagcccatgaacgcttctcccaaatcgaacatcttcaaccttccctgcagctttcaagacgctaacaacggtcatttcgttagccgcgactccagtcttcttcatctccacgaaatacaccattgcttccgaagcagaaccatttctcacaaacccatcaatcattgcagtccaagtaaccacgtccttatcttcagctccatcaaaaagacgacttgcaaaatcgaataacccagaactagaataacccgaaatcaacgaattcctgacaaaaggatccgaatccaacccgaatttaacgatatgagcatgaaactgaaacgggttcgagtctctcagtttgaaaaccgctttgagaagcggaggaaacgtgtggcggctagggatgacgccgtttcgccgcatatgacgataagcaagaaatgataaccgacggttgagagtaatcccgccggagaagtgaccaatgagcgaatcccatagttgaatgctcagagtttggagttgacataataaacgacgagcgtagcggaattgagttgcggcggtgcagcagcgacggagaagacgtgagagaaagagatcgcgacgagtatagaatatcggagaagttaggagtaagcaatggatctgcttgagatgaagaaagtgtaatggaagatcaagcaatgttttgagctcaatcatgtgaattgagaagtaagcaaaagagagagagagagggggtggttaatacttcaattcgaattttccagttttcagatttcagatttcaaaggaaccgaaccgaaccgacattaaaccaaaattcccattcaattgaatcgaagtgactctgaatatcagtcggtttagtttttatatattttttttaatagccgtagagggggagacgagggttcgatccacgtgtcaaacagtccagagaaaaaaacagaagtaagaagagaagaaaatgaacttcttcttctgcaatttttctaactttgttagcttctacagattttgctacgagccattggagaaactgttattgccctaaagatatgcgttatttttctccttcttcttcggatacgattcatagatg

SEQ ID NO: 21644 - DNA, 3000 bp, Unknown; identical to SEQ ID NO: 5930
  misc_feature (1)..( 3000): 2750-1469P.txt file - cDNA_ID_1989667; gDNA_ID_1620833; Annot_ID_57906

SEQ ID NO: 21645 - DNA, 3000 bp, Unknown; identical to SEQ ID NO: 5930
  misc_feature (1)..( 3000): 2750-1469P.txt file - cDNA_ID_1989667; gDNA_ID_1620833; Annot_ID_169752

SEQ ID NO: 21646 - DNA, 3000 bp, Unknown; identical to SEQ ID NO: 5933
  misc_feature (1)..( 3000): 2750-1469P.txt file - cDNA_ID_1989670; gDNA_ID_1620833; Annot_ID_57901

SEQ ID NO: 21647 - DNA, 3000 bp, Unknown; identical to SEQ ID NO: 5933
  misc_feature (1)..( 3000): 2750-1469P.txt file - cDNA_ID_1989670; gDNA_ID_1620833; Annot_ID_169744

SEQ ID NO: 21648 - DNA, 3000 bp, Unknown; identical to SEQ ID NO: 5924
  misc_feature (1)..( 3000): 2750-1469P.txt file - cDNA_ID_1989673; gDNA_ID_1620833; Annot_ID_57898

SEQ ID NO: 21649 - DNA, 3003 bp, Unknown
  misc_feature (1)..( 3003): 2750-1469P.txt file - cDNA_ID_1989675; gDNA_ID_2214462; Annot_ID_133010
aaattaaactaacacctttctaaattgaaaccattgtcacataacacatggctaacttgaaattcttgctgtgcttgttcttgatctgcgtttccttatcgcgttcatcagcgtctcgaccgatgttcccaaacgcagacgggattaaacgagggcgtatgatgatagaagcagaggaagtgttgaaagcgagtatggagaagctaatggagagaggttttaatgagtccatgagactcagtcctggaggtcccgatcctcgccatcactaagtcttattctcgtagttttgaattcgaggatgtatattttgttcttgatcgagaaccggtttagaagaaaacatatcgatcctctttgtttgttttttttgccttgtttgttcgttcggtgtaaccaatatattgatgtatctgtttcgttacacatttatgatttgtgcatgctttacgtaccttatacattccactatatagtagtctagtagagaggaggactttgcatataaattgttatataacaagaaagggtaaagaaatatagtatgataagggaggattgaattaatttaatttatcctgttttttcagtctctaatggctcgtgtagaaaagtatatattatatatggactcttttgcctcatcgtccaccaatgaaatatcacataaagagagaacgatagtgattgaagtttttcaaaaagaaaaaaaaaacaggggaaaacagagagaattatactttttaagagcgaagcaacgtcttcaaatcttcaatttttcagagatcaaacccttgaaatgctgctctttacgaaactcattttccaaaatctctttttcatcactttcgttacaaattcacaaaaagttacaagtcgtgacaagcttgagcttaagtatgtgtatgaatagtgtgaccaaattgttttgcaagagatcaagtaacttgttacaaaagaaatgattcaacgtaacttacaaaactataccaatttaccaaatcagttatctgtggaaagagggtacctacagtacctctcatttttcatacacataaagaatctctcataagccgaagccatttgagtcgctgtaaacatcgaaagagcgtatcccttacaagctattcctttcatctccaaaaccctaggcccatctcttacaacagaatccaaagtctcaacaagagatctcacgtttggagaaaatgtgtacccaaaacgctcgtccacaaccactgtcccaacaatgcttggataattaggtgccacgacaggtttcccacactgcatcgcctcaatgatcgtcaaatcaagcccctgtggtctcaacgtcggattcacaaacacatctaaagcgttgtagaaaccagagagctcctctggctctaaagctcctaaaaccctaacgttttcgcctaattccgcgtatcttttgccccaaggaccagatccagccacaagcaaatagactttcgggtgcattttaacgagcaaagcaaacgcttcatatagaagtggatgtcctttgtctctcaccaaacgtccagacacacccatcacaatatatgtcccattgtcaggaataccgtgtttcgccctgaacctagctccagattcaggagaatacacgaacttggtttggtcaacaccgttgactataacgtgaacttttctcttaggaagttgatagatgttaactagtacctcgcgcgcgctgttgctaatgcaaatatgctgtttatattttgggaagaatctgatttcatcgacgagtctaggcatcgtttgttgaagatcagagctaggacgatcattggaaagttcttgaaaaagatttgaatgcataatctcgtaccagattccgtgccatgtcacagctatgtcaccattaggcaccattttgactcgccaatgaggcagagaaacactctcagtgtgaacataatcaaaggaatgatgatctagactgttgattttatggaagatctcaaaagctcgagagtggttaagtgagccgtgttcgtttggagcaaagtagacatggagatctcctttgttgtagtactcttctcggttacttctgtcggaagaaaccgtgaagacgtgaatctcgtgacctcttgaggcgagagaagtgtagagtgtgtaagcatgacgctccattcctccggggatcgaaccaacaggccatgacttgcagaagacagcgagtttgagcttctccgagattggtccaagtgagagtttgttccaagggaatgtcaggtctcgaagatctcctgcgaaaggaggattttccggtgaagaagtcaccggagagtaatcaaactgtgagaagaaaatgtagtaagaagaacaaaagatgaatgctaaggtaatgattgttgtgaatctgaatgaaaatgaagtggaagaagaagaagaaagagttgttcttgaagaatggttcttgaaggccattgttttggtttatttgatttttgtgaattgagtgcaactattgatgttgattctttgcttaaatttcggatctttctcgagttattatatcaaagttcatttctcaatgacattgcacatggcttagctaatttttatatggtttttacattcaattgaaagtcaaatctctcttaaccaactgagatttgtaactaaaccgggatatcacacctaattagttttcccggtttgatattttgttttgtacacgtaggcgtgtgattactccgtcacactttacacatgtgtaattcccctaatttatcgggtttctttaggcgcgtgagataatgcgcgtgtgtctacgctattcttgcgacgctgtgcttcctagggtttcgtcgttgcaaacacagtcaatgttcatgaaccacggatcctaatctccccgatcttcgattcattgtttcagaaatccccaattactgtctctgtgcgtaaaatctctagagaaaccttaaaattttccgttcagagaaattgtcaacgaaggtaatg

SEQ ID NO: 21650 - DNA, 3000 bp, Unknown; identical to SEQ ID NO: 5969
  misc_feature (1)..( 3000): 2750-1469P.txt file - cDNA_ID_1989675; gDNA_ID_1620834; Annot_ID_57953

SEQ ID NO: 21651 - DNA, 3003 bp, Unknown
  misc_feature (1)..( 3003): 2750-1469P.txt file - cDNA_ID_1989681; gDNA_ID_1620834; Annot_ID_57947
gtaacaacagtctacaagggccggttcgtttcggatcacctaattgcaagaatttgttgactttagatttgtcatacaatgaattcgaaggcggtgttccacctgcattgggaaattgcagtagccttgacgctttagtcattgtgagtggtaacttgtcaggtacaatcccttcctcattgggtatgttgaagaatctcacaattcttaacctttccgagaatcgtctctctgggagtatccccgcagagctcgggaactgcagtagcttgaacttgttgaagctgaacgataaccagcttgtaggcggaataccgagtgcattaggtaagctgaggaagctagaaagtctggagcttttcgaaaaccggttttcgggtgagattcctattgagatatggaagagtcagagtcttacgcagttgctagtttatcaaaacaatctcactggtgaactacctgtggaaatgactgagatgaagaagctaaagatcgctacgctgttcaacaacagcttttatggagcgataccaccgggtttaggtgtgaacagcagcttagaagaggttgactttattggtaacaaacttacaggagagataccgccaaatctatgccatggaaggaagttgagaatactcaacttgggttctaatctgcttcatggtacaataccagcttctattggtcactgtaagaccatcaggagattcatccttagagaaaataacctttcaggtcttcttcctgagttttctcaggatcatagtctttcttttcttgatttcaatagcaacaacttcgaaggaccaatcccgggcagcctcggaagctgtaagaatctctcgagtattaacctatctcgaaacagattcacggggcagatacctccacaacttgggaatctacaaaaccttggttacatgaatctttctcgtaatcttcttgaagggtctctaccagctcagctatctaactgtgtgagtttagagcgttttgatgttggcttcaactcattaaacggttcagttccttcaaactttagtaactggaaaggcttgacgactttagttctcagcgagaaccggttttcaggaggtattccacagttcttgcctgagcttaagaagctgtcaactctgcagattgctagaaatgcttttggtggtgagattccttcgtcgattgggttgatagaggatctgatctatgacttggaccttagtggaaacggattgacaggtgaaattccagccaagttgggagatctcatcaagttaacaagactcaacatatctaacaacaatttgacaggatctttatcggttctcaaaggtcttacctcattgctacatgttgatgtctccaacaatcagttcacaggtccaataccagataacttggagggtcagttgttatctgagccgtcgtcgttttcaggaaatccaaacctctgcattccacattccttctctgctagcaacaatagccgcagcgcgttaaagtactgtaaagatcaatctaaaagcaggaagagtggccttagcacctggcaaatcgtgctaatagcggtcttatcgtctttattagtcttggttgtggtccttgctcttgttttcatttgcctacgtcgtcgcaaaggaagaccagagaaagatgcttatgtcttcactcaggaggaaggcccatctttgttgttgaacaaagttcttgcagcaactgacaatctaaatgaaaagtacaccattggaagaggagctcatggaattgtgtacagagcttctttaggctccggaaaggtctacgctgtgaagagacttgtattcgcgtctcacatccgcgctaaccagagtatgatgagggagattgatacaatcggtaaagtcaggcacaggaatctgattaagttagaagggttttggctgaggaaagacgacggtttaatgctgtatagatacatgccaaaaggaagtctttacgacgttctccacggtgttagcccgaaagaaaatgtgctagactggtctgcacggtacaatgtagcacttggtgtcgctcatggactagcctatctacactatgactgccatcccccgattgttcaccgtgacatcaaaccagagaacatactcatggactcagatttggagcctcacattggggatttcggtttggctcgccttcttgatgactcaacggtttcaactgcaactgttacaggcaccaccggctacattgcaccaggtaatgcatcttctcattatacatagtggacttggtataatctggtttagtgttcaaaccgagttagttaccggttaaaaaagtctgttaggaagatactctgtttcttattagctaatttcacaattaaactgcagaaaacgctttcaaaaccgtgaggggaagagaatcagacgtttacagttatggagtcgtgttacttgagctggttacgaggaagagagcggtggacaaatctttcccggaaagtacagatatagtaagctgggtgagatctgccttgagcagcagcaacaacaatgtggaggatatggtaacaacaatcgtcgatccgattctcgtggacgagcttctggattcgagtcttagggagcaggtgatgcaagtgacggaactggcactgagttgtacacagcaagatccggcaatgagaccaacgatgagagatgcggtgaaactgttggaagatgtgaaacatctggcaagaagctgctcctctgattcagttcggtaatctcgttactttgtgcagagcagaaggaggaaactaaaggactgttatcagtggtaacgtaactgggcttaccggtaatgtaactgggccaataatgtaaaatatggcttattgaaggcccaaatatgacggccctttaattgtaaccgtgtttgtttgtgaaataaaatctcgtttatcaaatttctgtttcctattttatttttaaaaaaagtgttgggaaaattttcgtttggccggagatg

SEQ ID NO: 21652 - DNA, 3003 bp, Unknown
  misc_feature (1)..( 3003): 2750-1469P.txt file - cDNA_ID_1989682; gDNA_ID_1620834; Annot_ID_57946
caatttaggtagaatatcaaagatctcctcaatttgctgtataatggtcatctaatttccaacttatcaacttccttgttaacaatttaggtagaatatctaagatcttctttctattattggcgtcaatcagatcgattataatctgtcaatatccttcaaggtgtcaatcaagttctattttgtttccctctttcctctctcctcttgcccttgtctctttataacatgcgagctccatttgtacatttttcttgattttcaagtctcagatggagaatcttgggttgttccaaattcttttgctattctgtctctttgtctcggtccgcatagtttctgtttcttgtttaaattcagatgggttaactttactctcgcttcggaagcatttggacaaagtaccaccagaattaacttcgacatggaagactaacgcatctgaagccactccatgtaactggtttggtattatctgtgatgattctaagaaggttacgtctctcaacttcaccggttcaggtgtttcaggccaattgggtcctgaaatagggcaactcaaaagcttagagatattggatatgagttctaacaatttctctgggattataccttccagtttagggaactgtagctcacttgtgtacattgatttgtctgaaaatagtttctctggtaaggtccccgatactctcggtagcttgaagagcttggccgatttgtatctttacagcaactctcttactggggaattgcctaaatccttgtttcgcattccggtgttgaattatctgcatgttgagcataacaacctaaccgggttaatccctcaaaatgttggtgaagctaaggaacttcttcatctgcgtttgtttgacaatcagtttactggtacaatccctgagtctattggaaactgcagcaagctggagattctgtatctgcacaagaataagttagttggttcattgcctgcaagtctcaatcttttggagagtctcactgatctgtttgttgcaaacaacagcctaagaggaacagttcagtttggctcaaccaaatgcaggaatctggtgactttagatttgtcatacaatgaattcgaaggtggtgtccctcctgaactgggaaattgcagtagccttgacgctttagtcattgtgagtggtaacttgtcaggtacaatcccttcctcattgggtatgttgaagaatctcacaattcttaacctttccgagaatcgtctttctgggagtatccccgcggagctcgggaactgcagtagcttgaacttgttgaagctgaacgataaccagcttgtaggtggaataccaagtgcattaggtaagctgaggaagctagaaagtctggagcttttcgaaaaccggttttcgggcgagattcctatcgagatatggaagattcagagtcttacgcagttgctagtttatcggaacaatctcacaggaaaattaccagaggaaataaccaagctcaagaatctcaagatcgttactctcttcaacaatagcttttatggagtgataccacccaatttaggtctgaacagcaacttggagattatcgatttcattggtaacaattttacaggtgagataccacgaaatctctgccatggaaagatgttgacagtgtttaacttaggatctaaccggcttcacggcaaaataccggcatccgttagtcagtgcaagactctaagcagattcatcctcagagaaaacaacctttcaggctttcttcctaagttttcgaagaatcaagatctttcgtttctcgacctcaatagcaacagcttcgaaggaccaatccctcgtagtctcggaagctgtaggaatctcacgaccatcaatctgtctcggaacaagctcacgaggaatattcctagagaacttgagaatctacaaaaccttagtcacctgaatcttgggtctaacttattaaacggtacggttccttcaaagtttagtaactggaaagagttgaccactttggttctctccggaaaccggttttcaggattcgttccgcccgatcgccactcttagagagaaggaaaacaaccatgtattccagtgacatcatatcaaacatttttactatacaacatactctcttttttttctttgcttaaatcgttgtataccttttcaccattcttattgccgcttagtacatttttaattgataacacaaaagtttcggttgataagatccaaattcataatatacaaaattcttatttaacattcaataagaaaaaacaaaatttgctaatgctacgatgttacccactcggaagcttaccatagtctgttagtcatagtttgaaagtcaatttggtcagctgtagcttacggttaggctgttcttatcaaataacaaaaagaatgtcaaacacgtattttatcgtattcaatttagggcacgttgataacgtttccaaaacaattattcaatagttggtaatgaaaattaatgaaagacccaaacctaatgaatgttaaccactaattgaccattcaccaaccaattatttaatgaaatatctttgttagtttcgttatttagtattgttaacggtttcttactctttttgactacatcagacggacgtaaaacgacatcgttgtcgaatattcaaaagattcacaatttgacaaagagaaacagagacgacttgtttctaaaaaaaccacgtgtgtctgaaaacggaaaaaaagaagactgaatgagaaacggcgtgtaaaaagaaaacgcgttgaaggttaggctctcacaatcgttggtatacagagagaccaaacatctcgtcataaaaaacggcaagaatcatcagttactttatacccatcaatcaagtcttgtcctttttctccttctctctctcatacgagcttctttcctgctgatgaggcttgagctttaaattttcaatcttgattgagattctgcatgtttctcgatctttaaactcagatg

SEQ ID NO: 21653 - DNA, 3003 bp, Unknown
  misc_feature (1)..( 3003): 2750-1469P.txt file - cDNA_ID_1989684; gDNA_ID_1620834; Annot_ID_57944
aaggtattggattccaggacagcaatgtaagaggacgatagatatgtgtttaattgtcttatctttctttacataaagaactaggagattccagaaaacttcaagaagaaacatttacgtggaacaaattccaaaagtgttcatcatagtgccaaaaagaagatgagaggaatattatattacctcctgttttcacattatcaatatttaagtttgctctagtatgtactatgctatatgaacatgtcctctgctttctgacacaggaaggtttgaaatttgccataatggttactctgaaagtaagatcaggccatttatcattatatctcaatcctgtttttttacatgaactatagacgaactcctgtactccgttattacatgaattaaccgaggagtccaatgatagaaagaaaaaatgaacaaactaactgtagaaccatctgatagagagctacaggtgaacgtataacagaaaaagaatcagcaaactaatccagaaaatgcgaaagagcccatcttgcggaaatcatttctatctcatcctctctctcagcatcttcagccccatgtacctgcaattaaagccaatgaaatttgtttttaagtctggtcaaaaaggactgatacagtttcgaagagtatacactttgatggtttcttcttaccttccaagcatcatcaaggtagcctgaggattagtccctggagagatattgaaggttgatccatccacgagtctaagagaattaacaccaatgactttgagatcagagtccactacttttcctacaacagcgcctccatggtagtgccagattgtgctcacagttcgtctgcagaaatctgccatcacaagatcatttgattggtccacaggcaatggagctccaacaaacctgaacctacggttcccaaaccattcccttatcataaagtcctgcatagctcggctcctgagtatttctccaatcttcctagtcccattgacacatctctctagatcctgtggatcactgaagtagttgaatctaacaactgggttaatcctcacatccgttgacgccaaccttagtaaaccaatagacactggacctaggatcttttccattatagttgtcacagggacgtacaaaggagaagctggagctctgatgaacacagaatgtaaaggcgatgcaaacggaatcacattcgaagcagcctccagaaaagccccatcctcagtaacacccacgacttgtatcagtgagttctccattggaaccggaggaacaatggagataccattcctcgggttatcatacacaaaatcccccacatgaggctggtcaagagccacagggatcccccaagttgaaagataactccttggaccaatcccactaagaaaaagcaactgtgggctaccgagtgcaccagcagacagtatcacctctcctctgtcccgtatcaatgcgtgatggaaacgtcccagctgatcacggtaaaccactccaatcgcagaaacgttggaacctgagacactaggagatgaagcaagcaatactctctctacagttgcgtaaactgcaactctaatgttggaactccttgcatatctgagaagatctgcagagctgtgtctcctcccagtacgatcaaacgtggaacctccgatcttagtccccactttatgctccaaggtgaagccattaaacggatggacaccaacttcaagcaacgcatccctaattgcagtttgccaagtcctgagctgaggtctaaacacaatcgctctctcaacccactcataagactgattcacactactcagatcccaaacaagacccgaattctcaaagaactgtttatcagcacggctatagaatccagcattgatcgcactacttcctccaagaacacgacctctcgcgttaggaactccttcctcagagatgaaagactgagccggcgagtcgaaattgttgacgtcagtgagagtggtcaagaaaccgtcgtgtgacatcacgttaggtctgttgtagggaacgccaccgcgttctagcagaagaactcggaaagattgcgaaagtgtggcggctagtggacatcccgccgttcctcctccgacgattatgtaatcgtagtaatcctccgacgcaaaatcagttgcgttcgatatgaatcgcatgaaaccgggagctgcaacgaaggttccaacagtaagaaacaacaatgaaagagaagaatctcaaaatcaaattagggataagctaaacatcgatcatcgttttcttgctattactcaaaagcgatacaaggaaatcaaagaaacctcatcaaaaacttcttcgtcgccaaagattatgatgtttcaagcattaacatgagattctacagaaattttctcggaaacttacgtcgattaacgcgtggccttgcattagagcgatgaactactccaagaagaagaagcactacgagcgccgtgtagagaagagaagaatcaatccgtttcgtcattctcgttcttctgttgaagattttctcggagctgatagaaaattaaattttctcgggaaagtgagaagtttctcagttagagagagaaacagagtaaaagtagttaaaaaagaagactcaaattaaatggcgcttggattctgttatagagagagtttctcagctctggaactctgatataaaagtaatcacagccgtcgatgaggtttagaccaagttgagatcagcggttgtcaagagaagtagtcctgagctctaccgcagtggataatagcatgcaatatatttgacgccgttagcaaccgtctctggaccctttaacgtcgtcgtcttgttgtaaaagtaccgatttgataactgccaatcaaattccggttcaatccggttaagggaagataacaggatttagccacgtgtcatgaggttgtgcagattagactgtagccagtgttatcactaccgtctaaacacagagagagagagagagcaaaaatg

SEQ ID NO: 21654 - DNA, 3000 bp, Unknown; identical to SEQ ID NO: 5950
  misc_feature (1)..( 3000): 2750-1469P.txt file - cDNA_ID_1989687; gDNA_ID_1620834; Annot_ID_57940

SEQ ID NO: 21655 - DNA, 3000 bp, Unknown; identical to SEQ ID NO: 5952
  misc_feature (1)..( 3000): 2750-1469P.txt file - cDNA_ID_1989689; gDNA_ID_1620834; Annot_ID_57937

SEQ ID NO: 21656 - DNA, 3000 bp, Unknown; identical to SEQ ID NO: 5978
  misc_feature (1)..( 3000): 2750-1469P.txt file - cDNA_ID_1989697; gDNA_ID_1620834; Annot_ID_57924

SEQ ID NO: 21657 - DNA, 3000 bp, Unknown; identical to SEQ ID NO: 5976
  misc_feature (1)..( 3000): 2750-1469P.txt file - cDNA_ID_1989699; gDNA_ID_1620834; Annot_ID_57922

SEQ ID NO: 21658 - DNA, 3003 bp, Unknown
  misc_feature (1)..( 3003): 2750-1469P.txt file - cDNA_ID_1989705; gDNA_ID_1620835; Annot_ID_57968
cataatctattgtttttttacataaatgcattgtgttaccgttacttcaaattcatacattgcaatatacggaaaaacttttatagatgatatctctttacaaaacctaaaaataacactagaacgatacttttgcgacactgaaaaatattatcacatcatcattatgattacaaagatgattcagtcgtgtacgttataacatgtcgaaattcatggtcacaaatcacacccatctgtcattctctttcttggacttcctaaataacttttagcctttttcccagattatattcaataattgacgatcgataactttaaactattcattctttaagagtgagtaaattgaaaagtttatgaacatttcacattctttaatcacgtgtttaagccaccagtagccatcattgttcactttcaagattgtctaaatcgcttcgacgtaccacttcttttgaagaactggaatcaatattgatcgtccgaagttttaaccactcatttgatttgtatcaatatataactgccaaattcttatgtgttttagtgtttatttcatacggctaaaccgtatacttttgttcacgtgtatctttgattatttaaccacaaacataattttattgcatatagtgtgtttattaaatgatactgtactttagtttctgttttgtataatacttctttttctttacaataatattttagtactctattgaactcaaagtttgaccaaaattttagatgatatttttgtaacaattaaaagagggcacatttttaaacttagccataaacattttgagtcactcagtcatagccttatacgcacaacactgtgtgtactagctttattgtggaatatgtatatttttgtgtagatctttatgtacattagctagaattatcaattatataaacacttaaacagatggaataatttggtagttaatggaaatggttaagctgacatatgaagtgcttccaaaagttccctaaatcttttgccgatatctaggattatttattttgttaattgaatgtcaattgagtgaaaatattaagatataataataggttgattcgattatgataaatagttgaataaagtgtataatatggttttgtaaggacggcagattttatcttagcttaaatcacaattaatcattcatgtttggacttattcgaggaagttgtgtcaagtaatattttatgcaatcagaaagatacagcaacactaagtcacaagaaggtcacgacattctctgtctcagccatttactcatgtgaaactttggctctgtactaaaaaggtagtaatgcccatatcgggaaaaaaaattataagaataaaatacaggaaaatatttttttctactatataagtgatttaatgatatattaactaaatttatacaataaattgagctatttggttttgtaaaactcataaataaaaatgacatatattaactatactcataagtactacattgtgatgataatattttaaaactcaaatatcaaatcaataaatgtctaatatcaatttcattgataattcatttttgaattttatttctctattaatctatttaaaaagatatgtttaccgctagcctccaaccactagttagaggttaaccactgtagttctaatttcagttcatctcaatttttgttttggttaaaaagtttaaaccgatcatctctacactaaattcagattttagtttatgtgaacaaataattccgaagcgacgtgttaactaatatcatgaaggggaattagacagaagcttaacgatgagaatataggctaaaatttatgtcgtccaaggagtaattgagtgttgcctacttcacgagacaaataagtaaacctaacaataacacatagacacactcgacgccattagccaaattccatttgagccatccaattccttagtggatcttctttgtctccagcccatcttgtctccttatttttctaatgattactttataaaaagtgttttatcaaacatcacaaaatataaaaagaatttccaaatacttttgatatttaactattgcttttttgattattagccggggtaccaagatattagtttttaatttagtaatatacccatatgtttaatattgatatcgatattgatttattcatattacgaaaatggattagttagagaatgtgaaagaaaggtaaagtaaaatattgaaaagcaaagattaggggacagaagagaaaaggtatgtctctgccatgcccatccccaaaagtagagtgccacatgtagaccttcttcttaagatctaactcagatgctatttgtacaagtaaaaaatgtggcagactcagtttctatttttccatattttactttaatcttcatgaatcataaaaaatgaaaaatcaagcacatgaatgtcactgaaattattcaacaatattcttatttatcagttattttaattatttgactatttatgtgtatgttgttatctacaatatgtccgtttcaatcagtcgaacaaaaaatactagattttagttatgtagtataaaatataaaaatgttgaaaaacactctaaccattaatttgtattattttaaactttccatatgatgagatgtattattcaatataataataaaaagaatattatttaataattaaacaaaaacataataaatcttataaacaatatcttaaaagaaaagaactatattgttatttttttgataagatcgataaaaaatgtaacatactaaagaataaataaaataaaataaattagtaaaaaggaacttgggtggtcacgtatttgctgtataaagaggtgtaaagtggcatccttccttaaattatatcctcaaaaaccaaacttgctcactccacacacacactgctcccaagtcctctcacttcttcttcttcctccgacaccgttgcttaacggttttccatttttgtcccttcaagatg

SEQ ID NO: 21659 - DNA, 3003 bp, Unknown; identical to SEQ ID NO: 21658
  misc_feature (1)..( 3003): 2750-1469P.txt file - cDNA_ID_1989705; gDNA_ID_1620835; Annot_ID_169857

SEQ ID NO: 21660 - DNA, 3003 bp, Unknown
  misc_feature (1)..( 3003): 2750-1469P.txt file - cDNA_ID_1989708; gDNA_ID_1620835; Annot_ID_57961
agaccttttgaattcacctttccttttcttttttgtttctttcttttaataagctgatttaagtagcatcgttgaatttgagtcggtgattgtttgtaagtgaataagaaaagtagtagagtcaggagacaggtgtgctttctcttcaaagctcagaagcaagatggagaaaacagaggaagaggttgagatgaaggaactggtagggcttgtgagaatcctagtgaagagagggatcgatcttgctcgtcgagacgctctaagcagcgacccttttgtcgtcataaccatgggtccacaggtactttttctctctttctgattctaatctgatttggttctcttctgtttgatgtttctatttctgttcttgagatgtatggtttctctgtttactttcttcgcagatggaagaccaaagaatcgacctttaagaaacatgattaataatcatttaaaaagattttacatttcatgctacaaaatgaaaacaatctatagctataggatgttgtgttgcattcgttctaactgaaattggttgtatctttgaattgcaccagaagctgaaatcttttactgtgaagaataactgcaacccagagtggaacgaagagttgactcttgcgatcgaagatcccaatgaacctgtgaagctggtgagtactagtacccgtcagtaactaccggaatcatgaattttcaactcaaaaccaactgatgataagtggttggttccatatgtttttgtttcgtatgagtgcagatggtgtatgataaagatacatttacagcggacgacaagatgggagatgcgcagatagatatgaaaccgttcctagacgttcacaaactcggtttgaaagaacttccacatggaaaagagctcaagagaattgtgcccaccagagataactgcttgtctgaagatagcataatcgtctccgataatggcaagatcgttcaggacatgattcttctgttgaagaatgtcgaatgcggcaaggtcgagatccagcttgaatggcttaaaaatccaggtggtagtggactctgaaaaaacagagatgaagtagctttatgattttctgtgtgtaataaaaaaaatctcagttaataaaatagaacagagtactactactctgttttgtaatggaaatatatttggttttagatctaaccgaaaccgttttggtttcccgcgagttttctcttcatcacaaaaaagaaaaagtgatatttatgttttatattggtttggtaaacatgttcttggaaaagtcaacggcttaaaccttttgtccatagtcagaaaaaaagaagaatcaagaagatattattaccaaagatgttcgtgagagtaacgcgtagatgagaataatatagaaacaaacacctggaaaacgaaacctattatatagatggtctttattttttgtttctttattcgctctatcgtccattgataagccaatttttaagtggtcctcgttgaatttgagccggtcattgtttagaattaaaaaaaaagaaggtaaaagagtcagagccgcctagagaaatcgatcacaaattcagaagaaaagaacagagaaaacagaggaagaggtgagatggaggaacttgtagggcttctgagaatccgagtgaagagagggatcaatcttgctcagcgagacactctaagcagcgacccttttgttgtcataaccatgggatcacaggtcttttctctctctatctctgtctttgattctaatctgatttggtctttgtggatttcttctgtttttgagacatatatctctttttatcaaaatattgtcctccaagaagcatgataaatttcaattaagtatggaaaaataagagagtttaaacaacagagaaatgaaatcaatagataggtttagtatatgattttgatttttgatatagagaaaatcgtctttcgatattaggatgttcatatcttgcatgcactctaatagaattctttaaaatgcaccagaagctgaagactcgtgttgtggaaaataactgcaaccctgagtggaacgaggaattaacccttgcgttaagacatcccgatgaacctgtgaatctggtgagtacttctatctgtctatttttttattactggctctaataggaatcatgaatttccaactcaaaaacaattgacaattagtagcgtttttttacagatagtgtatgataaagatacattcacatcgcacgacaagatgggagatgcaaagatagatattaaaccatttctggaggttcacaaaatgggtttgcaagaacttccagatggaacagagatcaagagagttgtgcccaacagagaaaactgtttggctgaagcgagcagtatcgtctccaataatggcaaaatcgttcagaacatgattcttctgttgaggaatgtcgaatgcggtgaggtcgagattcagcttgaatggattgatattccaggttctagagggctttgaacatatctctttctgtgtgtaataaaaaaaaaactcagttcgttttgggtttttagacaaaagtcacaataagtagaacagagtactactctgttttgtaattgaaatatttggttttagcacctaacctaaatcgttttggtttcccgcgagtttttttattctgttgtttgtttgcagatgaaaaaaaaacgtggagaagaaaaaaacaaaaacgatctaataagcttggaagtttgcttgcagatattttttttttgaaaatttttgtggttaaacatgtgaaaatgcagagatattcaaacgtaaggttatggttacatctagtaacgaatcttatccatctccaaatcccaaatttgaaaaacacttccaagggaaaaatcgcggatacatacaagattgcaaatatctaagcttggaattatatttgttttctttctttggatctctgctttcaagtctgaaacttgaactctgtttctaatttacttcaaaagctatg

SEQ ID NO: 21661 - DNA, 3003 bp, Unknown; identical to SEQ ID NO: 21660
  misc_feature (1)..( 3003): 2750-1469P.txt file - cDNA_ID_1989708; gDNA_ID_1620835; Annot_ID_169839

SEQ ID NO: 21662 - DNA, 3000 bp, Unknown
  misc_feature (1)..( 3000): 2750-1469P.txt file - cDNA_ID_1989714; gDNA_ID_1971889; Annot_ID_58455
ccttggtttcaattcaaattaaatgtcagttttgacttttgactaatagttttgtttaccaaaaataattatcgttttatgattctatacctttaaattaagtgaacgaattacagaattttagtactcgatcaaaaacaatactaatacatattgaacattgcattaaattttgttttatccctaccaaaataaataaattagtttcattgttacttgaaaaatgcccaacctaacgttaaaacacgtagtagtgattattgtttacaacatttgtccaattattaaagtcaaacaatccataaactgtttacgctaaaacttgtgattttgacggttgcgggattctagatgatcattggtcaccttgtacccaaagaaatcctattatattattttggaaagtacatttgaaatgtaaccttaatttttgtaattaattacatgacaatgatattagaaaaatttaatcaaaaacaaaatcttttaatgacgttattaaggttaccaaaattcatttaacgacaatattcatttcttaattatagggcttattggatctaaagacgggtcatcaaagattttctaaactgaatcaaaatataccgaatattcaaatatttatctcttaccaaatataaacaaataagttcgtaaaacaatttaatattttatatacgaaatcaattaaatcttaattacataaaaattagcacaaaaaaaaagtattcaacaattacaattttatcaaatctctctgttatataagttttgataatatattcgaataaagtgtaatataacttttcaatttgtactctttaactaatttaagctaattaatatatttgttaatcttatacctatcaaaaccgactatcgtttcttatctctatagtatttttgcaagactttttggtggattttggtaaaagtgcattcgggtcatatggtacattctcctattaaataaatatggtgcactcctatgttattagctaaaatatttagattataattagagtcatatcataaataaaattaatattattaaataaatggctttttggcaagacagatttggagaaatggggttttgaatcaacaataataaaaaggtaaaatataattaattcacaatacgggttaaatctttaatttattattttttaagaccactaatattaaacatatcaaatcatcctaatttagaaaaggttatataaaaccaaaaaattatgtggtatgtataatgttactatatataaaattaaactataaaatataaatgtattagagaatgatgcaatttataaaactcttatatataataaataattcttaaattttaaaaattactactttaaaaaaaatcacgggacaggtaaagaaattacagaacgggttttattttggaattgggttatatggtggatgtatttgaatcaatatttataaaattttaaaatattattaatatactgttttaagaagggttaaaacttcagttttttaacaattgtctcatggattcgtggtatagcgttacttaataacaattataaactgtaaaatataaatattttataaaaataaaatttgtaagttttaatatatattacctttaaaaaataaatagtcccgcggtatatcgcaggttaaaatctagtaattatatattatgaataaaataatttagataaagttagagatcaaatcctattacatctagaaaaataccagtctatatatttgtgatttttattgttgtaacaattgtggtgattagtttacgattttaaacatatcaacaacaaaaataattcagaaaagaaaacgcactcaattaatatagtttttttatagaatgaaacttaaacctttttacacgtataaaatgctttttagtgtaacggttaagacttcatcttcagataaatattttaggaccttaatatataatggtaactttaaaattgttctagacgacggtattattaatattatcaaatacttagtacaacgaatcaaattgactggaactataggaatgttcgaaatggaacatgatccaacaaatatcatacgtggtggattaacttgcttcacatataatttgtgctgaagtccaaataataatatacatggattctggaagtattatagttgggtataaagtcttgttgcatttgcatttatttcttgtacgcaatgcggctaagcaactttcattatccttaccataaaaagaacaaaaacaatcgtatcatattctcactctgcacgaaaagtcaagtcacgtaaattgttaaaagattggggatttgaatattgtatcagaaaaatgttatttaatctacaattttaaactatattaaaacacataattaactaagaaatcctttgtaatctcttaaagtcactaaaaatctaatgcttaaaatatttccaatcacaatgaattttaaagttttttttaccaaatcaattgttctatattactatattttataactttttaaaactctatggttgaataacataatattttgttttaacacaaatcattttaaatggtagattgaatacacttccttagttttgaaaaaatacactaaaagtatgaaatgatgttttttttttaattacaaaacgataactcgaaaacgatggtttaatgaaattatttgatgaaataaagttatcataaacatccttaatctcttcttatacatgtcaactttgaccatgacatgaatggatcgcattcccaatttactaacacaaaaaaaaatgaggaaatacgaaaacagtagtataaaaatagagcaaagccggtgagaaaaaacaagaaacacagaaacagaacataaattaaagaagactcacattcaagaatctctctcttctcctcctctcattctctcagcggcttcttcttcttcctttttctttcacatcacacaacacaaccactgtgatcttgatttgttaccaatg

SEQ ID NO: 21663 - DNA, 3000 bp, Unknown; identical to SEQ ID NO: 21662
  misc_feature (1)..( 3000): 2750-1469P.txt file - cDNA_ID_1989714; gDNA_ID_2684202; Annot_ID_191245

SEQ ID NO: 21664 - DNA, 3000 bp, Unknown; identical to SEQ ID NO: 21662
  misc_feature (1)..( 3000): 2750-1469P.txt file - cDNA_ID_1989714; gDNA_ID_1971889; Annot_ID_176803

SEQ ID NO: 21665 - DNA, 3000 bp, Unknown; identical to SEQ ID NO: 21662
  misc_feature (1)..( 3000): 2750-1469P.txt file - cDNA_ID_1989714; gDNA_ID_2684202; Annot_ID_137219

SEQ ID NO: 21666 - DNA, 3003 bp, Unknown
  misc_feature (1)..( 3003): 2750-1469P.txt file - cDNA_ID_1989733; gDNA_ID_1620834; Annot_ID_57931
gatttctcagggtcgccactcagcgcatctacacgacgagtttctgagaaatattaaaagagaagactctaacaaacaatgtcttaagaatcaaaaggttctgcttgtggcagacaacgttactaaggttaaacagttagaagctcttgcaggggatttcagcagttttggtcctgggagtgttgttattatcactacagacaacaaggggttgttgaattcttatggtataacagatgtctacgaagttgagcatttgaagttttgtggaatcttacgatcattgggctttaaaaagagagctgctgcgttccagcgggctttgtgtagagcaaagagttttgccacggaatgtttttgttgtcaaagtagtagtatatctggttatgggaaagtgacagatttagtttaattaagttgaatcccttattagtcatatgcattaagttaagtaaacttaataagttgtgtggcttagaaataatattgttttgtctatttttggagtgggttgctcttggggtgtagaaaaatgtcactcttcattggattaagtaatatacatttttttgttccttagtttttaagacatttttttacatctggatgtgccagttgtttgtaatatactgttctttccttatagaaataaatattacacaattttttaaaaaagatttatgtatttgggagggttttttgatgtttggacatgcccaataaaattaaaaattaatacaggagacacaaagtcgctaactttccaaagttggaatctacatatgtctaaaacagagaagaaaagcttttaaactttttacatgacgatcctccaataatagtaatacactactacagttcaaagccactgacaagtttctcgcttttttcccttaatgagaaactcttttaacctgcttttctgatttatgctctttgggtacgtggaagatttcaatcacagactaacgtaattaaatcatttattggaaactgtgagtcaagctgaataaacttgatgcaaacgaatagatatgaaagaaattgggttgatcaacaaaaaaacaagccgacaaaaactgaatctcatgatatgttttcgtccgtcagttttaaccgttcgtttgatcggataatcaaaaccagtaaatgccaataatacacaccagaaaagtaagatgataatttttgttcgttagtagtattttattattatcatgctcatcattttcttactttggcggcccatcttttctcttcccctctttctgagtagtttagtaaaacagaacctgacagaaaaaaatagaaaatgccaggaaacacacacttagcaggaagactatgggagtctctaaccaatgcacatgctttatttagttcaactactctctagtggtctataaatatcgttgagttctttatttctattactcatcatagttctcaatagagagaatcaaaaatcaaaatgtcttctcctactgcgactaagtacgacgtctttctgagtttcagaggactcgacactcgtcgcaacttcatcagttttctctacaaagaactcgttcgaagaaaaattcgaactttcaaagacgacaaggagctcgagaatggccggaggatttctccggagctcaaacgcgccatcgaggagtcgaaattcgccgtcgttgtggtctctgtgaactacgctgcgtctccttggtgtctcgatgagcttgtgaagattatggatttcgaaaacaagggttccatcaccgtgatgcctatcttctacggcgtggatccttgtcatttgaggaggcagatcggagatgtcgctgaacagtttaagaagcacgaggctagagaagaagatcatgagaaagtagcttcgtggagacgagcattgaccagtttagcgagtatctccggcgaatgttcattgaaatggtgaaatttcgtagcgttggttagaaagattggatttttatttgatatgtctcgttactaaagtttcgatttttattttgttttctctctgtagggaagatgaagcgaatctggtggacgaaattgctgacaagatatcaaaaaatctgatgactgttacaacaataagcaatgggagggacctagttgggattgatacacacatgaaggctcttaacaaaaaattggatttgaattccaacaaaagtttgagagtggttgggatttgggcaagaggatacaatggtagatcagctttagctaaatatgtttatcaagacatctgtcattggttgaaggttggttggttgaaggtttatcaagatatcaagacagcttccaaactttatgttttaactcgttggttgaaggttgcacatttgcttcatagatcacatcactcttttaaaactgagtagccagccaatcaataacccgaatttcactgagaaatccccacatttgttatgtttccatactacaaaatcatctattgacaccactagttagctgtgatcttataaagatgagtaagccaaccaaaccaataacccaaattggaaaatgtgagtcaagccgaataaacttgatgtaataacctattcgttctaacttgaaattgttattaaaatcatccttatcaattagcctttctcgtccgtcaattgacttagttctaaccattcgtttgatcgataatcaaacaaacagttgaatcttcttcaaccaattaaattagactacgagtaactaaatgccaatacacgagaaaactagactaagaggagaatttgtgttcgttaatatgttatccatactcattatcttattttggcggcccatctattctcttccctctttctgagtagtttagtgaaacagaagctgacaagaaaaaatagaaaatgccaggaaacacacagttagcagtaggaagactcttataggtcaacttctgtagtggtagtgcctataaatatccttgagttttttatttctatcactcattgagaatcaaaaatcaaaatg

SEQ ID NO: 21667 - DNA, 3003 bp, Unknown; identical to SEQ ID NO: 21666
  misc_feature (1)..( 3003): 2750-1469P.txt file - cDNA_ID_1989733; gDNA_ID_1620834; Annot_ID_169794

SEQ ID NO: 21668 - DNA, 3000 bp, Unknown; identical to SEQ ID NO: 9018
  misc_feature (1)..( 3000): 2750-1469P.txt file - cDNA_ID_1989734; gDNA_ID_1971973; Annot_ID_58675

SEQ ID NO: 21669 - DNA, 3000 bp, Unknown
  misc_feature (1)..( 3000): 2750-1469P.txt file - cDNA_ID_1989737; gDNA_ID_1971948; Annot_ID_58600
aaatctcgcaaagtttctaatttattatatcacttttgctccttactattttaatggaaaaactgtgataattacatgtcaatcactgaatttgaacagtaattataattttctataccgcacaacatatgcttattttggttttgggtactgtcttattagttacatacggtttaggttggcttgtttgtttgttttgtcctagctaatcacgttaatgaaaacgctctaccaaataaccgcgtttagaaaacgctattagttaccgagtgtggttgggaccgagtgaggacgtcacggctccaaccaatccgcaaataaggaagcgcgtgtgtgtaagtagtgggtgaccactttgcctagtcttaaacgttaagtctggaaataccaaaactacccctggtttggtcgaagattctcacgcccctaccacccaacccaatcacaatcctcgtgaacgaacacaccaccttctctccaatctggatctggttcctcttcttcttggtctcttctccatctcatcggagctgatctcgaattgttctccgttcatttgttacggtggagatgacatcggatcaccgcgacgctcttttctctctggaactggaatcgcctgatccggacgaaggaggtgtagcagacggaggagaatctgataccgacgaggatttgcgcgacaacgatgatgttgttatgccgggaacgaacgaagctgaagctgaagacgacgatcccgaagaggaagatctcaattctccgtctacatcatcactccccatggtttctacgatctcagcgactgctgttgtttccgggaccccgacggcgacttcctctacaggcgccgtgaccgttgcacttccggctggatccgccgtccctgtctccgtgattcccgttgattccgatccgaagtggcaccgtatgacggagatcgtccatcagagaccaccgatcgatgattctagacgccttttccagaggctgtggacagacgaagacgagatcgagcttcttcgtggttttctcgattacatgacgatgcaccgcggaagcagctcgcatccgccggatacggcgccgttttatgagcagataaagtcgaaacttcagctggatttcaacaagaaccagctggtggagaagcttcggagattgaagaagaagtacaggaatgtgatgagcaagatcagctctggtaaagaggtattcttcaagagccctcatgatcagtctactttcgagatttctagaaaaatctggaaccaaactgggaaaatcataggctttgaagataacaacgtaatggatttcgaagaaaccaataaccatcataacaccaccaatggtaactactcaacctttaacagccctagttctaatcctactctggagctcgactccgaaaatggaatcgagaagaaattgacaatgagtagcagtagcgtgtcgagaaaacgatcacgatcaagaattgggaagattgaggaagacaacaaacctgtcatcactccctctgatgggccaatagctagcaatgtcaacctcaacgaagctgcagctgttggtattggaggaaatctcgggggtttgatcgaagagactgtgaaaaactgtgtctctcctgtgatcaaagagatgatgaatgggacaacaagtatgatgatggctgcaatgggaggagggtttccgggtcttggtggtggtggtggtggtggtggtggtcatggttttggctcgctaagccccatgtttacacggccgttcaatttcggttttggtgtagagggaggaggaaacaaggcggttgcagatgagcggtggaggaaacaacagattctggaattggaagtgtattcaaggagattagagttggttcaagagcagattagaacgacattgaacgagttaaagacgatgccgagtggtatatgatgaagggcgagaagaataagacaacaaggaaccatttaggttgatatttgatatctttgagttaaccttctggtgtgtgagtgagtatagtaagagatttggatctttttaagttataaattggtaaggtattgtgatctttctctaggttttttcatcattttgatttttttttcttcttcttatctttaaattatttgtcaatagggatgaatcataggaggggggtttgtgtataaccttttgtattagattatagttcttttttcgtagaatcatttgttcaataacaaacagactttctagctgtttttctttcaaaaagaagaaaaataataattctaaattgtgtgctactctttctttgtctaataaaatctgtaataacatgtttatttctagatcggatactgttattgaagtgtattaaactttgacctctttctttatcatgttgattaatgtagttacttaaaaacttttgtgtttgaaaaaaagaaccaatgttgtgtttcttgctagtacgcatcagaagattcctttcctgattaagtaaaaaaaaaaaggcataatcaaaacaatttaaagattcaagaaggcagaaacttgtccacgtgacgaggcaaagaatgttaggtaggtttgttattgactttatagtttatacaatgattttaacaaaatacctatggaagatacatgattattttttataaatgtataaacgagtggatatatttggtggtggatgatggtgtgtgtgtatatgcaaataattcactttataaaagcttatcgctaatttgacagaacactagaacagttctctctttttgtcgacagtcttcttcttcttcttcttcttcgattggatctggaactggtaagctcttctataagtctctggttttgtatctttcgaactgttcttttgtttctctctccaaaaatttcaaactttcataatttcgcctcctcaagttcgatttcagctcaagaacacgaatgcttcactcacttgtttcattgttaaatcttatatttagtttgatactcatg

SEQ ID NO: 21670 - DNA, 3003 bp, Unknown
  misc_feature (1)..( 3003): 2750-1469P.txt file - cDNA_ID_1989739; gDNA_ID_1971953; Annot_ID_58662
gtttcatggtgcgattcaaatgtaggtgttctttacagagatgctggaaatataactatggctatcgatgcttatgaggaatgccttaagatagatccagattctcgcaatgctggccaggtatctatactttagcgtggtcttcttgttatgaggttgaaagatatatgtgtttaaaaccttcttgtccccttttgtagaaccgattgcttgccatgaattacataaatgaaggactcgatgacaaactatttgaggctcacaggtaagcacatatattattaatgtagatttgtattatgttgcttttatgggtcttacagtgaaaaaatcttctgaacacagagactggggttggcgcttcacaagattacaccctcaatacacttcatgggataatctgaaagatccagagcgacctatcaccattggatatatctcaccagatttcttcactcattcagtatcttatttcattgaagctccccttacgcatcatgattatacaaagtacaaagtggtggtttattcagcggtagttaaggtaggatttttacctatataacttatatagatacattttccctctaagcaattcatttcctggttctcgtggcatttttcccttttgagcaatcattggtctctcatggctttgcaggcagatgcaaaaacatacaggtttagggataaagtgttgaagaaaggtggagtttggaaggatatatacgggatagatgagaaaaagatagcaagtatggtcagagaggacaaaatcgacattttggtagaactcactggtcatacggcaaacaacaagttgggaacaatggcctgcagaccagcaccggttcaggtgagaggatatattaaacctatctcattttgttgtttcgggttttgcctttgactttccatttcaagtgtacttatattggctaagataccaggttacttggatcggctatccaaatactacgggtttgcccactgttgattacagaattacagattcgttggctgatccaccagataccaaacaaaagtacgttttggttcaagatgcaattttgggtttcggaagtgctccaaataaaaatcttaatttttatttatttattttgtgatatttgattgcaggcaggtcgaggagctggttaggcttccggactgttttctttgttatacaccttccccagaggctggtcctgtttgtccaacacctgcgctttctaatggctttgtcacatttggtagtttcaacaacctcgcaaaggttaaaaaatttgtgtccttggattatgcacaccaatctcccctagtatctctttcaatgttttgacaggtttatctctgtttgtgcaaatcagataactcctaaggtgctgcaagtgtgggctaggatactgtgtgcagttcccaattctcgtctagtggtaaaatgcaaacctttctgctgcgatagcattaggcagaggtttctcaccacgctggagcagcttgggttagaatcaaagcgtgttgatctcttgcctttgattcttttcaatcacgaccatatgcaagcctattccttgatggatattaggtaagatttgacacatagtgctctgtaaaacaccgaggcttatagattcacatatttaatttacatttattgcagtttggacacattcccttatgctggaactaccactacctgtgagtctctctacatgggagttccatgtgttacaatggctggctcagtacatgctcataatgttggtgtcagtcttctcactaaagttggtaagctcttagcaaaatttttttttttttttttgcaaaaattgttgttagtcggacatcttttagctaattcagccatttcttgattcaggattaggacacctggttgccaaaaatgaggatgagtatgttcagctatctgttgatctagcctctgatgtcacagctctttctaaattgagaatgagtctccgggatctaatggctggatctcctgtttgtaatggtccttcctttgctgttggtcttgaatccgcatatcggaatatgtggaaaaagtactgcaaaggtgaagtgccgtccttaaggcgaatggaaatgctgcaaaaagaggtccatgatgatcccttaatctcaaaagacttgggaccatcaagagtcagcgttactggagaagccactccgtctctcaaggccaatggttctgctcctgtaccttcctctttaccaacccaatccccgcagctctcaaagagaatggactccactagctagataaccagcaaatcgagctgctgcgaaatgccggcagagagtcttgacccatctggaaaaggtgtgaaagaaagagtcgatgagcttttcctgctatttacttccaagacaataggaactagactttagattactgcttgtgtagtaaaaagaatagtaaaaccagctctttcttttgttgtatctctttctactcttagtttagctttacatgattcttgggaagtcgttaggtggtagtggatttggagtttttcttctcatttgagagatcaagttgttgtgtatcgattagggttttaaggctttttaggatgttttcatgtgttggattttgactcatatgatagtaaatatagttatagaaagcttttcggtgcctttacctatttcataatataattatctaaaactcctgcttaagcttaatcccataggtgagacccaatgaaagacttttgacttgtatgattatgttgccaactccatatctctctttaattaattaatatggagagagtaaaaaggcaagcaactaactactcttcaattcaacacttcttctgctccattgcttccaccagaaccctaaagaccttataaaacccaatcccaaatccctttgctcattcaccaccaaagcatccaactttctttgcttcctctttcaaagcaacacaaaatattaaatctcaagaaacaaagtaaagaaaaatg

SEQ ID NO: 21671 - DNA, 3003 bp, Unknown
  misc_feature (1)..( 3003): 2750-1469P.txt file - cDNA_ID_1989739; gDNA_ID_1971953; Annot_ID_177407
ataactatggctatcgatgcttatgaggaatgccttaagatagatccagattctcgcaatgctggccaggtatctatactttagcgtggtcttcttgttatgaggttgaaagatatatgtgtttaaaaccttcttgtccccttttgtagaaccgattgcttgccatgaattacataaatgaaggactcgatgacaaactatttgaggctcacaggtaagcacatatattattaatgtagatttgtattatgttgcttttatgggtcttacagtgaaaaaatcttctgaacacagagactggggttggcgcttcacaagattacaccctcaatacacttcatgggataatctgaaagatccagagcgacctatcaccattggatatatctcaccagatttcttcactcattcagtatcttatttcattgaagctccccttacgcatcatgattatacaaagtacaaagtggtggtttattcagcggtagttaaggtaggatttttacctatataacttatatagatacattttccctctaagcaattcatttcctggttctcgtggcatttttcccttttgagcaatcattggtctctcatggctttgcaggcagatgcaaaaacatacaggtttagggataaagtgttgaagaaaggtggagtttggaaggatatatacgggatagatgagaaaaagatagcaagtatggtcagagaggacaaaatcgacattttggtagaactcactggtcatacggcaaacaacaagttgggaacaatggcctgcagaccagcaccggttcaggtgagaggatatattaaacctatctcattttgttgtttcgggttttgcctttgactttccatttcaagtgtacttatattggctaagataccaggttacttggatcggctatccaaatactacgggtttgcccactgttgattacagaattacagattcgttggctgatccaccagataccaaacaaaagtacgttttggttcaagatgcaattttgggtttcggaagtgctccaaataaaaatcttaatttttatttatttattttgtgatatttgattgcaggcaggtcgaggagctggttaggcttccggactgttttctttgttatacaccttccccagaggctggtcctgtttgtccaacacctgcgctttctaatggctttgtcacatttggtagtttcaacaacctcgcaaaggttaaaaaatttgtgtccttggattatgcacaccaatctcccctagtatctctttcaatgttttgacaggtttatctctgtttgtgcaaatcagataactcctaaggtgctgcaagtgtgggctaggatactgtgtgcagttcccaattctcgtctagtggtaaaatgcaaacctttctgctgcgatagcattaggcagaggtttctcaccacgctggagcagcttgggttagaatcaaagcgtgttgatctcttgcctttgattcttttcaatcacgaccatatgcaagcctattccttgatggatattaggtaagatttgacacatagtgctctgtaaaacaccgaggcttatagattcacatatttaatttacatttattgcagtttggacacattcccttatgctggaactaccactacctgtgagtctctctacatgggagttccatgtgttacaatggctggctcagtacatgctcataatgttggtgtcagtcttctcactaaagttggtaagctcttagcaaaatttttttttttttttttgcaaaaattgttgttagtcggacatcttttagctaattcagccatttcttgattcaggattaggacacctggttgccaaaaatgaggatgagtatgttcagctatctgttgatctagcctctgatgtcacagctctttctaaattgagaatgagtctccgggatctaatggctggatctcctgtttgtaatggtccttcctttgctgttggtcttgaatccgcatatcggaatatgtggaaaaagtactgcaaaggtgaagtgccgtccttaaggcgaatggaaatgctgcaaaaagaggtccatgatgatcccttaatctcaaaagacttgggaccatcaagagtcagcgttactggagaagccactccgtctctcaaggccaatggttctgctcctgtaccttcctctttaccaacccaatccccgcagctctcaaagagaatggactccactagctagataaccagcaaatcgagctgctgcgaaatgccggcagagagtcttgacccatctggaaaaggtgtgaaagaaagagtcgatgagcttttcctgctatttacttccaagacaataggaactagactttagattactgcttgtgtagtaaaaagaatagtaaaaccagctctttcttttgttgtatctctttctactcttagtttagctttacatgattcttgggaagtcgttaggtggtagtggatttggagtttttcttctcatttgagagatcaagttgttgtgtatcgattagggttttaaggctttttaggatgttttcatgtgttggattttgactcatatgatagtaaatatagttatagaaagcttttcggtgcctttacctatttcataatataattatctaaaactcctgcttaagcttaatcccataggtgagacccaatgaaagacttttgacttgtatgattatgttgccaactccatatctctctttaattaattaatatggagagagtaaaaaggcaagcaactaactactcttcaattcaacacttcttctgctccattgcttccaccagaaccctaaagaccttataaaacccaatcccaaatccctttgctcattcaccaccaaagcatccaactttctttgcttcctctttcaaagcaacacaaaatattaaatctcaagaaacaaagtaaagaaaaatgaagaacgaatctaccttcattgatgtccctgcagaatccagctcagccatg

SEQ ID NO: 21672 - DNA, 3000 bp, Unknown; identical to SEQ ID NO: 9054
  misc_feature (1)..( 3000): 2750-1469P.txt file - cDNA_ID_1989740; gDNA_ID_1971974; Annot_ID_58721

SEQ ID NO: 21673 - DNA, 3003 bp, Unknown
  misc_feature (1)..( 3003): 2750-1469P.txt file - cDNA_ID_1989753; gDNA_ID_1620833; Annot_ID_57914
ttaagggatatgcggtacgcagttgctgcaactagggagttacttccgtcgttgatgaacgactactagttttctgtgtccaaatacttttctgaatcagttcatccgagatcttttttccttctgtaaaaataataatattttttcttctttttttgcagatttcttcttatatcacaagtattctctatggctagtctcttattatatgcatctattttgtctactgaagacataacttgcaacatttcttggagtttttggtcttgatcaagtatgttttttctgcctctctgtgattgaaactgtgttctttgaaaactggactcagattgattttagatgtgaatgactctaatcgaattagtactggttcttgttgatgtatctgactttcatttttaactttttatttcttacaggttcatccagttatcatctgtagctggatatgtgaagtgtcttcttgcgaacttatgtcttaactttgaaatactttgaataacgatgataatttggagtaatgatggtaatttgatcaaattgtgtttggctttttggtgtgtccatttgcagagatatattgctttttaataacgagaaaaatgttatttaataccctaattttcaaattataaccgttttatacgtcaactttatatatggtcattttaaacatgatgttatcgttgaccaccatttaaaccatgaatatttcgttgaccaggccaaaaaaaatagtcgttaacggattattcaactcccgttaacacctccgttaaccattctaaacgatgtcgttttcgttactataaatcatgttttacccttttataagcttttaaaatcccttgtaaatcattccaatgccacttacttatgcttaaaaaaacattgtaaaccatgctagccctttttaaaaatccttgtaaatcattttatgccacttacttatgctttaaaaacgatgataaatcatgttttacctttttataagcttttaaaatcccttgtaaatcattcaatgccacttacttatgctttaaaaacgattgtaaatcatgttttacccttttataagcttttaaaatcccttgtaaatcattcaatgccacttacttatgctttaaaaacgattgtaaatcatgttttacccttttataagcttttaaaatcccttgtaaatcattcaatgccacttacttatgcttaaaaaacgattgtaaaccatgctaaccttttttaaatcccttgtaaatcattttatgccacttacttatgctttaaaacgattgtaaatcatgttttacccttttataagttttcaaaatcccttgtaaatcattcaatgccacttacttatgcttaaaaaacgattgtaaatcttgtaaaactattgtaaaaagttttaaaatgatttacaaaggtttaaaaaggggttttaaagtatttacctatgtttttaaagactttataaagattttaagaggttttaaaatgatttacaagggtttttagcaattaccaaagattttaaaaaactttacaaggttttttaaaagagtttttaaaaaatttacaaggatttttaaaagcattttttttgctgggaaacaaaatttacgagaaaaaattttggcgggaaatttatttttggcgggatttttttttttttggcgggaaaaaaaggtttggaggtgttcttcaatgaataggggtgcttgatgaggcttgtattaaatggtagaagtccatggagaaatcgaagtgttcaaaatcggaggtgttcttcaatggaagctttactatggaaatgttttgtttcgttaaagatgaagaagaagaactttaagcgtatataagtatctgtgtttgtatagaatgacagagaaatctttgcaggtagagtggtcaaatgacctttgatttttctcaaatgataggggttcgaatcccaggtctgtcatttctttttaaagaaaaacgaaaacgacgtcgtttagaatggttaatggaggtgttaacgggagttgaataatccgttaacgactaatttttttggcctggtcaataaaatattcatggtttaaatggtgatcaacgataacttcatgtttaaaatgaccatatataaagttaacgtataaaactgtcataatttgaaagttgaggtattaaataacatttttcccttttaataactgtaaccaatatgtaacagaaatccatccaacccaatttgatcaatagcgtaaaaactcattattgttataaaattttaggtagtttacatcaaaataatatcattcattttttatactataaaaatagtatttagattaatatttaacaagaataagaataatttttatatatagatcatatcaatccacataataaaaagagaaaaactcaaatatgaaaaaaattcaagtaacaaaaatatattagaattacatttggttgattggaaaaaaaaaaattacgtgtaaaactatagtattatctgagaaacgaatacaaaaatttgcaacagtagcagcaaaacaaattcaaaacttgcggcaacgacaacagcaacaacaacaacgaaacaaacaataacatgcgaggcagtctcacggctagtggcagcaaacccaacagtttatctaaacgagaaccaaaatttactctcgttttttttttaatgttatcctttgatgaacaaaatgtattttccaaattttactttttttattttttaagtattatcccttaaaataatatatcttgcggaaaaggaatcggattaaataaattttaacggtagaaaataggataggaggagagagagaaggtcttttattggtttgaatgagattagtgaaggcagcttctcttctgatttcttcaaccaaacctccgtctagggttttttactcttcccatctccgccgcccttttttctctcacttccgtttttcttcctcttcgtcgacgtcttcctccgtcgcagtcatg

SEQ ID NO: 21674 - DNA, 3000 bp, Unknown; identical to SEQ ID NO: 8371
  misc_feature (1)..( 3000): 2750-1469P.txt file - cDNA_ID_1989775; gDNA_ID_1971785; Annot_ID_57992

SEQ ID NO: 21675 - DNA, 3003 bp, Unknown
  misc_feature (1)..( 3003): 2750-1469P.txt file - cDNA_ID_1989776; gDNA_ID_1971973; Annot_ID_58669
ctaatggcacagcttttatatcgtcagggattcgtgatcttgacagtgagctttctcctttttatttacacatcaagtctcatgaggataagagagtctggttttggggctaaaaggtttgtattttattacttttccagggatactaggtggtgggtatcctttgggaagcttagtaatggtaatggaagatcctgaagcaccgcatcatatggatctgttaagaacttacatgtctcaggggcttgttaacaatcaaccacttctttatgctagtccttcaaaagatccaaaagggtttcttggtactttgccgcatcctgcatcatccaaagaggataagcctactgcgcccgaccctgatcaggtgctactttcttgtctgtaccttcgttctgtttgcctttttcctggctagttaaaaattgggtagtgtgcacttttgtcaattctgtagggagagagcttgaggattgcttggcagtatcggaagtatttggaaaaccagaagaatgctattggtaatttagttagtgcggttatatattcatttgcatatcattcaagaataaattgagctactagtaagttagatatcattctttggaaacataatcctctttacctattctggatcagatgattactccaatgactttgatatgagaaagcccttggagaggcaatttctgagcggacggcccatagattgtgtcagtctgttagactcttcagatctttccattgctcaggaccactgtgctacgtttttatcaaaatttccaaggttgtgtggcatcctttcttatttgatctcaattactcgctctagtttcgaatcaataaattttgttggtcatacctatgcagcaaattctgctcaagctcaattctttttacatctctcttatacttccaagctcagtttgtttatattgttttagtttgttactgagtcagttattgttcaaattcttctcttatttactggctttgttaagtagattgtcctttttttcttaagaacctgtgtattgtttcccacagaaacagcagtaacattgcatctattggccgcatcgcaatccagtctttttgctctcccctgtgtgagtattctgaaaaggtaattaggagagttttctggaacttttagcctatatcaagtcaacaatgctttctaacgaaaattctcttgactctatagttaatgatagctgaagcttgtaccagtatcacgtcgttatgtattatattgttgattttttgacattttgtttctatcaacacaggaatcagacatgctctcattcataagattgctgaaaagtatgcttatggtttcaaatgcggtagccattgttactttcccgccttccctgctctccccatcttcctctaaaagactgcagcatatggcagataccttgctctctatcaaagcaatcccaggtttgctttccctgattttcttattcataaatagattatcatagttgtttcttgacaagtatccttgcctttttttccagatggtgacaaggaattggagaaactcctcactggctacaaggatataaatggattcctcaacatacacaaggttgctcgtatcaacacacaggtatttacaaattgtgtaattctcaatttatatagggatattattaccctgaaacctgtaagcaagaacccctttgtattttgccaagtcaaaaaaacatattcaatggataaaagtctgatgaaattcaaaatgtctactgaacaacttatccagaaatccccatctaatccatttttctctcttttgatgagaatgacatgaacttgcttagaaaccgttgaaaaaatggattcactatggtcctaaaccactggtttgatctgaattgtttaatggaacaggtgcctgtaattcttgaggcaaaaaccttctcaatgagcttgaagaagagaagattcttggctctagagtgtctgaatcaagcccctgtagacgggtccagtggaacatcgtatggcacatctggtagctgctcatccaaatccggagcactagatttttgagttgctgagttagtctttcttttcttcttcttagtttttttttttccctctccattgagttctctaagttcactcactaacctgagcagttacattattattatagtctttggtcttaaaaacagttttgacagcaatatgttttgtttttataatgaaatttatttcatttctgtattatatatactcttatgaaactatgaccaatgatagatgctagttactaaacgttcaatgtaatcacttcaacatgttcacgtggttatttgttgaaccatccatatatataacatataaagaaagaaggtgagacattgaatgaagagttcaaaaatatggttgatctatatttggtgctcctttaattcagtgttcctttacttaccaaccaacgaccatatcatttgaattattgctcataaatctctctctctacccaatctctttatttagtaccctattcttcttgactttgtttctttccaaagcttatacaagagatattcattcttaaactaagattttcatatatattgaaaaagaaagaaaagatttctcatcattttactttttggtagagagcatttcaagtaaaaaatactttgagaaacaaaaagagaaaactagtatgagaaacaaatccttaaaaaaggaaataacagtaatgcacgtgatgatataacaaaaggttttgttttgtttgtttttttattgtttttttcttcttttatttgtctgttataataatcaaaaaacaagaagaaaaaacgagacgttcatgcatttaatctcgcaccttacgacaaagagtgagagagaggatcgctcaggtttgttcatcttcaccggacgattagcttttgcggtgggagaaagaacggcctgtcttcagctctgaaacagaggaacagagaggttaggaaggagacaatg

SEQ ID NO: 21676 - DNA, 3003 bp, Unknown
  misc_feature (1)..( 3003): 2750-1469P.txt file - cDNA_ID_1989792; gDNA_ID_1971889; Annot_ID_58466
tagctatggcggcggaatctgccggcggtggtttgagattggctccggcggccgaagtacatagcgatttgctaaaaagacgtttcatcgattggtttgttttattttgttttgaaaaaagtctttttaagtgacttcttgggtaatttggtgtagttgtatcacatttgtttaccgctaaataatgttttaaccgttttatggaacgtttctttctttttcagattgtacagagttagttggtttatgggtctaattgggcattctttggaaatggtctcacaagacattgtggagttcaaagaagagttcgacgattctcacaaaccaaacagcagagtcgattgctaaccaggcctttccatctaaaacatattggttataattgatgcattgcggtaggagtatagcgtatccgttgtaattgattatgaaaataataccaaagcgattaaaaagatactttcaccgcaccgttctttctatccgttactttataccacttttaattatttacatatcgttaaccgctttctctatctgcttaaatttttgtaccgttttatgttattaatcaaaccttgaatggatatgtttgtttttgtaatggtgtccaccaaagtttatttgatgagttacaaaaataattatattttaaagttttgagaaaaaaaatcatgtttgtgaactttcaattgattcacctcatgaagattttataagttctatatagattttgtgaatcttcaaaagtacaaatatatgtactctttttccaacataaatgtagtgaaaattttattttatgtgaaagaatgaaaagaaaccaagtgaaagaaattaatagacagtacatgtaattactgaatacgaaagataaaaagagaggagagtagtcattgtcagatagaaagaaagagcagacaaaaggatcgtaaaatcaaagaaaattgggtccctaaaaagattatgaccgtgaagacacaatattacgttttctgacaagacataaacacatcactcatcgcctttagattctcttccgaccctcacaagatcttaacaacaacaacaacaacatcaagatccgatcctccagattctcttctgtgtatttccttaaatctcctcctctttctctttcctatttatttatgtatctcactcaccgcttctgcctctctctctctctctctcttatttatgtaactcctcgtcttccttcttcacattgatttctgcgtcctttgacgttcaaactttaaacgtttcttcatctgttttgttgtttactttcccgagagaaaacaatggctctcagagatttatcttcttctttatcttcttcttcttcaccggagttacatgttcttgccgttgatgatagtttcgtggatcgtaaagttattgagagattgcttaagatctctgcttgtaaaggtaaaaggcaaaactgtttctctttacgttttctgcttttcttttgtttggtttctgattcgtttttttggataaatttggtgggtttctttatatagtgacgactgttgagagtgggactagggctctgcagtatcttggtttagatggagacaatggatcttctggtcttaaggtatatattcattcatttcttagaatctctctgttttctagcaaaatcaaccctagacgttgaaacttgaagtgttcttatgctggtttggctcccaagaaatctaaggtttcacaatgtggatcaaaagtttaacctttagaggatgattttattatttgtttattgatgccgtttatatgaacaattttgcaaattttgataacaggatttgaaagtgaacttgatagtgacggattattcaatgccgggactaacaggatatgaactcctcaagaagatcaaagtaaatttctattttgtgtcatttattagagcaagatttgaataagctcttctcgtgttttccttacaaaaattctgttgtatatttgccaggagtcttcagcactcagagaaatcccagtagtgataatgtcttctgagaacatacaacctcgtatagaacagtaagtcactatagctaaagatacaaaactgaatcaatggatcttaacactgtaatctgatttttttgtctatcctctcttttgttgttgttgttgttgtagatgtatgatagaaggagcagaggagtttttgctaaaaccggtgaaattagctgatgtgaagcgtttaaaagaacttataatgagaggtggtgaagctgaagaaggaaaaaccaaaaaacttagtcctaagagaatcctacaaaacgacattgattcatctccatcatcatcatcaacatcttcatcatcgtcgtctcatgatgtttcctcccttgatgacgacactccatcttccaagaggatcaaattagagtctaggggttaaatgattgagctcaatcttttctcacgttttctcttgatttccttgtgtaatatacattatttttgatatatgcaactatgtaagtctagattctaatgctcaccttattactctgttttttttttttgttaaaacaaaaggagatcaatgtgaatatgatttaaacaattttataaaattaaatactttgcctacagtatatatattgtttcctacttcacaaccagatcaattagattctataatgtaacatataatttaaaagtacacgtaaaaagattttgtatatgatcttccatgtgacatacacgatttcacttgtatgtgtttataattcataaactttcaagcatcagaaaacaaaaaaaaacgaatataatctttgttggaatacattatctattactatattcctagttgtatagcagaggaaacttgtttgcacttacgtggcatcttatgattggttcagtgatgtctgttttagaccgttgagagacttggataccattgcggtcttatcccgaaactccaagaacacataattttttttcttggtggtctctccaatg

SEQ ID NO: 21677 - DNA, 3003 bp, Unknown; identical to SEQ ID NO: 21676
  misc_feature (1)..( 3003): 2750-1469P.txt file - cDNA_ID_1989792; gDNA_ID_2684202; Annot_ID_191256

SEQ ID NO: 21678 - DNA, 3003 bp, Unknown; identical to SEQ ID NO: 21676
  misc_feature (1)..( 3003): 2750-1469P.txt file - cDNA_ID_1989792; gDNA_ID_1971889; Annot_ID_176816

SEQ ID NO: 21679 - DNA, 3003 bp, Unknown; identical to SEQ ID NO: 21676
  misc_feature (1)..( 3003): 2750-1469P.txt file - cDNA_ID_1989792; gDNA_ID_2684202; Annot_ID_137231

SEQ ID NO: 21680 - DNA, 3003 bp, Unknown
  misc_feature (1)..( 3003): 2750-1469P.txt file - cDNA_ID_1989813; gDNA_ID_1620834; Annot_ID_57927
ttcttgtattcgatgacattcattgtttaaaggaaaacataaagattgacccaaataaagagaggaatacatcttgtaaaaaaaggaatgcataaaccgttgtaaagtgaaacgaattggagtatttatttttgcaccttatccttagtccgcttaacaaattaaaaaaaaaaaaaactattttagttgtctcaaatatttgggctttcttttgctttttagtctttagatcttttaacagttggctacaaacacttctagaactttacagatatagaagaataatggggaaaaaatgtaatgcttgataatcaaattcaaaggtaagaagtaaaaactaagaagaatggttcattgtgttctctttcatttttggatggacttttcattctgtttctagtttatgcattgctaggaaatgtgttgggccaaacttaagtagcccacaagaataatgcagaccaaaaaaaaaagcctgactattcgattaacggtcgacaaacattattccattatacactactttgacaaaaaaaaaattttaaaaaaattgtgtttatctaatgccaattcaccttcggtaatcactttttattcaacaaatagcattggaatcgtcaaaaatcaatttatccacaagtattttttttgttcaattatgcgtcaaaatcttatcaaacttgtatttaacattttgccattttttgaattttctttaaatacttgcgaaaacttttgtaacttgtgtttgtggttactctagtttgaatgtcttaccagtttccgtgtacaaaagtaaattagaaaaatttacagagaaatttcacaactttatcgacttttcaaactaaagaaatcagatcaaatgtttagcttatgactctttctccttatgagttggtaatatctttgactcttgctcttgaataagaaaaacaatgtatccggccaaaaaaaaaaaaaaaactgcatatgactttattgaataaagcacgaagaaattggtcatggccagttggccactttaaattgaatgatagtatagataatgaaaaatatttggtcgagattataactgtacgtacggtcgacgaacatatgactcggcaatgtatagtagcatacgttaactacgttgcgaactcgatgattgtctacagaacaaaacgtataaaatatgttcgaatctttcaacggcgaatactttcagcaaacaaaacgtttttattaaattataaggtacaaatacacaaatatatctccagattctgtgacgtcgcatgtgttatacaaaataaatgaataattactttagaatatatgattgcgacaaaaacaattccaagattttatccaaatttatttttcaactttaggatggttgattggttatatgggcgtttacacgtaaacatgtctctaaatgtaaatttcacgtgatttaaaacaattttctgatgatttaagataaactcggtttttcagcgtaaatttcacgtgatctagaaggatgtacggtggcgtctagtcctggtttggactatggctctgttcgtttgcctgtcgctggcgactaaaaccagcgacaacaaccaaaagttgttcgtttgcctgtcgctggttcagcgaccaaaagtagcgacagtcgccagcgatcagcgaccgcaatttttggtcgctgaaatttttagcgatcagtcgctggtttcagcgattagtcgctgcttttggtcgctggatccagcgacaagcaaacgaacaacttagcgatcaaaaaatataaattaataaataattaaaaataattaaattaaattaaatttaaataaatgtctttttgcactctgaacggttgtgtcttttaatcgcaactttttgtaaaaaatattgacggttgttttttctcgcttgtgtcttttattgcaaccttcctatattgtaattctctgtcaaaatatttacggttattttttccggttagttatatatatactattgaataactacaaaatttataatatgcatcatttggagttagatttgttttaaagaaattattatataaacaaatttataatatttttctctgcgatatcacgaagggtttgagttctagtttaattaaaataattcttattaaattaagttaaaataaattaaattcaaataacataaactaattatagtaaaattaaatttgataaaactaaaataaataaatatattaatttatttttctcatggtgtaggatatatatgatttatattttgattttaaaatataaattagcaccaaaataattaatttaaaaaaaaaatatagcgactgtttataacgacaatcaaacgaacaacacatcgacaattattagcgattgtcgctgtaattggtcgttgaatctagcgacagacaaacgaacaatgtatgttgtcgattgttgctgtcgctggatccagcgacagagaaacgaacagggcatatgccttcgaaaatatctcatgttagggttaggccatgcaaatatattggacacttattttattttaatatgtggtctgaacttatttctttttgaacaaaaacaagaatattgttgtttaaaatttccatgaaatgattaagcaatacatatacaccacagaaaacaaactcagcttcttcttagctaagcaggcttaaggggcggctggacttatctataataaaaatttgagtatctaaacgaataaattggagatattcttttagtgttatcctaattatagttataaaacaattataaccttagaaagtttcttggaaatttaatggtaatttcattaccgtaaatagtttttctttcttcttcacgttttttttttttttttgttaaacttcttttctttctctataaaaactaaaaagcaaacttctcctttttggtacacttgccaaatgctctcaagctcaaattagcccaataaagagagaaaaacaaaacaataaaaatattaaaaatcatg

SEQ ID NO: 21681 - DNA, 3000 bp, Unknown; identical to SEQ ID NO: 9105
  misc_feature (1)..( 3000): 2750-1469P.txt file - cDNA_ID_1989814; gDNA_ID_1971984; Annot_ID_58747

SEQ ID NO: 21682 - DNA, 3003 bp, Unknown; identical to SEQ ID NO: 20464
  misc_feature (1)..( 3003): 2750-1469P.txt file - cDNA_ID_2024808; gDNA_ID_1620741; Annot_ID_166464

SEQ ID NO: 21683 - DNA, 1956 bp, Unknown; identical to SEQ ID NO: 2204
  misc_feature (1)..( 1956): 2750-1469P.txt file - cDNA_ID_2024817; gDNA_ID_1620502; Annot_ID_158941

SEQ ID NO: 21684 - DNA, 3000 bp, Unknown; identical to SEQ ID NO: 7169
  misc_feature (1)..( 3000): 2750-1469P.txt file - cDNA_ID_2024838; gDNA_ID_1621130; Annot_ID_172456

SEQ ID NO: 21685 - DNA, 3000 bp, Unknown; identical to SEQ ID NO: 8816
  misc_feature (1)..( 3000): 2750-1469P.txt file - cDNA_ID_2024857; gDNA_ID_1971893; Annot_ID_176869

SEQ ID NO: 21686 - DNA, 3003 bp, Unknown
  misc_feature (1)..( 3003): 2750-1469P.txt file - cDNA_ID_2024882; gDNA_ID_1621093; Annot_ID_170812
tatttttttcttaaaggtttttaaattatatattgttgactttattatgatgtgctttaaaaaaaaacaatattgtgattttgtaattgaccatgaatatgagaggttttggaatataacatataggtgaactactagccaattgttagtcggattactggtttaataagatgatcagaacaactaaacttgtaaacttccatcgattacaacaatcttgtgaggctaacttgaagtagttcaccattttggttggtgaacactatatatgtcaatttatgttctctaatatatattttcttgtttggttttctcaatatgtgttgtcgagtcgaaagtgattaattgatcgagctcaagatcttgctattaaggcgaagtaaagattgcaattcatattgctgtatcctaacaaatgtgatggtctcttatcgttctaacatctctctttcagatttatataaaaatatatatattgtctacaaaactcattcatccacatccaaaatttaaaatttggattattacacaaaagtagataaaccactagacaaataatatctagtcgaattaattaaattactcgtctaaattattagctttttagatatatatatctaaactaaggactaaagctagttagtgtaaatttgacttttttttgttctttgaaactatgtgtaatatctatttttttgtaaatgcaaagataatcgagtaatgaacatgaaaactactatattataaggaaaaaaatggtatttaaataaaaaaatatgaatagtgattgaagaaccgtacaggttatgtttgtgcagggagaggggtcgcgagtgcgtgggtcgggtacagaggatgagtcagtgagtcaggacctgtttccccctttgtagggacacttttaccatcctttaatgggcctattcttttcataggcccatttaaatcatatcagtcagtctttttcttgggcctcatctttgttttgtggttcttgcgatttgaactatctgatggtgactacaattggacgaccgcagaacaacccaaccgtatatgctgtcttttgtgggcaaatcttttttattgatatggattgtctcaaaataagtgatagaagtccgatataaagcataaaacaatctctcatgatcaaccattaaaagaaataaactagcaacaacccatgttcctcttactgacatacatacacatatagtcaaagatttatgcaataatttggactttattaaaaatatttacaaaccatatagacatatatatagtcatttttgatatcttggtttcaaaatctttctagatctttagttccaataaactttcaatttaaaagcggttttctaaaaatccgaagttggccaagtgatatattagtcctgtccaaactgacacaactcacgaatgtggtacgggttgaaaagccttaggccatgttcgtgaggtaaagatactcgcggtcgatcaactttggggaacgaattcgttcttggaacttttgttgattgattacgggcgtcatacgtgacgcccctgttcttttttatttttaggacggtttgggggtgttacaagagtggtaccaaaagacgacgaatatattgactcatatcttttatatcttagcatagtttgctttttcacttttaatgtgagaattctaacatgcacatttgagataatgaatcattttcactcatcgttttggatcgaacctcgttttgtttttggtttggtcataactttttaacttgaaaaccacttgagagtgagtcgactgatttatatactccttatattttactttatatcccatatttttttatgatgtaagattcttaacatagtcaagtactcataatgatctagtagttgaatgatttacgatgattcgaatcattctacttcgattgagggtgtacactaattagatcctattatatatgatataaactgatatatataagaattattatataatgcaaaaaatgatcataagacggacggtgtatatttattttgaatataatacaaaattatcatatgtccaactccagattcgtgtgcatgtctctacgtatctccggatacgatcatgctataagagtcaagacccctacacgatatgacaaaacgagtaggaaaaacgtgacaccaaaagatattaaaaagctgaaactaatatatagaaatgaaaatgagagatacatatcaacattatacaagaaagaaaatgaataaaataattgtaatgtaggactgaaaacctaaaaagaaaaagaaacatcaaaaggttgccaaaataaaaaagtaacatgaaaataaaacctgaccagaaatttccataaagcccaacctatttattttgcctacactctgagccccactcattagttgctcaactattttaattccttgtcataattgttatttaagaacctttataactttcactttcagggtatataatctctatggatttaaatggagaaaaccccagtgaccatagtttgatttaaggaagggaaagttataggaatggattatgaaatattataaattttgcatattaatgcaaaatatctatctttataaaacatacttttaaaaatatataatgttaagaaacaaaaggaggttaatattaagtgaagactctcactaaagtatacaaatgaagagatataaaaagcaggataaaaatagagtcaaaaagaaagaaaacaaaaacaagacatagcaatttgaatttaatatttggattccaaatccaagctcatgggtctattctactgttcacagtcacacacacactctctatctaagcttcttttgacttaagaccaaaatgaataaccccaaacctcaaacactcaaacataaacccaaaaaatctctctcacagagaaaaataaaacacacaattttaaccacaacacttgtctctctgctaacatacgcatcctctccggttcttgactaatg

SEQ ID NO: 21687 - DNA, 3003 bp, Unknown; identical to SEQ ID NO: 21686
  misc_feature (1)..( 3003): 2750-1469P.txt file - cDNA_ID_2024882; gDNA_ID_1621094; Annot_ID_170836

SEQ ID NO: 21688 - DNA, 3003 bp, Unknown; identical to SEQ ID NO: 21686
  misc_feature (1)..( 3003): 2750-1469P.txt file - cDNA_ID_2024882; gDNA_ID_2926160; Annot_ID_198719

SEQ ID NO: 21689 - DNA, 3000 bp, Unknown; identical to SEQ ID NO: 1917
  misc_feature (1)..( 3000): 2750-1469P.txt file - cDNA_ID_2024884; gDNA_ID_1620467; Annot_ID_157947

SEQ ID NO: 21690 - DNA, 3003 bp, Unknown
  misc_feature (1)..( 3003): 2750-1469P.txt file - cDNA_ID_2024889; gDNA_ID_1620356; Annot_ID_154489
taataatatttcccacacatattttttggattattgaatcaattcttgatttagatttccttacactactctaaagtcttataaactttaaagcataatgtaataaaactaacgaaacacaatacaaaatgggaaagatatcagtaaaaagatatacacatataaaacatttttttgatcgatacacattaaatttttgtaaaagaaaaacgctatttatagcaatacattaacgtcgacataaaaatctttgattataagaaaaaaagaaaagaaaaaaaaaaactttgattatatacacgtctctctctctctctcacagaaaaaaatgaaaaaagaagcattagttcccaaactcacatctgaattgcctccgtttacactaaaagaccatccgaagtttgtcgtcttagtggtcatcttgttctgtatcgctttcttcattgctatgaccttttgcgggtatgaacaagataaagaaaaagaaaactatgtcccaaatattacaataccttctatggatttcacggtccttaatataaccgagactcatcttagtgtaaaatgggatttattgttaaggatccctagagatcttcctggttggtatatgtgtctcaaaggagattttcagctttccataatatacagaggtgttaccattgctacttcatccatagagaggttaaactttttttctattctattgtctatattttagaatttttaataatttattcagcttatttgttcacatatttttgtgttattccttatcatgattgatcagttacagtctgataccacggtgggctcagctgattagggtttcatcgattgcttctgaaggagacatggagggtgtgattataaaagatattatgaaggatatcaaggaaaaaggtgaaataaggttccgatcgcgattgcttcttccggattgtagatatgggacaagtggaaagatgaactatgcgtgtgatgaagccatgttaaggttcgagcctggctctcaaaggaatgcaactttgtttggagaccaccctatttgccgctatcttcgctaagtacttttcatcaatagtttgttctttagtttgtcaaatgatggactttctaaattcttttgcgttttgatatggacttgctttacctaaattaaattcctataaattaattaatggaatatatttcttctagatgttaagtgttgaacattcttaattctctctctttacgaacaatagatatgttctagagcaatatcatggagttgtacgtggtgttatgatgatttctacacgaggcatttatccttgacggacaagttgcaattattttcctccatgatattcaatttttgggatggtattttcattctccacaaatgttgcatctatgagatcaatatgcatgcaagatctctaattaatggtgtggtgcatggtctgccctcccaaaggtggatctttatcttttgtgttgtgatagtaaatttgtatatatatatctagtgtttaaaaatttgctaagcatggggtgatccaatacctacctattaaaaacgtttaatccgaacatagctacacacggaccgaatgttcttttttggagttttttataattttattaagattttgggacatttagatctctttaaattaatatttactaaattaaagagagtagttaagatccttaccaataaacgagagagatgttaagatccgtctcatcaaaaaaagagaaagattttaagatccaagtcaggtcacttttttctttggtattaatctcacaactcaattctcaactcaactcaggtcaccaagatttaacacttataattttacactttgttttcttaatcattatatactatcctaagcatatatatgaatctttcaccataagttataccatttatatatgctaatattttctaaataaaccttacaaatttgttggcgctaacaaccattgtttaattttgcttggggtggctctagttatattatatagaccttaattttgcaggaggtatgtaacacctcatattgcttcagcttagcaattcatatatagccaagacgtgtggacttctcacccaaagtttcctagtttaaatgtgaatgcctctaaacaaaagttcttgctttcgatgtctaaacttagatgtgttaccgaataaagccagatttacctcctttgaccttactatatagccagctcgctgcctccgcaactctcaaaatgacactcgcgatcatattagttgtttccaacaaattgaaaaataaaacatttcactcaaacaaaaaaagatctaaacagccgaaaaaacaagtccaatatcaaaatctgttatagcaaaaaaaaagaaggtagagtattttggtaagaaagaactctaaatgcctctacgatataatattaataagtatgttaccaaacaacttaatattagtgcaaaaaaccctttagtttgtcataaacagcaaaatctgccactataagttgttttcatgaggtcaagttgatgagagtatatgattctctgaagctcatgtcaaaagaatagaaccaatgttcttcagtcttgtccacacggtaatgcttcaaatgaacttgtctatagagaatcttccagcgtgagagattcttagtgttggtggattgacataacagaaacatacctaacattggaaaatgctaaaaactttgagtgaatgaatgaatgtatcaatcatgaattagagattccattttttatggcctaaatcaatgtttctcacttgtaaaagttgtctttttgacaactaatcatattctaattctttttctctgccctttatggaaaagctttgtgactatttctttatttatttctgtccaaatttgatgatctgtaagaatctctttattgggattgcaatttcaaacaaactttacatcttcttcttctctctgcttttgccttcacgacgagtagagagagccatg

SEQ ID NO: 21691 - DNA, 3003 bp, Unknown
  misc_feature (1)..( 3003): 2750-1469P.txt file - cDNA_ID_2024916; gDNA_ID_1620730; Annot_ID_166084
taatttatttcaatgtatgcagaaacatatcaactactgaattatatatattaattaaccattttgtagtcagaattaactgggattaaatcacccaatcctaaatttgattttgacctaactaatgaaaatttaatagtaaaaaactattactttgattttacattttaactttgatagttttttctaatttttattaactagaaacctaattttttttcgtcaactagaaaactattctatcttgatattattttataattttacagacaacagaattatatataaataatttgagtttttttttgtagcttttaaaattgcattaatcaaatttgtttaatagaggatataaacatggtattaataaaaaaaaattctaaaaattcctctagttccacttttcagccaattcctcaactgatgtatcttaaaaaaaaaaaaaaaaatccacagattcagctaaaaatcactacgaaaaatgaacgattaaaattaacatgggccacatcaattgggcctaagaagataaagatgggccacaacatttaggcctaaaagaaaatgacctcaacatcaaaacttcgacagtcagtcactgtaacattttagatctttcccgaagaagaaaacgaagaagagacgaagagagaaatgaggccgatgcagctggatatgttatcggagatggatgatgcaggttcttcgatggccatggacgttgatgacctcgaagccatggagatactcaacgaaggaggacttgtctcagataacaagctcgccgacgccgatttcttcaacaaattcgatgatgatttcgatgacaccgatatcaactaaatccggttaagtttcctctttaagatttcagttttttttcctaaacttgatgtaatttgtggagaaacctatgtagtaagtgtgtaataagttctgggatttttatgtttgtggtatgtaacaatgtttttcttcatttggattactaaaacatttgatttgtgtgttattgtgctttgtctgattgttttttttggctcaaatttagaatgttttttttttccttggttctggagatgatgatgttttttggagattgaaacctaattttctttagtgttttggtattttagtaactgaaaattagagtctttgtatgtgaagaatgttgtgaatttgtatgtgaagaatgtgaaagttattgatattggcttaagatagaaactaattgattcatttggtaccatattccattgtgattgcttgtaatttcaacatctgaggtctctgaaatatgtgttgatgtgtttcattgtgttgatattcatgtgactcaccgggtctagagaaacttcccggtgagagatgaaatcctcatgtaagctgtaactttccactagtgattaagtgaactagggaactcatactgaagcacatattcctaccaacaatttaatggcctaagagaaatagtctcttgtatcttccatgtaactcagatacatcagtcaatgatttatatggatatggtatcttgttccatgttgatttcttgtaaattcaccatctcgtggtctctgaatgtgtgttgtattgtggtatgtgggagggggtgtataattcctgtcttgtggtatgtaggagggggtgtataattcccctggccaagttctgttgttgcatcgtgtcatattatattctctgggccggttttgagatggaaataatgtgcttgatgttcaactatggtagaaaggaaaaggaggctaagcataaagatgtcacttgtcactttgtcagtccctagcagtctttgttacttgccttatagtcgtatgtatgtagtgtagccaaatttcatgagatttcaacattcgatagcaattcattagatatcggtaacctcttttcagaatctcttactaataaaaaaaaagttatttgaggcctctcacactacccacctcagccttttaacaaatgtgttctcaagttgccacgtcatcaactctctcaaaaactcccaaatctctgcaagccaccatccatgagcctcttaactttcttctcctccctacctcaacctttataaaatctccacatcttggtttaatgactaaactctaaaattttgagttataaaaaagaatgtttgttaaactatgatattaacgctaaacatttattgaaaaaaaagttgggtttcgattaatattaaatatttcctatgtttcttagcaaaaataaataaatattttctctgttttttttgtttgattgttagaaaaaaacacacaaaagtaaatatattaaagttgattttaaatatattatattttgtgttttacaattttctatcactttaaaccaataaaatttaattatttttattaaagtttacaattcattaataaaaactaataaatattacataaaaattttaaaaaatcaatttttttgaaacaattttttttttcttcaaaatcaacaaaatagaaccgaaggaatatgaattacgcggattacaattaaattatcaattcatcgatcacctaatttgaacgagaaaaaacaagtaaaaaaacgaaaagtaaaatagtaaaaagtaaaaatacattctattggatttggttcggtatcaataaattatgatgttcttcacaaaatgcatttatatgacgtgtttgcttcctctccctccagtttcaagttgagcatatctgattagcaaaagcggttgaaggtcctctacttctcggcccaccgtaacaacatacactgtcaatccatatagttatcataaacccacacgtcaacgaaaccactcttttgacttcatcctctatccaatcacaccacgccacgttaacaccacgacctagtgtttctgtgatctccacacagagaaagaagcgtttcggttctgttttcgccccaacacaaagactccttttgtttcttttcctcaattggatcgaaaaaacccctaactttgacatg

SEQ ID NO: 21692 - DNA, 3003 bp, Unknown; identical to SEQ ID NO: 21691
  misc_feature (1)..( 3003): 2750-1469P.txt file - cDNA_ID_2024916; gDNA_ID_2926157; Annot_ID_198519

SEQ ID NO: 21693 - DNA, 3000 bp, Unknown; identical to SEQ ID NO: 4178
  misc_feature (1)..( 3000): 2750-1469P.txt file - cDNA_ID_2024920; gDNA_ID_1620689; Annot_ID_48533

SEQ ID NO: 21694 - DNA, 3000 bp, Unknown; identical to SEQ ID NO: 4178
  misc_feature (1)..( 3000): 2750-1469P.txt file - cDNA_ID_2024920; gDNA_ID_1620689; Annot_ID_164697

SEQ ID NO: 21695 - DNA, 3000 bp, Unknown; identical to SEQ ID NO: 4178
  misc_feature (1)..( 3000): 2750-1469P.txt file - cDNA_ID_2024920; gDNA_ID_2926182; Annot_ID_140633

SEQ ID NO: 21696 - DNA, 3000 bp, Unknown; identical to SEQ ID NO: 4178
  misc_feature (1)..( 3000): 2750-1469P.txt file - cDNA_ID_2024920; gDNA_ID_2926182; Annot_ID_200360

SEQ ID NO: 21697 - DNA, 3003 bp, Unknown
  misc_feature (1)..( 3003): 2750-1469P.txt file - cDNA_ID_2024949; gDNA_ID_1620549; Annot_ID_160241
aatctcccacaatattattatctctctcatatagccaaaacccaaacagtgcttctgtctctcgtgtgtttcctatttcgtttatatgggctatataaattaggcccatgacattatatgggctttcacatccaactaaatggattatggattcatagcgcgtgtgttcactgtctccttttaaacgcgtggttagatcaaagtctctcagatttcttaccttctcttttaaaaatgcaaaagatttcttaccttttctttttttgtgcaaaagatttcttaccttacaaaattaaaatagatacagagaatgttgacttggtgaggatggaggacacgtgtcagtttttgattgagtaagctattactctcctagatttctttctattccaatgtataaatttgtaacaaacattggattttgtcaaaagtaccacattttcgatttttgtatattgtaaattgtgaaattttcaatatttttattttaaaaatctaattttaaaattcatgcacattagtttgtcccaaaaaaataaaaaataaaagctcatgcattataagccaatcacactaccttgtaatgttaattctaagagttagataattttgttatttgtagatatacaaaacaaatgattaaaaatacatttagtaaattttgcattgttcaacatacgtgctaacatatagccattgtttttcgacaaatctaaaaccaaaattttatactatttacatagaaaaaaaaaataggcatacggtgttatatcatttttgttttagctatattatagcgcgtggttcacacacatgatctaaagagcgtgttgaatccccaattattaaaaagaaagaatattggcatttacctagatattttgttttggttttgttatatatagcacatgaaatcttattcatcaaaacactaaattttgtttcttctctcaaatatatcgtcgtcttcattgcttaagtcatgaatcgtttatgcttttttaacaaagttgtaaaagttgcccgtggtgattcacctccttttgatcttgcttctttacctcccaaagaacaacgagatgtaaaattgattttgcttactttaagattgcagctacttacaaatatagtttatgttatctttatatgacctaaatttctctttttttgtagttgattggtgaaactttgttctttatggtggaagaacttgagccacagtttgcaccaaaaatcacaggaatgattcttgaattggaccaagacaaggtccttcatctgctggtaacacctaaagccttcaaagaaatggtcaaagaggcaatggaggtcctagcgcactcctttctgcaacagatgaaaattgctaggggaaaaagatgttagcaagttcctaccttccatgctccccgctaaactttgaaatgtttgtttggtttttgttcattaatatgagcaacaaaatgtggctttaagttgagttttaaatctttgttttcatttaaaaaaaaaaaaatcatatgttagtgtatccaaatgttttaagacaataataaaaataaaataagttctgcttcgtccaaataattactagagtggttataactgatgttttagttaagttgaatttttaatttgtaaacaatgtatcccttagtaatatctaaacttctttctttcatatttaatcttacttatattaaaatatatatatatatatttatattctattaaataagaaaaaaatatatatacatatatataatagtaataatttatgttgatttcaactatatcgataatgtaaagcatgactaaacactaaataaatgatatttttagtagcccgtaagatatttttattatcatgtattcaaaaagttttaatccaaacatatttatttaaatatttagatttattttactttgtatgatgtaagtagataatgtttagtttttattttactttgtatgatgtaagtagataatatttagtttttaccaaccaatctttttagttgctagttttttaccaaccatatataccctctatcctttttgtatttatatcttttaggataaaaggctaataatagtttgatttactttgttaacatatctatcatatacatcaagtgttgcttcaaaacataaaaccaagacatggaattttataatttatactagtattctcgttgtatcataacttatatttaaatttgtgtttgttgtaaacaatcgaaaagcatatagaattcgtatatattttataataataaagaaaaggaaaaaacaaaatcgagacaaatgaataataatcatgaaaaaatgtttttcatatgttcttatatattttcaatttgataaataccgaataaatgtttcaaagtaatttgactttttaagtcaaataaaatctctaaattataacagtgaatcacaatagaccaaatcaatcatagcaaatagatatgatttatgaaaaaatgagaacctaagttttaatgttatacgatataattagataatttaaaatatatgcataatatacatatactattatttttatttaatgtgttgaaggatacaaaattattaaaaccatagcgattacgtaatttattcactattcatcagtttcttaatccaaaagaaaaaaaagaagaagataaagaggtatttatatatcagatgttcaaaaaccctaaatcgcgtttcttctctcaaatctgccgccgccatcattgatccaggtattgctctaaccttgactcttcacgtcattcgcatattactctcctcctcgctgatccattcgaattctgcactcaaatcgtgtttttgtacatcatagtttcaagcattatgattctctctagccaatgacttttcttgcgattgaatccttttgcagtctcgttatcaaaagttgaagaatttagtttagtttggttgtgtagataagatttgtaatcgcaaaattcgatctttgttacagttatg

SEQ ID NO: 21698 - DNA, 3003 bp, Unknown; identical to SEQ ID NO: 17923
  misc_feature (1)..( 3003): 2750-1469P.txt file - cDNA_ID_2024980; gDNA_ID_1621094; Annot_ID_170847

SEQ ID NO: 21699 - DNA, 3003 bp, Unknown; identical to SEQ ID NO: 17923
  misc_feature (1)..( 3003): 2750-1469P.txt file - cDNA_ID_2024980; gDNA_ID_2926160; Annot_ID_198725

SEQ ID NO: 21700 - DNA, 3000 bp, Unknown; identical to SEQ ID NO: 1825
  misc_feature (1)..( 3000): 2750-1469P.txt file - cDNA_ID_2024994; gDNA_ID_1620452; Annot_ID_157500

SEQ ID NO: 21701 - DNA, 3000 bp, Unknown; identical to SEQ ID NO: 8037
  misc_feature (1)..( 3000): 2750-1469P.txt file - cDNA_ID_2025014; gDNA_ID_2926133; Annot_ID_197049

SEQ ID NO: 21702 - DNA, 3003 bp, Unknown
  misc_feature (1)..( 3003): 2750-1469P.txt file - cDNA_ID_2025014; gDNA_ID_1972068; Annot_ID_178492
tgaacccaacacctccatatgggaaatttactactagactaccaccacgttgtttacaatacaagaaaatgacatgaaaacgattgtagtttataacattgaaccctaataggaaccatgaatccgagagagaacatggcaaaaactcaatttctcattaatgaatcagaaagtttgttacatcaatgtatagacaacaaaccaactaaaccaaaaataaaccagagattcactttaattagaatgaataaaccgggactataccgaacccttaatgacttctattatgtacaaatatacttagtatagaaactatacacaatctaataaaccctaacactttcgagatgatttagaattgaaaaattagtataaaatgcacgttgaagaaaaagcacgattgacatatttttataaatagtaaaaaaatcttggtcaaattcgagtagacaaccttatcaaaaaaagaatttataaattagacgacaaagtgaagcaaaaacagaaaacgttatctagaaaacgattaaatgaaacatcacaacctaatttcttcgtcaaagtaaaaaacatcttatgattcataattatccaacggaaaacgacacagatattataaataacttttccaaataaacaaaaatgaattaaagtaataaaatatccattcctcttcgatcatatccacagttcccacaccaacatgtcgcgaaagttcctaaaaccgccacgtgtcagtcacttatccaacagtaatccaattattcgtcaagcctccggtttattaccgtctaaaccggtagctcctcccaaatcatatggctcactcacttctccgtctatataaacaaaacatctcttactcttcacaaaagaaaaaactctcttcggaatctgaaaagccataaatcagcagaaaaaaatcttaaggatcggaaattttataatcggatgaatagagtgattagtcagttttccggtaagttgatgaaggagaagagtgttaccggtgtaagcggcggagatacgactttaagatctgccgtcaaagaatcggtctcgtctccacagagtgcgtcgtcgtcgtcgtcggtgaggaggcttaaaggagatctggaatcgagtcgatttggtgcggcggcgagtgagaggctgaggcaagcggaggaatctttgaggacggtgatgtttctgagctgttggggatcttgttagatctggttgagaaaataatagatgagaaaacgaaaccaaaacgtttctgtttgtgtttttgagttttggatttttgttttctctgtgaatagttttttttttttttcgttttctttgtactttgtgttttatgtaaatcatgtataaaatgaaaagtaaatcaatgaagataatggtttgtcttcaccaaatcatgtatttacatgtggatttgaactatagattatacaaaaaaattagtttgataaagacgatgactcaaaatgtaataagtatgttattttggattttaataagtcgatttttagataatgtataattggtaaatcgttaaataaatcgatatataaaagttgtattctaaactcagcaaattgtcataccatgcctaaataaaaatgctgaaataggtagatttggtccattttggttgatactagaattgtttgaagtctacatttacgattataataatggataacaagatattttgtaagatgtgagatggtcatatagtttggagttgtcaagctataacgttaaaatggtacaattatttatcaagctaagcgaagatttacagcggatttttgacgcatttttaatcgtttttgataggtctgggcaaaatatctaaatctgaagaaccgaatcaaattcgataaaaatttttgatccaaacttgaattcaaaactttaaaatatccgaacggatcacaaatttcaaaactcaaaaatccgaattcgaaaccgatccgaatatgaacccgatcaagtatccgaacatatccaaaatatatacataaaaataatttaataatatttacacaacttaagttcctaaaatatttgaattttaaaatattttgtatattttggatacttaacctacttttcaatagatttggatagaaaatactcaaattttgttagaaaattttatatatttttaagtaatttaaatattttgatacaaaattttgattttggatactcgggtgaatccgaaaaacagatccgaatctaacttagagtcttaggtggtgttattcaattatggtgttaaagtcaattatttaagctttagatttgttttctgatattgcttttaagaatatgtttgtatgaatttcaaaatctctgcaatatgtcttggattttgattttaatgatttactcatgaaactccaaagagctttcatttcaaatcaattaatatacaaagattttaaaagtcttttagttttgaataacattggattttaatgaaatatttcaaatcttaattgaataacaccaaactttagaatctattaagcatgatttacaaatatgagttccaataacactagattttaaagctggatttagaatcattagttaaataacagtggattagtgtggatttcaattctattaaaatccattaacgaataacacccccttacaatatccgaatggatcttagatttctaaatttggaatacccgaacccaaaaaactcgactcgaacctgatccgaccccaatccgaatacccaaaaacccaagccttattttttgagtgtaactcaaccgtttttattgcttttcagaacgcaatcactacaacaaccaaaaagtaagctttaagcgaatccaaacgctatcgtattaaacgctattactatctgcgttttagctcttcatcttcttctccacttcagatgactttctcgcttaataaaaaaacactaacccaatcaaatccactttaatccttccctctctcgcgtccgattctccgatg

SEQ ID NO: 21703 - DNA, 3000 bp, Unknown; identical to SEQ ID NO: 8037
  misc_feature (1)..( 3000): 2750-1469P.txt file - cDNA_ID_2025014; gDNA_ID_1621185; Annot_ID_174404

SEQ ID NO: 21704 - DNA, 3000 bp, Unknown; identical to SEQ ID NO: 2084
  misc_feature (1)..( 3000): 2750-1469P.txt file - cDNA_ID_2025039; gDNA_ID_1620485; Annot_ID_158448

SEQ ID NO: 21705 - DNA, 3003 bp, Unknown
  misc_feature (1)..( 3003): 2750-1469P.txt file - cDNA_ID_2025043; gDNA_ID_1972192; Annot_ID_180216
agatatcttcgagctatccccctacctggcgcgccaactgttgatgcacgaatcacacaagtacgaaaatgggatctctagggaaggaagaatctttctattaaagacgagcctgcgacttaggcgaattggacggatttcaaaggatgatttcttcaacgagcattgatggagtaagaacgagctgattgtagatgaaaggcgagcttgaggccggaagacgaacttaatgtccgaggaagaatagagtttattcgttttatagctgaaccttgtaaaaggttgcctacgtacccttagaaagggatcaagccacacgtagttcatattagaataagtgagctaggccgtcattggaggtaggtcggcaggtagttgacgagggatgagctatagctagacgaggagttggacgagctgactagctgacagctaggcggcgaggacatggtcgctgtgatgggaagagcttgaagacgagctgaggagcttgaggacgagccgaggagtttgaagagctgaagagcttgacgaagaggagcgagctgatgaactacttgagaagggcccaatccgacccctaacaaagacttatgtttagatatgttttcatgcgatccaaactatactatatatttttttggacggattttttaataagttttatggagttcacagacgagtttgaacgaagcgttttctttatatatgtgctatgcgaaataaaaacttgaagacaaatttaaataataatgtgatgtagtagggcaattgcataatcgataaatccggataagtgtgccccgatacaacaaaagcaacaacgtttacgaaaatttaacaagtccaaaagtaacagacatgataataatatcctcattacaaaactcaacacacgatcaaaataagtgaaacataacataaaccataaaccctcaagtttcaatacgtatcaggagatttaatgggggggggggttaaaatcatatactcctccttgccgaactattaggggtcggattgggcctacttggcccaatgcccaaacccaagtcaaaagcccaaaataagttccaaaccaaggaggagtattaaggcgaagggtagtttcgtcaaatccctcgatgaatgccctacacgcgtagtgctataaatacggaatagcatgtcatgtcgaaggggggaattccgcctgacacgcagacacagagtagctcgcctttctcaagtagctcgtcagcgagcccttctcaagaagctcgttagctcgctcctcttcgacaagcttatcaactcgttctcttcaccaagtccctcagctcgtcttcaagctctccaactcgtctttaagctcttcaaactcttcagatcgccattaagctcaacaagctgctaagctcgtcttcaagctcctcaactcgtcttcaagcttctcagctcgtcttcatgctccactcaacgaccatctcctcgtctagctgtcatctatacagctcgtccaactcctcgtctagctatcagctcatccctcgaaaacaaaactcatctacctcctcgcctagcggcagttcgtccattgactgcatagtccacctatctcgtcgtccagctcgtctagaccttcagcaaacaactcggtttatccaactcgtctctctaccacggttcatccagcttgtcgcacatctgccggctcgtcaactacctgccgacctacctccaatgacggcctagctcacttattctaatatgaactacgtgtggcttgacccctttctaatatggactacgtgtcgtctcgcttgactatcaccgagacagcacattgtcagctcgcccgtctcacgaagatcgtccgtctcaaatagctcgtcagctcgtccttctcaagtagctcgtcagcgagcccttctcaagaagctcgttagctcgctcctcttcgtcaagcttatcaactcgttctcttcaccaagtcccccagctcgtcttcaagctctccaactcgtcttcaagctcttcagctcgccttaagctcttcagctcgcctttaagctcttcaaactctttagctcgcccttcttacaaaaacaaaaaaggatatcaattatgtagatcaaaacaaaaacaaaaaaggacttacaaggacgtagatatcaattatgtagatcaaagaataagcagtccaaattccagcgttgatgaaacgaactaacgatagccaaaacggcatgtacttgaaggtcttagtctccggcggcattttgtcctaattgtttcacgcattaaaaacttatcaaaaccagtttaatagtttacttatctatatattcatcaataagtgagagccagagagagagagagagcttactatggtaaataaaagatagatgataacaatgttgtaaacgttgcaaacaacaccaatgaatgtatgcttgccggccggataaactcccaaatccccagatagtcatacaatagactgttgccacaaaactaaactccaacggaagcaatagataaaagagtaatatctgcacatcaacatcgacatcatcaaaatcaatatacaatatttttctggatttgttttttttttctttgggatatttctatagaatttagtcaagattgtgtttgtttgttaccaccttttgtgcaccagtcaccaatccttatttttattattaaatctatttttgatactataattcgtgattttccttttagttttatatatatatatacttacagagatgcgagcttcatattattatttttatctttttgaacaccaaaaaaatagcctcgtattatttttaaatgatcaattatgtgatcatatttaaaaatacgatccggtttttaagggatttgaacggatcaaatgtgtttccggttcggttatataaaccggtattttaccatatccaaccgaaatgagtatcgacgggaattatccgtaaacagagtgacagtgaggtgtgaaggaagaagacgatg

SEQ ID NO: 21706 - DNA, 2557 bp, Unknown; identical to SEQ ID NO: 1644
  misc_feature (1)..( 2557): 2750-1469P.txt file - cDNA_ID_2025081; gDNA_ID_1620430; Annot_ID_156819

SEQ ID NO: 21707 - DNA, 3000 bp, Unknown; identical to SEQ ID NO: 2011
  misc_feature (1)..( 3000): 2750-1469P.txt file - cDNA_ID_2025094; gDNA_ID_1620477; Annot_ID_158203

SEQ ID NO: 21708 - DNA, 3003 bp, Unknown
  misc_feature (1)..( 3003): 2750-1469P.txt file - cDNA_ID_2025098; gDNA_ID_1620464; Annot_ID_157862
acctcccaatgaccatgttgacaagcttgcatcaaagccgtctgtttccaaaaatttcttgtattcagactacttcaaaaccaatcaataatgcaaagaacaaaaagacactaatcacaacacctgtccacggtagttccggagattaatatcaactcctgattccaccaacagagaaactatctgaagataaacaaaacccaaatcaccaatcaccataaaagtcagaactttagaatctctaatcttacaaagtattgatctttcaagtaattacagttacctcgtggtggccttgagcggcggagtaatgaagaggagagttacgaacgccaaaagtagagtaacgagcgagtcttggattgtaatctaagagagctttagcttcctgtaaatcaccgtctctggccgctgatactaagcgttcgccggacgcagaacaaccgaatgagtttccgacgaggcttagaaacctcatcgttttacgatacaaaattgaaattttgatcggatcaaccctaacaaatcaccatcaacacaacaacacgaacaaattttattggattcacaatttgcagcaaacccaattcgagaaccagctcggaagaatcgaagaattgaatttaatttcaaatgattgcaacaagaaaaatttggtttttattttcttcctctgtttttgttgttgttggtgttctttaattctcttatgtacagatcagatcatcatcatcatcatcataatgatccctctttaagaaagaaagaaactttaaagaattaaccaaaaaaaaatcaaaactttaaaagaattgaccaaaaaaagctttaaactttagaggaaagatcatccagaaaacttctctgacaattgtaatacagagaacatcaaaaagaatggtgaaattaagttgtgggattttttttttggtcaattgattaaggaaaataacaaacaataataacaaattggtgattactttatttttaaaccaaaaatggaaaagaattgttctaaattttttattgtgtgtggaggatctcttaatattttgtgatggtgacactaattaattgacttttaattatttgaacaaaaaaaaaatatgacaaagccaacgttgtagccagaggtttcgataaaccaatagccggaattcgcgcgtttttttgttttaaccaaaatcttaatgattataaagattctctaacaatgaaaaaaaaaagacattcttcatcacaccataagaaagctttctcctttattacatataattaaataaataatcttactatactgcgtaattgaataaatataggttctttttgtgccaacaaataatgattcaattagcaagtctccaaaagtaacatgacattagtggaaaaacaagtgtataataatgaaatgtggaggagcatgtgggtcgtgtcacgtcatgcttataattgcatttgcattagcaaacctataacattaatgacttcaaattttaacattagcaaatcagaatgatcatgccaactctcagcaaatatatttatcaaaaaaactctcaacaaatattacttgattttaaagatgacccaagctatcttcaatctcactttctgtagaatcactaatttgtgtctcacaattgtgcaaaactgtggccagttgctgtaaattgacagaaaattctttagttgacaatttgtcttgtactttggaacttgtagcagagtttctttgtccagagttaacactatccaaactaaactccaactcccaaactggatgtacaagcttaaatctccacttgtgctttatgtggaacttctccacaccaaaaatgagttgtgtaattcagtctgaaacatgtccactattccacatctatgttctctcgagtccacatcacacaatcaagtaggtgcatgtgcacatgttggaaccacaaacacaacaccctcactgtcctagtgttttgtaagagagagatgtgaagtagtctagaatgtctcatcaagtcgtcctccaaatgtaaccatatatcctcaccttctgtacacattttcaaaatagctgcaatggaaagtgaagttcctgaaaagtctagagtataaccagctcaattttgactttctgatatcctttgttgaatggccaactccatagacattaacacacactcatagtttggcttcatagtctgctttgacaagccagatccagacttttgaacattaattctcattccttcccatgcactgcttcaatttcgcgagaaacatcttgcataagcctatgtcccaaaagtttcttcaagttctcaaacaacatgcactgcagctttctcgaattccacctcacaacagaacttgttttttgtcattttgatctcctctaagctaaatttaaacttgaatttccaagctttagggaacttcatatggttcatgtctctgacatactgcatcatcctcattttgcacctactgttccagcttcccttgagtctttttatgttgttcttggtatagccctctgcaaatacgcatgcttgtaattttgtcaggctactttttttcttcatctcgttgacaaatctataacagattctgttaaagtgtctgtctttcgttcgtaagatcattacgttcatataacaatatctttgatgcttgttttgttattcccaattgtcttgattaacgaagaaaaaaacgaatccttttaattttttctcctctgtttgttaatccgttactgctctgttagtctaatgtcaaagaaaccacgttgcttttgaacaacaatacatctgtattgggaaatctatgaatacttgacttctatatttaggaaaaccacaactcactttgcactgaaacgtcaacgttttgtttctttactttttttggttacaataacagagtcttcctattattcactttttttatcttctttcacttatttccccatctccttcctcttgaatctttctcaagaaaaccatg

SEQ ID NO: 21709 - DNA, 3003 bp, Unknown
  misc_feature (1)..( 3003): 2750-1469P.txt file - cDNA_ID_2025109; gDNA_ID_1620412; Annot_ID_156298
agatttgcagatttatggagacaagtgtataagaaatcttcaacgatatataattatagccatcattgaaattctccatcaaaagcataaaaaaaacgaaagaaatgccgtctctcgtgaatctaataaaggcgaaatgaactttttgtagcaaaattgtttatataacaaaaacatgataataaagataacttacgcataaaatatcggtagtttttagtatccgcgtatagtttacttaactaaaggaaatatggtattatgactttttaacacaagattttaactgggcagaaagtaacatgaacggaaaaggtctacaaagtggggttatcttgaaaatgccgtatataacctgttatcgctattttactttacattatcgcttaattaattaatgacaacttgtgacatctttaattgcgtccaacaacattttttttgacttttaaacaataagctataatgacattttatttttagaagctatacttacacagtgacacataataattcaactaaacaacccactgtacccgattgaatattttacaagccatgaaggttttaagaagattttgttgctgatgcctcggctagcttgaaaatgttttatggattttacgcaaacacgtcattttgacagtgttttagagatttgtttttgtctacaactaatatataattaagctttggagccattgaaaatatttggtcgataaataataatcacaaagtgtacctcaatcatagaaatggaatgctatggtccatataacttgaaatattgtagtcataaaattacgatatcacctaacggaaaatagtcttaacatttgaacataacatgtgttcagagaagttataaataagtgttcagagaagtgattttttatttctaagttataaataagtgtgaaaaagtaacttatgactaaaaaatattttgtgaactttttaatattattatttttgcaaaacaacgcactatatatgtacctcgtacactctaattagctcatccaccacggtaaaatttatttattattttgcattttttatttggttaagctgaaacatatcattatcaccaagcaattatatatgtaccgataacccatgctgaggaaattttctaaccaaacctttgggatcagaatatatattagtaaataatcatactttaacttagattacactaaaaactagttatcgttttagagttttttttgtctgacgagatctcggatgcttcgattacacctgacttgttagatgggatgcatgaccacattttggctaacatggcgtgcaaacgatgacgtggaggcaactgattggctccactgattcccacaaatttgttgcaaaatcaaaagtagggccagactaattatattatttttttgtggatgtctataatatgaaatttgaatcaatacgtaatttatcgattctttgtctaatcgatgtcaactaaatttaacaaattatctggaagtcactcaacattttccttgataatgctagtttcttcgaatcttaaatgaggcaacgcattgtccattgaaattttaagcatatagtgtatatatgtatttatttttctagcaaattcaaaacggcctgggatcgtttggtttgtaatcaatatatgggttttttttggtcaacaatcaataattagtatttttgagaattcatgaaatactggatgagtaaatgagataatttttatggatgatcactagcacatggttgctaaccagtgaagcacctaaaaaatcactgcaaaaaagtttgtaatcaatttcgttgcagctaagcaacatttatgactaatttgagtaaatattaattgacgatcccatgaatttcacctaattgacgagtccctagatttgttttagagtaaattttacaacttcatatactttacattataattaacaaactaaaaaactcgtaaaccaaataagactttgtctaatggtccaagcatgacctctccaaagatataatatgttttgatatatacgtgataaccgatcagatgttgtatatacatattaatgtgtattaatttcttcatataatatttacaaatttttgtgagaagatatcaagtacacgtatatcgaataagaaaagctagattgtgtaaaacgttacggggcttgtgcattaactcacaagttggctatcacaagtttcaaattgtggtgtttagagcatcgcagttgtcaaacaaaaaaaaaaaaaaaaaaagaaagagtatcacacgtgattgttttccataactatgagaacttttctgactattttcttcttttgtgcctttgttatgtttcttcaatcattacttaattattaattactaatcgattttcgttgcctgtagttttcacatgttgtaatctagaaaactgaaaaagactttccccataatagtctctgctaactacatactagtccctatattttgcaattttaagtgtttttaaccactatcttagagactctaaacatgaggaccctaaaaaataaccatcatcttaaattgtacgtaagaaatatattcaatctacatcagatgataccaataaaattcggcatataagtagaatttgaaagaaacaacaacgtgggtagatatgcaccatttacaacaacaaaaaagaaaaatcaattttggtccaactttttcatatacatttaaattgtcaattatcatcataattagtaatacgacaaactgtcgtataaactagaaaaatacatacatctactatctaaaacgacagataaaaatacgtaatcatcaaaaagagttaaaaacaagttttggggttctcttagcaattttgttttatatgtctatttttatgtaacgcgacagctgtaacgttgtgtctatatatatactaacagagtttgtgcttcgaaatcttaagaactttcccagttttgttttttaatcatatcaaagcaaactgtgtgatg

SEQ ID NO: 21710 - DNA, 3000 bp, Unknown; identical to SEQ ID NO: 5552
  misc_feature (1)..( 3000): 2750-1469P.txt file - cDNA_ID_2025142; gDNA_ID_1620801; Annot_ID_168679

SEQ ID NO: 21711 - DNA, 3003 bp, Unknown; identical to SEQ ID NO: 19322
  misc_feature (1)..( 3003): 2750-1469P.txt file - cDNA_ID_2025191; gDNA_ID_1620655; Annot_ID_163615

SEQ ID NO: 21712 - DNA, 3003 bp, Unknown; identical to SEQ ID NO: 20915
  misc_feature (1)..( 3003): 2750-1469P.txt file - cDNA_ID_2025218; gDNA_ID_1620842; Annot_ID_170070

SEQ ID NO: 21713 - DNA, 3000 bp, Unknown; identical to SEQ ID NO: 5240
  misc_feature (1)..( 3000): 2750-1469P.txt file - cDNA_ID_2025218; gDNA_ID_1620775; Annot_ID_167657

SEQ ID NO: 21714 - DNA, 3000 bp, Unknown; identical to SEQ ID NO: 20917
  misc_feature (1)..( 3000): 2750-1469P.txt file - cDNA_ID_2025218; gDNA_ID_2926205; Annot_ID_202118

SEQ ID NO: 21715 - DNA, 3003 bp, Unknown
  misc_feature (1)..( 3003): 2750-1469P.txt file - cDNA_ID_2025243; gDNA_ID_1620418; Annot_ID_156506
aatgtaaaaaataagataaaataaatagaaattagttcaactataattagtttgcttgagtggatggaattttttttttgtgtggatggaaaatttatcatgtggatcaagatcacggatcaacttttaagatgtctgaaattttcgtcattttgttatgaccatggtaaatgtttaaatggaaaaatattcgacaagctatagacctcaagaatttgtttcggttaatttataattttatatatcctttttgatctaagagaaaaggatatattttggaaatttgaatctgatcaatgttaatcttagaagctgatttacgaaatatttgaaaaaatgtagtcaaggacattgcaatactctcattcgaatttagaaactgatatatttattttatgacagtgcttgcatcctctaggctctaacatgcaagatagtttgcgtgcgcatgcatgtatggccatctcaaaatgataagtttttttattaaacgaaaatattctcttaaaaagaaacggttgcacgttgtaaattagccatgcacacatacatgtgtagaaacatagatatacgtgcgtaaatatgttaccttcgaggaatttgctgagacgggtaacgaattggacacggcaagtgtcacagtaaactgatccttgaatctggaaacgatcgaagtcgtcagcatcagcggcggcgaaacctgccagagaagacaaacacacggcggagacgacaaagaaagagaagaagatagctttggaagccatttttattagagatttttgttttgtttttggtcttctcttctttttgatatctctttttatattcaaacaataagttgagatatgtttgagaagaggacaactattctcgtggagcaccgagtttgttttatattagaaacccgattgttatttttagactgagacaaaaaagtaaaatcgttgattgttaaaatttaaaattagtttcattacgtttcgataaaaaaatgattagtttatcatagcttaattatagcattgatttctaaatttgttttttgaccacccttttttctctctttggtgttttcttaacattagaagaacccataacaatgtacgttcaaattaattaaaaacaatatttccaagttttatatacgaaacttgttttttttaatgaaaacagttgaatagttgattatgaattagttagatcaatactcaatatatgatcaatgatgtatatatatgaactcagttgttatacaagaaatgaaaatgctatttaaataccgatcatgaagtgttaaaaagtgtcagaatatgacatgaagcgttttgtcctaccgggtattcgagttataggtttggatctctcaagaatattttgggccatattagttatatttgggcttaagcgttttgcaaagagacgaggaagaaagattgggtcaagttaacaaaacagagacactcgtattagttggtactttggtagcaagtcgatttatttgccagtaaaaacttggtacacaactgacaactcgtatcgttattagtttgtacttggtacctttggttcaagaaaaagttgatatagttaaatcagttgtgttcatgaggtgattgtgatttaatttgttgactagggcgattccttcacatcacaataacaaagttttatagattttttttttataacatttttgccacgcttcgtaaagtttggtatttacaccgcatttttccctgtacaagaattcatatattatttatttatatactccagttgacaattataagtttataacgtttttacaattatttaaataccatgtgaagatccaagaatatgtcttacttcttctttgtgtaagaaaactaactatatcactataataaaataattctaatcattatatttgtaaatatgcagttatttgtcaattttgaatttagtattttagacgttatcacttcagccaaatatgatttggatttaagtccaaaatgcaatttcgtacgtatccctcttgtcgtctaatgattatttcaatatttcttatattatccctaactacagagctacatttatattgtattctaatgacagggaaactttcatagagattcagatagatgaaattggtgggaaacatcattgaacaggaaacttttagcaaatcatatcgatttatctacaaaagaatacttagcgtaatgaagttcacttgttgtgaatgactatgatttgatcaaattagttaattttgtcgaatcatttttctttttgatttgattaagcttttaacttgcacgaatggttctcttgtgaataaacagaatctttgaattcaaactatttgattagtgaaaagacaaaagaagattccttgtttttatgtgattagtgattttgatgcatgaaaggtacctacgtactacaagaaaaataaacatgtacgtaactacgtatcagcatgtaaaagtatttttttccaaataatttatactcatgatagattttttttttttgaaatgtcaattaaaaatgctttcttaaatattaattttaattaattaaataaggaaatatatttatgcaaaacatcatcaacacatatccaacttcgaaaatctctatagtacacaagtagagaaattaaattttactagatacaaacttcctaatcatcaaatataaatgtttacaaaactaattaaacccaccactaaaattaactaaaaatccgagcaaagtgagtgaacaagacttgatttcaggttgatgtaggactaaaatggctacgtatcaaacatcaacgatcatttagttatgtatgaatgaatgtagtcattacttgtaaaacaaaaatgctttgatttggatcaatcacttcatgtgaacattagcaattacatcaaccttattttcactataaaaccccatctcagtacccttctgaagtaatcaaattaagagcaaaagtcatttaactttcctaaaacaatg

SEQ ID NO: 21716 - DNA, 3000 bp, Unknown; identical to SEQ ID NO: 2884
  misc_feature (1)..( 3000): 2750-1469P.txt file - cDNA_ID_2025284; gDNA_ID_1620612; Annot_ID_161938

SEQ ID NO: 21717 - DNA, 3000 bp, Unknown; identical to SEQ ID NO: 2068
  misc_feature (1)..( 3000): 2750-1469P.txt file - cDNA_ID_2025303; gDNA_ID_1620484; Annot_ID_158427

SEQ ID NO: 21718 - DNA, 3003 bp, Unknown
  misc_feature (1)..( 3003): 2750-1469P.txt file - cDNA_ID_2025310; gDNA_ID_1620437; Annot_ID_157050
gatgaatgtaaacgtcgattcagtgtgagactctggaaagtgtttacagattcttttaactgtctccctgttgctgctgttatagacgataagatattatgtatgcacggtggcctttctcccgatttgaccaacgtggaacagattaagaacattaagcgacctactgatgttcctgactctggtttgctctgtgatctgctttggtctgatccaagcaaagatgtcaaaggttgggggatgaatgaccgtggagtctcttacacgtttggccctgacaaagtcgcggagtttctaataaagaatgatatggatctcatctgccgtgcccaccaggttcgtcgtctacacactgttcgtttctattttactaaagatgtcacggaacttctataaaaatataactgttgtgtttttctttttctaaaaggttgtagaggatggatatgagtttttcgccgatagacagcttgttacgatattttctgctcccaactactgtggtgaatttgacaatgctggtgctatgatgagtgttgatgaaagtttaatgtgctctttccaaattcttaagcctgctgatcgaaagccccggttcttatgaagtaaagaggtagttcaagtcttttatactaacttgtgatgagtgtttcaattcctgtttcagtctttcagatttccagattgctataaaaagttcatcatgcatttcttctcaaattacttagattatgacatttgttcatcttttgcttacacaacttgtttaagatttgattgagtaaaacagaaggggtttcgttttgaactttgtgaatatgagctcagagcttggatctcagattcaatcacttacaggaaaacttgtttcatttttgcatgttgcagttgaaacctcgcgggaaagaagaggaaaaaggcgatacgaaagcgggagagacatttgaagctccctgagactttgtccggaggccttgcaaaggcaaaaaaacataatttacatgttatattatcttatttgaactcttgccatttcttttctcaaaacactttatgttcttatgatcttctcctctgactctatatagacagtaaaaaaagtctgcaaattttcattctttttcaacaaccaatttcctcagtgtacatactaaattgttctgtatccatacacacatatacttgggaaatcttcggtttcatggattcttcacaactcgaagcctctttaaaaacagattctttgcttagttgttgtcgtcgctgcaaattatttgacaagtggagagtttttgcagagctaaaaagcgaatacaagttgaccaaaaaaggtcaaatccctggttccatatgaaactgtcaaactttggacgtgcatggatacaaaagcttctgtcagtttactttcctggatttagggttttaaaaccagctgtgaggtttgctgcaatgtggcaatgtcactgcaatgtgttgtatagagtcttaagtcctctgtttactttaaaacccgtattttaacttgctgctattcacaacaagaaaaatgaagtcttgtctagctacttttgctctcgcagtgttagtaacacaaggaagcatttttagtttgtgtttggcctcctctgcttctacaaactctgttcctaattggtttcatcattggccgccgtttaaatggggaccaaaatttccatattctccacctaaaccgccgccaatcgagaaatatcctccaccggtgcagtatccaccaccgatcaagaagtatccaccgccaccatacgagcatccaccggtgaagtatccaccaccgatcaagacttaccctcatccgccggtgaagtatcctccaccagaacagtatccaccgccgattaagaagtatcctccaccagaacagtatccaccgccgattaagaagtatcctccaccagaacagtattcaccgcctttcaagaagtatcctccgccagaacagtatccaccaccgatcaagaagtatcctccgccagaacattatccaccgccgataaaaaagtatcctccgcaagaacagtatccaccaccgattaaaaagtatcctccgccagaaaagtatccacccccgatcaagaagtatcctccgccagaacagtatccaccgccgatcaagaagtatcctccgccaattaagaagtatcctccgccagaagagtatccaccaccgatcaagacttatcctcatccccctgtgaagtatccaccgcctccgtacaagacttaccctcatccgccgatcaaaacttatcctcctccgaaagaatgtcctcctccgcctgaacattacccttggcctccgaaaaagaaatatcctccaccggttgagtatccgtcgccgccatataagaaatatcctccggctgatccatagtaactcaaaaccaaacaaggacgtgtttgtctataagtatatgtctagttaaaaaactgttctgttctttctgttatgttctttctttttcttatgactttctgttatgatgcatcaaataaagaataaactgttctgttttgaatttgttaaataggagagtgcaagctcaagaacaagctgtttcataaataaataaaatatattttctaaaatcaagtaaagtaaaaaaaaaatagatattgtactaaatgaataaacttgattcaacaaagttttgtacgttgttataatttcacttaaataatttagtgcgtcaaaaaaacaaaattaaaacgtaattggtcaaggaaaaaaaaacaagtctcaagggaaaaggaaaacaaaaaaaaaggaaaatttaataagcaatctggaccgttcatactttttagatctgacggctgacagagaactaccattgggcatcttttataaacagagagatttgtttgattccggtcgaactcaaaacataatttgctctcaataagacattaacaaagtcccagaggcagagagagagaatcagagagagagaagtcgagatg

SEQ ID NO: 21719 - DNA, 3003 bp, Unknown
  misc_feature (1)..( 3003): 2750-1469P.txt file - cDNA_ID_2025342; gDNA_ID_1972118; Annot_ID_178863
aaataaccagtaaatttttgttttcgaatcttgccagacagttcgtacctgagcataaaaactagtgtatttgcaatgtaagcggccatttccctacaaaagttatagggcaatcataaaaatataatatatacatgtaaagatttcctttgatttgacgaaaaaagaacactgagttgtgaaataccagaagtgatgcagactctggtgactgtcccccttaaaagctgtccttgcaaatgcagcgaaaaacctattacaattatgttatgaacaatggctttttgacacataacaacagaaagaagggataatttaccacgacttacatccccaaaatcatgacagtcaaaattccagaaaccccagcccactcttgagcctgtacatagtagaaatttcttaggtttcctagagatttaagattctccattggggactaagttatgtagaagagaagagcatacagtgtaataggcgaaatagctcgctgaaagtgttacagtgatctgagccaccgtgtcattgaatatgaatttaagccaaaaaactgatgcaattccaaaagctagaccaatgcctacactaaaaaaccagaacaacataagcggagaaaagaagacagcgacatacaatactactaacaaaggaaaataatccatacgctccgaatgagttttggacaagaaatttgattatggaaccccaatcagagttatgccccatcaccatcttgaagaataattgaaaaaccacaaccgataccctgaataatccaaacaactaagcttgatcatatatgacataacatcaccttgatgctaaacataagagtttgacatggttacccatcgttcatgagagattccccatcaattaacgtggtcatcttcttactagcaccaagctcctttagcaaagcaacaacagccacggggtcggtagctcctaaaagtcctccaagcaacaatgatgttttccagtcccagttatatggaaaagtaagctacaagagcataactcgaaaaaattgttaagttaattgaagctcacttaatcacagtcgaaaatgttgaagctagttaaagtacctttataagagctccgagacaaaaggtggaaatcagaactccaggtccagcaagcagaaccatttgtcccatacatctctaccaatgatgtaaaacaatcaataccaggaaccaacacagccaaggaagtagctcaatcaggaaagtaaaaaccttgatctggtgcacatccatggagaatgagctctcgaaaagaagaacagggagaaaaacagccaaaagtaggtcagggttgataccattccctgtaaagttgccattttttagagctcgtaatctaacagtatggagaagagaaaatacagtagcttacagatacgaattccatggccgagcttcccaaggttatgcttagttccatattctacagaagcaaaaaaatccaaaatttaactactttctaaaatcttccacgaaattgaaactgagctataaagcttaatgagcaaacaaataagacctagggatccgagaaaaatgccgatgacgagaagaacgacggtgtacggaactctagtgccgttaaacaaatatctacaagcggtgccgagaaccagcgaagttcccgcgaaaataacagcatcaacaggactcgaatcgttctcagctgaatacgaagaagatgcaattgctttctccggtgatttgtacggcaacgccgcgccgattatactcgtcatctccggtagaaagaagcaaacgatcaatctttcgttttgccagtgattacggtcaaagatgcttttaccgaaccgaatctgcttcgtttaagagtgaaccaagattgaatctagtctggtttggcttgacctgttttatttcggttacgtctggttttctatcactaatttgaacgaaaatttgagaaatcttaatacgtttttgattaggtttctgttttctttgctagatatgaatgtagttactggattatactactctgttcaaatgaagggtacatatatttacatgaaccaaattatgaaataacaaaaccgactcactctagtctctaaacttaactagtgtcacttttgtttgtttgttttgatccatacttcaatgtatcttgttcaaattgtttgattttatttttggtataagtggctacattgtaatttcttgctgattcaatctataaatcgaaaaccttaaattatccatgcctcaaaacgatgcacgttgtgtataaatgagaattttaaattgtttagtttctataattgctgtcatgacgtgagatcatgcaaagcaattacgtacgataacgcacgtaaaggaaaaatgattatcagattcatatattttttttttcaaaaacttggtctcgtgtaacatcattcgtcattcttcatattcactatactataaccacaaaagatattaaaaaaatagtcactccactccacatctaatacaaagaagtaataatttaactattcaaaatttatgaagtgttaatacgataagattttcgacccaaggaaaaaaaacactataagatacataggtttggcagaacaattagttcgctcactgcctacatattctttttttggtttaattagcctacatatgggaaaatgatttgtattttgttaaatgccactcacatttgttataaataattagtcttggtttcaaaagccatatatttatgaatttatagacattgatatttatttttatggttggaaatggtataaagtattattgactatagtttttttatgtatttttcttatgaaataaagtgagaaaataataaaaatattaaaatttgtgtagctgactcgagtttgattgaagtctttggtatataaatattgtcgttatttcctccatttttctccctcttctcccaaataaaaaaagttactcagatctcacgatttgagcagaatacgcaatg

SEQ ID NO: 21720 - DNA, 3003 bp, Unknown; identical to SEQ ID NO: 21719
  misc_feature (1)..( 3003): 2750-1469P.txt file - cDNA_ID_2025342; gDNA_ID_1620801; Annot_ID_168649

SEQ ID NO: 21721 - DNA, 3003 bp, Unknown
  misc_feature (1)..( 3003): 2750-1469P.txt file - cDNA_ID_2025346; gDNA_ID_1620567; Annot_ID_160749
tacagctacaactaattcatttataccaaaaactctacaacaacaaaagctacgacaacagtcagcactaaaaaactacagctacaacccaaccaatcacctaaatagttgtttatcttcttggatcaattctgatcataacaatttatagtttacatatatttctgaattatttataaaacaagaaattttctaaaaaaaaaaaaaaaaaaaggaaccaaatattcgaatttaaaataatcgagaatatcgcatagtgatcaatatgaatatatgaaattgacttgtataatatgtaggattacaactgattatatacagaaacgaagagtaattatgctgagtaatgagtggaagaattacaaggatacgactcaattagaggaagctgaataagcaattcgtatatgtcaaacacaaatatggatcatctataccgttgcttgacttcatttgatatgctagttttggaattatattatgtaacacacagttcataagttttgcaggtaaataaaaatggtggagatctagagcttaacatcaagcaacatttgccattcttcataaagcagcagcatatgtatattgtatcagacgacccatgtaagagtcacatcatctagaaaagcaaagtaattgaaatttatgaagagtagaatagagagatacacattagcatatgtaatgtaatagtttaagtgacatttacatttgatgtaaaacagatttatttaatatatggaactttgattcagagtttcttttgaaatttgagttatatatatagagagagactattaatcagcatacaaacaatatataatttttaacagaaacaattaaagataaaaactatatacacgtcggtttacaaatgactcaaaagaataagatttacacgacagaacttaaccgatgttaagattactaaaaccgacgcaaacgtttcgacgtataagtaagcgtcatttcctaaagttaagttaattatattaacgtcatgcaatgttacgacggtttttaaaccgacgctattatgttaaagtcagtttgaaaatgacgttaaagtcaataatgaccgacgtcaaataccgtttctcttgtagcgatcataatttggaaagtgttgatcatataacaacatatacttggatattttttttaaaaaaagttagtgtcaaaacaaacatggatcataatttggaaagtgttgacttaagatgttacctttttttttgtgcaaaaagatgttacctatacagtataaatactgaacaagtttgattgaaatagttatcaacatatacttggatattttccaggattaaaaaaaaaaaaagtttagacgaattatgggttctcttgagacatgcttacttttctttgtaatggttatgtttatgagtgcaattatgtctcgagcctcgacgagtgtagtgatttataatgatcttggaggtggtttgccactacggcaccactgcaaatcaagagaggatgatcttggataccagagtttagcaccaggtagatcgtggtcgtttggatttacaccggatatttttggccggactttgttttactgtcgttttagttggggagctgagagtcatatatttgatatctacaaacagagtagagacaaagaatttcaagagtttggttgcaaaaaatgcgaatggaaaatacggaaaaatggaccttgcaagttttataagaagaccggcatgtttgatcattgctattcttgggattaatatccttattttataaaacatgtcgtaactatcaatctatgtctgtctacttcttcttctacctttttttttcttttttgtatgaggtaattgtgtcttaatatgatattttatggtttgacctacaattcgttttcttttttttttacttgttaatgacacaattatagtcaaataattttagagcgaagtaacaaaacattataagaatataatgtgaactacaatgagcttttcttttatgcttaacgttcattttttaacaaaaaaaaagaattataaataaatagagaacaagtgttgatcgaaagaacaactatgtaaattatacatttgtgcttaactaaacgcatatcgattagagtcccatttcatgaccccgaaactcaatgagtcaaacgtagtgcacaatctagtgtaatttaaaaccagaaaaaaaaaaaaactagtataattcgacataaccaaatggcatagttaaacgcatgttggtgaatggaggaaactaaacccgcgtgggaaggcttttctcgagtagtggaagtgaaatattatcttaaaacatatactttcaatgacataaattggtgaagatttactcccataagtgaaatgcattacatctagaaacttatctcttttatatttatttccgatttagcaaaagaagtaagtagaaagtctattgagtcaaacccaaattttaaaaaaaataatgcaaagaacttgcatataaatattttacattataatttgtattaaattttgatttagtaaacatatataacaaaattttcatctttcttttaataatatagtttttagtttgttagattttttttttttaatttgggcaacacaacagttgtgtaatagtataggcaaagaaaatggtcggacagctaagggaagatcgctctctcctcatcagacaaaaaattacaagcgagaatttctttgttcctttacgaccggacaagacacgtccgtcatcgtcttctactactttctatcttacgcctctccccttatcctacgccaaaacatcttatcctgcgcatcatcccttccattaagacctagggttttctctctctcccatcattctcttctcccgatctcatttccattacccaatcccgctccttttctctgattttgaatcgaacccttaatacccagaaatctcacggttccgaggagtgggtttttgggggttagggttttcgagagatgttgaatg

SEQ ID NO: 21722 - DNA, 3003 bp, Unknown
  misc_feature (1)..( 3003): 2750-1469P.txt file - cDNA_ID_2025381; gDNA_ID_1620655; Annot_ID_163625
ctgatgtcgaataaacctacataccgattgataaagttaaaccctgtgtcaaaaagtgacaggggaatgaatgtgcatttttttgcaaatacactaccttcacgatattgtctgcatatttcatcaccatcgacacagcaatgccacttcaaaacaaacaataaaagagtgttttggtgttagcttcactaacttacatcagagttaagaaaaaagtctggcctcttaagcagcttttacctgagagcatggttaagaatcatgagtaatgtgatgaaggagtaaccatggaagaatcccctgaaaatggaaaaccatcccattcaataccagaacagaagagtcataacagcataatacgcagttagtataatataatggaactataggacaccgaggatatagaggtgtagtactagtatgttctggcattttatagcaagtatgaaagaggatggtttttggatttacttatttgcaacggcatcaaaatcttggatcactatagcaacagcattgaaagccatcccaaagacatatagccagaagttctgtacatttatattccttgaaggtcgctttttaataatggcctgccaaaatggaaagcaaaacctttataagctttatatatcataagttaatttatcaatggaaggaaccaattatactgtattagtgttgacacacacacagagaaaagaaaccaaatcagctttgagtatttacagtatacagtcctaatatcccacctctgtgtacactccggcgaaaccacttaaaagagccatgacctagaaacaacgagtgattatattaattgatgtggacatgaaagctgcttcacaactcttagttgatattagcttgcaaagggggctaacagcttacaattgccatagtccagccaggaagagatgtctgaagaacacgatcagaactgcaaaagcaatttcaaatatgagacatatattggaaaaatcagcagagacctgaaagttcacagagcaggaaccggatatgagcttttgtgtgttacgcatcatatgcaagaatcgttaaagctcaatttaatagaattcatatgaaaatcaagggtaaagttttactttgaattcaactgagcagtggtgcatccgcaacacaatagaatgaaacccgcccactgaatctcgctcaatctgttagagaagatagtaagcaaagcagttcacacttgcaagaattgaaggaaactgaaacagctcactgatggatttccagaacaactattcattggaagctgttaaatccatttggatgattaaaaaaacctactttctcttcagtataattctgtacaagacaccggtacttatgatgttcaagttcttcaatatctgatagcctggggcgtctacatatgcaaaaatataatactgccacgtaaaaggtgacacaacaagtagttagagacatattaacatgaaaaacataagttaagaaaaatcgaccaaagccacagaaaaaaataacaaactcaggacaccccacctgtaacaaattcttaaaaagatacaatgctgcgggaattggaaagactttaacttcatcaaatgttgtgcttaacctgttatagagacaggatttgggtatcagtaacgaaaaattcagtgagctatctacggtcatgttcaaagaggaattagatataaaactcatggaaatttctctaaaactgataacaacagattgagtaacaaaataattcgctacctgttgtcgtcagtaacaccttcatttttccatatccttgtcaaagcaagaagagataacgcacatttcagagttcaacctgatgtccaccaaagagtaaacaaaatcactatatcatcatgattcagagattaaaaaccacacaaaactggcctcgcttgcaacacatacagtacactcaatttaatgcatctatgaaactcaccaaaaagttggcggttgtaacactatactcatacttcccagctcgtttcgaccacacgataagtatcgcttgagaactcgtcagaatcgtcagtgcacatgttactacacccctaattcaacacaagctatttaaagaacttgaattttccaaaaaaaaaatgaacaaaggaaaaaaacttactttcgtttccagttgatccgttcactggatccaacacccagagtagccattgcaatgttactcgaagcaactgtcaaatcaaagcaccaatgagcacattaaagaacacgagaagtggaatttgagaaaagaatatctcaccggtatgagattttcctttcacactctcgatatcagaagcaacgtcatgatcgtcctgaagaagctcggaacaaaattgagcattaaagagagtccaaatcttaaattaaaagcagcagaaagacaaagtgaaatggaagtaacgaacctcatctttgattttccggtactccattgtttcaagctctcagatctctgtgatctcttctccgaacatacacactcgatagctattaaaaaaagaaagaataaagtgcttaatttcgattttgggcttgaaatttattgggccttagtctaatacctgattaggcccgtctgggatatcttttttcttttttggatttttgtatgtgattgttcttttttctgtcaacataaatttgcttggctatggacattggacagattctgctacatttttctgatttttattataaaaaaatcaaagccaatgcaatttcaacagatttctgtactgggaaaataacctttaaaataaaattacaaagaatttttttaattaaatttgtattgtgacttgtgatggaaccctacctgaaaacaatgtttatctatattcactaaaaataaaattgttatatttccaatattataggtgcattcattcatacacaaaacaactaactatacaaatcaacaaataaacataacaatacaaattatttaatacaaaaacaaacagcaacaacaaaatg

SEQ ID NO: 21723 - DNA, 3000 bp, Unknown
  misc_feature (1)..( 3000): 2750-1469P.txt file - cDNA_ID_2025463; gDNA_ID_1621108; Annot_ID_171670
aaccctcttccctccactcggcttctttagttgttctgttttcgtagcgtaaactacgggtttcttcttctcactcttgtgaagaaattcttggtaaagatcgttgcttgcagcttctgttgctgtctttgaaggctcgtgactcgagctgtatcgtccggatttcgcaagaagagtaattacaattgcgtttccgatgaagaaaacgaatctcgggctaacgagaaacactgctgcttccttgaaaatgtccccagagatttttacagaagggaaagagagtttggagatcaagattacaagaagaagaagctcgaacagtctgaacaagctcgtgaacgatcttattgcttggaaattcaagattcctctggatttctccatcttcaagtgttgaaacttaattggatccatcaagatgaattcttgcaaaaagaaaaacacagaaaaaagcaagaaaaggagcttttttaagagatcgtggaagtgatttaggtcactcgaaagaagtgatatttacggaaacaaagtgagtagcagagagttttgtcatcaggagattaaacaaaggaagaagaacaatagtcatggtgaacaaggaccagtttgtatgtttcattaagaaaaacagaggattggggaatatgtatttgctccgttttgttatatctttttgtgtgttttttcttgggtttgtcttgtaggtgttggattgagttgcttacgcttattatatatagactatgaaaaatattcatgataataataaaaagtttattttaaattaaatcaattttattgcaataaaatgtagaaaattcaattctcccaagactttttattttggaaaaaaacatctaaataattgtgaacagcatttgctttcttttgtttttactttatccacaaaattattctcaatgctcccaaaagctgtcctagctattccttcatcgcccatgaggtaactcatgaccaatcacatcttcttcatattccctgatttgttttcatcatttattcgatcttcacttctacatatacgtgcatcttctagataaatctaaagacgctgttatgaaactaaattaatgtgaaagattaattgcataaatttatcggaagatttgtaatagtctttgtcgtgtttaggttaattatcattgtacaatttttacgtgctcaatttagactaatatttttgtttcaagaaagtgtgttttgtttaatccaaagatgaaataaaataacatatatgtaatcaaaacgttggcgtttacactttatagatgcgtgcaaaacaatacaagaagaagcagttacttaaaaaagccttctatgaaagtggagaatacaaatggaaactggcaagtgtaggatctttaacaaactaaataactaattaaaggtatatgcatgtaaagagttctttggcacaaaaaaaatatgtttcttaattcaagagtgacaagagtcctactatatatcccatgatcacttacgatgaatacatacgtcgtcaaattacgtacacatgatctaacaagatctctatgtctaacaacgtacacatgcaactgtaaaaacgacatagatatgaacaggcgttgtcgacagaaagttttggtcgataagaaaaggaaattaacagtcataaccttattttctttttatcccattttgatactcttttggaaagggaaattaaaaaaaaagaaagcgcaaactgaaaggccacaattaaattaaccccccaaaaaatctgaaaggccattatggatgggatttggatgtaagaagctctttttttcagtctttagtttgaaaattttaagttaatttgatgatctaataaatttctaactcctaaactctcaaacccaaaactaaagtaaaaatcctgtctatttgaagcctataacttgtttatgagaatctgagatacatgttttaaaactatgaaaaaacattagaatgtacattccacaaattatacagatatatattgccaatagatttataagattatcttctagcagaaagcccatttgtaaatgtggaacacttaatgagactgatttccttcttcactaagacaagctcaacattatacacttttctgtccttttttttggtgtctctctttaataatttatggactttaactttgcttttccgaaatatgaaagaccccatcttgtaaatagaatgcaattaacttctctttttgatagtttttgagtcacctattaaactttccgttatggacatgattgatctataaaagaaattttcaaattatgtggtggctggctaagttgataaaactctcccatttctttagattatccatttgtttcgtagactttgtatcatccaaaattttctctcctttattcagaattctggcgcttatgaaacttttcttgaacacaattttaaatgtaaaaaggtgaaattaatatacgtatggacccctcggaaagaaaaaggtcatatacatatggtccttgagcaagtagctttgatttgattctggaatatatggctctaccgctctagtctagtgatacacatcatatttacatattagtcgcttaattcattgttgacttactcgatccattgtcatgaaggatttctaagtttgatatgtcttcttctaagggatttgattggttggggacttgggactgtgactatctgcttgagttctatctcttcttgtgtaactaacccaagtaacaagcccagttcaacattattattgttcgatccaaactaggcctaatctgaacagaacaaaagtatataatttgagacgttattaaactatttattaataattaaaataaattcccgtcatcaaaaaaagtaataaagtaaagtatttcgccgtgagagaaagaacaatcaccatcgtctagggtttcaattcattgttccagtacttcatcgtagcgccgctcctctcttgtccagactccagaagattcaatg

SEQ ID NO: 21724 - DNA, 3000 bp, Unknown; identical to SEQ ID NO: 21723
  misc_feature (1)..( 3000): 2750-1469P.txt file - cDNA_ID_2025463; gDNA_ID_2926207; Annot_ID_202326

SEQ ID NO: 21725 - DNA, 3000 bp, Unknown; identical to SEQ ID NO: 2125
  misc_feature (1)..( 3000): 2750-1469P.txt file - cDNA_ID_2025487; gDNA_ID_1620491; Annot_ID_158618

SEQ ID NO: 21726 - DNA, 3000 bp, Unknown; identical to SEQ ID NO: 2248
  misc_feature (1)..( 3000): 2750-1469P.txt file - cDNA_ID_2025511; gDNA_ID_1620511; Annot_ID_159122

SEQ ID NO: 21727 - DNA, 3000 bp, Unknown; identical to SEQ ID NO: 7287
  misc_feature (1)..( 3000): 2750-1469P.txt file - cDNA_ID_2025553; gDNA_ID_1621137; Annot_ID_172717

SEQ ID NO: 21728 - DNA, 327 bp, Unknown; identical to SEQ ID NO: 341
  misc_feature (1)..( 327): 2750-1469P.txt file - cDNA_ID_2025553; gDNA_ID_1564117; Annot_ID_148882

SEQ ID NO: 21729 - DNA, 2584 bp, Unknown; identical to SEQ ID NO: 2615
  misc_feature (1)..( 2584): 2750-1469P.txt file - cDNA_ID_2025601; gDNA_ID_1620566; Annot_ID_160701

SEQ ID NO: 21730 - DNA, 3003 bp, Unknown
  misc_feature (1)..( 3003): 2750-1469P.txt file - cDNA_ID_2025614; gDNA_ID_1620320; Annot_ID_153303
aacttaagtgacaactaaacatcatgaatattcaggaaatcctgaaaatttaaacagaattatagtaatttctgaaaaactcaagaaattatggaataaaaagaaaaaagaaaaaactatggacacttttaaattactcaaactagtttaaggcttttggaaatttcactttttgcttttttttaactcgagaaaattacaattttatgtagacacattttgctcacaaatgtttatttatatattttccataaatttatttttcagccttttatctacaaaaatttatcttctaagaatgtttttaccaccaaaaataataaatataaaccacaaaaataaaattatatattttatatatatatatatatatatatatatataacaatttttatctatgatatctggcagtcgcagttggcttaagccgcctggccgcctctggagggaccaaaataattcaaatggtaattacgtgccttggcttccaaccaacgtttttgactagggctgactcggtagcttgttatgttagtataagagttaactccatctgatactcagctgaataaactcatacgtacaaaggaatattatctaaaagacgagagtacaagtgagaaatggcgttaaaggtgatcaagatctcccgagtcagccctgcaaccgcctccgtcgacccgctcattgtcccactctcgttctttgatttacagtggcttaaactcaaccctaccgagcaagtcttcttttacaaactcaccgaatcatcatcatctcgcgacgttttctactcctccatcctccccaagctcgagcgatctctttcactcatcctcactcactttcgcctattcacgggtcaccttaagtgggattcacaagatccaaagccgcatttagttgttctctcaggagacacactctctctcacagtggctgagactgatgcggatttctcacgtatctctggcagagggcttcgtccagagctagagttacgccctctaatacccgagctaccgatttattctgactcgggggctgttgtatctctgcaagtcactttgttcccgaaacaaggcttctgcattggaaccacagcccaccatgtcgtcttggacggcaaaacggctgaaaaatttaacaaagcatgggctcacacttgtaaacatggcaccataccgaaaattctaccaacggttttagatcgttctgtcgtcaatgttccagccggacttgaacaaaagatgctcgaacttctgccgtatcttacggaggacgacaaagagaacggaagaaccctaaagctacctccagtcaaagagattaacgctaaagacaacgtcctccgaatcaccatcgagataagtcctgaaaacattgagaaactcaaggagagagccaagaaagagtcaacacgcgctgagcttcacttgtcaacgttcgtagtcacgttcgcccatgtgtggacatgcatggtgaaggcacgtagtggtgacccaaaccgaccggttcgtttcatgtacgctgctgattttaggaaccggttagaaccaccagtccctgtgacatacttcgggacttgtgtcttagccatggatttctataaatacaaagctaaggagtttatgggagaagatggatttgtcaacaccgtcgagattctcagtgattcggtcaaacgtttggcttcacaaggggtagagtcaacttggaaagtgtatgaggaaggaacaaagacaatgaaatggggtacacagttgttggtcgtaaacgggtcgaaccagattgggatgtacgaaacggacttcgggtggggaagacccattcacactgagacaatgtctatctacaagaacgatgagttctctatgtccaagaggagagatggtatcggtggcgtcgagattggcatctctttgaagaaacttgagatggatacttttctgtctttattttacaaatggattggaaactgaaaacgtacggtcttaatcgatcccagcttttgcttatttgtatttttatttctagttcaataattgccctatatgtactacgcaaatttgtattgattctgtcttttgaattctattttttggggtacaataatcatccatatttgaaatattagtagacttttcatgatcagtgaatctatttccccctactttgaaaaatcgaaactttgatttcagaaaaaaaaagctgtgatacgcagtggcggaggtacagcttcaggaggggggtcacttgaccccatgacttttacaaaaaaaaatttaatagcttaattatttggtatttagtatataatttgggttcaaatattaaattgacccccttactcgaaattcaaatcctatttttgccccactcaattaccatattttgtgtaaatcaatctcattattcttcttctattaatttcctgaaccctatattaaattttggtaactggttttattattcccctaaaaatacatgaatttagatagacaaaacaattaaataatgtgggtactaatctttacatttagataaacaaaaaacaattttagtaacaaaaaagatgtatatcatttttcaccagatttttagtaaacttttaaatagaaaaatgatgaataacatatgactactcgtgtattttccacaaagaattttttttcggaaaaacaacaataatttacgaaattgtgatattattttttgttctatttttttatctataaaaaatttttttttaaaaaaaatccttgttttaattttctcagaaacgtgggaccacaatattttccaaagggttcagagtttagcgggccgaatatatgtcataggcccataggctaaaacaataagggtagttatgtaaaatccgctcacacacactcctcaaaagccctaatcgtttatcataattcctcaatcccgtcttcaagtatcgccgacgccgcagcacaaaggaggagaagaaggatcaaaggcgcgacaacaatg

SEQ ID NO: 21731 - DNA, 3000 bp, Unknown
  misc_feature (1)..( 3000): 2750-1469P.txt file - cDNA_ID_2025627; gDNA_ID_1620635; Annot_ID_47335
ttgggaggagaaacaatcgttcgggatgttgatcagattcattttgtcgttgagcatatatacttcaacctcattgaaggtaatagatgaatcattaggatgcattccatccaagtcaacggatatcatgtaataattaattacaataatgagtctatctatatatgtgtgttttcagtacataaactttacatcttctttttctttttaggatcactcacccataaaactttaattcatatgagctgtccgtatatatacggtcccccggttagtaaaggatttaatgtttaaattttattttgtatcaaatactatttactaatgcaatttatcatttatatttatttttctatctcattacccgagagattactctcaaatttgtggtagacgtgtaagttttatttacaacattttattattatttgttgttttatgttaacttaatactttctcttttcgttttctattttctagtcatatggaaaggatgatatttacaaatgccaaagtggcagcagcggtagcaaattatttgcccgatgtgctttttatttcacttcggaggactatctctccatttcgtcacattaagtacgttttgtttcgtaaattacttatcaattaaatttatatattaatttgtttacaatattcttggaatgcctttactcagagatatcatacgatatttgattttgggcaccgccaaatcggattttctctcgccacttccaattacgacgacctggaccacgaagacgacgtagacaacgaggacgacgaggacagtgtggacgacgtggaaagactcgttcactcatcaacattaagctttgtttttttcggtaagaactaattaagcttttatttttttctttgataatgagaactaattaagcttttaagacctttcatgagtgtgtaatattttatgaaatatctttataagatttaactgctattttttgtgtttgcgtttttatgcatttgacgttaatcacataaattgtttgtacggtttcgtaacatttcaaaatgcttaacattagaatcttgtttcatcgatcttttattatagtaacaagcgattgttttttttgttttgagtacatttgaaagtaacggaaacttagtaaaacgaattcacgaagagaaaatgaaaagtgattaagtcatctcctcaacaagcgattgttataaagtaataaaattatttagatgaattggttgttttaaaataaaaggttgaaaatgttgaataactatttattttatttttacgatttgaaatgaataggttggaaaattgattcaactcattcaacaaaaaaaaaagaaaaatgaacaaattataaaagaaacttgttcaaccatttcatctactcttttgtagatgaatgagttgaataatgttcaacttggttttgctgaaaatggttgcatagagatgaaataattggaaattttgagttgaaaaataaaagttgaatattattcaactcatttctctgtgaaatagaagatatacaagttgaaaaaatttctttataattagtttatttttccaactttttaagttgaaagggttgaatcatttttccaacttattcatcttaaatggtaaaaaaaatagataaatgctcattcaactctttcaacttcttaattttaggcaaccatttgcacctatttttccaatcattcaactatatgtcattcatttggagcaattatatttcttaaatctatatatttatttttatttctgctataattcaaactgtcaaaccattaccaataagatgtggagctaattcaacataagtatataaagtatatgaaatgtatagatctttccacttattttcaaatgattaaaattgtacatggtgttagagcccgaacaaacccaagataaatgagcataaagatgatctcacttctaaaaccatttttgaaccaccatttctactgcattgccatttttcttaccgccttttttttttattttgattttcataaccgctaaaaaacttttcaccacatcattatattatttggtccaaccaaaccaatggtccaagatggtgccttttttttttgggctcaaagatacaaatcctctcttttgatttcttctctcagcccatgacgtgtaatgaatgaagaaaaaatcaataacttacatcacaatcatatatcaatttcatgaatccttgaaaccaaatacataccataccgacctctgtttaaaagacttatcttttctccaacaaatgcgacaaaaccgtgtggacgaatcagagagacacatgtataccaatgccgacttctttttatgcaatcgtagcgtctctctcacgtggtaaacgcgtcgccatttttataatacgaccacgtttgtgactccattaatggcggtctcatgctccctcaattcttcatgatctaactactaagagatctgattcactttcttcacactctccgagtctcatcttcgcttcttccctagctcttatctggttagttcctctctttctctctctctggttagctaattttgctttgttcagatttacagagattttgcttatctagctttgaatcagtcttgggaacatagacaaaatcagaattcgacctttcaaattaatgggtctgattgggtttatcgagttcatcacccgttttcccagtcatctataaagtttgagtttttaattcggttatatactctgttttgatacggagatatctaattgctccaaccatttagctttctagatctcatgagatgtttgcttttcattgtacagtttaaattaatgttaagctaaagagtgaattttgatgtggagctatttggctgaatataatgctgaaacatttgtgaagatttagatgtttgattgattagaattcttgtgcaaagtctgatggcttcttgatgctaaagagttatgtgtattaattttgatgcaggacacaatg

SEQ ID NO: 21732 - DNA, 3000 bp, Unknown; identical to SEQ ID NO: 21731
  misc_feature (1)..( 3000): 2750-1469P.txt file - cDNA_ID_2025627; gDNA_ID_1620640; Annot_ID_47475

SEQ ID NO: 21733 - DNA, 3000 bp, Unknown; identical to SEQ ID NO: 21731
  misc_feature (1)..( 3000): 2750-1469P.txt file - cDNA_ID_2025627; gDNA_ID_1620635; Annot_ID_162846

SEQ ID NO: 21734 - DNA, 3000 bp, Unknown; identical to SEQ ID NO: 21731
  misc_feature (1)..( 3000): 2750-1469P.txt file - cDNA_ID_2025627; gDNA_ID_1620640; Annot_ID_163031

SEQ ID NO: 21735 - DNA, 3000 bp, Unknown; identical to SEQ ID NO: 21731
  misc_feature (1)..( 3000): 2750-1469P.txt file - cDNA_ID_2025627; gDNA_ID_2926178; Annot_ID_140430

SEQ ID NO: 21736 - DNA, 3000 bp, Unknown; identical to SEQ ID NO: 21731
  misc_feature (1)..( 3000): 2750-1469P.txt file - cDNA_ID_2025627; gDNA_ID_2926178; Annot_ID_200001

SEQ ID NO: 21737 - DNA, 1563 bp, Unknown; identical to SEQ ID NO: 2296
  misc_feature (1)..( 1563): 2750-1469P.txt file - cDNA_ID_2025638; gDNA_ID_1620516; Annot_ID_159269

SEQ ID NO: 21738 - DNA, 3003 bp, Unknown
  misc_feature (1)..( 3003): 2750-1469P.txt file - cDNA_ID_2025646; gDNA_ID_2936567; Annot_ID_194648
gaaccattctgctttcgtattgcaatctggacaggttggtagcttctgtttcacttaaaacctatcctgtgagtatattgtcgtttgccataatcactcatatttgaaatccggcacaggttctcacttgtggggataattcatcgcattgctgtggtcatttagatactagccgtccaatatttaggcctaagcttgttgaggctttgaaggggactccttgtaagcaggtagaattgataccaaccctatctagacctattgattttctaaattggttctatcaaacattgacaaacttatcttctataccaggtggctgctgggcttcactttactgtgtttctatcaagggaagggcatgcatatacttgtggatcaaatacacatgggcagcttggtcatggagataccttggacagaccagtacccaaagttgttgagtttcttaaaaccattggccctgtggtgcaaattgcagctggacccagctatgttttagctgtaacacaggatggctcggtttactcgtttggctctggttctaacttctgtcttggtcatggagagcaacaggacgagctccagccgcgtgttattcaggcttttaaaagaaaaggtattcacatactccgtgtctctgcaggcgatgagcacgccgtggcacttgattccaatggccgtgtaagttctttgtttctatctcgttctgtctccatttggtctcagaaaccaaaagaactcttgttttaataattctttcttgcaacttaggtctacacatggggtaaaggttactgtggtgctctaggccatggagacgaaaacgacaagatcactcctcaagttttggtcaatctcaacaattgccttgctgtccaggttagattcgtcccccatctgtaccatctcaatgtctgagataatgatccctttacaccttgttcctatattctctaagaccttcagcggtctctaagaactaataagtgatcagttcaattagaatcaaaacttagcacaagtattttagtttagaggattttcagtataacattcagtttatttttcggttttggtaaagaaaaccgaagctggatgtgttggcctttgtttgtatggagttttgctccgtttaggatcagttagtcagccctgatcatgactctgcttttacttgcaggtgtgtgcaagaaaaaggaagacttttgttttggtggaaggtggattactatatggatttgggtggatggggtttggaagccttgggttcccggacagaggagtttcagacaaagttcttaggccaagagtattggagtgtctgaaaccacaccgtgtctctcaagttagcaccggtttgtatcacaccattgtggtcactcaacgtggtcgcatttttgggtttggagataacgaaagagctcagcttggtcacgactcactccgtggctgcttagaacctaccgaaatctttctccattgtggccgttctcgtagccggctttgttgatccaaggtatagataaacaaccatgtttgtatgaaccggattgagattggatttaccggttagtgtatcttgtattgatttgtatctgtttgatttcttcaagttgtgagagtaatagaagatatttccagacaccttagtgcagagaattatgacatgagttaattaatctaagaagttttacaacttcaactacataataacaaataccttaactcttggtgatagtagatccactcaagacttagcaaaatatcttagtctttagaacattatagaatgtaaaagtaaaaaactgaaaacaacctagaagcaaatgaaggaatcattgtaacgaccaagatgcaaaagaataataaatcactcaacatcgatctcatcatcttcaggaaacatgtgtgcaacaacttcaatctttacttttatcttctccaatttctccagaggtgaattcaatatgctttgaatttcttcagcaaatgttttcatgatccctagatacggaggaacaccaacatcattgaggatttcgtagattgtggctttgatttgttcttcatcttgaccaatgaactcgtctcgaccatatctttgaagttgatttgtagtccttgttttaaccttactggacatgtagtcagattctccatcactatttggctcaggcacttttgtgtagacaacttcaaaatcaaacaaaaaagtctgacgatcttgagttgtttctttcgaataatagattggcgtcaccatacatgtactatccgatacatcatccacaatacactccataatctctatgcaatgatgggaaaaaaagaagttaagagagagttaggtttttcaagctatgagagtgtataaaaaatatttgtgtgaaaggaaaattgtaaccaggaatgagtaattgttgggattgaatacgagattttaggaaatagttacaataggaattcttcattaaattagattgatcataactacaaaagttaacattcatacatatcgttaaggttcgatgaaccataaatagatattccgatatttaaaatatcttatatgattgtattaataaaatatctcatatattcaaaatcatatttcacttaactatttcgctgtcaaaaaatatcctaccacttttccaacatgacaaaaaaaaaacatactacttttctatcgtggcacgtttaaaaaatcatatcattccaaaaagatttactcgtcagattaaatatctaatcatcattggattcacaatttgtttatttacctaccagacactttaaaaaaaaagattaactacagaataattttgtctaaaaagaaacggataagaacacgtaagacatgtcagtcttatcttaaaatccaagtcagcatctcgtgtaataataatctcgtacctttataaaacccctcattgtcttcaacaaaaacataacacatttcaagcattggattaatcaaagacaaagaaaacgaaaatg

SEQ ID NO: 21739 - DNA, 3003 bp, Unknown; identical to SEQ ID NO: 21738
  misc_feature (1)..( 3003): 2750-1469P.txt file - cDNA_ID_2025646; gDNA_ID_1620500; Annot_ID_158841

SEQ ID NO: 21740 - DNA, 3003 bp, Unknown; identical to SEQ ID NO: 21738
  misc_feature (1)..( 3003): 2750-1469P.txt file - cDNA_ID_2025646; gDNA_ID_2936567; Annot_ID_143719

SEQ ID NO: 21741 - DNA, 3000 bp, Unknown; identical to SEQ ID NO: 8751
  misc_feature (1)..( 3000): 2750-1469P.txt file - cDNA_ID_2026192; gDNA_ID_1971875; Annot_ID_176686

SEQ ID NO: 21742 - DNA, 2686 bp, Unknown; identical to SEQ ID NO: 253
  misc_feature (1)..( 2686): 2750-1469P.txt file - cDNA_ID_2026192; gDNA_ID_77261; Annot_ID_147167
  misc_feature (86)..(86): n is a, c, g, or t

SEQ ID NO: 21743 - DNA, 1814 bp, Unknown; identical to SEQ ID NO: 90
  misc_feature (1)..( 1814): 2750-1469P.txt file - cDNA_ID_2026252; gDNA_ID_2404; Annot_ID_145701

SEQ ID NO: 21744 - DNA, 1144 bp, Unknown
  misc_feature (1)..( 1144): 2750-1469P.txt file - cDNA_ID_2026339; gDNA_ID_1590999; Annot_ID_150387
aaacaaaacaagtgttgaaatgataactcccaaatttgaacttactttcctagcaaataagaaattgttttaattaaaaaaaaaaagcatatgcagtctcaaattgtttctaagaagtattcacgcaccaaggttatatttgtagtgacatattctacaattatcacatttttctcttatgtttcgtagtcgcagatggtcaatcttttctataataatttgtccttgaacacaccaaactttagaaacgatgatatataccgtattgtcacgctcacaatgaaacaaacgcgatgaatcatcatcaccagctaaaagcctaaaacaccatcttagttttcactcagataaaaagattatttgtttccaacttttctattgaattgattagcagtgatgacgtaattagttgtgatggcagtgatgacgtaattagtgatagtttatagtaaaacaaatggaaatggtaataaatttacacaacaaaatatggtaaaaatctataaaataagaggttaagagatctcatgttatattaaatgattgaaagaaaaaaaactattggttgatttccatatgtaatagtaagttgtgatgaaagtgatgacgtaattagttgtatttatagtaaaacaaattaaaatggtaaggtaaatttccacaacaaaacttggtaaaaatctttaaaaaagaaaaaagaggtttagagatcgcatgcgtgtcatcaaaggttctttttcactttaggtctgagtagtgttagactttgattggtgcacgtaagtgtttcgtatcgcgatttaggagaagtacgttttacacgtggacacaatcaacggtcaagatttcgtcgtccagatagaggagcgatacgtcacgccattcaacaatctcctcttcttcattccttcattttgattttgagtttttgatctgcccgttcgaaagtctcggtcatctgcccgtaaatataaagatgattatatttatttatatcttctggtgaaagaagctaatataaagcttccatggctaatcttgtttaagcttctcttcttcttctctctcctgtgtctcgttcactagttttttttcgggggagagtgatggagtgtgtttgttgaatagttttgacgatcacatg

SEQ ID NO: 21745 - DNA, 172 bp, Unknown
  misc_feature (1)..( 172): 2750-1469P.txt file - cDNA_ID_2026392; gDNA_ID_1591528; Annot_ID_151117
ttaacttcaatgaaatcaatgtttaacaaaaaaaaaacatttaagaaaggataaaggatccaacagtaaattgcacacgacagccaaacggatcccagtcggggctccgacaaagttttaatggtttcttaagaaaaatcaaaagccgtttgctttttttgaaatttccatg

SEQ ID NO: 21746 - DNA, 3003 bp, Unknown
  misc_feature (1)..( 3003): 2750-1469P.txt file - cDNA_ID_2026392; gDNA_ID_2684232; Annot_ID_192301
agaagggttttgaaactttgaatgatatgtatgaaatttgtctgagctctaaggtctcattctcctaggagttataatatgtggcttttgacttttgttatgaaagctgagaagcaaagattataaaaaaaaatgagtgtagcaaaaaaagagagaagtgtgttagttttgtagagaatgatatgatattttccccaaatttggtaacttatgacgattgatgatatttctgacatttttagattttgctttttttgacaccaatcttatttccaaatttttttctctatcaaattattatttttcaaaaaaatcataatactatgagtttgatgatttcaaattcacattcgctggacatgtgccacaaatgaagttagtgcttcctagagaattgtgctctcctcaagaaactcactctacatttggattctcattcaacaaaagatgaagtcgagaaactcctcaaaatcccaagagcctctaccaaatgtgaggttgtcttttatgaatcagtttgatgtaagaagttcttgctacacaggaaatgcatgtctagattttgaaggtacttttgtaagaaatcatgttttctatgcaatcaagtttattactctcttgcttagaccatgtacataggtgatttattttgggtatcagtagcccaaaaattatattttaatagatcaaaccatgtatttgggcctgatccgtataattgtactgatacctttgatacttagtatcaggtgatgtggcagcacacgattggtcagcgtttttgctcaaatcagagaaagaaaaaaaaaatcttttgtaatcctatgttttaatatattactttttgattttgcaaatttttttttttatatatttaaaccgatctcaccaatgcaaacacattttgtaggagtatcataaaaatctcaaacaataaacaaacattataaatagtactaaaaaattctttatgatactaggatcaattatgggattggcacaataaagtgtggtattgtaaaattggggcctttctcaaatgcttatgggattaggcacttctaaataatcaaaatacggatttaaccttttattactttgtttactttcaaaccaaagagatatgaagatcccgagaagcttggattgatggtgaaatgagaaaccagagatgaagaagatgatcgaaaggcttatcattattaggatttgaaatgattttgttgtttgaatcgaagtttgtgtttgatttgagaagaattaatggtggtggtggatgaaggggagatgaaattatgggttgacgacatgatggactacggtggcgatggtgagccggtagcaccgccgtacaaatacttgtgtatatacgcacatatctacacatatagaaggtgaagattgggtttgagtggatttgcatgatccgatgttcagaaactcatcatcaccatcaaaaactcatcatcacaatttggttattctctaaagttgaaacatttgggttccttatgcagtatctttttagggtttagttttcttacatcaaaaaccaattaattgtttattgggttcatcagacagtcgttggtggcggagggattgttggtggcggaaggatcgtgaagtcgaaagaagaagaaaagatgtgttgatggagctaaattacaggggtaaattagtcaatctcattcacagaaaatgctttatcctgttagccctttatgaaaatgctcaatccctaatttttgggccataaagtacccatatatgtaatagcccctatgatactatatgagtatcacccatatacatgctcttatatttttaaaatttaattctcttgagaaggttttcactcttttcttatcttccttaaacatgtataaacagtaagtactaaatataaataagatattgaaaacacaagcattcttaaaccaaacatagaaatcatgtgtcgcatttgttccaatatatttaagggcaaccgagattagatgttagtatcgcaactttagaacattttgatctaaagttgactttacgctttccatattctacgcttactctttttctatgggtgtacaatgttggctatcgacaagagaagtgaagaagacaaggcatttagcagtccctcaaatttgcaatacaaaaaaaatgatgggttttggggaaaatgcaaaagtcatcgtgtatgttgaataatatataatttttgtatttttttagcttgtagaaattgaattttgctaggttaagcagcattgtcacttgtaaattaattattttagagcaaactcattagttttagtgaaattaaaaaaaatgtgaaaaatgaggttattagaataaataaatcgaggattacaccaacaaataagtattactatttatttatcccaaaaaaaaaacaatcatttatatgttttccaaattagccaaagaagtctttcaagccaataactcttatgtttcatgcaaatcctccatgaggatcaaattagggactgttcttgatttgccattttggcgcccaaattttttggatttactatttacttcaaagatattatatttgtcattttggtcacttaaaaactatacatttgagaatattttttatatacaatatatacttaataacaaacactaaatcccaaaagaaatggaacaaaataaactcaaacataatatgtaaaattattttttagatataagaaaataacaaaatgtaaaatatttaaggtaaaatgacaaaatcctcaaatgcaaaataaaataaaataattcgtattgattcatcacattatgtcttcagtttctatttaacttcaatgaaatcaatgtttaacaaaaaaaaaacatttaagaaaggataaaggatccaacagtaaattgcacacgacagccaaacggatcccagtcggggctccgacaaagttttaatggtttcttaagaaaaatcaaaagccgtttgctttttttgaaatttccatg

SEQ ID NO: 21747 - DNA, 3003 bp, Unknown; identical to SEQ ID NO: 21746
  misc_feature (1)..( 3003): 2750-1469P.txt file - cDNA_ID_2026392; gDNA_ID_2684232; Annot_ID_137639

SEQ ID NO: 21748 - DNA, 71 bp, Unknown; identical to SEQ ID NO: 206
  misc_feature (1)..( 71): 2750-1469P.txt file - cDNA_ID_2026504; gDNA_ID_28591; Annot_ID_146703

SEQ ID NO: 21749 - DNA, 836 bp, Unknown; identical to SEQ ID NO: 182
  misc_feature (1)..( 836): 2750-1469P.txt file - cDNA_ID_2026537; gDNA_ID_24979; Annot_ID_146470

SEQ ID NO: 21750 - DNA, 1245 bp, Unknown; identical to SEQ ID NO: 439
  misc_feature (1)..( 1245): 2750-1469P.txt file - cDNA_ID_2026674; gDNA_ID_1590997; Annot_ID_150380

SEQ ID NO: 21751 - DNA, 3000 bp, Unknown; identical to SEQ ID NO: 661
  misc_feature (1)..( 3000): 2750-1469P.txt file - cDNA_ID_2026708; gDNA_ID_1620304; Annot_ID_152770

SEQ ID NO: 21752 - DNA, 3000 bp, Unknown; identical to SEQ ID NO: 10974
  misc_feature (1)..( 3000): 2750-1469P.txt file - cDNA_ID_2026721; gDNA_ID_2214468; Annot_ID_182910

SEQ ID NO: 21753 - DNA, 3003 bp, Unknown
  misc_feature (1)..( 3003): 2750-1469P.txt file - cDNA_ID_2026721; gDNA_ID_1972067; Annot_ID_178414
atgtacataagaaatcacaattacataagataccagtcgaaaaaacattaatattgtgtagcgtttcgaaaatatactctgtttgaaactttgaatataagcgggttttcactgtaagatgttaaatttagaaggatttttttttaaatctatcgtaatattaatgacagcaataaattgggttatcaaaaatgctaatggcgtttaaaagtttttaggtgttaatttggtaggagatgtatcagttgcgtgtcctacgtgtaattgtgaaagcaacaacgcaaagaaaatgaagccttgatgaaaatatatgtttaaaacaaaattaattgacggaaatagtatgttttaaattaatgttctaattgtacaatagaaaaagcatgtacatgtacaaaactcagttatattgtaatcaaatttattgatctgtaattcatgcttgtttatgacttttttgaccggccgatagagcggcggacgcaactttgggatctgaagatattaaaagaaaatgttcctaaagaattctaatatcgaagttgattctcatcgtttcttactttatttctttatgatctcaaaatcatcaccctttagaaaatttgtttcatgaccagaaaatatgcaagtgttaacatgttttaatttagactgttttcaaaatttacagttgttatttagtaaaatttagcaatgaatacaaacaaaacgatacaccaaattaatgtttgtagtatttactatttagtaaatgcatggtactgtggtagactcgctaagtaaattgcatgtgttacattttaatatgtaaccagtaacctcatgcatgtgtatctctttcaagtttcaacaacctttttgttttttagaagtaaaaacttaaaattctttaattggcggacagaaagataaggcgattactcaccagaccaacaaaattaaatggaaattaaatacatatagagtaattaaatggctctgtgaccaaaacatggaattaatgggcgttattcattagaccagtaaaattgactggaaattaaatatatatagtaatgatacgatggtcctgcgacgaaggaggagccatgtctacgcaactcatccaataagcaacacaagctattcttttttacttctttcatgattgtcagtttcttctttcatttattctatcattgcttgagatatgtattctttaatagaagttaaatagtgtgtacatataccatgttgtcactttttaacaaacaaaaagtcatatggtatcatcatcatgtcgcatgaagaggagctacaacatttcttgattcatgcgttacgtggtctaacaaagggaatgtgatgaattgtcgctctgggagtaatttcgaaacgaaagttttcttacctaaaactctttattaattatctgagtttctgtagagagaaatagcatcaatttaaagcttgaaaagtttaacacatctttgacaaaacaaatttaggaagaccaaaaccaaaataattactatttctctctatctgttttcagtggggggacgaaagacctttctttctttttggtaatgggccgggccgggccggtttaatccaaggcaaatggcaagatccgtagagttttacatacaaactttactctagtgtaaacaagaaagtcagaaaccgcatgcgttatagttagtgaaaggttcgatttctgtcaggtcttcgcatccgtcacgtttgctatctcgaacttcagggagcatattacaaacgtaaaagaaattgatatattacgctaattaatttattcccgttgttgtcaagaaactaatgtcttaattagccttttaggttaaaccctaatttttgtcgatttaagttttgaaaaacgaattttgattgtttggattttggtaaaaggagatcagagttcatcgctggtaccatgttggttaactggctcgccgggagacccagcaataagttttatgctctccaaaagtcaatagacgagctacacaaggtattatcatatatattggcaattgatgtttttaagttcctatttatttttctgtgacattgaatctattttcaaaagcacccaataatgtggttctcattctttttttctgatcactaatgtgtgttcacctcaagacgctcgagtctcttgaacaaaaagaaaaggtttctctgctgccgtacagtacaaggaagcgaaaacatgttacctggcaggttacaaaacatgttacctggcaggttacaaaacaagtatgaaacatcttttgattttgaagcacgaaaaagtaaaatatcttattatcttttatggatcaatttaaaacatgtgtgttgaatcttgtcatgcaggtgctaaactttgtttgaaagagaagaggattcacgagcgaacagctcaatataataggaattgtcagcttctcttacatgaagctgtgagttttttctttttctttttgtgtcttactaaattatttttttattaactactttttaagcgatgaattgaatttattgtcactatttttctttcttcttaattatacagctgattttgtgtgaaagtagaaaagaacaaatgattgaagctatgcgggatggagattttactacgcagaagacaatgcaagtttttatttatctttgtttgttccttttaatcttaacttatttgtatcaatctaactcatgtattatcctacgtctatctagactgatcggacggacataatgtgtatccatatttcttggctacgcgtgtccaccttttagagactatgcctttaggtagtagatgttttactacaaaataaacatatttagtcaaataaaataaaatttgagagaatcttctacataagtagctcacagacccaaccaaaggaccattgaataccatatatatatagatacacagacatataaacacacaaatattcgtgtttttttcaaactgtgagagaaaaagaaagagagaaagagatg

SEQ ID NO: 21754 - DNA, 3000 bp, Unknown; identical to SEQ ID NO: 9056
  misc_feature (1)..( 3000): 2750-1469P.txt file - cDNA_ID_2026743; gDNA_ID_1972047; Annot_ID_178244

SEQ ID NO: 21755 - DNA, 3000 bp, Unknown; identical to SEQ ID NO: 9056
  misc_feature (1)..( 3000): 2750-1469P.txt file - cDNA_ID_2026743; gDNA_ID_1971974; Annot_ID_177583

SEQ ID NO: 21756 - DNA, 3003 bp, Unknown
  misc_feature (1)..( 3003): 2750-1469P.txt file - cDNA_ID_2026764; gDNA_ID_1620549; Annot_ID_160255
tctaaacgaaagtgtatgatttattatgttgtttttgttaatttgaaaagtatgaatctattggcttatgcaagtatgggatatgtattaggtgcacagacttgacagagactgtagtggacttttggtgttggcaagaacacagacggctgcaacagttcttcattccatattccgagagaaaacaactggtgcatccgcatatgtaaatcctctgctttctctccgatctttccattgcttgtcatggatcgtgggaaataaacataagtttctcttccaatgacttttattttacttggcagggtgtcaaaaagaacgtaaaatccttgaaaagaaaatatatggcacttgtgatcgggtgtccaccacgtcaaaggggacagatttcagcgccactcagaaaggtcttcacactctgttttagctagagagttttatccatctgagtttttagtctattttgttttatctaggagttgctttgtttgttcgaattcggtcattgcttttgctgctttactggagtcaaatttgaaggtaaaatatatgttaaatatctgggtaggtggttgtggatgatggaaaatctgaacgtatcactgttaatgacaatggagaactcgtttctactcagcatgctatcaccgaataccgagtgattgaatcttcaccacatggttagtgagactgacttccatttctattcagttaaacttaaagcaaatgattttgccttgagtttttagcacattgttgaattgcaggatacacatggcttgagcttcgccctttaaccgggagaaaacatcaggtctctatagatattcagtttttgtttcaactttctctcttttttatgttctcttaatactaatctgttttcaactgttcttcgattgccacagcttcgtgtacactgcgctgaagtgctaggaacaccgatagtcggggactacaaatacggttggcaagctcataaagcccgggaaccttttgtctcttctgaaaacaacccaaccaagcaatcatcatctccttttggattggatctggatggtggagatgtctcttcgaaacagccacaccttcatctccattcaaagcaaatcgatctgccaaacatatcacagctcttggagaaaatgcaggtctcttcagactctgatatttcggatctcgatagccttaaattcgatgctccattgcctagtcatatgcaactaagctttaatttgttgaaatctagagtcgaaacttgtgacaaaaattagattttttttcttaccgagctttcttctttgtgttcattgaggcccaagtatttgtgtatttggacctgaatattctcatacaaagataaataattataattaaatgatttttcgcatataatcattattgtggtatgattaacacagttggtgtgatgactgattgacacaataatcaccgtttggattcgattcctttaatacttgtcactagagttgtttgactaaacagctaacttgtcactagagttattgtgtttgtattttgatctgttattaatctgattgggtataattacagatagagagacatctatattgtaattaagacaatcttaaagtgtaaactaaaaagatctctctgacctctggaaaacgaaaggtgggtgacacatcactctagctatgaatatgatgaatattcagtacctaaccgaacaaagactggtttggtatttttattggaaaaaagagataaataattgtgaatgtgaattatcctgtctgaaaggtaagctgatgacatggcgttatatgattggacgagcttcagaacaaaagagtagcgtcgaatcgaatctttacctactacactttgaactttgaagtacattacctacttcctccttgatcgaacgtcttttctcaaaactattttatttccccaattaaagtagtggtgataaattcacaaaaatacaaacacttttatttttgacgtcaaaaacaaatacttctttgaacaggctattacaatatttttaagaaaaaagtaagcaaaatagtccacaaaccaaaatctgtaacatattaaacgatttatgtttttttttttttttcttaactagagaacaattcgggcttttactaaggatgatgagtgtagttaccgaatagtgtattcatataatcttttaatgagcttaagatatgatattatttcgactaatcagataagagtagttagataatttcgtaatagagcaactctttcgcaaataaaaccattgtaaacattaccaattagtttttctttttttttggtcacaaccaattagtttgtttgttctattttatgaagtgcgtattaaagctaacgtgtttacagtaacgccacacaaataaaaataaaaataattatgtactttatggatttatagaaaaaacaagaatagtcaccaaaaattgattgtgtcatatatcttttgtcaactattttatcttatttttctatggatatgtatgtccaaaatgttagacaaaaaaccaaaaaatcatgtccaaaatttcgttaggctgccgatatctctgtttccctttcaacgactatctatttaattaccgtcgtccacattgtttttaatatctttattcgaggttggtttagttttttttaccaaactcactttgctacgtttttgcctttttggtatggttgtatttgtaccaccgggaaaaaaaagataagaggtttggttggtcgagcttactgattaaaaaatatacacgtccaccaaatattaaaacaatatatcccatttttcctcctctcttttggtattacattaatattttattatttccccatttgctctgtatatataaacatatgtcaatagagtgcctctacagtcatgtttccatagacataatctctcaccattgtttttctctgcaaaactaaagaaacaaaaaaagaaaaatcggagaaaccaagaaaaaagaaatg

SEQ ID NO: 21757 - DNA, 3003 bp, Unknown
  misc_feature (1)..( 3003): 2750-1469P.txt file - cDNA_ID_2026922; gDNA_ID_1621117; Annot_ID_56217
catgtcctcagaaactattcaagagagaataaaataacaacttgtgcaaagaagaagcaagtcgtaataggaggcctgtaatggtaccttttatcacccatgtctctaatagcagatgctggaggtccaatgaatgttagacccgaatcctcacagagttgggcaaagtcagaactttctgacaagaacccatagccagggtgtattgcctagttatataattcaaagaagacatcagctacaagaacacgattattctttttcggggatcaaaactcatacctgtgcaccagtccgagccgctgcctccatgatagtcacaccgctgaggtaactaagtctagccgagggcgggccaatccgtaccgcttcgtctgcagatttcacatggagcgaatctctatcagcgtcactgtaaaccgcaacggtctgaatccctaaacgcttcgccgttctcatgatccggcaagcaatctcgcctctgttcgccaccaaaatcttctcaatacattgctccttaggcttcatcgatgcggagccggaaatatatctcacgagcatcgagtgatttttccgacgaacattccgtcgaagtgcccacaccgtcatcatcgacatttgatctcgattttcgaattttccgagtgaagaaaacaagtgtgactcagcaactgcgttgtagataaaaccaaacaacgagggtatgttggtcaatttcgtaaaaactaatcgacgatgaatagtgacgtggcatatactttatcatggtttggtcggaatggatatgtgtctgatgtgccgcttgcgttgcgtctttacctgattttacaagtatgggctttattgttttattaatgggcctatctgcacgaagcattaagaaaggctgcaaggccttgtttcagttttgaaatataaatacttttgaatcatccatataaatcgcattgatgtaattttaaaattcacttggtcttactatatagagtttttaatataagatcaatttgactattaaagacatgtggagggatagttataaatgattttgaaaatcataattaatctttggaggcatgaaaaacgatacgagctggaactattaaaagtgtttgttaggtagtggctgttgagtgttgactcctctattcatttctttttgttttgcatttctataaccgacaaaaaaaacaatacaattaaggaaaatatacacaatccttttaattaattcaatattggcaacaaactgaacaagaatatatgttagtaataaacttataagaagacaatttgatttgaagtcacgctgttgattatttagtttacaattaaatgaatcttaacacactcgaaacgtttatgtaaaatagtatataaccgtttgtgatgcttaaaagtcagacaacctatttgttcccaataggtggatagtttatttgtccgtttcgtgaatcttcgtttgagtaacaaataaaggatgatatataagttgtgtcaaacaagtaatgcataccaaacaccaaaaacattctcagtcaattaaatttgaatttatcgtttttaatcttaattataatattattttttaaattataaattttagaaagctgaatgaaatgatacataacgataagccaccatatatcgtatatacttttttcttgcaaagtttaaataaaagttatgaacaacgtaactctaactccgactcaacttttagatgattggaaaaagtttgacacgcaagatcgcaataagtcgaatctaaaagcgaacgtggagaaaaaaacaaagggtgacgaaagtggaccgagagctcaccgtccaagacctccctgtctttgtcacttatctcttgtcagcctccttatcattactagtatttaatactttttttttttttttaaatcatctttcgtgatttaatactttgttattccggataataaaatgtattaaaattacaaaatcattttagttcttgagcagacaggtatagaaaaagaaaaagtgaactgcagacttgatataaatcaggggtaaatgggaagtatcagattgaaaaataaagaaatcaaataaaatgtcatactgtatttagttgtagttcgataaaagaatattttctttcggacatgaaagtcgtgtttttttttaagttggcagcgaaggcgatcccaaggaggcaaagtcacgcaacaagtgaattaaaataatgaaacagaacatctgtgagaactgtactggagggtaatatcgtcatttaaaagcttacctaaacaattcttcttcttcacaacgtaaaaagtaggaaccagagctgaaaaacgcctggagagagaaagagagagagatctagatgaagaaaatgagatgagaagaagaagaagaagaagaagtgaaagcgaaagctgatccgaagatttctgatttttgtagtacaagtattatttccggtaagcctcacagaattcttgcttttggacctgatttcactagtgttagattcgctttgtagatttaacctgtgtagctaatttcagtttccgactaagtgcgttactataacctctaattcctgtaagatcatgtggtttcacttgctattcttccctaggattctcgtctaatttccaaagacgaattgatttatgctgatccaatttttcatctgtaatgaattgtttgatatgttttctgaccaggttactactggatttggctagttaattatttttgtctcgaatttggccttcattgacttagtggtaattcgtttctattttttcttttgttttcttctgtatttgtcttttatatgactgttgaacttgttcattattatcaaagcttaacccttgctattttcttcttcttcttcgtcttcttaagttaggatttttttacagaggaatttggtgtacttggctttgagagagacttggttccggagtgttctaatatcctcataatttttgtgtgattttgccgggaaaaatg

SEQ ID NO: 21758 - DNA, 3003 bp, Unknown; identical to SEQ ID NO: 21757
  misc_feature (1)..( 3003): 2750-1469P.txt file - cDNA_ID_2026922; gDNA_ID_1621117; Annot_ID_171917

SEQ ID NO: 21759 - DNA, 3000 bp, Unknown
  misc_feature (1)..( 3000): 2750-1469P.txt file - cDNA_ID_2026996; gDNA_ID_1621174; Annot_ID_57295
aatgctgagttaactgttgatacttctgatagtgaagatcaaacaaagcctctggagaaacaccatgtttatcttgccaatgcagaggtgctgataaactccggaagaaaaccaatctggcaaaattcagaggtgccatctacgtctctgctggtcatgtcttcttactatatagaatgtacaatggctgacactcccttaaattttatcaattccagatatctttctatccgatgtatccaccagactctgatggcaagaacctgaattcgcatcaaggtggtggggagacagaaatcgggaaagtatctgcgaacgaggttgacattaggcgaaaggatcttctgccggtatatgataattttcacagtgtgtataccagtatgcgcaacaggtaagttacctcgctaactgcatcacatcttataaactgcgtctgtcattgatccaattttgaagtggttcttctttgcttgtagaggattttctggggaaagagattcagattcttcttcttcttctgaccctggacaagttaaagaaatgcatccattcaatggtaatcaaatttactttcttaatccatgcattataagatatgtcaaatcttaaaactgaagttttagcaggtatggtttaccccgaagatgaggaaagaagagggagtgcccattttgcactaactccaaaccaaaatcctcataccggaattgtaacatttaaacagcctgtagtttccatttcttctgctgtgaaagacactgattatatagacgacgacgctcatgtcttgccaaagaacgcctccctgcccgctgaaacaaaaattgaaaacagcagtgggataagtggagattcaaatgtaagttctaaccgttctgatatgagcatgaatgcagcagacgagggtgaaggacccattgacggctccccaaacttcgagcagtttttcgaggaggtggtctccaatgaaactgttacagaaactgagcataaggatgctccatctgatggaaaactcgatgatgatgaggacgatgacatgcttggtggtgttttcgctttctccgaagaaggtaagaagaatacatcccatagcctgtaatttttttcgatgatttgaatcctcttctaacggtattatctcaatatatcatcaacatttttggatgtgttacaggttgagtttagttaaactatggccaaagaaagctctaatggagaaggggtcacatactaatcccgtttgctgcaacttttactcactgatgatctttaataccctgaaaaaataacatttaaaatcaatttcttttatcatctgtttctgtaaatgcttgtaaatgtaatgttcattatcaacagtctctcgatttccatggactgtttctttgtaatctttttttttcgtgtaactctctctattcattcatcaaaaaaaaaagagaaaaaaaggaaaaaagcaggcaaaaaatagaaataaagatttatttcgtttgggtttttactaattgagtaaaggcattgtatattttgttgcattgcagtgttataatctcatgtttctctgcagggttaagaatacaacaccgaattttcttaatcgcgtcaactcaactctttcacattctctaatcagaccttaatattaaatattatcatttaattgtgaaataagttctcatttaatagattttagtggatatttaaaacttccaaaaatcataacaaagtaacacatagtctaaagcaatcttttttcatgtcacttaaacccaaaatgtttcccatgaatggttataatctaaatcaaggtctcgatgttgtttttaacggttttaccacttgaatttcacaatcaacgttgttggtttaccttgactataaagatcaaaattttgtagaggctatcaaaggattaagggaccgaatattcacatgttcaaagcaatgaaaccatttaagtgcatccacaacctgttttcatagaaaactttgccatcatcttctacggtcataccatcaatctcgagaatgacgtcattcttcttcacaaactggttaccaagtgcatgctgattgacctcagtcactacaacaccggtcatgatcttcttcatcttaagatactttcgcatcatcgcattcttcatcgactgtagagagtaaacaaaaccctatcttgtctccttcatcaatactagctaagaatagaataattttctttgtactgttattattttgatgaagataaacacccttgtatacaaaacatatcgaccttgcataagtcgcaaccattccatgtatgctataattatttgtcaataaattcattagttgtaacatgtggtcaaagtttgagttttagttgttcactcttttttttttttgacataagtgttttgactttttaagtttgactttataaaaacatgcagaaatgtacaaagaatatatacatataattatcttaattaatttaataactatcaatctgtcatactacaccactatcaatctatcatcatcaccaccattatgcttgacagtcactttttagttggcccatgttaaagctgtttgtgttatttgttattgggcttatccttcactaccatttgattgaaatttatctcatgacccaacaaattgagctaatttcggttcaacattggatgttaattttttttcaaaccgaaccgaattatagttttggtgcattttttctaaaccgaattttaacacaaatagtaatcgtcttaaaaaattcaccgacttgttaaaaagaggcggaaaaaaaaacccgcgagaacttacaatggtgccacgctggcaatccgcgtgactcacaactaaccaatcaaaatccattatctcaacgctatatatttcagaaatcacaacctaaaccctaaatcactccactcacaaaatcctcagccatctctaatcacattttacaatcgcctcttcaaatttcccgataaacaaaaaatg

SEQ ID NO: 21760 - DNA, 3000 bp, Unknown; identical to SEQ ID NO: 21759
  misc_feature (1)..( 3000): 2750-1469P.txt file - cDNA_ID_2026996; gDNA_ID_1621174; Annot_ID_174090

SEQ ID NO: 21761 - DNA, 3000 bp, Unknown; identical to SEQ ID NO: 9734
  misc_feature (1)..( 3000): 2750-1469P.txt file - cDNA_ID_2026998; gDNA_ID_2213619; Annot_ID_180910

SEQ ID NO: 21762 - DNA, 3000 bp, Unknown; identical to SEQ ID NO: 9734
  misc_feature (1)..( 3000): 2750-1469P.txt file - cDNA_ID_2026998; gDNA_ID_1972176; Annot_ID_180005

SEQ ID NO: 21763 - DNA, 3000 bp, Unknown; identical to SEQ ID NO: 10044
  misc_feature (1)..( 3000): 2750-1469P.txt file - cDNA_ID_2026998; gDNA_ID_2213619; Annot_ID_131959

SEQ ID NO: 21764 - DNA, 3003 bp, Unknown
  misc_feature (1)..( 3003): 2750-1469P.txt file - cDNA_ID_2027089; gDNA_ID_1620689; Annot_ID_48526
tcttgcttccgaggccaggcttcccatgggacatggtccactctatctacaaacaccttgaggtccgaaggtatgagttcatccctgaaagagactttgagatcgatttcaacagcgttagagagatggtagacgagaacacttttgcgatatttataatcaacccccacaatcccaatgggaactactacactgaggctcatcttaagcaggtatttacgtacgtattagtactcttggagaagtatatattcacatgattggctagatgatctagacttgagatcttttagtttgtgtttacgtttatattgacatggttttttctttaaattaaaagactacatctttgacttaattttataagaaatatatatttcaaacgttgtaaacgtaaccagcaaagcaatacacatttatttcgtttacaatttgcactatattagataaaaaatttacaaaatttaaattttacaatctaatagataacattattttagcaaccaaggccctaatatttacttgaaagatgaatcccagctcgctacattggcacgggaactcgggataatggtcgtttcggatgaagtatatagatggtccgtattcgggagtaatccatttgttccaatggggaaattctcctcgatagtaccagtgattacactcgggtccatatcgaaaggatggattgtcccaggatggcgaacgggctggctcgcgttacacgatctaaatggtgtctttagatccacaaaggtcccggtcactttttttgttttgtttaatatcgatatacgtgatatgcatcgttttcctatatactattatatttgattaactgtaaatgaaaaaattcatttcaattaggcttatctagttttatatggacaggtcttaaaagctgcgaaagaatttctggagattacttccaaaccaccaactgtcatccaggtttggatcattattggtttactctcgtaaatgaaaaaaatacaaaaatcgataatccatttattattgtcaattgttatagtctatggccaattcactatcataatcttatgatataggcggctattcccacaatcttggagaaaactcctcaagattttttcgagaagagggggatttttctaaaagacaaagtggattttggatattctaagctcaagaacataccaactctcacctgctacatgaaacctgaatcatgcaccttcttatgggtattctatcctataatcattacatgtctagtctactataacttttcttttaatgtattagtttgaaacaaacttctcattgtggataatccgcatagcgcagaccaagctggacccattgcattttgtagacattgaagacgatcacgacttctgcaggaagcttgctaaggaagaaaatctcgttgttttaccaggtaatataatcattatccctctctagagttttcagaagattgagatttaagttttagggaactatgatttaaggaaaaatatattcgattgtttttttttttaacttgtaatataaagaaatgtagactaagacatgtaatctagtggttcgtcattgagttacaacctaactttaacacgattaaacgcatgttgttggattggtaggaattgcatttggtcagaataactggttgaggcattctatcgacatggagactccaagattggaggatgcatttgaaagattaaagagcttctgtgaacgccattccgttatagttgaagcttcttcactcaaagacgtcaatggcgtcaactaaagggtcaatataaatttctttgccttaagtcttttacatatgctataataataaatgtgtgttttattgatatgagatcaatcatgaacacttttgtatctgtaacaaataaaattggtgaatttatcaccatgtcgtgtaatgttttctcatagtttgcaatatttcgatcgatgtatttctacttttcgaaacataagataaataatttattttcattaggtatagctagactggtgtgaaaataccatgggagcacaagaacatctatattgacctccttaattagccattcaaatacatttggtcatgtcttatatatggctcaaaagcatgttgaatcggattcgtactgaatagccaggagtacttcctaacccgaactaaccggcaacaccgatcgactagattgagattctaattaagaaaatgttagcgtgcaactttgataagtttgataagctttttatctacttttttttgttcagtttagatcataatgaaggaaaaattgattcctaccattggatattttgtctttagtaacaatatttttaggtttacttaattacataattagtcttgtatgttgatctgatagttttctcaataataaaatttagtattaactattacgtcacattaaaatatacttgttttaaaattaaatataaatttatgcatgacacggataaccttgtaaagataataacaacgagtaaatcatgaaatcgtacgttactatttatattttaaaatgggcaaaacataacaaaaaaccatgggtggttttcctcctctcgtcggtcgaagacagagacaaaaaatatttaaatacgtaagaatctttgcttcttcttgatgctgatgagtgatgagtaatcgacagagttattttgtttcttttgtataataaaggagattgcgactctacaagagagggctaatatagcatgcattaagatcaatcatacagtttacttaaacaagatttaagatcaccgaaggctcgagattcgagatacattattttctttttgtcttctatgttgatgttaatatcccacgtgagatatcaaatgtttagaacaatgtgaaaaccattggcaaaaaaatgaaaagtggttgggaattttcactatatattcgacttcgtagcaatgagagttagtcacccaaaaacaaaatctaatagagaaaaataagtagatatg

SEQ ID NO: 21765 - DNA, 3003 bp, Unknown; identical to SEQ ID NO: 21764
  misc_feature (1)..( 3003): 2750-1469P.txt file - cDNA_ID_2027089; gDNA_ID_2926182; Annot_ID_140626

SEQ ID NO: 21766 - DNA, 3003 bp, Unknown
  misc_feature (1)..( 3003): 2750-1469P.txt file - cDNA_ID_2027099; gDNA_ID_2684224; Annot_ID_191896
ggagagggaagttgaaggaggataaaaatggtaggccaccggaaccgaaccttgttttcattagttgatcgagcacgtgccactaaagattcttagagatgacgtggcacgggcacagcaacttttagattctgttataattgttcgaatactaccaaaagtcgggtgaagatttggggtcaatttgatgatcataaaggggattatattctccttctcaagcaagatgtggtatttactagtataatagatcattcgttatcttgaggtagacctctccgtaacgttcacaggtgcatgaccaagtaacaatttgattcctttccagcataacgtcatgttggttgcaaaaagaaggcaaagtagagcaagcaagcaagcaaagcatttttcttattttatattttgttgcggattccaccacccacttgaaaaattgacatgtcacaatgatttcgtatcctagtcttttattatttaacactctcacaatcccattactctacacctctttcattaagtcaacacacggttttcaaaaatccactaccctcccaccacctagaatcttttgttacctaccaacaccctcctttgttctctttatatattggtccaactaaatcaataagggaaagcatccttttggttggaggaattgctttcattctcactctttgtgtgttgatcaatggactagctaataacaagttcctcctctatatatttcaaaagaatggaacagaaacataaacgaaagacagagtacctgatgttgatgattcattgtctgtctggagctcccaaatgccttttatgcttacatattcataaccaacaacggctattaattataaaccaaaaacacgaaataagtttgtagcaaagtgaaattaggaatcttggagatggatccattagtagtaggataataggatatgatggaatttggttggggaacagtgataacttacgcttgcttccggcgccgggaaagttggaaaacctacaaagtacagaaatggatctgggccttgaagtgggctttttattaaagaaaaaaatacatctccgttatcaatcaccatcttcttctatctacaaattaaagaaggtaacaacagaacgtggtggatcatgtggttaggcattaattatttgctttgtttcgccgttttggtaacacacagacacagttccggtaagagcttttgcagccactctttatagttatttagaattggcgatcgaatcaatctcactccctccctcccttaagtcttgttgaatctgctgaattgttttataaagagttactttggcaaaatggaaaatccggcgaagagagtgttgatgacatccaacggcgacgaggtgtcccgaaacatcgctttccatctagccaaacacggttgcaagtgagtctctcattttgtcttctttcctcctatcctgtgtttcttcttctagccccgatttgtgttgtggttgactttggtgtctatagttaaccttcaaaaaatgcaatgtactgttgctaggttggtaatgatgggaaatgagggttccctaaggagcattgtagacaagattagagattccattgagggagccttccctgccgatgttatagcactcgacatggaatctgactctgaagttgcttttcatgccgctgtccaaaaggcatgggaactttccggccatttcgatgcttttctcaactcttatacctaccaaggtttaatttgcttcttgtttttcactaccctgcctttgatgctcttgtgtgttgatcattcctttattcaacaatctttctttcttgcaggaaaggtgcaggacattcttcaagtctctcaagatgagttccacagaatcacaaagatcaatctcaccgctccatggtttctcttgaaggctgtagccacaaggatgaaggaccatggatcaggaggctccattgtcttcatggccactatcgccagcggagagagggcgctttaccctggcgctgatgcctacgcttcaacttctgccgctattcaccagctcgtccgggtatgcatcctagctcctaattagacacatcgcgttcgtaacttgaatatgtttgttgatgattgggtttcaggcatcagccatgagtctcgggaagcacaagatacgggtcaacatgatctctagagggctgcatctggatgatgagtatacagcttctgtgggaagagaccgagcgcagaagctggtcaaggacgctgcacccctcggccagtggctcaacccggacacagacctctactccactgttatctacttgatcagcgatggctcacgcttcatgacaggcaccactgtcttggtggatggagcgcagtcccttacgcgaccccgtctcaaatcctacatgtgatcaatgcctagtattattataattctatgttgtgtgtaaaaagtgaatatgaatcaagtttgaataactatggagggatgaataatccatggaatcaatgattatatacttttgacaagtatagaagaaagcaaagagccaaaatagtcaacaatctcaacatcattcgagctcattgtttattgaattcaatcaagtttggtaggtgaacctcaaatacacgtgatattggatattatcttggaaaccttgctaatccaaattgtaaatcaaataagaaaagaatgattacctcagagatctagatgcatattgattcttgaccaagaaatatgtttgaaatttgaatccattgaaccaaaatttgaaggagttgcatatataataatataaatcagaatgatgtagccgccacacctttttgtttccacaaaactctttttctgtgatggatccgctaatgtagccatattttcaatatatatcactttctctggcatcttcgctaccgtgtacgtctctctttctctccctcccctccttggcttttttcaagttcccaccataaacgcagagggagttaagaaatg

SEQ ID NO: 21767 - DNA, 3000 bp, Unknown; identical to SEQ ID NO: 9262
  misc_feature (1)..( 3000): 2750-1469P.txt file - cDNA_ID_2027099; gDNA_ID_1972047; Annot_ID_178265

SEQ ID NO: 21768 - DNA, 3003 bp, Unknown; identical to SEQ ID NO: 21766
  misc_feature (1)..( 3003): 2750-1469P.txt file - cDNA_ID_2027099; gDNA_ID_1621111; Annot_ID_171791

SEQ ID NO: 21769 - DNA, 3003 bp, Unknown; identical to SEQ ID NO: 21766
  misc_feature (1)..( 3003): 2750-1469P.txt file - cDNA_ID_2027099; gDNA_ID_2684224; Annot_ID_137531

SEQ ID NO: 21770 - DNA, 3000 bp, Unknown; identical to SEQ ID NO: 3428
  misc_feature (1)..( 3000): 2750-1469P.txt file - cDNA_ID_2027168; gDNA_ID_1620733; Annot_ID_49439

SEQ ID NO: 21771 - DNA, 3000 bp, Unknown; identical to SEQ ID NO: 3428
  misc_feature (1)..( 3000): 2750-1469P.txt file - cDNA_ID_2027168; gDNA_ID_1620646; Annot_ID_47596

SEQ ID NO: 21772 - DNA, 3000 bp, Unknown; identical to SEQ ID NO: 3434
  misc_feature (1)..( 3000): 2750-1469P.txt file - cDNA_ID_2027168; gDNA_ID_1620733; Annot_ID_166164

SEQ ID NO: 21773 - DNA, 3000 bp, Unknown; identical to SEQ ID NO: 3434
  misc_feature (1)..( 3000): 2750-1469P.txt file - cDNA_ID_2027168; gDNA_ID_1620646; Annot_ID_163228

SEQ ID NO: 21774 - DNA, 3000 bp, Unknown
  misc_feature (1)..( 3000): 2750-1469P.txt file - cDNA_ID_2027168; gDNA_ID_2926179; Annot_ID_140467
gaatttccatcgatgtcacagatctctctcctttagagtgagtgaggagataacgtgtgagccacgggatccgaattaaccacaaaagacacaaaccttgtaccacaaaagaaaagccccactttgtctttaatcggtttctgttacatgatatgtaacttacatccagaacattggctcactggatatttgtgatgggcttcattgggcctttcaggcccatagttattactcaaattgggtatgattttgttggttaatgttgagatttgtgtgtttgggtggttttgtctcatatctctcttaagagggaagtgtaacctactaacctcctcagacaatccacacagtatctattgattaaatgatggctttaaatctactgaaagtaaaaaaaatggttgctaaattaactttacaaagagatgaaataaagctgtcacatctataactaaagagaaatgtgttatccgatcaaatcttgttcttataatgcttaaatccttcaactagctcatatcacatggaatttatacggtccttggaaccttctttgctatatatagcggttgctacttttaaagaagggaactagaagacatggcaactacttcagagttcatattcttcactatatcagtatatctggaaactaagaatttgagcctagattgctttaaaagtctggtgagagaaatatattagttaacgttttttttgtcttggtattgaatcttgcaggccccattgtgaatgcaacgttgaggacacggatgagtacagtgtccatttgtcagatgaaagatccatgattaactactaacttgtcttaattcaattttgataaccgggtttgtttggtttcctatacactggaacttaaccggttatcatcaccatgaacacaacagttttacatgttacacgtcaatttttagttagaacttgctaatcagtatttagtgtttagcactcgtggagccactgagctagagagtgacatcactagaaggtccccagagactcatttggcgacacttggataaggaaacaaagtgtcggtggtcacagttcattcatttttaattgaaaaaatcaaatttgttcatttaaaaaaaaaattggaaaatccaaatatccaaatttgaagtgaatttgaatctgcagattcaatgtgatcttggtaaaagcaccgatacttcccccagatgaaaaaaaaaaataaaaaaaattctaggattaagaaaagaagaagaatcgaattagtagtaatgtcctctcattttatagctctgttacatatttatttagttttaatcattctaaacaaaattagtcctttgttactgaaacgagaaacataatagttccgcaacaaataatagtggagcctttagcttttaattagatatctagtttacctctatgaaaattagttaagaatatgaaagataacataatttcagatttttcttaattttgcagggacatattagtatacctatttaccttcttagtttatgtgaaaaatatcaaaacaacgtttatgttaaaacataggaaaagttcaaaatgtactctaaactaaattcaatatttaacttcaacccacaaacagataaagtatagggaacactcaagagtgaagagtggtgaacgtgttttattacatcacatggatcaagattcattcaatatttgagaagactttacgatacgaatctactgacaattactacaataagtaaaatagttggatatataaataactacagaacaaaaagtaattgaatatgtacaaatggaattatatcttgaactaaataatcgaaatgtacttgaaaaaataagaatccaccttgagttcatcgaaaagaaagattccataacctaaaaggagcggtttatccgttgtattaaaaatttaacaataacaaatgtttcaggtaattgcaaatcgacccatgaatatattttgactttagctattccaccccataaatattatttgttatagccgccccctttgtgtgtattattaacaaaagaagcataagttttttttgtaagattctttttagtcataggggccactgatgccactcaatgagaccaaaatccaaaacttagtgattggttttttgtttgacaaaaaaatgtgaattgtttagttaaccaaaatactcttctaaatgaggtaaactatctaacaagccatccacattaatatctccaacctaaacttatttattttctcatagcactgtgtaggactctaactagcatgatctatggtcactcacccgtccttcgaaatagtaacaaagttgggttttagatttcttaccgaaattaaatttccagtagaacgtctagcatacatttgagtaatttcaatgaaactccacaaattaatttttatcagtttggaaaatatatgttttggcaacagtccatatgaaagttcatacattaaaaaaaaaaaacgtagaaaaactttgttattttttctcaaattcaaacttacactaatttagctgtcgcatcaattaagtatgatttttttttctgtttaaagcttataatgtgtctgcaatttgataaataataaaaaaaattacataagtttcttataataagtctacgcttttcaattttcattgaatatagattcttaatcacgactgaacggaacatacaattattgtagtcttataataatattgttggtttctcaaagtgaaaatgaataaagcttaatgatatatgatctgtcacgtacttaaacatatagaaacagtagcaaattcaccaacttgcctttaatttactataaccttcaaattaagcttcttttattttatgaaaaataaataaagaaaactccatttccctttatttaaggaggctgcattgcttgctcactgactcaactcaagagtggtgtagtgagagaagaaagatagagaaaaaaaatgggaggcaaaggtgtgatgaatg

SEQ ID NO: 21775 - DNA, 3000 bp, Unknown; identical to SEQ ID NO: 21774
  misc_feature (1)..( 3000): 2750-1469P.txt file - cDNA_ID_2027168; gDNA_ID_2926179; Annot_ID_200074

SEQ ID NO: 21776 - DNA, 3003 bp, Unknown
  misc_feature (1)..( 3003): 2750-1469P.txt file - cDNA_ID_2027229; gDNA_ID_1620843; Annot_ID_170123
ctaagggataatttgtttatctcaaaaaatttcgtggagtaatgtgataagatttatgattaatttcgtggagtttagaattcgtggagtaaaaattaatttcgtggagtattcgataatatgatactacattatattattcgtttctgtctaggaaacttgcaagtttggttgtaacatttcacgcatgtggtaaacacattttgaatatttggagaaattaggagcagtaacaatatgtaaaacataaaataagtcttaaccacaaatttatacgatcacaatcttccataacactaccccaaaatttaatgacagaaaagcgatctcatataccattttcaccttctactccccccttcttcttttttcggtttcatttaaaaaattgatgtatttttgtataaatctcttcatataacttgatataatcttctgatcctacaaaacaaccactatattttttctcaaccaagtaaactatatttgtctaggtattacaatcgaacaattcattgttcaattaatgtataattccgtaatttcgtcatctcattatgcgtacaatttttttctttctatcttaaatctgactgttaaatttcctttagcatcctttccgattcgagcagttataagcacacttttttgtgattaaacattgtcatccttcacgctagcttaccttttaaacgacaaatcagcaataaataaaaaacatggacaatgactctaatggtggagctacatatatcgtgacgaatcacacatgtaagagaatcatgtgaacaatagtggtaggcgaatctctatctcttaatttgattcttcaaaataataattaatgattcgatattaagccactttatcaacatttacttccctaacatagatatatgattctagcacagccaatcgatcattgtattagtgcacgcacacaataatcttatgcgtcatcggtcggaatgcattttttatgttgcacaagattaattttcttcgatgcgtagaattttagtaacattgtttatatgtttaatttacaatattactttttttgtagattaaaaatacaatcacaagatttaatggaagtaataactaattgaaagtttagagatgcgggaacatttatacaaaggagcgcatatagatgctccaagttataaaattctttaatattttggattagatgaaagaataaaagaagcatgtaaaattgtgtctaggtacatttggtttagtagtaattagatttgggacaagatgtataatcgttttttaattagtttgatctttctaattaataaaatcggatgtccattgagaaatacggattgagaccatttgtattgccgatggtggtgttacatagtttttgcagaacaagctcatccatgtctctccaatccggtgccaagatctagttggaatccatgaaccaaatcttttttgttggactgattcactcttagaattaatcaaacaaattaaattggttataattttcgaaattctagtcctcggtaaatcccatttcgttgctaacctagaatttccaaagttattaagaagcatgtaatagtcggtttatatatataaaggatttgttttaaatataggtctaagccataaaaacaaacccaaaattctggaatcgaatcaacctaaaataaaagtctagtttggtattctaaaacatttgttttgcggttgggttggatacgaaatctgaaatccgatacccgaacaaatatccttaaattattatttattattgctactttttatcatgaaacaaatgaatttatgttactagaacaatgaacttttttgtgtaattcggtccaaaaacctaaccaaaataggtttcaattctatgtcggaatgaaattaaatttcgaaaaccgattcgaacctgacaaaacccaaatcgacctatatagatcataaatctccctatttgaattattccaaatccgaaaaaaccgatttgaaaacctgaatgcctaaacctactttaaagttaaagaagcaacagtagccataagaagacccacaatataaagattgaaagaacccaactcgaaccaacaatgttcctaaaaatagaagcccataacctagatagagcccaaacccctaattcttcttcatcgacaacatgcaataaactttgctcttgctcgttagatctctcgctccaagtccaaatttctccataaagatgaagactattagagcatcattattgatgatctcttaaaacaattcttatgttaagaaacatgtcttataactaacaaaaggctcttatataagagacattaagtcacttttgttagttataagacatatctcttaacataagagttatgttaagagaccatcaataactatggtcttagtgacatttgagaagaggagcagccaaagaaatttcagatcacatgttcgattaccaaactactaaaaatagagactgtagagtatagacttattcacaaacttggaaaaaagattaagtttgttttatattaaaggtgaaaacttttgccaaataaaagcaataataatgtgtctcaaaaaaaaaaatcctttttttttttttttgtgcacccaaaaaaaaaaaaaaaaagaataatccttaacattctctctcacataagctttttgaattagacaaaaaaaaaaaaaggcactagtcaagtttttttttttttgtataacaaaaacagagacagatccagacaaaaggctagacatccaccacgtcacgcttcccaaccaagtgacacgtgtcgcatccacaactcgtcaaaacacaaacaccaaaaagtagatgacgttacaaagcatcatccgtaaatggcggcttcctctctctcgctctcttctcctctctcaaacccacttcgcagattcactcttcaccatcttcacctctcaaagaaacccctttcttcctcttctctgttcctctgctccgccgcaaaaatg

SEQ ID NO: 21777 - DNA, 3003 bp, Unknown
  misc_feature (1)..( 3003): 2750-1469P.txt file - cDNA_ID_2027264; gDNA_ID_2926242; Annot_ID_142914
tttcttctctcagaagaaacagagtttgtctttaagaactagtcgaagatcactgagtttaccagagtttcctctcaaaatctgccattacttcaacaaaggattctgcaaacacggcaacaactgtcgttatttccatggaaaaatcataccgtagaaagatagttttgcgcagatgtttaatccaaaagacaacaacctaagcgacgaagagcatgttgtttcccctggatcacttgagaagctagaaagagagatcattgagctgcttaaatcaagaagaggtgctccaatttccatagcatttttgccaatgatgtaccacgagaagtatggtaggagtcttcaagctgaaggatatctcacagagtcacaaagacatggcaaagctggttttagcctcaccaagcttcttgctcgcttaaagaacaccatccgcctcatcgacaggttagttacttagtcacgtaacacatattaacaaatgaatatacgaggaagtgtagtttatgcattgttttgcttaatggtgtttgaattgtaggcctcatggacaacattcagttatactagctgaagatgtatcaaagtttgtggaatatacgggagagagaagcgaacatggagcaatcttagctggttcaaggcaggtttacttgacatttccggcagagagtagtttcactgaacatgacgtttcaaactacttctctgaagttggaccagtggaagatgtaagaattccatgtcaacaaaagagaatgtatggatttgtaacttttgtttatatggaaaccgtcaaacgcattcttgctaaagcaatcctcatttcatatgcggagcacgtgttctcgtcaagccttaccgagcataattaggttcgaggaaattccaaaaactgttatcacatcatcgtctttgtctttggggttagactgtttggtcggatggcatgggccatggagttaggttttttagactatttggtttatgacagtgggtgagacacaaaacatatataaaggatctgttttcaggtgagcaagttaagaaacataaggtgcatgagttatctcttattgaacgttttgatatttcattgtatcatatgacaaatccttctagttttacgaacaatgttagaaaaatgtatgggtagtttcgcctacttaagaaaatatcgccatatcaacgatgaatagtctgtatgatcagaaacttatgaatgttgaacacttatatattgtacaatgaataagagatgaataacattgaaaacataattttttcgctaacaatgaaagaaatgaatattcaaaaaaatatttcatcgtgtcttgtgaaatgtagttaattctaaggttataaaaccaaaaaaaaaaattgatctggaaaatatacctgaacaaaataatagcaagatttgttaatagaaagaattgacaacaatctggaaaattttatagcagtataaatagatattaaatctaacgcgagccaccatttatatttcattcttcttctcgtgttccattacacatgcgatacgtagttacgtaccagaagacatgtatctgccgcgcattgtgagcgtttggatatcacctcctagcaattaacactttagccgaccaaaagcttgcacaagcgcaaagagatgcgcgtggtgattacttttaccccttctccacgaaatcaaactggtaaataaaaaatcaactacgttaataaagatcatccacgtggctacgagatgtttacgattttagtcctttaaaatttagattattgcagatctagtttttacggttgtacacttcaatagttttaattcgtttccagtccttacattctttttaacttgattttaatttaaggtataatttggatttcattacctaattaaatactaaaatgagatatgaggttgttaaattgttttctgtttgctgacaaaaataaacaccattttataaaatctggattaaagttcaaaatttagcaacaactatagatgtattatttctatacatatataaccatgccatatgttgagtaactaggatttaacccgcggattaccgcggacaatcggtttatttggttcttatactaaatatttgaataaatatgatattttaaacatataaatataaatttctagtgattagtgaaaaatcgtaatatataatttggatattattgattattgattttgtgattgaatatagtgtttttaaggatggaatgtgattatattttgatttaaaaaatgacatagattctttatttttgttgaacgatttagattaaagggaattaattttattgaacggtttagattgaatcggattatataaagtttaggagattgttaagaccaaattacccttaatgattttgaatagcaaagaacaaaattcaaaattgaaataaaaattgaggctaaattagacaaaattttaatttatatttcccttttaataataaagggatataaatatggcaataaataaaaattgatataaataaagagaaaaattaatttaaattgaaaatgttcaaacaaattcataacctatataaaataacaaattgcttttactttctacattagtgatggtaacaaaaatcaaaagagaaaattactagggtttaagaaaataagaaaaacaacatagggtataatttgaattaaattgagaatgtttaggttaaagagaaaataaaaaagcgtcgacttgttttcttttttgtcgttgttgttgttgtgagcaacttttatttatttatttgtcttccgttgcgtgagatattattgaacggtgtttgttattcggagaagaagaagaagaagaactgaagaagcatattcgacggtcaccaccaaacctcttccgtcggattttcactctccgtttatcgaacatctgagatctctctccacttccgtcaccgaagatgcattccagtcatcttcttctcgaggagccgatcaggatg

SEQ ID NO: 21778 - DNA, 3003 bp, Unknown
  misc_feature (1)..( 3003): 2750-1469P.txt file - cDNA_ID_2027264; gDNA_ID_2926242; Annot_ID_204129
ttttgaggattctgtgaccagtcctgaattctcaactagtttcttctctcagaagaaacagagtttgtctttaagaactagtcgaagatcactgagtttaccagagtttcctctcaaaatctgccattacttcaacaaaggattctgcaaacacggcaacaactgtcgttatttccatggaaaaatcataccgtagaaagatagttttgcgcagatgtttaatccaaaagacaacaacctaagcgacgaagagcatgttgtttcccctggatcacttgagaagctagaaagagagatcattgagctgcttaaatcaagaagaggtgctccaatttccatagcatttttgccaatgatgtaccacgagaagtatggtaggagtcttcaagctgaaggatatctcacagagtcacaaagacatggcaaagctggttttagcctcaccaagcttcttgctcgcttaaagaacaccatccgcctcatcgacaggttagttacttagtcacgtaacacatattaacaaatgaatatacgaggaagtgtagtttatgcattgttttgcttaatggtgtttgaattgtaggcctcatggacaacattcagttatactagctgaagatgtatcaaagtttgtggaatatacgggagagagaagcgaacatggagcaatcttagctggttcaaggcaggtttacttgacatttccggcagagagtagtttcactgaacatgacgtttcaaactacttctctgaagttggaccagtggaagatgtaagaattccatgtcaacaaaagagaatgtatggatttgtaacttttgtttatatggaaaccgtcaaacgcattcttgctaaagcaatcctcatttcatatgcggagcacgtgttctcgtcaagccttaccgagcataattaggttcgaggaaattccaaaaactgttatcacatcatcgtctttgtctttggggttagactgtttggtcggatggcatgggccatggagttaggttttttagactatttggtttatgacagtgggtgagacacaaaacatatataaaggatctgttttcaggtgagcaagttaagaaacataaggtgcatgagttatctcttattgaacgttttgatatttcattgtatcatatgacaaatccttctagttttacgaacaatgttagaaaaatgtatgggtagtttcgcctacttaagaaaatatcgccatatcaacgatgaatagtctgtatgatcagaaacttatgaatgttgaacacttatatattgtacaatgaataagagatgaataacattgaaaacataattttttcgctaacaatgaaagaaatgaatattcaaaaaaatatttcatcgtgtcttgtgaaatgtagttaattctaaggttataaaaccaaaaaaaaaaattgatctggaaaatatacctgaacaaaataatagcaagatttgttaatagaaagaattgacaacaatctggaaaattttatagcagtataaatagatattaaatctaacgcgagccaccatttatatttcattcttcttctcgtgttccattacacatgcgatacgtagttacgtaccagaagacatgtatctgccgcgcattgtgagcgtttggatatcacctcctagcaattaacactttagccgaccaaaagcttgcacaagcgcaaagagatgcgcgtggtgattacttttaccccttctccacgaaatcaaactggtaaataaaaaatcaactacgttaataaagatcatccacgtggctacgagatgtttacgattttagtcctttaaaatttagattattgcagatctagtttttacggttgtacacttcaatagttttaattcgtttccagtccttacattctttttaacttgattttaatttaaggtataatttggatttcattacctaattaaatactaaaatgagatatgaggttgttaaattgttttctgtttgctgacaaaaataaacaccattttataaaatctggattaaagttcaaaatttagcaacaactatagatgtattatttctatacatatataaccatgccatatgttgagtaactaggatttaacccgcggattaccgcggacaatcggtttatttggttcttatactaaatatttgaataaatatgatattttaaacatataaatataaatttctagtgattagtgaaaaatcgtaatatataatttggatattattgattattgattttgtgattgaatatagtgtttttaaggatggaatgtgattatattttgatttaaaaaatgacatagattctttatttttgttgaacgatttagattaaagggaattaattttattgaacggtttagattgaatcggattatataaagtttaggagattgttaagaccaaattacccttaatgattttgaatagcaaagaacaaaattcaaaattgaaataaaaattgaggctaaattagacaaaattttaatttatatttcccttttaataataaagggatataaatatggcaataaataaaaattgatataaataaagagaaaaattaatttaaattgaaaatgttcaaacaaattcataacctatataaaataacaaattgcttttactttctacattagtgatggtaacaaaaatcaaaagagaaaattactagggtttaagaaaataagaaaaacaacatagggtataatttgaattaaattgagaatgtttaggttaaagagaaaataaaaaagcgtcgacttgttttcttttttgtcgttgttgttgttgtgagcaacttttatttatttatttgtcttccgttgcgtgagatattattgaacggtgtttgttattcggagaagaagaagaagaagaactgaagaagcatattcgacggtcaccaccaaacctcttccgtcggattttcactctccgtttatcgaacatctgagatctctctccacttccgtcaccgaagatg

SEQ ID NO: 21779 - DNA, 3003 bp, Unknown
  misc_feature (1)..( 3003): 2750-1469P.txt file - cDNA_ID_2027268; gDNA_ID_1620322; Annot_ID_153362
aaacaattaaaaaaacaaaagaatttagatacgtagttattaatatagaccattagattgaaaagtaaaaattaagatctatggctgagattaaagacaataaatggattaattttttgatgttataaatctgattagaaaaaggtatctctcttcgtctctagaactaaatctctctctttaaaaaaacaatcgtttctccctttctccttcctgaagatcgatttttcataaatccatagtagtttaaaaaagaagcagagagatgttgaaaatcgtttctcatggaatcaatcgattattctctatgaagttctttaatccacacaactttcctcaggaacatgataatagtagtaaatggaggtttttcctatggttactctagacgaaggaggatctccttgtgttggacaggtttgtgatttctttccagggataaaaaaaatttgattgtttgtttatgatgaacgattttttggctacggaagagtgtcatggagttctggtgaattttttggctatgtttggtgatttcatttttaatcaagttgggaatcaataggaaacaactaagcatacaacatagattagaagagatatcaagatggatctgatttaagtaagatttggcgactaattctagatgattagggttatttgtgatttattacaaggaatttgtgttctcattgatttggcgagtaattctgtatgactagggttatttgtgttttcttaaaaagaatttgtgttcttgttgaaatcttgttcattggaattatttgtgtttggtaaatcttcattggtggctaaggatgtgtttgtagctcttacggcgtttgttattggtgatgtccattatgaatggcaaattatggatggcacattatggatgatgaatcatggatggcatattatggatgacgcatcatggattgtacattatggattgatatggtgagatttgtaaatcttttggtcttacatgttaagagtaaaagatgaagaattggagaagcatgtctaacatcctaaaaacaagctatatccggttgatttgctacgattttgtttttgtgaaacggtggctgtaaagcggtgaaaaactttgctgttctcctctagtataaacattgacctttatgatggttctacgacttagatcgagttggtctccaatgttaatgttcatcgtactattaaaggccacaaaatgttgatcatcgtgagattataccgtgtatcactttcttctataattccagaaattcttatacaaacacatatttaatgtccacgcgctaatgaccatatggtaatattctcgtggcatcaatatattgtcttaaaggtagagatctctgcaaattgaaagaaaaatcaacaaataatttatccagtatagattgtccatttaaacttgtccaaacggttcacttttatatttgcccttaaagtaatgaaaagaaattgtaccaatttgcccttaaagtaatgcagacgcaaataacttataaatgaagctctccttttttagtcatggccgttcactccagatgagatcgtgtctgagaaactatcattttttatcttctctgtcttccatgttttttttttttcatcattttcatttcctttttcaaaatcatcaatcatggtggttctctataattcttacaaatcatagaaattctgagattatctcaaaattctctatcataacttaaaaacgaaggatatattaagaatcaacaacagaacattgctgctacaattgatcttcttacacgctttatatacttaaacttgagtacttggacactcatcaatggacaactatgcttcagatgtgagttactagatgaccacttggactagagtgcttggacacttatcaatggacaactatgcctcaaatgtgagttattagatgaccatttggacttgaatgcttggacactcatcaatggacaactatgcctcagatgaagttacatcgacaatggcctttttgctgctactcgcgttctcaacatcacgaaccgtttcaagcccagattgcttagaaggtaactgatcatggttaacatcctcacttttcattgtaatcgatgacagagattccttaatcaaggagagaaataaatggaaccaaatcaaataattgttgagagacagggaagatgatgataaatcatatgaaattgggcttttagttttgatttggaatattgagattcccgtaaaaaattggttttgattttggaaagagagagaaataaagacgatggagaaaagagttgagagagaaaatgaggagaaagcgttgtggttcagagggcaatttgggaattttgatttggtaaagtgccttctcctttcaaagtgcctaaacgggtaaatagttttctaaaagtgtcttataatgtaataatctcaataaacaattcaaagctgtataccattcaagcccattattcaaaattttgtttgactaatactattcaatcgggtctatgggcctcagaaaataataaatgggccttaaatacttggaaacaatggatagatcgatctcaactttaaaatgcgtccaaaaatataaacaaacaaacatctctcgccgtcaggttacatctatcgccaccgcaaagagaccaccgtctcctccgcaatcttcataacctaaacaacactcatcccctggtaagctcaattctctaatcaattcaatctcctgtgatgtcgatctgtttctactcaagttcaatctcacgaatcccttctttgttctgtaaattagggtttcacgatttgtgtgtctagggattcaagatccctaatatctgatcatctagtaattgtgaaagtattgatttttgttcttttgatttgagtttagcaattattgagatttctttgaagttgaataccttttctcaatcattataaaagtattgatttttatgtgtgttttgtggcaaaggtacttaaacaatg

SEQ ID NO: 21780 - DNA, 3000 bp, Unknown
  misc_feature (1)..( 3000): 2750-1469P.txt file - cDNA_ID_2027308; gDNA_ID_1620391; Annot_ID_155608
atcttaattaaaatatcaaagaaattatggaaacccaatgtccacaaaattaatcttaattaaaatagaataagcattaaaactaaaatatggagcacgtctatgctgcaccgcatattaacacattcatatataactaagtatttcattaaccttaacgttaacctcaccgctcccgaggattgcaaattatttaaatatttttctcttatgctaactaaagttccaactactcactgccatttaacaaaacaaattcgtgtgattccacaagttaaactaagcatgataaaatatatatcttctaaaaattatgaaagtatttttttaaaaaaattattaatcaaggactagatacatctataacattttaagaacacttttgtttttctaggactaggtggatctttcatcctttcatactcgtcgattgttaagattgccaatgaacacgttctttgttccactattttctttatttttaattgcacattagtaaataattttgaacaatttatatgatttacgtaacaaattatattaaatataatattaatagcaaaagctgaggatgcggagatgattatgtgagaatgatgtcttcttcacctccattattacctttcgattttgattagtgcttttaggtacaaacaaaagcattgtctttttattatctatctttaacggaaaatattgtctattttgtagtcttccaagtcaaaactttcttcagtccactcgtttatattttatttcggcaacccggcactagccaccaatattcaatgatcattttttatatcatttgattttaaatataagaaattggaatcaactatttaattggagtatatgttgttgggagatgattatccgattgtctacatgtggacatgttgcggtagaatttgtaaccaaaattttgaaaaatatttggttctgcggataaatgctaaaacctaggcaccaatggcttaattccctagctatgcaaaacgcggctcgctatcctaagtaattatggcaaacaaaccattgtccgcatcacacaaagccgactaaatgcatttgtacgaagagtcatttacgtcaaacacgcatagaacgttccctcgatggatacaatatctacaacaagtaaaagactacaccaacacgaacccgttacatcgcacatgctgaaagcacattgcatccggtattctaaagtcatatgactagatttaccttacacaaaaaaaaaaaatttaagatatagatcatgtatgttgttagaaacactctctcattagtttataattaaagaattggaaaatatttggaaaagaggataaatattaaaatttcaaaagattgagtcgtacacacacgcctcatgctaaataaacgcttgaccttaattacgtcggtggcaacgtatcttcaatccgtcccttaccatcattctatgattggagtagtcgattaaccacactcgccacttggaactctccaacccctatccaggaacccttcttcgttcgctgaatccctaccaaactcactaaatatcaagttggagatgaaccacttccaaaactagatctatatatctttttttttttttcataatgtaagtgtaaatgtatacatacaagtaacaaacaatcgaagccttgttctaaaagaacttatttttgtaatcattaactatttgttggattataaacaaaaaaaaaaacttaaatgcatggcaaattggcattagtccatgtttttaaatttagttacgattttcatgatttgttttcgttaaatattataaagttgaaagtcacgtttcaacgtattcatataagttaaaaacttaacataacatatctcttaaaattatcaatgacggaaattatgggaattcttgttttcctcccggtaattgatggccattcgaaagaaaatgattatcacaattcataagacaataagaaacatgagtgggtcaatggtaggtatgatattctttggtttcgattatgtttggggatgggatggtctgtgttttctcatatgcttacaattatcttctaatataattctaagaattacattgattctgatatatatctttcaggtatttatgaaaataaatttaaaactttatataaattttttactatatatccataactgaaattctacgagtatagtgaattcggataactattttacggattcaaaacatgcggaatttcaaggtatcttcttaacatgccaaacatgaataataaatagagagaaaaacaaaaagagacaattcacatgaaacgaaaggagatcctttaagaacgcataatttgtctgcttgcacgctctttgattgcttcgtgcatttaacgctttgattgtcattattattgttttggtctccttttcctttttgtgtgtggacatacccaaacaagcatccaatgcaaacaacacaaaaatagatgttggagtttcctaaaaatctcatgtggaccggtcttattagtctcccaatatcaaagtttaagcccaacccatattcagtttctccgacccatattttatatcatggtctagtctagtccacacctaaagtcgataagttcgaattaaaatgaaagtgttaaaactattaaaatgaaatgaaaactattcaaatcaaaaagctaattttgcaaacgtttaatgtattagaaaacaaatcattgcttaattgtgtgtatgtaatttattatttattatattatttttataattactaaatttctgtagggtatataataaattgaaaaatattattttgcaaacgtttattatcttaagacctttttgaaatcacattatccaaaattcaaaactgattattttccgtaaataaattaggaatatataggatattaggattttcccactccacaaaattctgaaccagaattattaaaaaaaaaaaaaaaaacacattgtcatatctctggtcccatatgtgatatg

SEQ ID NO: 21781 - DNA, 3000 bp, Unknown; identical to SEQ ID NO: 6834
  misc_feature (1)..( 3000): 2750-1469P.txt file - cDNA_ID_2027344; gDNA_ID_1621108; Annot_ID_171696

SEQ ID NO: 21782 - DNA, 3000 bp, Unknown; identical to SEQ ID NO: 6834
  misc_feature (1)..( 3000): 2750-1469P.txt file - cDNA_ID_2027344; gDNA_ID_2926208; Annot_ID_202377

SEQ ID NO: 21783 - DNA, 3000 bp, Unknown; identical to SEQ ID NO: 5549
  misc_feature (1)..( 3000): 2750-1469P.txt file - cDNA_ID_2027359; gDNA_ID_1620801; Annot_ID_168683

SEQ ID NO: 21784 - DNA, 3000 bp, Unknown; identical to SEQ ID NO: 5770
  misc_feature (1)..( 3000): 2750-1469P.txt file - cDNA_ID_2027363; gDNA_ID_1974077; Annot_ID_180401

SEQ ID NO: 21785 - DNA, 3000 bp, Unknown; identical to SEQ ID NO: 5770
  misc_feature (1)..( 3000): 2750-1469P.txt file - cDNA_ID_2027363; gDNA_ID_1620816; Annot_ID_169277

SEQ ID NO: 21786 - DNA, 3003 bp, Unknown
  misc_feature (1)..( 3003): 2750-1469P.txt file - cDNA_ID_2027368; gDNA_ID_1620819; Annot_ID_169412
gagagtctttaggtctaaacacatgttacatgtataaaaggaatttaacaaggttgtatacgtagttacgtacattaggtgtttctctgttcgtgtgtacaaccgcatatttttaatctttggatcatatagtgttgatgaatgtgtacatcaactattggagatataatgtattatgctgtatacgtacaacagaatgttccaaaaatctttcttcttttttttattttattttaaatcggccccaatggtgctataataaacgagaaagccaaaaatactacaaataaaagcctcagtgatgggtttatcgtttaagcgaaagtgacgaaagagaggaaactagacagatacgacagtaagttttggtcatcgaagatacgtattgggatccgctcacaagaatttgttgtgtgtctttttgctaaaaggccaatacgaaaatcgttgataattcgtttcatctaccgcaatcactttatccttgaccaaaaaaagaaagaaataactcaaatatcaattttataatcaaataaaaacttaaataatcaaccaatatacccgtgtgtgtcaaaccatactgcatcccaataattgatcttttaatcattctttattatcttatccttggtattgtggctagtggggtattttcaaaagacttttttgacaaatcaacatcacactattaaaaaagggatctcgacggagaccaaccttcagctctctggcaatggcgtatcccggttcgcctatcttgatgaagctcctcgtcttcatctttttatcaacttttgtagtcactaacgtgagctcggaaactaagtgccgggagttcaaatcgatcatcagtttcggagattccattgccgacactggaaacttgcttggcctctcagatcctaaagatcttcctcacatggcgtttccaccgtatggagagaacttcttccaccacccaactggtcgtttctccaacggccgcctcatcattgatttcatcggtacttttgactttacagttttacttaaggtgtgagtaagtaagtgtgtaaaaaggtgaaactaaaagagttattaaatttcttcagccctttctttgttttcatcttctttatggttttacttgattaccaagtttgattgtgtaaaacctgaaatcatctaaatacagaaccattaagtgtggttaagtctttatgaccaacttacaggctgtaagttacagctcttagttcatgttcttttctttggttctgttcacagctgaattcttgggtttaccgcttgtgcctccattctatggatctcataatgcaaactttgaaaagggagttaatttcgcggtagggggagcaaccgctttggaacgttcctttcttgaagacagaggaattcattttccttacactaatgtgagtttaggcgttcagcttaatagcttcaaggagagtttacctagcatatgtggctctccttcaggttgggatgattaactatttcttttttgttttatagtgtttactgttatctatggttaggatatcaattctgatttctagtgcggttgctcttcaaaaaaaaaaaacattcgttctgtttttggttatgcttagtgatatcacttattgtatataatggcttactttatattcttgttttagactgtagagatatgatagaaaatgctttgattctcatgggggaaattggagggaatgactataactacgcgttcttcgtggacaaaggcattgaagagatcaaggagctgatgcccctggtgatcactactatttcttctgcaatcacggtaaacatttatctttcttaatatctcatcaagttcttgatcttctctgtgaacaacgaatattcgatagcacaggagttgatcggtatggggggaagaacatttttggtgcccggagagttcccagtcggatgctcagtattgtatttgacatcacatcaaacatcaaacatggaagaatacgatcctttaacaggatgtttgaaatggctgaacaagtttggtgaaaaccatggtgagcagcttagagcagaactcaacagactccagaagttgtaccctcatgttaacatcatatacgctgactactacaacgcgctgtttcacctttatcaagaaccagccaaattcggttagacttcttgatcgttttactgaacctaaacaaacaagtacattgatcagtttgctaaatattgagttaattatgcaatcaggattcatgaacagacctttgtccgcttgttgcggcgcaggaggaccgtacaactataccgtaggtaggaaatgtgggactgatatagttgaaagttgtgatgatccttcaaagtatgtggcttgggacggtgttcatatgactgaggctgcgtacagattgatggctgagggtatactaaatggaccgtatgcgattcctccttttgattggtcttgccgtagctctggagttaagaacagtgggtcatctgacacatagaattctttgatgagaaactgatacaagttggtcaaaaaattgagaaaaggatactgataaaaacatgtatgttccttagtattgtcttggatcatgttcatgtattgtatcatgttgttatgtgaaataatttaaaagggtatcatgttcatgtatactccactccatatagagagtaagtaaccggcaacggcattgaaaacttggagataaattggaatatttgttgattcaatttggaaaatggcaaaaacaaattatttagccaagtgaacatttgttgattcagtttggaaaatggcaaaaatgagaaagagacaatcatgctctcatttgtgcccatccctaaaccacataaagataccctgtctagtctctattgcatctaataattgatctttgttttttttggactttattgtctccgagcgaatagtggctctttccaaaaagtcattttgaaaagtttctaacctctaggccaccactcatg

SEQ ID NO: 21787 - DNA, 3000 bp, Unknown; identical to SEQ ID NO: 15024
  misc_feature (1)..( 3000): 2750-1469P.txt file - cDNA_ID_2027375; gDNA_ID_2684254; Annot_ID_193078

SEQ ID NO: 21788 - DNA, 3000 bp, Unknown; identical to SEQ ID NO: 15024
  misc_feature (1)..( 3000): 2750-1469P.txt file - cDNA_ID_2027375; gDNA_ID_2684254; Annot_ID_138079

SEQ ID NO: 21789 - DNA, 3000 bp, Unknown; identical to SEQ ID NO: 8802
  misc_feature (1)..( 3000): 2750-1469P.txt file - cDNA_ID_2028729; gDNA_ID_1971889; Annot_ID_58481

SEQ ID NO: 21790 - DNA, 3000 bp, Unknown; identical to SEQ ID NO: 8783
  misc_feature (1)..( 3000): 2750-1469P.txt file - cDNA_ID_2028729; gDNA_ID_1971889; Annot_ID_176834

SEQ ID NO: 21791 - DNA, 3000 bp, Unknown; identical to SEQ ID NO: 2887
  misc_feature (1)..( 3000): 2750-1469P.txt file - cDNA_ID_2029104; gDNA_ID_1620613; Annot_ID_161986

SEQ ID NO: 21792 - DNA, 3003 bp, Unknown
  misc_feature (1)..( 3003): 2750-1469P.txt file - cDNA_ID_2029214; gDNA_ID_1972175; Annot_ID_179986
tggacagcctgagcctgtggaagaccaagcgtgcaccaacgtctgttctcttgctttgttattagaaactttttgaagtaaactatacaaataagtggaaagactgataatactaatatgtgtctcttttggaaaatattttcaagtaaaaataaaataaataccaaatataggtgaaaaaaggttttaggataacaagaacgattatccacaaaggcaacatgaaagcagaaaccttttccctgcaaaagtgtatagtaaaacacactcataccaaactttcccttcttttctttttcttatcatctttgctcttttcccggaaaattccaaagatcaacagccgcagaaacatctcataaatcatgatgatgaagttctatacgttcactttcttaatctgcttgttctcgaagctccaaggtcactgcaaatcagatatcagccttggcaattctctgacgctcacttctcctctagaatacactccagggtttatggggaaagcttatatcatagagacagaatcatcgtcaacaagagaacctggttttaaagccgcgttaacaatggaatcaagcgacaaagatgatggaagatatttatgttcccttcaaattttccttggagatgtaagagtttggagctcagggcattactcaaagatgtacgtttctagcaaatgcatcattgagctcacgaaagatggagacttgagactcaagagtagctataaacacgttggatggagaagtggaacctcaggacaaggcgttgaggtataagatttgattggttgatcatttttaatgacagaaacatgtaacatgctaaactgtgtttggaaacaaaattttgtagaggttggagatacaaagcacagggaatctagtgttggttgatgctaagaatctgatcaaatggcaaagtttcaatttcccaacagatgtgatgttgagtggtcagagactagacgtggctacgcaactaacttcattcccaaatgactcgactctgttctattcctttgaagtcttacgcgacaagattgctctgttcctaaatttgaacaagctcaagtactcttactgggaatacaagcctagagagaagaacacaacggtcaacttcgtgagactagggttaaagggtcttgacctattcgacgataacagtcgcataatcggaagaatagagcaaccgttgatcagattcttggcgcttggaaacagaaccggtaatttaggactctattcgtataaaccggaaaagggaaagttcgaggcaacgtttcaagctgtgagcgacacttgtgatcttcctgtagcgtgtaaaccatatggaatctgtacattctcaaagtcttgttcttgcattaaggttgtaagcaatggatattgcagcagcatcaacggggaagaagctgtttcagtgaagaggctatgtgatcatgagatggttgagctaaatggagtcactacagtgctaagaaacgggacacaagtgagaaacataagcaaagaaagatgtgaagagttgtgtaagaaagattgtgagtgtggagctgcgagttactctgtttctgaagagagttgtgtcatgtatgggatagtgatgggtgttaaacagattgagagagttagtggattgagttatatggtgaagattcctaaaggagtgagattgagtgatgagaaatctaatgtgagaaaatgggtggtgggattagttggaggtattgatggttttgtgattttgttgcttatttctggatttgctttttatttcattcggaagcgacggaaaagcttgttactgccgccaccgccaccgccacctccaccgctatcgcagcagccggctaataccgattcttgatagttctgtttttggatatttcagattaacttgtgtcttacaagaatacatgtaaacattgataccgtttatagcgaaaaccgttgctttacatcgaacattgtaaaagcctaaagaaaatttattgattaatgtttctgaggattttgaaggtaatgcatggtatatcactcttacaattattttttcttataattattccatttataaccaagtttttttatgatatcaatatagttgattcgttggggataagaaaccaatttcttagagttttatgatttttctactaacctttgtttagctaaaatatttttgctattcaatcatatttcactattcatctaacatatatgtcaaaactcaattatttcatgtaaaacagaagaagaaaaaaaaacactgtttttccacatttctactgttaggttaggtatgggatatatagaatttagggctcatggatttatggtatgaataccagtgtagaattgtacgcactagtcgcaattcgcaaagcagaccaaggcacgtccaacggttagttgaaatagtgtcattttaaaaactgagactttcactatgtggcccttctttatgaccgttagtgatccccaccacaaactccatcattgacgcagctaactccggcacaactccctctataatccaacggtccaaatactctttcacttttctccaaataaagttatatttctaatcacatttctatttctagattagaagacaattgagaaaacgactacaagttcacacttttttattgaatccaacggtccaaagattctttcacaaatactttgaatttacttgaatcaattaatctcacttgctataatgataagatattcacctccctcttataagataacaaaattagattttataaaaagtgcttaaactataaataaagacaaaactagtaactgagaaggcaacggacacttgtagctttatgcaactttaattattccctacatgagaaaaagaccgttgcgataatataaagtcttcgttcacacacaatctcgaagaaaacaacaacagttttgatcactctgtctctcttactctatcttcttcccaagttcttgtcttttgatg

SEQ ID NO: 21793 - DNA, 3000 bp, Unknown; identical to SEQ ID NO: 6855
  misc_feature (1)..( 3000): 2750-1469P.txt file - cDNA_ID_2030742; gDNA_ID_1621109; Annot_ID_56064

SEQ ID NO: 21794 - DNA, 3000 bp, Unknown; identical to SEQ ID NO: 6855
  misc_feature (1)..( 3000): 2750-1469P.txt file - cDNA_ID_2030742; gDNA_ID_1621109; Annot_ID_171746

SEQ ID NO: 21795 - DNA, 3003 bp, Unknown
  misc_feature (1)..( 3003): 2750-1469P.txt file - cDNA_ID_2031118; gDNA_ID_1620418; Annot_ID_156515
cggttaggagaatatatgttcaaattatttgattaacctatctttaacccaaatgatttagattggtttgaaaccgaaccaaaccaatagctcaatcatgaataagatgatttagtgtagcttggttgtatttttcttttcaaatatataagtgaaaatatgtattaaattcaaagaaaattattagaaaatatataaaaaccaagaaaataacttattttggatttttttttttttttttaagtgaactcgaacccataatttttcttagtcagtgttcttctattgattttctttattttgataaagattattattctactgatttacaatgaataaaataaaaaagagagtagatctgtttccttatccacaataattcaatttggtagtgaattacaattatacgagtaagtaacagtcgatcgtgagagagcaagagatatagaaaagtgggtgatgtgtctaataaatataggtcacacaaccacctaatcttacgaatcattctactctccatatttaaagttatatagcaatcaatgtcagctacattttcttacgtatcttttttttggttataatatgccatgattcttgaaaattttaattcttgattcatagaattgtatactaaaggttgggatttatcataataatggaaacatgaattctatattaatacataatgaactggattctagaataatacagagatttgggtactggattaaatcgaaaaaataaaactatactgtttgataggtacatttagataactattgtcctggtattattttttaaattttttatttttaaatctgtcgcattttgtttttcctcaagtattaaaaagtaagaaatggtatccaattttgaaccgaaactgcattaaataaactgacccgaccttgtgtgtgtaaatgtatagagtagacacacattaatagttgaaaaagggcaatgctaattgttagtgaccctaattaatactccggcaaggatatatgaccattctctaactgttatgttccaacacattaggtgacctaaaactgtttggaaactttcatgtcacttaataagtaataacaaagcccatgtcaacatccttttttatgtgtttttccccaacattttggtttaattaatcactcattattatatattacttacctgatgaattagctatctgatgaaagtttcgttagaaatatttacatgattaaacacttaaagattaaaaaaacaaaaaattcgatgagatatcagctaagaaaagagagaaaaagataaggctaaaaagtttatggctgtaatataatatataataaattaaacagaaaaaaacttgaaaaaatctaagaggagtaattaatattgaaggaagacagatgaaacaattgtataaaaaatgaatgatagaaattatttatcaactataatctttttttgaaaatctattgtttgtagattataatgaacaatatttcgtttctattaaggtaaaaattacaacaccatagagaggacaacttagctaaatgaccatcaacattgaataaattaggtttgaatgattaaatcctttaacaaaaagtaggtaaatgtttatggaacattcttattaaaaaagcatttttattttctcaagaaatataaaagaatgatatttcttttctttttgcccaacactatgtttttataaattaaatgtttgtatataaaatagtcccaaacaacaaactaggcgtacaacggcatgttattcaaataaatagcactctgattacgtgtttttttttttgcaataaaaaaattcataaacttaattaactctctcaaaatggttacatatatatctaccaacttgacttaaaaggaagaatgatctgacttctgagttctgaaattcatatttaacaaattatccataaatgatgtgttggacacctattaacaaattagcctctagtgtacatgttagacaccgacgtattacttcttggtctctatccaataaacatttggcaaggatcttaaatatgtataactatttgatgtataagtctgttaattgtgaatgttaagaccgagagtataaaagagcttgttaccagtttaagtcattatttatgtatctttattcccatcatggccaaaaatggctgcgttaattactccaccgcaacacgacacttaaacctaatacttaaatgatagtagataagttggatatggaataatggatacaatcctcacaaaataaatacaatttagaacagagaatgtttgattgcttgatgttttaacattttataaaattctgttctttggcaaaagtgtcgttcggtggtttactttcactttattagtaaagacggtgacagtaatttatatatatatatatatatatatatatatatatatatatgactttctaaatttggaaggttagtatgaaatttggttcagaagaagctacaattcatctagtcggtgaaaataattgttgttgtagtcaaaccaaaattacttacatgatttcatttttatatagttaaaagttaaagtttgttatattattacttatatgttcggatttagatctgaagagagcagtacggatttaaagcccaaaattgtacattatttcacgaatataaatcccatatatatgttttttttttctcaaggaaatcccatatatatgtaagataccataaatagattatttgaaagacaagaaaatcatgaagatatgatatatcaacaaaaaattaacacaagaagtcaaattaaatttctctgttggccactttacattatgtctcaaccaacaacagaacgccaagctgtccaaaaaaaaaaaaaaaaaaacccctcaagagtctatatatataacaacattctcaacacaaaccatatgacatttacattctctcaaaagaaactttctacataatataaaaagtcacacattctctctattaattaaacatg

SEQ ID NO: 21796 - DNA, 3000 bp, Unknown
  misc_feature (1)..( 3000): 2750-1469P.txt file - cDNA_ID_2031469; gDNA_ID_1620567; Annot_ID_160745
ttaatggatatgtttattcacaaaatgtataaattcgaatcccgaaatatataaacacttttcaaaccaaattaaccctatattgagttggaaacaaaaattgagaattttcttatagagagagagaatgagagatggatttggctataggtagagaacctgaacttggcagtcatgaaacataagccttagcaaggctgcaggagaagtaggatcaagtataaacattgatgaaagtgaagatctcactatctcttcgactttgggacaagttttctcgtagtaactgtaagacaagccttcattattagtctccatttggtcaccaataatgcagctgcataacaagctcatgacgagaaaacatgatgcagctgtagattctgcaactttgctctttggtttcataactttctcttttgtttggaattttaggtaaatattaaaagagaagatgactttgcacacactaaaaaaagagagagaagatgacttgtgtatttgcaattggaagtgtatgtataaataggaagctgaagaaagtccccgtgaattcgtgacattaataatcccaaccgaaaagaatttttaaaacatgaaattggtttgagatcccacctagttttaaccgataggttattgatttttttgggttgagtttagtcatcctctcgactcattatacgaaacgaaaccagattgctaggtttactaatgtggctaatgttatatgcgttatttataaaattttgctaaagagatgtgacattagttattaaaaagtcaaccaatactaatttaaagactactatatttccggttaaagttggttaacagtttctgaaccgaatatatctgtattaatatgatgttggataaagtatatgttttcaattatattgtagagaaatagccaaaaaaaattcgtgttttgttttgtttcagtatagttgcggtacatgggaattgaaatcacgcatttgcttacataaaagtagcgaaccggtggaccggtttggttcaataaatggttataggtaacagttgatggagaagacaagacagagaatgggtaaaagcaacatgcatggataatgtgaaacagttaggttgattttcacgtttgcatccatatactacacacatatattatctatccacatgatgtctattaatgtattatcaaattttggattttttagccttctcttttaattactgttcttatactataaaataacatttcaattttctgcattttaatttatcataaactaataatgcttgattaaatatttcaacaacatacatatatatatatatatatatatatatatgatgatgtgaatgcttggttaaattgaattaaaagaagtagaaaagaaaaaatattctaaaatttaagtgaaacgtgaatatatatatatatatatatatttttttttatcatcaatcattggcctaaaacgtgagaaaatagcaaaaagaaattggcctagctagacccaaaaaaaaacattcattgttacaatcgtcaatggagggttcatatttcagaaaataaaataaaaaatcagataagcattatctatagtctataggctataagatataaataattggaatatagttatcaatatattgagaaaacagagtccaacagaagaaatatatacacccaatgacccaaaggtgtagggttagtagaaaaagacgagtagagattctagagactccagtgagtaatattggtggaagtcattaatacgaatttgcggtgaaattaatgtccctagctgttttccaaatgtggaatcaacactgtgacttcactatttcccttcgtcatcctaaaactctctctattgctttctcttaattctctgtgttcttttagatccgcaataacatacaaaggtccacaagttgaggagctagagtctccgttaagagtaataaatgtggtgatattagtaaacgtaaagcttttttttgttggtaagaaaacgtaaagctttcttgtgaaaatatatgcagcagtaatttaactataatacgaaaaattactttaatttaatttaatgtcaactagagtgtagagtgtagtggtaactggtaaacttccacaagcatagtttttttttttttgttggatactaataaagtagcatcaaactgatcaaagttataggtttcttttcctatgttcctcgtcaagtttgaggtttgtggattcgttaaggacaaaatatagcctttctataaacgaatatattggtcctacccttattacagctaaacacaataaatattttgctaacttaattacattaatacgttgaaaactagtaatacgtacatcgaatgtgaagttgtgaaccaataaaaagaaaaaacatgagagaagaagttgtgaaccatatacagattgaatcatataagatgatatatcactcccaaattgaagttttgagacaacttttatcgtatattatggagaatgcataaatccattgaatttttttaatcaagattttgattttcagtaatgtttttgtagggtataagaaattaattatgacaataattgacgttctattggtggattgggcttcacgagattctaatggcccccgactaaggtacttctttgattaccgttgattaatgaataagcggcttatacagtgtatcatttacacaacattcacaatttgtttttgtaattagttaccaaagatagaaatatacttcaaagtatttatcgtccattaatccttaataaatgtctaaaaataaaaaacaaaacattccaagtaaaaaccatttcttcctccaaaatcccttacctcccaaaactaaacaaacacaacaaagcaccctaaatttaaaaacctgttttcttaaattaaacctctcccttcaccaatataatctctttctcataaccccattccaaaagaaaagtagaaaccccaagaaaaaataaaaaaaataatg

SEQ ID NO: 21797 - DNA, 3003 bp, Unknown
  misc_feature (1)..( 3003): 2750-1469P.txt file - cDNA_ID_2031499; gDNA_ID_1620581; Annot_ID_161161
acttaccatttgtttcataaatcccgaaattgatttatacacaatcctaaccagttagaaccagttagctgccggtgtgcaactatgaagtccattcctgatcgatatttatatggttataggcttatagcctaagcttattcacctaaaaacaaatcaatggttagctctatagtcaagttttttattcatgtaataattgactaactttaataattcagttatgtcatccattatgtaaaagtgcatcaatcctcaaaatagaaaagttatatcggttattattttaattttcaatatataagatagttaaattttgtgttaaaaatagaatagaaaatggaaatttagtagagtgatattccatattactttattgaacggatgtcagtattgtttgtgctactgctatatatcgtctctaaagtttgtacggatcgaccagtattaatgtactatgtagtctagtatttgtgttagagttgttactgtatcaactatcaagtatcatcgctcatattcaaattcgtataatacatgttgatagaaaggaaaaaaaatatagatgattacttaatgtcacatgtatttcgaccaaatgttcttttatttataaacttaaacgttaaaagagttttcaaaacacattctacctacaatttttcttctttcacgttgttcttaactacagaagatttgatctctacattaaaaaatatatatataacgaaactctggaaacatcattgttcgattggtttctattgcaagttgcatgtagggtttaaaccgattttaatttatatggcacaaatccattattccaaaaaagaaatagaactttatgggtggattgtggtgtaccactactagtaaagttgagaggaaaaaagctagatctctgggatcaagcaaactattaattacataccaaatcaagaaaactaaccttaattgacttttctccaacaaaagatatgaacgtggcctgccatttatatgaaaactttataatataaaaaacatgaacgtggtctggcctgctttgcataaaccaacccatataataaatagtgagaaaattaaatgtaatgataatagtagcaatgtataaatcaagaagtagtttcgtaatgatggacacaacgttttcgtaggtgccagcttcatcaccttcccacattctctctctttctcacctggtacgatcgtaaccggcacgtgcgattcacgtggctcgcaaaaaagttgactttttagctttgatttaatctcaacaaacattaaaaagtttatgatgatgaatgattagtttgctttttcttttgtataacatgagaggttacatgttattgctcatatctttcacttacatagcgcatcgcacgatgatgatttgatctgatatacggtctgatggtcatatgttcagtttttaagctaactagatgagttcaaatacataaaatcataatatatgcgtatagttaaatatatttcaccatagaatagctagctaactaatacatggatcgatgccaaaagtcccaaaactatataagtgacgaggacaccaacaaactattcgtcacgtcgacaaaatttagaacgaacttaattatgatctcaaatacattgatacatatctcatctagatctaggttatcattatgtaagaaagttttgacgaatatggcacgacaaaatggctagactcgatgtaattggtatctcaactcaacattatacttataccaaacattagttagacaaaatttaaacaactattttttatgtatgcaagagtcagcatatgtataattgattcagaatcgttttgacgagttcggatgtagtagtagccattatttaatgtacatactaatcgtgaatagtgaatatgatgaaacattgtatcttattgtataaatatccataaacacatcatgaaagacactttctttcacggtctgaattaattatgatacaattctaatagaaaacgaattaaattacgttgaattgtatgaaatctaattgaacaagccaaccacgacgacgactaacgttgcctggattgactcggtttaagttaaccactaaaaaaacggagctgtcatgtaacacgcggatcgagcaggtcacagtcatgaagccatcaaagcaaaagaactaatccaagggctgagatgattaattagtttaaaaattagttaacacgagggaaaaggctgtctgacagccaggtcacgttatctttacctgtggtcgaaatgattcgtgtctgtcgattttaattatttttttgaaaggccgaaaataaagttgtaagagataaacccgcctatataaattcatatattttcctctccgctttgaattgtctcgttgtcctcctcactttcatcagccgttttgaatctccggcgacttgacagagaagaacaaggaagaagactaagagagaaagtaagagataatccaggagattcattctccgttttgaatcttcctcaatctcatcttcttccgctctttctttccaaggtaataggaactttctggatctactttatttgctggatctcgatcttgttttctcaatttccttgagatctggaattcgtttaatttggatctgtgaacctccactaaatcttttggttttactagaatcgatctaagttgaccgatcagttagctcgattatagctaccagaatttggcttgaccttgatggagagatccatgttcatgttacctgggaaatgatttgtatatgtgaattgaaatctgaactgttgaagttagattgaatctgaacactgtcaatgttagattgaatctgaacactgtttaaggttagatgaagtttgtgtatagattcttcgaaactttaggatttgtagtgtcgtacgttgaacagaaagctatttctgattcaatcagggtttatttgactgtattgaactctttttgtgtgtttgcagctcataaaaaatg

SEQ ID NO: 21798 - DNA, 3000 bp, Unknown; identical to SEQ ID NO: 3837
  misc_feature (1)..( 3000): 2750-1469P.txt file - cDNA_ID_2031704; gDNA_ID_1620669; Annot_ID_48122

SEQ ID NO: 21799 - DNA, 3000 bp, Unknown; identical to SEQ ID NO: 3837
  misc_feature (1)..( 3000): 2750-1469P.txt file - cDNA_ID_2031704; gDNA_ID_1620669; Annot_ID_164030

SEQ ID NO: 21800 - DNA, 3000 bp, Unknown; identical to SEQ ID NO: 3837
  misc_feature (1)..( 3000): 2750-1469P.txt file - cDNA_ID_2031704; gDNA_ID_2926170; Annot_ID_140095

SEQ ID NO: 21801 - DNA, 3000 bp, Unknown; identical to SEQ ID NO: 3837
  misc_feature (1)..( 3000): 2750-1469P.txt file - cDNA_ID_2031704; gDNA_ID_2926170; Annot_ID_199457

SEQ ID NO: 21802 - DNA, 3003 bp, Unknown; identical to SEQ ID NO: 20128
  misc_feature (1)..( 3003): 2750-1469P.txt file - cDNA_ID_2031854; gDNA_ID_1620711; Annot_ID_165439

SEQ ID NO: 21803 - DNA, 3003 bp, Unknown; identical to SEQ ID NO: 21198
  misc_feature (1)..( 3003): 2750-1469P.txt file - cDNA_ID_2032001; gDNA_ID_1620753; Annot_ID_166846

SEQ ID NO: 21804 - DNA, 3000 bp, Unknown; identical to SEQ ID NO: 5540
  misc_feature (1)..( 3000): 2750-1469P.txt file - cDNA_ID_2032139; gDNA_ID_1620801; Annot_ID_168657

SEQ ID NO: 21805 - DNA, 3003 bp, Unknown
  misc_feature (1)..( 3003): 2750-1469P.txt file - cDNA_ID_2032685; gDNA_ID_1972175; Annot_ID_179982
gagtcatacccggacaagttcggtatgttgaaccgtaaacatatcacctatgatccactgactaacacggtttgagtcgacttgtcataaaattcacctagtaaaaccgacaacctgccttaataattaaaccgtcgaattccggtttgtgtctcacaagtcacaaccgtccggatcccttgcccatttactttatcacgtgtttttccccataagtttatattttttattaattgatggacagaaagtttttggttttgggatgaagtcacgaggacaagaagaaatggaaaaggcatcatgacttgtaagggttaacaacaagagatagaggttatatgcttacgcggtcctaagcacgaatactagaagcttagggttaggaccactagagatataatgcaatttggaagtcaccacaatgtttaagaattttatcagcaactttggttgaaaataataaagaagaatctagttcgaagttttctctccatgattttttgaaactgatggaccatcaaaacatctttggcgtatggtggggcctcagaacacatgggccgggcttggttacacatgagaaaattgttgtttttagttagattttggtggactagtataaatggataaaagaagtcgttggaagaaaaccaaattgatagaagaaagaagaagaaaaatagcaaattgttgaaacagggacagaggctgtctttaaggaaaatcccgtatgattaaagtgtacgtaatcgattagtgttcctctgtaagcactaagtcaaaagtaaactctaaagccaaaggtttcaattttcaaacattgttaaagcgaagtctgtccacgagaattagcacatactggtccaccatgttatcaagaaacgccaaaccttttttttgacaatttatagtttttgaaatatttagtagaaatcttttatcttaaggaagagattgacaaaaatagataaataaacaaataagaataaaagattgaaatttttgaaattaacatatatttagccatagtggaaagaaaaatttataataaggttggtatatcaaaaatcaaagaacatgtgaaaaggtttaataaaataaaagctatagaaaattgataagttttgtccttatgaaattaatgtcatgatatatatatatatatatatatatattattgtactttttaattaataatccctttttgaaaagaaaagaaaaatatgtataagaattttttgtagtgttcatattcagttttctagaaaagctaggaaagcgaaagtggcctggcatggttttgtaatttccttttttaatatgatcataaaataaaatatgtaaaatgaaaaaaaaaactcattaacaaggtaaggaataatgagttgacaacaaaacaaaggtaagggataaatgatgaactattcggatgaacatattattgcaaaattcagttatatactatatggtccaacgctactagcaaagtagcaatacacatgttggtcataattattgaaattagttacaatttgcgtgaactttcttaattaataaatatttaatttgtaggttatgggaatgaactggaaagtaataaagttgaaccgcatgggtgaaaagatgattgtttttggctaaactaatgtgtttttatattgctaatttgatcggatccccatatattctcataatcactccctcttattacgttgaaacttgaaacaaaatgctaagctgcctaaaactcctttcgctttttagaatctagaggagagaactaacaaaataataacgaacttattttaagatcttaatatgcgaatatgcgattaccaaaactatgcctatatatcaccgtgagtctttctttttttgggattactttgccagtttgcctataaccatgtcattgagtctatgactacaacatggcattgggtttagatgtagtggtcaacatcttatagttattgagatattgagtccattggtaataaaaaaaactcggttaaagaaaagaaaaaccggtttaaaaacggtataaaacatgtggttgaatgattatgattagtgaaaacaaaaatttgactaaaaaaacttactaaaaaaactttaattagtatacacacaccttgcttccacttaactatcatgaagccatcatcactgggtttacatcggctaagtttatgaaagtgaatgtctctataaatgcttactctctttttaccatacatattagcctagagaagtatgtagagttcaagtttccaacatacattaatttgaactcaatacgtacgtgaaagcaagccttcctacatcaataaagaccgacctactagtttcttcataaatcagatagaggccgtgtttgaacgtagatgcgacttggtgtctcaatgagtgtaaaataaaaacctaaaaaaggaaaaaggtaggaccaaacacgccccatcccttaatctcattattatcacctcttccacacgttacctccctgcaaacctcacgctccttccctcataacacgtgactctcacgctcctccacctctcaaaaaaaccaaattttccttgtaatttacttgaaccaaattcatatattcacctaaacataactaattcttgatctaactttcgaaaattttcaaattaaaacatctcattgattccaaaaacatactttattgttttatatggttagtattttaatctttacgtaaataaaagacgttggaattggaaattactactagtagattgctttatcagaattttataatctatacaatgtaaaaagccgcgtcatctgttcaaaaattcagaagatcagagtcacgcctatatttctctctctcccgtcactctcactcttcctcttctgcttcttattattacatcgatcctcgttgtccctcctctgtttcttcaatatctctttctctccaacaaaatcaaaatcaagaaaacaaaaaagaaaaactctcaagaaacaatg

SEQ ID NO: 21806 - DNA, 3003 bp, Unknown
  misc_feature (1)..( 3003): 2750-1469P.txt file - cDNA_ID_2032694; gDNA_ID_1972175; Annot_ID_179980
cgaatccccagccaaatgttcagagctcacaggttcccagtcaagtttcctcaatacgaacctttgacaatcccatcagttttgggctcccatcgccattcaccataccggtgtactctagtggatccactaccagtagtttaggtttctcacctccaacagaacttgtttttcctcaacccggtgaagatgagcgttttgaagatccatgttatgttccggatccgatatctctactgggacctgtttcagaatcacttgatttaagagctgctgggtatgaaactggcataggacaggtaaaataccaggcgatgaagaatacaccttcttgtgaagccaacaagccatctccaattgagtctcccttgtctagatcacgggctgcggatgaaaaacaagctaatgatggaagctggcaaatgtggaagagtcctctaggccaaaacggtcttggtttagttggtgggtcagcaaactgggttataccttccgaaataagtagatctatcgaggaaagtgatatgcatcacgcgcctcagcatagaacagaatcattattttcaaaagaggattgccagcttcatcaaggtgcttattcacaaaggaaggactatcttgaacatgatcagagaagtggcgttttcagccccattactggtccaaccactactgatccttggtctcagaaaatgttcttccctgcattatctggtattgagagtcctttttctactaccacacaaacaaaaagcgtcttgaacaatgcggcagggtacagaagtccaacgggatctggttcagacaatccatttgaacatccttctcctaatcactggctcaagtaagtcctgaaaacttgttgtttctgtagttttctgagatggcaagacaaagtgtaaatcttgaaaagaagcagtaatgatttggtagaatttgtgaatgtacaggaaggtgaagagctcagggaatgggagtgggaagcaagttttagcggccggtgaagttgagaaccaccaaaaagatgtagaatcattctggtagtcacaaaattaaacaaaatgaggtcaaattttttgcagatacacacacgttgactgtgtctgtctgtctctgtcttttgtcctctcgggtcttcaatggagatatagagataatttagattacattttatgcatttaccattacagtgataacttaatattcaaataaataataagaattaaagtatatttctaatcttgatacgacgaaagttgtttatcatctcgtatcaaacgtagaggcagttgaacaatttaacaaacgaaaatgttcttagattggtataaccattcgtcgaaaactataaagatttacttttatttaaccataagatgatatcatctatcaaaaagtgttaattatagttgatcatatataataagaacaaattataaaggctatatacaaaggaaatttgcgttaattaggttatctaaccgcatgcatccaaaacaaatcatgtatttaaaaacttgatcacaacttgagcaaaatatatggagagcaaagggccatcgccaatagttccacttgtgcttgtggtactcttcggatggttcctatgcggctcgtaccttgtctcactattagaagatgttgtattaccaatcttacaaaccggaacgttcattgtaggaatctttctcttgcttctccttttgcttctccatgtcttatcttcttcttggatctatccatggatcccttctctttttcttttaccatctccggcttccaccacttctactgactccgacagctttggccttggatcctttcttttgctcacactttttttcatctccttctggttgtttcagtcagtgtaattaatgtatattcttcttgtacacaaatagtttctctcattggaatttgtattttcctgattgttcatgcaagatattattatacacttttttacatcttataggaaagaccacttgataaatcatgcaagattccaacatataatgtttttctttttgtaatgtttaaataattaattactgcatcactcatatttcattttgcttgtaaagaaactgaatacaacatatatatatcatctgtgaaaacaagatataagaaaaagaagtaggggtgaaacaaatcaaacacaataaaaaaacctagctagctagctaggatcggagttgcataataatgagtcgatagaagatgttatataagtctccgtgcaaccacctttcacgaccaaccagcacgaaggacatgaaatgaaagcaacaacatgacacagagggaagatcacatgcattgccttgggttttagattcaaattttagggtcagattttgagtactgtaatatgtgtgtttaaataaggtaaaaactataagaaatttttttaagaaacttcttacttgatttatcattttttccaatatttttgtgaagatgtaccaaacatatccaagaaaataatttcaccaatctggtagataatgaatgattcgatatagtatgtatgtgctataaaaacttttatcaatgcttaaacttaaaatagctttgaccatatctaaactatgttataaaataacttttaaaatattctttttttaaaaaaattcttaaaatgttttatatgttatttgaacatttctttgaaatgcccattattagtccattagcccaacaaaccgttggatatatgggtggggcggcgtttaagaggcactgacttgacccgactacccacccggttcgttccttggttccggttttgccttgtaaacattttctttcgtttttcttcatcatcttcttctcaaatctttcgcgtttacggtttcttcgttagcaggattcgaacgaaagccacgagactacgtgattcaacccgaatacgatccgaatcaggattctccttccatcatcttccatccccaatttcaaagctcttctctttttggctgatgctttgcttcaatg

SEQ ID NO: 21807 - DNA, 3003 bp, Unknown
  misc_feature (1)..( 3003): 2750-1469P.txt file - cDNA_ID_2032704; gDNA_ID_1972175; Annot_ID_179977
aatgaatcagaatcctccagttcgtctggtgctactggaaatggtagacatgaccaagaagactcgttggatgcaggagtaagtataccgagtacaactgggcctgatttaagtggatcacctggtgaaacagtgccttcggtttcagaggaacgattttcgggagacgcaaaagacttggctactttgaggatccaaaagttagagatttccgatgatgcaatgaaatctccgtgccttagtgataaggaaagtgactctcctttgaatggtaagcatcattcttttaatcagatgagaaatggagaagttttaaatggaaacggggtggggaaacagcaagagaattcctggcatactggttccagaagagttaaagatatacatattaatgagaatgagaatgagcatgttggttatgaagacctgccattcgcaagtgcagtaccttggccacaggaggacatgcatctccactactcaggtcattgtgtttctggcactccgaatatgctgtctgacctctcaggcgattacgagagtcagcttaacagtttgcgatttggtcgctggtggtttgattatgtccaaaatggtcctatgtctccactatcacctcctgggctgcctcagctgccgaacaacaattcatgggaagtaatgcggcatgctctgccattcagacgaaatgcgcccactccagtaaatgcaaatggagttgttccgagacaggttttctttcatgtgaaccctcagatgattccaggtcctggttttggtatcgaggaattacctaagccacgaggaactggaacatacttccccaatgcggtaattacttatttgcctctctaacatctcttacagacactccgtaaatggccaagcttctaacgtctcctttatgcagaaccattacagggatagaccgttctccccaagaggaaggaactcacaccaagctaggtcgccgcgtaacaatggccgaagcatgtcacaagcgcactcagaaatgaattttcctgacagaaacacccgtgagagacagcttcattatcccaaccaaacaaatggttcatgcgatatgagtcacactgattcacttgatagctttcctgataccaatggctctacaaatcatccatatgaaaaggctccagactttaggcctacagagcctctaccagtggaagtactctcccctcctgaggacagcaagccaagagatagcattgaaggtcatcataatcggccacatcgtccaaaacctagaccctcctcaacacaggaagaacggtacagcatatatctcttacccttaaaaacatattgtcttcactgaattattaccatggatcaccaaagccactatctaattcactgtagtgatgtacatgtagggtaacacctacacagtcataccatttgacggatgatgatgagttccctcctttgtagctctggcctgaattacaaatgcatgctctctagaccgttataggaacaggtatagttttctaacttggtttgtctcctaagttatttgtttttacctcctgcaagcgcaaaaaaaaaaaaaagaagaagaatggagctgatatgttttgggctgtggttctttcttgtatgttatctctggtgctatagaataatttatatgtatctttatcaaactctctggacaaaacctttgcagagctttgtattttctacttagacaggtttgctgagtgtattataggatgtttttttttttctctcagtctctattctatcttggtaattctccttcttgtttcttgattcttcttcctaatggatgataaaaaaaaaagtaacaaggttttggtcattataagttgattccatatcatgtcttcttttagtaaaatatgtcattagttgaaaagtgcatgaaatagtaaagagttttaaaaaaaaataaataacagcttttaatatggctaatgcgttcagtttttgtgattggtaactatcaaaatggtaaggtccaattgttgacatcaaatcgtaagatttttttagggtgagcagaagtataatatcgctattttttccgcttttgtgattggtaacaatcaaaatgataaatcattcattgtgaaaatcatcactgaattccttatgttttgttttggtctatgtatagatttagttgaacccaatgtgacaagtttattattctctcaatcagtgctggattctgcaaatcactttcaaaaacattgaattcgaatattgtaataagaaaaacaaaaattgtggggaggggaaatagtcaaataaaagggtaatggtgtcaaagtcacgcaatcatcggttacatacattactcttacatatcgacatacttaacgttaatcaaatctcgtttgacaaaccatcatcaataaagagcacaagaacaaagaagaaggaaaaagtagagcttttttgggaatcagaatcatcatcgatggtgaatccaaagcgtggcaataggtttttcaaatacagaattgtgtaaattgctctctatcttcttctctttcaaattctcttccttttgttgtattcaataactttttccccactttgatgggctgcaaccacatattcttcttctatctttaacttttcccaccaaacttctccttttttttctttttttttgggttctgggtctgcttttttgttgttgttgttgttgaatgaaggtccgtaagggaagaagacagatgattgcgaaagagcaagacgaatacaaattacgccaacaaggtcttgtttttcaaatggcttctcttttcctctctttcgattactccttactcttcttttggttgctcttccgcgttttcttatacgagaatcacgaacgaaaactccagattttctagcacacctcttctctctgcatcgccatcttgttttttcccccaaattttcgattttttttttgtataacttttgagattctgatagatccggtacggagtcatg

SEQ ID NO: 21808 - DNA, 3003 bp, Unknown
  misc_feature (1)..( 3003): 2750-1469P.txt file - cDNA_ID_2032711; gDNA_ID_1972175; Annot_ID_179975
cgtacagctatgaggcatgtcgataacttgagctgtgactccaagcagatctcctccagaatatctctgcgcaaatgaaaaaatcaacccacaccgaaaaatccaaaaactggtattacataaatctgccttttttcctggtagcaaataatctaatcaatcaaagcttagataaaaactcaaaatcaatgctaaacataccaaatttacatcgatcatcggaacttctgagctcttacgattaattaccaaaagccagtgaatcagaaatttctcacttccaacttggaattttctgcatgtaaaaatcatccataaacacacatcaggcacaaaattactcttaatttgcatatgaataatgtacaaacacgataaagatgtagccatgtcagtactccatgttcagcacagataagacatcagaaaaacacaaactgcagtaagacagagctaaaaaaaacatacgaaatggcttaagctaatcaaaagagatgagagaaatggcgaaaacatcacagtatcttcatcatttcctttcagagtagcaacaatcgaaattgctaaatacaatctaaaagctggttaaaccagtaatgaactaagcaagtaaactcaattcaaaagcaccaaatagagctatacaaaattttcatttgaaatgcaatcaaaataaataccagaaaattctcacatcttataaggatcagttcctgtgtagccaattggtttcgctattgggatcaacacctaaaaattggcaaagaaaggcaagcttcaatctaaatttccaaattatccatcaaatgtcttaagcctatttgcacacagtacctcgcgattgacggcgaagatcgggcaatgctttccgatcacatcatgccaagtcgttctcgactgccagagaatcaatagatccttagtctccgatcaaattagaaaataatctcagctaatatgttaaagagaagtacgaacagagtgatactgccccatcttgctcatccggacgatatctccaggtcggtaagcgctggagagaaagggaaatgatagagatatcagaactagagcttgaataaaagcgttccacggtcgtaatcctgccaccgcagccatgcccgccataactccgcttcgttggcgaggtttctccgtgaaatttgccggtaattttcttcgccgggagatttagaattgaagcggaggatgtcaaatgtgagaactgagaactctcatccgtgttattattgggccaaaatatcaggcccaactttattgtttccaactcagttttgaccaggtatagggcctagtaactgatatttgttttggtcggagggcctggtaactgattattgacgaaaccaaaaaatcaacttatatcagaacaaaaaaaaagagacatggtttaacatattttagtgatgtatataatttcgttttaaatcattaccaaaaaaaaaaaaaaaaaacacgaccatctgatctgtagctaaacggattgtgttatgagattttagataagaaaattttacacaaagtattagaatacattagtacattgcttcctaattttgatttaaaagaccgtgttatatatttcgaaatagaaaagtattcacaaaaaattatgaaaatatagtttcggggtgaaatgtcgttgttataacgactaaatgttaaaacaaatatgttttgttatatatatttaagatataacgatgttcatttttggactgttatattcacatcagtaaaatctgttgctttaaatattatacataagtttttaatattccatgtaaaattcttaaattttgattttgttttgcagattttctatattgttttgttctgtgtataacaagattttgatttttgttttcaaaacgggactaaaattagagatttttatatatttttttttccaaaacaaaacgtttactagatttttgtaattggagttttcaatttaaaattcttttatagaacaaaattaattattaatttatctaattattggagttatttattttgttttactaaccatatcattatatgtggataccacgtcaaaacaaaatcatattcgagaataacaggtgatcaaatttctggaacacgtgaaacacagttggatccccttataacttaactcgaataaaggattttgaagacaatgattctcaaatgttacctttttcgtttttaaaagcataatcagttatgataatcgagcttattcaatagaaaaaagcgcgactgcgttagttaaatcataaaaaaaaatttatatttgttaaggtacatgagaatttagtatgtcatagaaaaaaaaagttaaaagtttctaactttttgaatgataaaaaagataaagctaaaccatgaaaacatgtattaaaatctttgacatttctcttaaaacattcataagaatcacaactctataaaaacttaatggaagaatatctgaactttacaatttaaccaactatagtgaaatcaaaattctgaacaaataacttcccaagtcactctaatcaaacttcaaatgatgtcttaagaatttaatgctggtcgttgtttctaaatactgcatcgttaaggtaaataaaaaggtacacaaaaagagcgacatctaaaagggtttcaagttgcatacacaaagttaagacaaatttgttttttttttttttccgatgcagtgaaaacaaaaaagagagagaagaaagaacaatcaaataacacaaaatcggtcctcaacagtaatcacttgggatctttcaaaacctagaagaaaaaactcatctttcttcttcttcttcccctgagacatctctcgattctttgtactcgcttgttttgttcgaactcaatcggattttcaatttcctgggcgtagtttacaacgaactgattccttggtttgatcaatcggtgtgttcttgtatcaatcgatttttttggttagtttttaggtttttgttgtttttcatg

SEQ ID NO: 21809 - DNA, 3000 bp, Unknown; identical to SEQ ID NO: 9718
  misc_feature (1)..( 3000): 2750-1469P.txt file - cDNA_ID_2032744; gDNA_ID_1972175; Annot_ID_179967

SEQ ID NO: 21810 - DNA, 3000 bp, Unknown; identical to SEQ ID NO: 9737
  misc_feature (1)..( 3000): 2750-1469P.txt file - cDNA_ID_2032781; gDNA_ID_1972176; Annot_ID_180011

SEQ ID NO: 21811 - DNA, 3000 bp, Unknown; identical to SEQ ID NO: 9738
  misc_feature (1)..( 3000): 2750-1469P.txt file - cDNA_ID_2032789; gDNA_ID_1972176; Annot_ID_180009

SEQ ID NO: 21812 - DNA, 3003 bp, Unknown
  misc_feature (1)..( 3003): 2750-1469P.txt file - cDNA_ID_2032791; gDNA_ID_1972176; Annot_ID_180008
tcttgcagagacagcttcgcttgctttagtgcggtcagtacagtttcacaagtatcaggcttcacatctttcactgaaactaatggatcatctacttcatgaatggtagtggtagtactgccaaagaaaccacctctcgagtttggttgcgttacaggaggcgaccgaatagttgatgaagaatgctcattgatacctttactgctctgtggttgggaatactcacttgtagggctctcagaaatatgttttcctttgtctcgagaagaataagcatcttgttccacagatctggaaccacaactattgcagcacttatcaggtgacgttactgaattatcaggtgaaccatgcgacaaagtttcaaacgattctctaaagtcaacttcattagctatagaccttgtatcacggagtgaagggactactgtagaaccttgaagtggagattgagctttttctccgttactttcatccgtcacatctgaatggtttccaacgtcacataaatcctgaaagattggacaagaagtattgttcaggaattccagtgaattaagcggagactaagttcaacctttgtgaactaagatatcttcatagataatgtcttcagaaacaatatggttatataacagttaatacaaagaagaaaaaaagcatacatttttcataactttttagcacaatggagagaagacagaataaaagaatcaatgtatacgcatgcaaaccaaatatagaaaactgcagcatatgcacaattatcaacgccacataaaagaaactttgttggttgattcatataaacacgaaatataccataatcacaattgatgaaaacaatttctaaaggtcaaagcctgagatatagggcataccagggcagatgatttattctctctgaaatttttctcccattccctttgagtctcttccatttcttcaaaagatccgataacttgagcacggttttctaacgctctctccaagttgatgtccgtactgtttcccttctctaaaccatttgaatttgacaacttgttcaaactatcgtctcccttcacaacagcaacatccaccacggttctagatacttgatcattcttttgaggaagcatttcagtgcgaactccattttcttgaaattcaaccggatttccatctctcttgtaatcctcagatacatttctggaaagttgaaaaatgttggttattctattacacaacatacataagcaagctttacaattgctttactaataaagcgatttatgatgtatataattagagagacgatttctaagcatataaccttcaatctcaaatttctaagcactgtgtttctaggcaatgcttgcacaatttgtaatagtaaaccactcataaatcactgagcagctaaagataacaaaacagaccttgcttcaccacgtctaatttgccgacaagatcttccttgacgatgtctcggtgaggaaaaataagcacactcgaaacctctgtgatgtctcctattccggttttccttgatcttgtcagaagaacctggttccctcctgcgacctttccaggacaaacttttgcctaacactaaaaaacaaacaaatctccgacactgagagttgctcaaatctcattaaacccatgaatcagaaactttcctcctatcacataaaaactctaacctgagttactctgagagtagcattcatgatcagagtttgaatcataatcatcagacacatcattatacccattttcctctaagatcgcaagaacatcagcagttgcctgttcagccttcttcctctgtaaagatacaatcttgagctgttcctctaactcagctacctaaagatattaagacaggacataagactaaagaacatttcactggatcatccctacaaattataaaagaacatactttatcagcgagaccatcaagctttgctctagcactcttggaaacagctctttcagctaataaacgtgcacgaagaaactcaatagtcactgaagtaggatcttgtgcctctgaatcaatacacctataaaaatgtaccaaaacccaaatctaaatttcgattcgcaaaacgatcttattcatctggaaaaaaaaagacagaactataccgatgatgatctaacttgtcttgattcgccatcgtgtagacgaaccaaaagatctacgaacttcgaagatcggtgtgaagaagaagacgtctctctctttgcttacacaagtcaatgaagatagttttttttttaatctttcactaatgtattttactctcttctcattggttgtaagtatttactaatttcgattttatacttttttgtgtagtagacaaagtcatggatttggattgagatttacagaaaaaaaaaagtaaaaaaaaaaaatgtctttttcagaataggagtaaaataatataaatagagcggacgcgaaaaataaaatgaaatagagtttaattggaatctttaggttacagggattattttctctttccttcttcttcttcattgttctctctctctctatctcttcttcttcttcttcttcttcttcttctttggattttgtgagctaataaacagagaggaatcgccataaaaaaacctactttgtctttcaacaccgaaattaaaggaaatctctttttctctattgagcttttttcttcagcggtgaaatctcccttccttgtctctcagtagtgatttttacatacagctccgctctcaggtttcttcctcttttgattctgtttccgctctttttgggtttacttcggattttaatcttcagattgacgaaaccctagtttgattttggtttcagaaacgacgagtcttcattgatttggtttccccaccagctcttcttcttctttttttgttccgagacctttttgacggaggtaggtacggagggaatctggagttgggtttgaaggatactcttatgcgattcttctggataacttgatg

SEQ ID NO: 21813 - DNA, 3000 bp, Unknown; identical to SEQ ID NO: 9735
  misc_feature (1)..( 3000): 2750-1469P.txt file - cDNA_ID_2032797; gDNA_ID_1972176; Annot_ID_180007

SEQ ID NO: 21814 - DNA, 3003 bp, Unknown
  misc_feature (1)..( 3003): 2750-1469P.txt file - cDNA_ID_2032805; gDNA_ID_1972176; Annot_ID_180004
tataaaaggggggatggtggttgagaagattccagtatttacctaaaatccatgtcccggatggatttgtgtgcctttggctcatccaaaattacacttaggtttggccactccataattctaagacatccatcctgaaaataacttgtagtaagctacaactaaattgtcgcaacagtgaaagaaaaaaatcccttatattgcagttccttaccactcccccaacagctaatttagacccatcaaagctgaaggccatacacttttgtagtccagcattttggagaggaaggagttctttggctaagatcgtaatacctgttgctcctccgacaagctcaaataacctgaaaaccaaataaagttttaattaccatctagaccgtaaaacaaaatttgtatagacaatggggtagacagtgtccaaaaatggttgaagacaactcctcgtatccatgaaataagtggaatagtagagttgctaaagatgaatgcaagaaagggaagtcaaaatattatgaaagagaccaattataaaaggcatcggcaatctccaacaaaagtataggcatatataaaataaaccaaaccttaaacacaagaaattcaagcctcactacaattaattctacatcagcaaacatgggaggtgggagatcgtctgatgtaatgagagaagtaatgtaaagttctagtaatctgatatctagttctcatcataggtttaacaataccaactcaacaaatttagaaacatagtatcagaggaaggaactgtaggatgtctagtaatcataagttttgggtggtaaaagcagagatagaaacgtacttgcaaccacctttggaggttgagcaaacaaagtaatccccaccagggtgcactgaaacagccacaggatcaccatcactatccttaagcgtgtgtgttgcctttggtcaaagaaaaaagagaaaaaaggttggtttttttatttcattagtccacagaagtaaacaccaaaagaaaggggctttgctctgctttctcagaatcagaagaaaacaacttgaagaaccctagatttattgcatgattcagaagaacccaagtttcgcaatccaaagaactatagtagatttcaccctaaacccaataagatttcgaagctctcgattgaaaaattcaaaaggtgtaagaaaaatttaccaaaggagaggaggaaagagaagcagtaatggggtcaaaagagaagatgttgaggagagcaggagaagaaacagatgagccacggcgtttggaagctttagcgataagaacccagtttactttcttcgggcgacgaatccatgatccgcacacaacatgtccactttcacgactcgcttcttcaatctccattcgttgttggattgattgttattaatttcctctttggtctctccctaatttggatccttaatatatatatagacagaaaattgtttttttttgtgtgtgtgtgtagttgttgttccagagtagagaagaggaaaacagaaagtaaaacaaaaaccaaaaaggagttgactttggaaattggacagagagattttgttgagttattatataatgggattgaaaaatctcagatttaacaaacggacatttgcggtggtgggaaaggatattccttaagatccatgttccgatgccgaatttaatacaaacaagttaggtcacatcgtgcttccgtaatctatagcagactttcccattggtgtcaatctcgttgtttaaaaaaaaaagtaatattagaaaagattgaacgtaatctgaatattaagaaaaaggataaatatgaaaagatatgatgtaaatatgtaatcgatgcatactcttaattatgcaatgtaattctttttttgtgacattaatacattatatatcctttatcttataaaacacaagtcacttggcaaatcatgttttgacatgtggcaaatttatcaaaaacaaaatccacaatgtaaaacaaaaatgaatttttcgacaaaactcaaaataaaattaaatgtgaaaacagtgtacaaaattaaaacattatcgtcaattttcccacgatcactctcaaaagaaaataaaaatcaacccacatattctccatactcccacaatttctttttcttctattcaaactatgtaactcttttttttcaattaaaacattcaaactaactattgggaaacaaagacagatacgatctcaaacctatatatacaaatctcggtatcatctttctattgttgatattggtttttaaaagaaggttgagagtaaaatcatttaggagcgagaccttctttgtaacaagagtcttcaatctctaatcagttcatataaggcaatatggccagcgtatgttatatttcttttattttattgattgcgtttagatgagtatattaatgctttctgtttttgaattatcttttattatgtatgtttaatatctttttgcttcatagatcaaccactaaaaataaacaagcaaacttgatcgatagaggataaaacacaaacaaagtagaagacttgagcaagaaaaacaccaatggcaaagtagtaggaggttgaagacgaagtagaagtgtacaacattaagacataaatgatatcatctatgtattgagtcaacttcactctggtaacttttttttgtctatgactataatctatgtttgtattgagtctttgaataccatatgtaattttttattttatagcttttgtatgtattctagaaagcattgaagttggaagctaattctctatatttggaagactaataattttgtgatatcaacttcaattctccattatatatcaaattatcatctgaaaaaataaaatccacaaatacatgaaacgatatatttttccctacacgattatatactaatctatttataaaattaatttttcatgtataaatatcgataatatgtaacatatcataacatttaaattcaaaaaaagaatg

SEQ ID NO: 21815 - DNA, 3000 bp, Unknown; identical to SEQ ID NO: 14520
  misc_feature (1)..( 3000): 2750-1469P.txt file - cDNA_ID_2032898; gDNA_ID_2684126; Annot_ID_137200

SEQ ID NO: 21816 - DNA, 3000 bp, Unknown; identical to SEQ ID NO: 10720
  misc_feature (1)..( 3000): 2750-1469P.txt file - cDNA_ID_2032973; gDNA_ID_2213670; Annot_ID_132762

SEQ ID NO: 21817 - DNA, 3000 bp, Unknown; identical to SEQ ID NO: 10720
  misc_feature (1)..( 3000): 2750-1469P.txt file - cDNA_ID_2032973; gDNA_ID_2213670; Annot_ID_182267

SEQ ID NO: 21818 - DNA, 3 bp, Unknown
  misc_feature (1)..( 3): 2750-1469P.txt file - cDNA_ID_2032973; gDNA_ID_1563882; Annot_ID_148455
atg

SEQ ID NO: 21819 - DNA, 3003 bp, Unknown
  misc_feature (1)..( 3003): 2750-1469P.txt file - cDNA_ID_2033129; gDNA_ID_1972067; Annot_ID_178406
aacggcttcttcatcacaaccgcaaacaccaacttcccggcaaaatccatctcgctctgcggtggataggctaaccactcgaactcttgaaccatcctcgctatcatcaaatgcacatgtaccgtcgccattcccatccccggacagatcctacggccaacaccaaaaggcatcatcttcactccagcaactcctgttatatcggcgtcttcccgccctgataagaaccggtcagggtcgaacttttttggctctgaccagatcttcgggtcttcactaattccgggaagataaaactcaatgttgaccccgacagggatgttatagccagagagagtcgttggttccgttacaccgtgacttaatgtaaagtaagtcggtggatgtcgccggagaatctctttgactacagcttgtaacaagaccattttgtccacgtctctttcatcgaccgcacgatctccaaccgttgatttaatctcatcgtacagtcgagattgaatctcgggattcgctatcaactctgcgattccccactcgatcgccgccccagtcgtgtccgtaccggcattgagaaactccgaacagagcgttacaagatcttcatcagacggcgtcgtttcacttccttcgatgattctaagatcaaagagtgtatcaagatacgagaaagacgataccgttgcggtccgaatcgccttccgtcgtttctcgatgaatccgacgacgaaatctacaagttcccgacgaagcttaagagcacgatttctctcattgtagttaaacggcgttaagatcggaaggtaatcgtggagttttggatcaacggcgtttaatatcgccgtcatcaactgatccatcttctcaattgattcctcttccatctcaactccaaaacagatatctaataaaacacaaaacgcagcgtatctgctgttttgcagaacccagacgagtccatcgttgtctctagcttcagatttgattctctcgatgagtttatccatggcggattttctaacagaaccaaactccttgagccgattcgagctaagcatgttctgaaccatgttccgtctcaatgacctccacacaggtccatacatagcggaatgaactgtgatttcactggagctgaagattttccgggtcggagtttcaacgggtcgggtcgcgaattgtgctccacgttcgattaacgcttcgtgggcgagactggcgtcggagatgatgatcattgttcgagtaccaagcctgagagtaagaatcggaccgtagatctttacgagatcctcgacgtactcgaaaaactgtttcccggagcgcgtgaactgaaataagtttccgatcaccggccatcctggtgggccgggcgggagatttaaatggttcgaattgtgtttccggtacgtaatggttttaagtaaaccggatatgataatcgctagaatggttaagaagacattactagataataagtccagagaaataggagaaaatgataagaatgacatttttaaaaatcttcacctcctctagtgttttcttttagcttcggatgaattgaagaagaagaaaagaggaagctttataattataagactgaaatatttttgtagtaggcaaataatttttgttaggttaatcgtcaatgttataaagccgtaacggtcgttacttgacttgtaaatcttaatttgatgtttgttttcctatttcttcgtataattatctttttaacgccttcgcattattgcttaccatttctatttgcgatatagtttcatttatttacatgtataataatcatattagacgtgtatacagcatgttatagcaatcggttatatgttatatggagtataaaatcattacttagaaacagttagacgttatataatctgatggaaattgagaatgggctcagcattatatggaaacgtttcttataagttactgcaaaaaccacgcaagattgattgcttaaaaagctgatttggccgatcagctcgagaggataacgagttacaatggttgaaaacatataacatgttgtagtgttttttaagtggtaagaggaggcaacatgctatgtgttatagaatattgacttagttaggttttaaagtggttataattttacaaattagtaccgacatatcttttggattgaagtggtacatatgtattgaggaacggacattcgaagagcaccgggaaatggtgcaaaaagtagtgtgtgctttttttttcttttacttttttttttagtcatgtattttctattttcaagtattccggggtttagtgattaattttaatatgctgaaattattattttttaggtaaaaactaatgagaaatatactattataaatcaagggggaaacgattgcggaatttttctgaaccgacagagtgttgcaggtaattttggtcttttataaattcaacttggataattcaggtgacatggctttgaagattattgatgttgatgtttaatacaattcaaattgttgataaacacctgtggattatttagtagtttgtgactttttgttgttaagacggtgacatataattgtgcacaactagagataagttcttctaccgtccaaaatttaactttatataagaaaaacatttcgtacattatatctaatacgaaaaacagtattttgaataatttaactttagttaaatttctaaattagcgttaagataaagaattattatggaaaaatattttggtaaatattttgattgacctcagattattttgccttgattttttttttttttggttgccgataaatacaaatagataacactaaacaaaataaagtacaaaaggaaaaaaacgacaacttcgtaccaaaccaaaacagtgtcgtattaattgattggtgtggcgaaacaaatccgtcgttttgctccgttgatcggcaggtgatcaccagaagcctcgtcaccgtctctttctctcccccctttttcatg

SEQ ID NO: 21820 - DNA, 3003 bp, Unknown
  misc_feature (1)..( 3003): 2750-1469P.txt file - cDNA_ID_2033137; gDNA_ID_2214468; Annot_ID_182913
tgtacacaaactcgctaagctagctgtatatttatgtaattaattattacatttgctgagtaattttacggcaaaatatgacatattttggacatgccacgtagaaaagcatgtgatgatgatatatactgtatatagagtagatctgtgtaagtgagtcagtggtaatatctaactaaaaaagtacagaaatggaaagatctatatgatctctctcgcaggatctcaatctctggcccttttttttgtcaacccttcttcctctcttattatgttcttctctctcttttcttttggttactgtaatttgtttttttgtttattgacattgacacgttttcttgcttcgatttttacggaaagagagatatgtatatgaggaattaggataagtcgatgtaattttgtaaggccacgaaaccatacgatcacaatcaaacaatctgtagcatttagaatccatcaattataatcgatgttgaagtttcggtggtccaatatacttacggttgttaaaactttggccaaaacgaatcgtctaaaagcaataccagatttaaatggaatgtaaatggaaaaggaatcgagaaataagaacaactgatcttaaagtctcacaatgtcctacaaattaaaaatgcacttgtaataatagtaataataattaattatattaaaaaaactccttgcaataaaatcataatttatgtaattcaaaatagatcttgtctgaattagtttcaacatatttcctagaaatgcaaagattaatgaacaaaagcaggacatatataataaatcagattagagaacttctagatctagttctattacttagtcaatcgattaaaagttctatacactcagaaaaaaaaggatatatattcataatatagacagtttaacaacttgagttgaaggaaagattctcacatatattttcgaggcataagacacgatggccctaccattacaggatgataacaaggaacgaacattgtagacacaagaatcactgttacaggttggtaacaaagaaaacgaacctaaattgataagaatgaacgtgtcttttttttttttttttttggcaatccaaattttgttgcatatgcataggattccaaatcatttctgtttgttcttttgtttcgaccgtgtttttttgttaactttaaattatataagttagatgcataaaattagtacacacccatatagaagaagacaaataatcatgtgtctatcacatgaaattaaactgtttgagtatatatattagaccggaatttaatatgtaattttactaattaaaaaatgctttcaaattcgtaataagtcgcaaatcaaatttcgttgttacatttttaaaagaaagtatttcttcttttcaaggaaatattttttaaacaagatcaataaaatacgtattctaaatatagattaactctcttgttccatgtgtatctgtgtttggtgatgtaaagagctcatttacagacatttctttttcttgtaaagcggatatattgtaatgatcgcatgtgaaacgtaattacgtaaagcgacatgcaaatctgagttatggtatattaattacagtttttgtattgacgtgaattttaaaaatgaatttgtttagcatccactgccgttttaacattttattcgttgtaatgtacaatgtcgacaaagaaagcaagtgaaacgtaacgtgcatggcctccaaatcatgaacttattcgtaaaatatcatttctataataatatagtttagctatatatcgcaataataaatagaaaaaccataaaattccaaagaatatattaccaatcgacaccaaaaagtaaagataagggtcataatgggctctcccttggatggtttagaatcttcgtaaccaattgtctccctagtccctattatagctttgagagatgaacgagtaatactgtatcaatcatacaatatatatatatatatattaatttgacatatatattagagctaaccaaaaacaaatatcgcaatagcttagattagtgaatgatagttaattgttacatttgataactcattattagaccgccaagagtcccatcaaactagcaggttcatgcggccacgccgggaccaagatctggttcttttatttcccataacaagaatctttttcattttatttatattatagagaacttttaaagcagtctggttatgttggatctggaggaaaatcaggaaagtacatttgattttttaaatgtactcatatgaaaatgtaaacaaaacatgaataatcctttatatatgggagtgggacctagattttttttgttgctatttaacaaaacaacatttctccaacattctgaaaaacaggatcacttgttttgtttcactgtacagtagaagagttttcactaactagtaaactaattaattagtgatttttatttttttttaatcaactcaggcctaattgagataacttgttcgtgggtatcaggcccaatataaagtattctaaggcctactcaataatatctccaatatttttattttcggacagatcatttatttatttttgtaatattttgttttttcttctcgtaaaaccctaaaatatacaaaaccctcaaattcagtctaccagcgaggatcgatgtcggagctcacagtatctcctttcacgcattaactcaatttatctgctaaaccctaaatagcttcacgccgtttttctaattctcaatcaaagcttcaccgccgccgtgtgttgttctttctccgagtcgtgttctctaatctcaggtgaagcttctttcttcaatttgcctttggtttcgtttcgaaaaatcatgtcttttctaagatttatctccggtgctaatcagaattagtcggtatctaatgggtttctgaattatctgtctggtttggtatcagtgtttaattgtaattgagttgtttggttcgtttaggtgataaggatcaagatg

SEQ ID NO: 21821 - DNA, 3000 bp, Unknown; identical to SEQ ID NO: 9300
  misc_feature (1)..( 3000): 2750-1469P.txt file - cDNA_ID_2033137; gDNA_ID_1972067; Annot_ID_178408

SEQ ID NO: 21822 - DNA, 3003 bp, Unknown
  misc_feature (1)..( 3003): 2750-1469P.txt file - cDNA_ID_2033414; gDNA_ID_1974077; Annot_ID_180420
ggtgaccttctagataaaggtcttgatgagcttaatactacagctgaagatggaagtgtcgatgaggtatttcggaatcttacgctaatttcgtgattctttctttaatggggactgataagttttggtttgtgatgctactaaaggtggcgaacttactagtagatttgtacgaagattgctgtaacggtaactatgaaatgcttgaggaactaagggcaacttattctcagacgagtgcaagtgttgtcaaggttaggttctttctactacttccgatactgtcttgtccctttcactgagtttgagctcatgtcaagtctactttggtttggtttttaacaatctagttaagatagtttccgagagttagaattgaggctgtttagtttcttataccaattatggtgtttcaggtttcaaacggtgatgacgaggaaagtgatgatgaagatgatgatcaaaccactgacatgatggtggatgcgtctaaccagaaacaagaagccatgcctgttgatgaaccagtagccgatgatggttggacggttgtttcgtctagaaaaaacaagggaaagaggaattaacccggttttgatccccaaggtgttgtgtaatttgaacagttttgtttgggttgctttgtttatttattttgataatattatgatagtatgacttgtgtaccgtcactttataaactaaaatcataagattgagttttcacatattaatctactctcacataataatcttatgatcccatctttgacgcctaaaaaaagactcttaccagttatcatctcctccgcttcaagataaatgtttttttttctttttaatagaatgtaaatattcatttcagtggaaagtttgagttacacaattaagcatagccatagtcaaatatggtcacacaaatatggtcacatgccaaaaaaaaaaacagaaagataaacagcatggaagcgtaccaccttcttacaccaaatgatcaagttggcttgtgggtcgtgggttcgtgtgctcttggggctcgccgagtaattttggaccgtggattggcttttgagagttgaatcttatggaaatattctattttggcaacaacttgggaatcactacaagtaacttggggaatattctaagaatattctctcgaaacctacctcctctactatataaagaggcattcgtctctcattatttctcaagctgtcaaacagaaaatactcttagttctaaattctcgcatctattatgtttcttaaaagtaagttcttagtttagtagttttttagaatatatcgtagattaagtttgtttgagcctattattgtgtgctcgggtataagtttgtaatcggttgtatctaggaattcataaaccgtgattgtccgaaagcacttatggtcgacgatttattgaattaagaaaaaagatataatatcttgtttatgtgatttactttttgtctttaaatacagttgttgtaattcgttgttcataccgttattttaataaaattggcatcttttctcaatttggttttgcattcttacaattttattatggccgattaaatgaattaagattgtagaagcgcaaaaacaaagttgagaagaaaatacaaattttattaagataacgataacatgaatgaattacaacgactgtatctaaagacataaaataaatcacggaggcaggatctgctatctttttctttaatttattaaatcggctgtaactactttcagacaatcatgatttatgaatcccaagatacaaccgacaaactaatacccgagcacatgagtaatagactcacaatgactggatctaaagacataaaataaatcacggaggtaagatctgatatatttttctttaatttattaaatcggctgtaaatactttgagacaatcatgatttatgaatcccaagatacaaccgacaaattaatatccaagcacatgagtaatagactcaagcaaacttgatctacgatataatctcgaaactattaaactaagaacttatttttaagaagaaagagagaggcgagattttagaactgatagcgttttttatttgagagcttgagaaataatgagagtcaagtgcttctttatatagtagaaggaggtaggtctcgagagaatattctccgagtactccccaaattacttggagtgaactccaagttcttgccaaaacatagaatatttttgtaggatttaactctcaaaattgggcctatccacgatccaaaaattactcggcaaggcccaagagcccacaagcctatgtggcccaaaagtcgacgatctgatgaccatccctcgtgcctagcttggttcgatttagcccaagttactcactttacaccctttttctcatataagtcaactccgtttttgatgtatgagtataacatcttgcagtactcattaccatatttccattgcacaattgatctgacaatttcgtttggcaggaattggcaggaaagccgccggaaagtcactttttcaaaaacagttccaacaaaaccatatagacaaaatcttagtcaaccaaaaagattaataaaattatacaagaaagagatataagcacaatctacatatactaattattgtacatcaaactggattaggcttattgtagcgttacacgcaatatactattttttcatgttttggtattttattagattttagtaaaatatctatatttatagtaaaataaataaatagtaaagtatactatatattaatacatatttatagtaaattaattttatatatagtaaaacatataaaaattaaatgaaaaatgtaaaaaatggaggttccttttcttgagattgaaatgcaattaataaataatagtcaacaatattcactatttcctctatataagaaggccactagctctaaccagattcaagttaatcaaaatgcttgtgtggaaaccacactagtgaaagagatatg

SEQ ID NO: 21823 - DNA, 3000 bp, Unknown; identical to SEQ ID NO: 5771
  misc_feature (1)..( 3000): 2750-1469P.txt file - cDNA_ID_2033485; gDNA_ID_1974077; Annot_ID_180395

SEQ ID NO: 21824 - DNA, 3000 bp, Unknown; identical to SEQ ID NO: 5771
  misc_feature (1)..( 3000): 2750-1469P.txt file - cDNA_ID_2033485; gDNA_ID_1620816; Annot_ID_169271

SEQ ID NO: 21825 - DNA, 3000 bp, Unknown; identical to SEQ ID NO: 9837
  misc_feature (1)..( 3000): 2750-1469P.txt file - cDNA_ID_2033821; gDNA_ID_1974083; Annot_ID_180473

SEQ ID NO: 21826 - DNA, 3003 bp, Unknown
  misc_feature (1)..( 3003): 2750-1469P.txt file - cDNA_ID_2033838; gDNA_ID_1974083; Annot_ID_180468
tgagtacacaatttagggttattcctcatctctgcgctcaccactccctcggcatcttccctcgtcacagctctgtctgccgataacttccctgctgcaccctatataattcattcggttcgaaaacatttagccactactttaaaaggaaaacatcaaaaacattgatgaaaatgttttgaaaattagggtttaaccgtcaaaacatcacgaagcttgattttcctctcgtcacgatctacggtagcgttgtgatccgctgcagattgagctgaagcggcgactccagctagagcaatgacgttggtaccggaagctctcatctctgccgcttgaatcgctgcggcgtcgctttgatccacaggtttgtttccagctgtcttcacagttgcttccagtgcttctccaatcgttattgtactttgcaaagcttcttcgtccgtacgcgcagcagcgactacacgcctcggttcaacgtgttgtccaacgacctaaagcttcaccattactccaaaacaaaaaacggatatatgaaaagaagtactagtacttttcgaaacaacttgtgacctgtccaccgacgaattcggttgtgacagttgcagcagggaccgtttgctccactgtggcgcctcgttcagcgacaagctcagttttgtcatctggatggacaaagccaccgcgtatattggtggtggctgcagattgcatgaccgcagctggaccgcctttctgagtatggccgaacacatgtgtctccgcggattgcatcatctttgcatcctcaggtgctatgggcttatcagcgagttcaccggagacttcaaaaacgtccccgtatttgactggctctcttggcctccttggttgctcttggctcatctttgttttgttacgttaatgttctgttacaaactacgataactcctacctgaattgagtgtctattatataaagagaggtgcatgagtatgggatcaacgttctgagattttgacacttactcgtagatgaggtgactaggacactcgtgtcagtttgcgagtttgtagctaaaaagataaagcttagattgagatagggattttacttttctttttgtaaatttgtcatttagttttaagagtgaatgaaaaaggacatgtttccaacgttaccacatatgagtcgtataacattggacacgtttgtttcaatatttgtttttgttcttgtagacacgtttcaattttaagacaaacataacagaaaagtcaaatgttggaaacaaaggtcaccaatatgtcggaagtcaaataacaaatctttgtcggtctaacaaaactcataaacttcccctaactcttcggatctctctagatccttgtttttcgttgccttaattatctttctcttctcttatttcatgttagaaaacagagtatacaacagaaaacacaatcgtttatttttgttctctgtgttcccatacacaaaatcttccagcttctgtttctccgttttgttcaacggagttacaaagcggaagaacctttgccttcggcctgaaagaccaaagatatgggaactggtggaataacgtccaacgctcacgtggtctctcccacgtggcatcacaagcacgtgcctcctatggatgacgactctgttcttcaaagagacatcggagagcttctttcacggtggggcgggcttcaaatggccgtaaagaaccagtggggaggccatgattctctcaagaaatctcaagagctagctcacaatctttttcatctcatctctcaatcaaatggttcgattttctttttacttctttagattttatgttatgatcatgaatatattgatagtttgattccaacattatgatatgagcagtgattacggtggaagaaatagagaatttgctacatgaaagcttgcttctttctttcaacacagagattgaagatggcagcattgaagaggtacgtactatttcttgaaaatgtagacgatcaatttacttgtgaattatgtcgactaatctttcatcgtgtgatttcgtcaggtagctgaacaattgatgatactccatgaagaacatttacgtgggactctttaagcagtagcttgaacgatttatatcatttttggtgtataattagatcaatgtaagatacaaagaattgaaaattgggtggacaacaaaatattattcatcagaaatcatagaatataggaatacgtatcaaaatctatgtttatttgatgtaatcattttgtagttgtgatgaacagtttttcctaatgtaatttcaaattaaccagtaagacactccatcatgattaatgtggggaatatggaccgagtgaccgataccacgtagaaaatatatatctaaattttccaatataatgcaacaaaattcatattgaagcaaaaactccatgtaatttggattcttgacaattttattatggtcaaatcatgtgtgtaatatgcaaataaaaactagagagatggcaataacatcattagtatgaaccactaggctataaattggtcaaagtagaaatggtgcaaatgaaagactaatttacgtgagtgcgattacggtaaaatcggtcattaaagacaaaaagacttaccgtacaacaagtcatttacatgaaaaccaaaaaaaaaaaaaaaaaaccctccaaaaagggattgtccaacataagggcacaatagtcaatttcaagcgattcctcgtttattcgtgtttcatcttgatctcagctagaggaggaactaaaccacatctacagagtcagaaaataaaaagtagaagaagcagaagcgagagtgcaaaaaggttagatctgctttcaaaattgttcgtactgcttctttaccacataaagttcatagctttttacgtttctaccgataattttgcattccgaattctccattttctcaattttgcttaaatgggtgtttctcttctgcaggaaattaggttttgagtggtcatg

SEQ ID NO: 21827 - DNA, 3003 bp, Unknown
  misc_feature (1)..( 3003): 2750-1469P.txt file - cDNA_ID_2033897; gDNA_ID_1974091; Annot_ID_180617
cagcttatcccaattactcttctttatcccaaattctctttgatttcttgctacttggtcttctccgattagatcttcgaatctgtttctctcctctccgggaaccggtggctacgtcatgtgtctttctcatattccggcaatcctcaagaggaaatctagaatcctccatacatttcttatttccttactagggttttgtgtgtgttggcaggtggaagctgacgaagaacaacatcatatatcattcaccaagtaagtaatgtaaagtaaagtagcagctctatttattttctttcctatgattgagatgaaaaattcgattgttgttgtgtgagacagtggtacgagaaaaagatatctgctgggaatacgcagagaaactagatggtaacaaggttaaatgcaagttttgctctagagttcttaatggcggcattagtagattgaagcatcatctctctcgccttcccagtaaaggggttaatccatgtgccaaggttagggacgatgttactgatagagttcgttccattttatctgccaaggatgatccccccattaccaacaagtacaagcctccaccacctttatctcctccgtttgatgctcctgcgtccaaactagtctttcctagttctcctcctaatgcgcaggacattgcagagaggagtatttctctcttcttctttgagaacaagattgacttcgctgttgcccgctcaccctcttatcaccatatgctcgacgccgttgccaagtgtggtcctggatttgttgctccttctcccaagactgaatggctggacagggttaagtcagatattagcttacaactgaaagacactgaaaaggagtgggtcaccaccggctgtactatcatcgctgaggcatggaccgacaacaaatcacgagcactgattaacttctccgtctcttcaccttccagaatcttttttcacaagtctgtcgacgcctcctcatatttcaagaactcaaaatgccttgctgatctctttgattctgtcatccaagatattggtcaggagcatattgtgcaaatcattatggacaacagcttctgctacactggtatctcaaaccatctcttgcaaaactatgcaaccattttcgtctccccctgtgcatctcagtgtttgaacatcatcttagaagaattctccaaggttgattgggtcaatcaatgtatatcgcaagcgcaggtcatatctaagtttgtctacaacaatagccccgtgctagatttattgagaaagttaacaggcgggcaagatattatccgaagcggtgtcacaaggtctgtctccaattttctatcattacagtcaatgatgaaacaaaaggcaaggctaaaacacatgttcaattgcccagagtataccacaaatactaacaaaccacagagcatttcatgcgtgaatatcctagaggataatgatttctggagagctgtggaagaaagtgtggctatttccgagcctatcctgaaagtgttgagggaagtttctactggaaagcccgctgtaggttctatatacgagttaatgtccaaggccaaggagtcaatacggacatactacatcatggatgagaataagcataaggtcttttctgacatagttgatactaactggtgtgagcatttgcattcacctcttcatgcagcagcagcattcttgaaccccagtattcagtataacccagagataaagttcctcacttccttgaaagaagattttttcaaagtgttggagaaacttcttcctactagcgatctacggcgtgatattacaaatcagatattcactttcactagggcaaagggaatgttcggctgtaacctggccatggaggcgagggattcagtttcaccaggtatggacaataaatacatttatattttctttaagtcatgactagtgaacagagatgtataggtagtctgagtcgggagaaaaataatccacttatctatgaccgcaattaaagctatggtcttattacacaactaaataagtccaggttgatatagcctggcacgtagtaaaccgaattgcaaaactagtagatatcttcccctcaccaggctattaggggtatggtctgggatctttagaattggtaacgaagcactagaagactagaagttgatgtctaataatggtttgcttagtaatgcaggtctctggtgggagcagtttggtgactcagcacctgttttgcagcgggtggccatcagaatactaagccaagtttgcagcggttacaacttggaacgccaatggagcacattccagcagatgcactgggaaaggcgaaacaagattgacagagaaatattgaacaagttggcgtacgtgaatcagaatctaaagttagggaggatgataaccttggagacagacccaattgccctggaggacattgacatgatgtcggagtgggtggaagaggcagagaatcccagtcctgcccagtggcttgaccgttttgggaccgcccttgatggaggcgacttgaacaccaggcagtttggcggtgctattttcagtgccaacgaccataacatcttcggcttgtgaagtcctggtaagaggttttcataagttggtccagcgtgttgagtgtttaaccacacacctcggttcgctatactgtacataatgtttgagtaattatcaatgtagaaaataaatattttgtgttcctcacacagtcacacgtcgatgagcttggtggtacaaagcatgtttcgttcatatttgggattcataaaacggtgagcttaagattgtttttgtttgtattgaagccgtaattatcagaacccatatgatagtagcggttattgggccgctagtgaggcccaaattaaagtaaaaaggaaaaatcagtctgaccggagctatataattaatatatatcaagaagactcgttttagttggtttaggtgattcagatcacaaagtacaccgagaatg

SEQ ID NO: 21828 - DNA, 3000 bp, Unknown
  misc_feature (1)..( 3000): 2750-1469P.txt file - cDNA_ID_2033909; gDNA_ID_1974091; Annot_ID_180615
gcatcacaaaaaaaaaaagtggaagtaaaaccatataacaatcctgcagattgtcccatccccatccaaggaatagataaacataatgacggaatgttcagtgaaatcccaacccttacctctccagccccgaggaagaggaatctgtggtctgacaaggatccccccacaaatctaagagcagcgataagtccagcaagcacaactgatgctgtgccctatatatgaaattacagtttcacaagttggtaaatatgtaatccaagccgaaatcacctcctgtctcacaacttaaacaggatatagttatacctgaatatcgtcattgaaaacaagatgtgttgtaccatacttagctaacagatcaaaagcattatggttggcaaagtcttcaaactgcaaatcatcaaaagaaacatatctggttacaagacagcagattcatgttggtggagtacacttatcccacttatccatgtctcaagctaacctgaataacgactttctccccatagttctgcttgactgctgtcatgaattcatgcataagttcggagtattcctgtagaaagaagaggattaagggttcagtttcaccataattttcacaggaccgtctaactgaaaggtgaaaggtgccaattacctctcctgtagctctcctttggcggagccctatgtagaactcatcgttcaatagcttttcgttgtttgtcccaacatcgattgttacgggcagacactggcaaccaatatacagagagaaaaagatgagtggatatggttgaatgcaataaagctgattagcataaaactatacttacggcagatggccggacacctccaagggctgtgtagagagaaagtttcccaacaggtattcccattccctgaagacattaatgatggcatgtaatgtgcaaattagtaagaggataaaccctgactcaccactctcatgaaagcagaaaagaatcaaacaacttgcctgacatccaagatctcctaaccctaaaatgcgctccccatcagtgacaacaatgacctggatgttcttctcaggccagttcctcagcacttcatgaatcttacctctattattgaaaattgtatcctcacttaaaagatgagaacaagaatagtgaaagtggtagttgatttccgtataaaaaggctcacttttctttcaagctgataaaaagcccctgtggacgcaggaaaatgctaccatacttctggcaggcttccccaaccgttggagtgtagataacgggtagcaactcctcgacgtgatcaatgagaagtttgtaaaacagcctctcgttggtctcctgaaatacaaaagcattgtgaaagaagttgggtaacaaaggaaggcacttggtgtagttgagatagcgagacttcctaatgagttagtttacctggagatccatcatagccatatacttctgcaagggaacttgatactgacgaagagtgtgcataatttttttaacctgtagacaaagcgtgcagtaaaaggatcaaaagtccaaatctccagttgcatatatatatatagaaagggtaagtgaaacctgacaagacgggaaacctgaagatcttgtgagataacagtgggggggaggaggccgcgtagatagtgagcgtcacgctctctgtggctaaaggcaaggcctttgttgtgatgtggatcacgcaacaacgtatacccactggcgacagagagagaccaaggagtgataggcatgtcctcggtggcggcatcctcgccgtagacatcctgaactccaccagatacggtggatttgggaacaatgtcggcggcggaggtctcgagagaggaggatgaagtggcagtggtctcaatcaaaacgctgccggtgggatcctggttagatccgagagaggaaaagactctcaaggaagcaggaggagtaattatagttctaggctggcgcagagagaggcgtgtggaacatccaggaacaaccgtcttgttctgagaaaccaaagcaatgagactttttcgtatataaaaaaagatgagacatggacgatggatggagaaggaatgatgtaaataataccagaaacaacgagggagtgagagagatcatggcgtctggggatgccttgtctcttagacggaggaggagaagggaggagacggagagagtcttcttcttcagagcggccgtggtcgtggatttcagcgcggccgtggtcgtggatttcagcgcggccgtgatcgtctctcgctcactttctctcttcctatctccctcacacgctctaaatctgctgggagagagtcttcttcttcagaacctccattgttgacgtgtcttcttccttttctatctcttcccaaattgcgtctccactccttggcttctccctttatttaccaatttgccattgctcaccggtccctgtattggtacgcttttgtcaattttagcccacaaaatctaaattataacttttcgttgactctgacctctctctcttatttcttttcaattgaaaattgtgactcaaactagcaaaaggacagacaatttcaagcgaaaatgcaactaccatcaatgtactggtactaagtagatttagttggtttggaattggtatgagagagattcaccacttgccctctctacttgacatttatttttttatttatgtgacagaaaaggactcttccaacttggacttgtgtcacactcgatgcccatcctgtgaggatccacgtcaattgggtaaacaaaaggccgcttaaggcccaacttgggtccatccataatatgatgaatagtgtcatcctctctggtttttggaaaaggaaaagttgcaatgaataaaagcaaacaagagaattgcatctcatcattatgctctcgctttatttaacaaaaactttttctttggccaatgatcgatccttgctctacatatatacaagtattatcacgagtaagaccccaaacaaaaatg

SEQ ID NO: 21829 - DNA, 3003 bp, Unknown
  misc_feature (1)..( 3003): 2750-1469P.txt file - cDNA_ID_2033909; gDNA_ID_2926306; Annot_ID_205873
cctgcatcacaaaaaaaaaaagtggaagtaaaaccatataacaatcctgcagattgtcccatccccatccaaggaatagataaacataatgacggaatgttcagtgaaatcccaacccttacctctccagccccgaggaagaggaatctgtggtctgacaaggatccccccacaaatctaagagcagcgataagtccagcaagcacaactgatgctgtgccctatatatgaaattacagtttcacaagttggtaaatatgtaatccaagccgaaatcacctcctgtctcacaacttaaacaggatatagttatacctgaatatcgtcattgaaaacaagatgtgttgtaccatacttagctaacagatcaaaagcattatggttggcaaagtcttcaaactgcaaatcatcaaaagaaacatatctggttacaagacagcagattcatgttggtggagtacacttatcccacttatccatgtctcaagctaacctgaataacgactttctccccatagttctgcttgactgctgtcatgaattcatgcataagttcggagtattcctgtagaaagaagaggattaagggttcagtttcaccataattttcacaggaccgtctaactgaaaggtgaaaggtgccaattacctctcctgtagctctcctttggcggagccctatgtagaactcatcgttcaatagcttttcgttgtttgtcccaacatcgattgttacgggcagacactggcaaccaatatacagagagaaaaagatgagtggatatggttgaatgcaataaagctgattagcataaaactatacttacggcagatggccggacacctccaagggctgtgtagagagaaagtttcccaacaggtattcccattccctgaagacattaatgatggcatgtaatgtgcaaattagtaagaggataaaccctgactcaccactctcatgaaagcagaaaagaatcaaacaacttgcctgacatccaagatctcctaaccctaaaatgcgctccccatcagtgacaacaatgacctggatgttcttctcaggccagttcctcagcacttcatgaatcttacctctattattgaaaattgtatcctcacttaaaagatgagaacaagaatagtgaaagtggtagttgatttccgtataaaaaggctcacttttctttcaagctgataaaaagcccctgtggacgcaggaaaatgctaccatacttctggcaggcttccccaaccgttggagtgtagataacgggtagcaactcctcgacgtgatcaatgagaagtttgtaaaacagcctctcgttggtctcctgaaatacaaaagcattgtgaaagaagttgggtaacaaaggaaggcacttggtgtagttgagatagcgagacttcctaatgagttagtttacctggagatccatcatagccatatacttctgcaagggaacttgatactgacgaagagtgtgcataatttttttaacctgtagacaaagcgtgcagtaaaaggatcaaaagtccaaatctccagttgcatatatatatatagaaagggtaagtgaaacctgacaagacgggaaacctgaagatcttgtgagataacagtgggggggaggaggccgcgtagatagtgagcgtcacgctctctgtggctaaaggcaaggcctttgttgtgatgtggatcacgcaacaacgtatacccactggcgacagagagagaccaaggagtgataggcatgtcctcggtggcggcatcctcgccgtagacatcctgaactccaccagatacggtggatttgggaacaatgtcggcggcggaggtctcgagagaggaggatgaagtggcagtggtctcaatcaaaacgctgccggtgggatcctggttagatccgagagaggaaaagactctcaaggaagcaggaggagtaattatagttctaggctggcgcagagagaggcgtgtggaacatccaggaacaaccgtcttgttctgagaaaccaaagcaatgagactttttcgtatataaaaaaagatgagacatggacgatggatggagaaggaatgatgtaaataataccagaaacaacgagggagtgagagagatcatggcgtctggggatgccttgtctcttagacggaggaggagaagggaggagacggagagagtcttcttcttcagagcggccgtggtcgtggatttcagcgcggccgtggtcgtggatttcagcgcggccgtgatcgtctctcgctcactttctctcttcctatctccctcacacgctctaaatctgctgggagagagtcttcttcttcagaacctccattgttgacgtgtcttcttccttttctatctcttcccaaattgcgtctccactccttggcttctccctttatttaccaatttgccattgctcaccggtccctgtattggtacgcttttgtcaattttagcccacaaaatctaaattataacttttcgttgactctgacctctctctcttatttcttttcaattgaaaattgtgactcaaactagcaaaaggacagacaatttcaagcgaaaatgcaactaccatcaatgtactggtactaagtagatttagttggtttggaattggtatgagagagattcaccacttgccctctctacttgacatttatttttttatttatgtgacagaaaaggactcttccaacttggacttgtgtcacactcgatgcccatcctgtgaggatccacgtcaattgggtaaacaaaaggccgcttaaggcccaacttgggtccatccataatatgatgaatagtgtcatcctctctggtttttggaaaaggaaaagttgcaatgaataaaagcaaacaagagaattgcatctcatcattatgctctcgctttatttaacaaaaactttttctttggccaatgatcgatccttgctctacatatatacaagtattatcacgagtaagaccccaaacaaaaatg

SEQ ID NO: 21830 - DNA, 3000 bp, Unknown; identical to SEQ ID NO: 9846
  misc_feature (1)..( 3000): 2750-1469P.txt file - cDNA_ID_2033914; gDNA_ID_1974091; Annot_ID_180587

SEQ ID NO: 21831 - DNA, 3003 bp, Unknown
  misc_feature (1)..( 3003): 2750-1469P.txt file - cDNA_ID_2034117; gDNA_ID_1972137; Annot_ID_179144
ttggttctggtggtataatcatttaattaagttagttctggtggtccaaaactaggccacgagtttcattattccaccagaattatataatttagttagtcaagtctgattagccgaagatggaaatacgaaaaaatgtcaataatacatgaagtctttgtcttcttaccaaaactgtacgatctcaacgatggaagataagaatctaaaaccaacgagtgagatggaatcggaatattactaaaattaggatgagatgaggtttgggtccatacttaacagtgacaaatgacaatgatggagctgactttttcgttcttaaaacgtatcacaagttttctcctactttaaatttcatctccaaattgttgaccaaacgacatcgtctgttgcgacaccttaccccgatgttttttcctacgttgcatggaccttttcttatactttcaaataattatttgtctttttttctcaacatttatatccacattttaacgattttctcaggatattttctatcaatatgcttaattttctttctttttttgttaaagaaattaattcccatagttaacatgagagggtttagcaaaatatgcttaattttcttgttcgctgatgtttttatttttatttattattactgattcagcattcaaacttatcatgtgatttggatggttattgaagtttcatattaattgataaattaaatgtgttgggatgatgagaggtgatatagaaatacatattgtagtgtttaaatagatatggattcaagtatataattaattcttcttaatcaaattaatttgagttggactagtagtctagtaagtagtaagagaacatattcggatggtatcttaaatttatgaaatacagtgtgttttcagtttttattggtagcaacaaatttatcggttcatacctcaaagatagtattatacgtgtctacgattatataaaaaaatcaatacaaaataattgttcattcaagaaacaatcggacgatatgaacattatagttacaaactagtaaaaagctataaatatgtaaagtgaaaactatttaaaagggtgaaaattaaaacgtatcaacgttggagtgtttcaaaaatatttggttggataagctcaaactagtcaaattgtctcccctcccaagcgggaacatcacgccatgtccacaataaatccatttttctttctctcaaatatatatagagatacatacatcgatactattctatatattatgtaacaaattagaaatatcatataccacatggtaagttgtataaagagaattattagtgtttgcttattgcaaaattaatacaaaacattttctattgaagagctacaaattaagaaggaaactgaaaaatataataaaaagcagaatatgttacgatatttgtatgagtgtatgagacaacagtatcagataagatcataatccttgcgaccaacctatccaaaagtctcttttttgttttctaatcaatttacaaaacatttaaccaataaaaatataaagatggtgaaaaaaatatggtcatacaacaattgcttcaaagggggatgaactaaaatataccaaaaaaagaagtgaggataggttcatgtgagcccccatcccacttgaccctcttggtaggtccacatttaccatgaacatgtaacccattggttattcatttgtatgtattgttttttgtcaatgacttaattttattttattttcttcttctctgacttttttttgtttatctgactcttctatgtatgtcaaaatgtagcaagataattgaacatatttggattgttgaaaaacatatcgatatttagtgaattagtttctcctccaagcatctagaatgtcataactgtgttgaattgtacataaaatttgatatggattgatcattgataataaatcaatgaattaatgatctattagaatatgaacttttcattcaaatttaattgataataagtggatttgtctatatgtaatattttagtcaaaaaaattgtttcttttcaatgcgatattattatccttaaaacgttttctcgagataatttttttccgagccattaattttagtatgttcagatatagatcgacagaaaaactataattacgtcggaccaattgtagattggattgaatacatatggatcagattctaataccatattagaatatgaggtatctaattcaaaaccaactattaataaatagattgactcatatatgtcttatatactagtcaagatttctttgtcttttctaatgtgggatattattatccctaatatcatgaataaaatcaagagttaatgtttaactatatctaatctatactacccatcttttttcggaaactatatataagttataaaaccaagaaattctcgttatccaataaaaataataattttgactatggttatatatcagtttcaacaacttatatgatgattgatgagaaccttattttatgaaagtacgtggtaatgtgttgtaagaaaatgttcttacgccgttgaaatatttttccaaaaaatgtacataacaaacgtacgatatgtatgtaaaagccgtggtactacatttatttttgtctgcccttctcggaaacttccttcaaagttatttttgccgttcttgaaagcgttgaccctacctttccatttttaaaatgttctctcattttgacccatttttttccataaaccaatcaaattttaactttcaaaaacataaaactaattagatataaaataataacatgtacatgcacttgcctcgtccattcctcacatcatcatatgtctttgtatatatatagatgaaccaaagaaatgaaaaagtaacaacgtcacctaaatctctctcacccaatttgtgtttcttctttctgctaaaaggttataatttttgtttcttggtttggtgagaatcttcaagaaactgaaacaaagaaaatg

SEQ ID NO: 21832 - DNA, 3003 bp, Unknown
  misc_feature (1)..( 3003): 2750-1469P.txt file - cDNA_ID_2034153; gDNA_ID_2684254; Annot_ID_193064
cttctattcttgaggaatatgacaaaacagagattagtatcaactgtggtgaaaaaagtaaagaactaaattgtttctatgaatggcttcacctttttttttacagtgattgtggagtccatcttggtaagtaacagctaagcaaagcaagtgtgggagaaatgaaaccatataacattaaaaacggtgaaggtgtaagaagagtttgacccctcttttgagcatttaagttaaatcagtttttggcctttatgaaatttgatcctcatagtacaaataataatactcattgtgggtctcatgaatggagatatattaggatttattagaattgtacacatcgttaatgcctccaagctttgttttcttttagggactctctttggattttctcatgtgggtctttgtactaccattcatcctacacgtgtgagtactgtttctctataataatatcttttgttttgattagtaattggattagcttacacttaggtgggtgagaatagttgagaagaaagagaacatggattcacttctctttcactcgaatattacttatgttgttagaaaatggggtcaaagaacttattagagcttaataagaagtgcttaggtggttttgttgaaaggttaaaaaaggtggggatgtttcttatagcaccaaacttttagctttactttgaatgagcctgattttgtcaggtatacttccccatgtattcatttgtctcttacttcataagtcacccatgtgatgtgaaattattatatagaatgtatctatatgtgtatattagtttggaaacttctctcatttaaattagacacaccactatacttgttaaagccttttttcatgatttggtttccatcttagataagatgacaaaaaatctctgctgtaacatcatacctttcgattagatttctcgtcccactttttttttggtttccaaaaagtttcaataattgaatacattttattggttgcagaattctctgctgttactgttttgtattttctagcatttattttacaattttgttcctaaccttctaacatagcaaattagcaatcataaacttttatgcatatatataagtgtaagacagtaaatcttgtatgtggaaagacattttccttcaaaatataagttcataaacgtcaagtcaattatggtcgactctctttagagtacatactacatagattagattcagtcggatttaatgtgtacttaactttttaacttgcaggtcttgcatgacaagagtcgtgtcacaagaccattaaagtcactgaagtttgtgtttatggtgcacattgacatcatgtagatggtattttgatgtaaacgaatgatatatttgtaatattacaacttcaaaggttacatctaaattttgagacttcgatgatttgttttttcttcgaatcactcctgcgactatgcatcagccaaatcccaaatgtgtgtcaacatctcgaaagcacaatcctcattcgttttttactgagtgtgtgtctttcccaagcaatatattcaaaaaaagtagaaagtaaatggcccatgcaggtttcgaacctgcgaccttcgcgttattagcacgacgctctaaccaactgagctaatgggccattttgcaatgacttgttttcttctaataatactattttcaaacttgtgattgcacagttgcacattctcgaggcttggagatgttattagtttaaaaaactctattaaggtgcataagtcaggttcaaatctaagaggtcaacacaatcctctaccattataccaaaaccacctaacactagtttttttcaactaatgcatgtagccctgccaatatataaccttgtttttaaccgtttttaagactgaaaatattcttaaaataataacaagttgacgacaaataaataattcaaattttagcgaagatcgcgttgttactattttaataaatattggactttcatttttttatgtaatcgtataattcaagatgccgccaaagagtggatcttattttccctcctactttttcatctagatttttcgtcataggaagaaagaacagagaaagagaagaacacttagcaaaattatttccaaggaaatgatataattaagctcccgctacacctacacaaagtttacgaggttgagagtatttaataaaatttataaagctcgacttaaataactcaaaaagagttgggaacctatttgcgacctatatatctcactaattactcatgatattattcttaacaatagacagatttagttccaaactaactacggaaacattgaaaaagaagtttagttgatttatctaacatgcatgaaataatatggacaaggatttgtactttgtagttgccatggtcgtgtcaacaacatagttcaaatcctattgagactatgcaaattcatttctggaactacattatatgtattcttttttatccgaaaaaaacactaaatatttcttaggtgaacaaaaaaaagagaagtagatagttccggagcagaacaaaacagttgaacgaattacaaaagaacgagaattctagatttgtttcaagaatcagttttgatgtgcttgcaacttttgcaaacatacaaacaaatatatctgccttaataacaaaagtggaatatgaatcggaaaaaatagtacacttttatggtaatataataatttgggttggtaataatctgcactagaattcaaataaattttcatctagttacctttgggtcataggagaacccaacaaccatctcacaaaattagttgcatctcacttgacctacttctcaagacccttgtaacacaagaaaactaaaaactctacaatgccctcttctcaaaaaattatatatctctgggaagtctcaaccatcttctctaactcctatctcaacacacatattttcccaaaatttggatcaaaaagttttccgatagaagaaattaaatatg

SEQ ID NO: 21833 - DNA, 3003 bp, Unknown; identical to SEQ ID NO: 21832
  misc_feature (1)..( 3003): 2750-1469P.txt file - cDNA_ID_2034153; gDNA_ID_2684254; Annot_ID_138071

SEQ ID NO: 21834 - DNA, 3000 bp, Unknown
  misc_feature (1)..( 3000): 2750-1469P.txt file - cDNA_ID_2034153; gDNA_ID_1972137; Annot_ID_179145
ctattcttgaggaatatgacaaaacagagattagtatcaactgtggtgaaaaaagtaaagaactaaattgtttctatgaatggcttcacctttttttttacagtgattgtggagtccatcttggtaagtaacagctaagcaaagcaagtgtgggagaaatgaaaccatataacattaaaaacggtgaaggtgtaagaagagtttgacccctcttttgagcatttaagttaaatcagtttttggcctttatgaaatttgatcctcatagtacaaataataatactcattgtgggtctcatgaatggagatatattaggatttattagaattgtacacatcgttaatgcctccaagctttgttttcttttagggactctctttggattttctcatgtgggtctttgtactaccattcatcctacacgtgtgagtactgtttctctataataatatcttttgttttgattagtaattggattagcttacacttaggtgggtgagaatagttgagaagaaagagaacatggattcacttctctttcactcgaatattacttatgttgttagaaaatggggtcaaagaacttattagagcttaataagaagtgcttaggtggttttgttgaaaggttaaaaaaggtggggatgtttcttatagcaccaaacttttagctttactttgaatgagcctgattttgtcaggtatacttccccatgtattcatttgtctcttacttcataagtcacccatgtgatgtgaaattattatatagaatgtatctatatgtgtatattagtttggaaacttctctcatttaaattagacacaccactatacttgttaaagccttttttcatgatttggtttccatcttagataagatgacaaaaaatctctgctgtaacatcatacctttcgattagatttctcgtcccactttttttttggtttccaaaaagtttcaataattgaatacattttattggttgcagaattctctgctgttactgttttgtattttctagcatttattttacaattttgttcctaaccttctaacatagcaaattagcaatcataaacttttatgcatatatataagtgtaagacagtaaatcttgtatgtggaaagacattttccttcaaaatataagttcataaacgtcaagtcaattatggtcgactctctttagagtacatactacatagattagattcagtcggatttaatgtgtacttaactttttaacttgcaggtcttgcatgacaagagtcgtgtcacaagaccattaaagtcactgaagtttgtgtttatggtgcacattgacatcatgtagatggtattttgatgtaaacgaatgatatatttgtaatattacaacttcaaaggttacatctaaattttgagacttcgatgatttgttttttcttcgaatcactcctgcgactatgcatcagccaaatcccaaatgtgtgtcaacatctcgaaagcacaatcctcattcgttttttactgagtgtgtgtctttcccaagcaatatattcaaaaaaagtagaaagtaaatggcccatgcaggtttcgaacctgcgaccttcgcgttattagcacgacgctctaaccaactgagctaatgggccattttgcaatgacttgttttcttctaataatactattttcaaacttgtgattgcacagttgcacattctcgaggcttggagatgttattagtttaaaaaactctattaaggtgcataagtcaggttcaaatctaagaggtcaacacaatcctctaccattataccaaaaccacctaacactagtttttttcaactaatgcatgtagccctgccaatatataaccttgtttttaaccgtttttaagactgaaaatattcttaaaataataacaagttgacgacaaataaataattcaaattttagcgaagatcgcgttgttactattttaataaatattggactttcatttttttatgtaatcgtataattcaagatgccgccaaagagtggatcttattttccctcctactttttcatctagatttttcgtcataggaagaaagaacagagaaagagaagaacacttagcaaaattatttccaaggaaatgatataattaagctcccgctacacctacacaaagtttacgaggttgagagtatttaataaaatttataaagctcgacttaaataactcaaaaagagttgggaacctatttgcgacctatatatctcactaattactcatgatattattcttaacaatagacagatttagttccaaactaactacggaaacattgaaaaagaagtttagttgatttatctaacatgcatgaaataatatggacaaggatttgtactttgtagttgccatggtcgtgtcaacaacatagttcaaatcctattgagactatgcaaattcatttctggaactacattatatgtattcttttttatccgaaaaaaacactaaatatttcttaggtgaacaaaaaaaagagaagtagatagttccggagcagaacaaaacagttgaacgaattacaaaagaacgagaattctagatttgtttcaagaatcagttttgatgtgcttgcaacttttgcaaacatacaaacaaatatatctgccttaataacaaaagtggaatatgaatcggaaaaaatagtacacttttatggtaatataataatttgggttggtaataatctgcactagaattcaaataaattttcatctagttacctttgggtcataggagaacccaacaaccatctcacaaaattagttgcatctcacttgacctacttctcaagacccttgtaacacaagaaaactaaaaactctacaatgccctcttctcaaaaaattatatatctctgggaagtctcaaccatcttctctaactcctatctcaacacacatattttcccaaaatttggatcaaaaagttttccgatagaagaaattaaatatg

SEQ ID NO: 21835 - DNA, 3000 bp, Unknown; identical to SEQ ID NO: 9499
  misc_feature (1)..( 3000): 2750-1469P.txt file - cDNA_ID_2034266; gDNA_ID_1972133; Annot_ID_179124

SEQ ID NO: 21836 - DNA, 3003 bp, Unknown
  misc_feature (1)..( 3003): 2750-1469P.txt file - cDNA_ID_2034426; gDNA_ID_1972192; Annot_ID_180218
ggaataacaaaatctccaaaagctggtcacatgtggctcattcttgtccaagtcaaaccttcttcacatcttttgtattttattttattagtacaataacttattaatattactcttaatttccgttgcaatatgcttttaatgctctcattcggctgactaattttcacttttcgactttacagaccaaaaaaactttttatttcttgccatgaagtgacatggaattgatactcatggtttggtttactaataagtttctcaaataaggtcttaaccaagaagacttttttttttgtcctcaatttaactcttgtattattcgcattggatatgaaatttcttttgtatgtgcaagatcttggattcttttaatattcttaattatgcaacgtatccaaaattccaaattgattccttcaatggcatcaatgcctatactaagaacctcggaaagcttatttgaaatcataaaacgcttgagttgtcaaaaacactcacataaaactctatatatatgtatgtaatatagttatatagggatcccataaatacataagaaattattatttttgttcaaattatgaaaatagtttttgcatagtaatataaaagatgtgcaaaactagtttatctagaaatatagttgttataccacaacaaaaattgtgatggatactatttgaaaccactgtataatttttttttgacctctattagggttgtattaaaagactacaacaaataacaaactaaattgtctctcttttgtttaacaatgttcacacatatatattatcggatgtaaacatgggtttattattagatgcaaggccggcccaataaattattggatcttgtgctatgctccaaatttttttacctaaaactctaaatatttaaaaaactagaccctgttttgcaattatttgaaaatttggaccctaaaatataaagaaaaaactgaataaagaattgggacccggtgcactagcacactcagcacctcccaagagtcgggcctgattagatggtgaccatactgaaacaaactaatatgatatgtcaatgttttgagtttaattctatttggtttctcattattcaaaataactctcattaaatggaacaaaaactcttattagtttaaatcttaactttttttatgaagagaatgggcttctttacctactacactcaatgagccctctggttcgtttggtcatcagttcaaatggacagtgactttggaatagatctcgaccgttggtcatcatcaccctaatgctttgtgttgccgttggattggtcatgtcatgaccaaaccaatttgacttctttatgtgatgtaaaagtcttattgctctcaaataatcttctaaaccatccacgcgcctgactaaagcaactgaacgtcagacgctacaatagatccaaattaagaaaatgggaatacaattttttttttttttggttgggaaaataatatctctcacttcagagttcagatatgaaaataaatatttatatcttcttgttaattcgacataaattttaccaaaaaaagagaaaaaaaaactatcgtactctttgttttaaaataatttaatcgcataaaatacaattaatttatagcattggtttgtaaataccatggaaaactcataaccaagaaggaaaaaattgtattactaattgattggtgagtgggtgaccaaaatcatttgtaagaaaggctttcgattggcatgttgttcattgttcttgtaacagttgcatcttaagtaattagtatatacgtgtaagatttatggaaaatggagtttaatggatggaaacaaacaatatcagtgacacaatactattttgcccatgctcaaatggacatcatgttctattttttcttgacaagtagagagattcatcgctttttaaaatcaaactttcattttgtagtgggagccttaattgtatttgacccataaatccaatttcttcatggacgtgtcgtggtccattgattaaaataaaaaaagtagaataaacaatcgcttttaattctttttaaaaacaaagaaacaatccaatgtaattttcgattaaaatcattttgattcgatgtgatattgtgtagagaaaacttcattagcaattaatttactaaaatatagtaattgtagtacaaaatatatttcctataatctaagtacagtattttatcgatactaaatctaacagtctaataatcaacgtccctttcctatacatgaatgtacaattaaacaaaaaatagaaatttatagactcaatgatttaaagtacataccaccaaatatggcagcctagtgattgttgtaataagcttttctaaaatatttctacctgattttcaagctttataatttgtatttcagattcttatttatataccaacaaaaatatctacgtaaaatttatcattttcttaaaatatattttggtatttaaaaggaaaagaaatagagaagaaaaaacaagaaataaaataaaaaaagagaagagagagaggagaggagaggtcactaattgtctatgtttggcgcgtatattaaccaccaccggcaaaacacccacgaaaaaggcgaccacgcataaagaaagatcaaaacttccccatcacttccaaaaagcaataacacacacacaaacttgttaccagggaaattataaataaaaatcgtagccgaaaattataaaaatattttatttttattttagttcaaaaaagttttcagctttgaaggcagagagagagagagagagatcaagcgactagtgagagtggtgttgaagcgaaactacgatcttcttttttccttttcagattttcacaatcacaacactcttctttgatcggagctctaacattccgacaaaagctcaaaaaaaaaaaaaaaaaagacttctttcttttgctcttttgagggatttgtctccctctgtagagattagggtctatcaatg

SEQ ID NO: 21837 - DNA, 3003 bp, Unknown
  misc_feature (1)..( 3003): 2750-1469P.txt file - cDNA_ID_2034525; gDNA_ID_1972047; Annot_ID_178248
ggcaaaaaatcaagtatgttgtttattcctcatttccatttatcaatcactcgctcgtgaatcttattaacatgatttgtagacttttcaagtagagggattgatagattcttcttgtactagttgtagttggtatcaaaagagtttcttttttcttttgttttttgttgtatgaacaacggcatttctgccttcttcttcagaggacgattcaggaacagggatggtcgacgcagctccagatatcggacctaccgtgaaagcagcagcctcttctcaaatggaggcagccattgatgcattgtcccgggatttaactaaattaagaaccggaagagccgctccaggtacttctcacctctttctttcgggtttaggttaagcctctctgtgtctgtgcttattgtgtgcatttgcaggaatgcttgatcatattgttgttgaaacgggaggagtaaagatgccactcaatcacttagctttggtctctgtcttggatcctaagactctctctgtcaatccttatgatcccgatgtatactgattctttctttctcttttactaagaaaaacttcgactacattagagtgtcatttttctccaacaagccgccattgacgctttgtttgtctctgcagacggtcaaagaacttgagaaagcaatagtcgcgtcgccattaggattaaacccgaaactggatgggcaacgactggtcgcatctatcccagcgtatgaaagttcttctctgtcaaatttcattgtttatcacagccgtaattgactgactttgtctgatttccgctctatgtttttatttcgtgagcagattgaccaaggagcatatacaggtaaagcatccaagtcatgtgttattgtttagtcactgaggttgagccttgaccctatctatctatatgaactccaggcaatgtgcaagattgttacaaagtccagtgaagttgtcaaacaaagcataagaagagcgaggcaaaaggtagtatgaatggtgtagagcacaaccatagaagctgtttgttgtaaactctctcctacacgtcagaacatctaatgatcagagacttttttttttggtcaggcactggacacgataaagaaagcaggctcgagtctaccaaaggatgaagtaaaaagactggagaaggaagtgagtgtcattgtatgatctttctgcaaatatgcatcctacttcagttactgaaaataatggcctttgtgtgaacaggtagatgagttgacgaagaaatttgtgaagtcagcagaggacatgtgcaagtccaaagagaaagagatcaccgaagcctgattcatcattcctatacatcactagtcttttcacgctaccttgaaagaatcttttattcattaccaagatttgttttcaacttttgaatgtttgatttggggatcttggaactgcaagaaaattgatgatgaatagcgatggaaggcccttcaaagggcccaagaaaggccttgaaagaattccaataattatgatgttatttttcgagtttcatatatagtagtactaattggcttttgtagttgaagagaagtttccaaacttgaaaaccaaggcaaggggggaagaggtaggagatgagtcaattagtttaccaataatttgacatgatagtgaaattgatgtgtttggtaaatttgttacaaccccattaatctaatctttttttttgtacttgttgcaaagaataattcaatgatatttcttaaagaggaaatttctatatacatataaacgataagcttatctcagcattccaaattgatagtgcgctttcaaacatattataaaatttcagacatagtttactctaaactcggtccatctctgcaacaaaattaaaaataaaaccgtcctcaccaaccacaaatcttatatttaaaattgaatgcatttaatttttaaaattgatcactaacaaagaaatgtaggtaatataacaagctgtataatttgtcggcaaaaagatataacaaagaaaaacatgtacatatacatttatctaaaatgttgagcaataacaatattgaagacgcaataacgataccatttaatctttgcccactcgcattggtgacggagactaaggcaaaatctatcgaaagtggtgaccattaaaaagcgcgtcggtgttcactttttttagtcagggaccaggagatcaccgtaacgtcgccgtttcgatatttgcacgatcaaactcctttttttattcttttttggtcatcttttttttctttcttttctttatggcatcataattttttttagtcgtaatctatagaggagactaaagattcttcattctgtgtcagtggctcacatcctctgattaactaaaacgcacacaaacaagaaaaaaagctatgaaaacaggaaaaaaaataggaaatatcagtcttgtctaaaacgacgaagaagaagaggaagaatcgagacaaacatttcacattcccagagattgtggtgtcgttgggtattcattctctctctctctcacattactttgacgagttcttagtgtgttggttctccaaatgctctgcatattacattaaatctctctctgcttttttttgggctataatatatgttgggttttcttcaacttgcttggatctgttgtaataagcgagttagctcaaaatctctttcttaatgaatgagctttcaaagttagctgttttttcctcttcttcttctttatcttggatcttgatcaatcgaatcagtaatgtgtttggaatagaattagttacatacatttacctttctggttcatgcattgtcttagcatttgacggtttcgctgtttcagattaaaagttgaattcttagggtttagacaaagctttccctgttttgttacttaaatgtttgctttgcattcggatgatgcttgtgcaggtacttacttcttagggtgattcaggacttgctaattataggcaaaaaatg

SEQ ID NO: 21838 - DNA, 3000 bp, Unknown; identical to SEQ ID NO: 9269
  misc_feature (1)..( 3000): 2750-1469P.txt file - cDNA_ID_2034533; gDNA_ID_1972047; Annot_ID_178246

SEQ ID NO: 21839 - DNA, 3003 bp, Unknown; identical to SEQ ID NO: 21495
  misc_feature (1)..( 3003): 2750-1469P.txt file - cDNA_ID_2034537; gDNA_ID_1972047; Annot_ID_178245

SEQ ID NO: 21840 - DNA, 3000 bp, Unknown; identical to SEQ ID NO: 9786
  misc_feature (1)..( 3000): 2750-1469P.txt file - cDNA_ID_2034597; gDNA_ID_1972187; Annot_ID_180186

SEQ ID NO: 21841 - DNA, 3003 bp, Unknown
  misc_feature (1)..( 3003): 2750-1469P.txt file - cDNA_ID_2034611; gDNA_ID_1972187; Annot_ID_180178
acataacaatataacatatcattctagaatgtcttatgattcatatttttacttgtaaatcaggatatttgtaagttgtcttaaaacccatgtttttctgtcggagaaatataaacagtcagtaaatttcagcaaaatttaacaagttcaaattatgtttttgaccgtcgcacgtgtgcaacaaggccattgcacgtgactagtcagagaaaacataatcttcgttaggatcttgacgccaggccgccccgaaacaggtggttcgctttagattttgatgacgtggtttcaatcttgaccgctcaagttttcaccacgtggcaccgtctatgtcgttggattcttcgtagacgacggtattaggtgggccgtgacagcccaatgttcaaaagtgggtccacatatgtgccagatcagcttgatcattccaactgtagaaagatgtttataaaaatataatgacgcgtaattagatttaattatccgtaattaaagagtcatttgcctctcttgtcatatatgtctttaatttcttgttcccaaatcatggcgaatcaaaatctacgcgataaattatttttaaatgacaacgtcgcttggtcatgcgatgatattgatataatataagtatatagtttcctgaattattaagatgtgtattattatttactcgaattaaaaaacacaatcatttgaatctaataaccaataacaggctattgatatattaaattaaatagatctatctgacaaagtgatatcccaatcttatttgattatttggtgagagagaccaatgcattgtatatagtataaggattaggctctaataaggatcttcaacgatctctttgttatgcttttttacgttgaataaccttcgtactttataaaacatgaattcaatagtaaaaaatttgaccacagtaagcaaaaaaagataaaacggatacaagactacagtaatcctagaagaagcctcattttcaaaacactgttttttttgtataatcattacctcgtgctcttcaatttaatgacagcttcttatatgattagatcgaggcaaaataatgtatactctacaaaagaagtcaataactttccattagattaattgggattcaaccatacgactgtacgtgttatgtatgttacacttctatattcgtatagtatattaatcacatattcacacgatatcaaaatgaataactagcgagttaatctaagatagattcaacgaattaaattgaatatcaactgtagaagaactgaaactttgaataccgaccgacgaacgtgacataataaaagccacacagtagaacaatttcttaaaaaaatatcatcatgtggttacaaaacattatcacctggttcattacttaatttcattcgcgatgacgattatagttgatggtcgatcacagttaatatacagatacaattaatttggattagtactagtatagtttttttttaaagaaggagataaacataactaatcatttggtcttttacgtgggtatcacattaaatccatacaacgtagtgcacgccggtacaccttttctaaaatattataaatatatttaagaattactatagtctatataggctcaatcaaatgtgtcgatcgcttgagtccttttgttttttaacgttactaaatagtactagtagtaaattcactcttacaaaaccgttaggtgaatttacctttattctaacaataactatagtttaaacaaatttcaatgatgaaaagcggtcgacgaagtttctaactgcaatttgcttctgaaaaaatcagagtaaccaaaacagaattcgttaatttttacacgcacgcttaaatgcgtgtcgacgagtaaacgagcacgtatacatcaaacttgccggattttttttgttttgtgatgagttcacatgtaaacgatagtgacctttttgttataccgaaatagatcatagaccaattctcaaaccaatctctaaaatggttaatggtagccaatatgtcacattcctagatttcatatgttcaacttttaaacgctgttaacatataacgtattcatattttcaagttatcaacaacgcaatatacatgtttgattatttatatgtggctaatcgtgttacttctttttttttgttctaaattcaaatatgaagatttttagtggaaagaagatattggcccttgacaagttgtttatgatctattaaagttttgtttttccttttaattgaatttcctctatgtttatcacaaaataaagaaaatgaggagtaaaaacaaattcagcagaaaatagtgaaacaaatgattcatttccatatataaccacaaggaaaaagaaaatttccctattctaatagttttgttcctcctaattactctgattacatatatttaaactaaaactgaaaagtacacatatagtaatccggtcaggtgattactgtctttttttcaagattttggaagttttacccattttaaagaaaattttgaatgctgttctattatagtattaacatctgtttagtgaagtcaaaacattggtcataacaatgtgattaaagttaacatctgtttagtattaacatttttagggctggtgggctttttgtgtccacttcccgatggttactgcaactttaattgaattttactattttaccctacccaatattaaagctttttatttatttctctgcttctctcttttgctctgtctctttatcctttttcttttgatgcttcattctctcttttcttttttttcctctgtagcgtttctaggaatctctctccaacgtttaggtttcttctcagatttagaaagtttcttctctatctgaagaattttcatttcgatttcgcttcttccttcaccctaatccgtaatcgaatgccatttcgaagattgtgttgaagagtagagaggaagaagaagactaagaagctagggtttctctgatgagtagatg

SEQ ID NO: 21842 - DNA, 3000 bp, Unknown; identical to SEQ ID NO: 9788
  misc_feature (1)..( 3000): 2750-1469P.txt file - cDNA_ID_2034624; gDNA_ID_1972187; Annot_ID_180170

SEQ ID NO: 21843 - DNA, 3003 bp, Unknown
  misc_feature (1)..( 3003): 2750-1469P.txt file - cDNA_ID_2034662; gDNA_ID_1974091; Annot_ID_180594
gataaaaatgggaaacaatgcgctattctcttctgacgccgccatctttggagcctttaaactgagagattctattctgctgaaaggaaaagctctgttataatctcacaacatccaaaaagcttcaaggatacaaaattatcaataacatgaaaagctggatctgaggccactgaaattaattagggattctacatgacggagatcaacactaatagatctcggctaatctagtctaaaggtatatgaatccctggactcactttgagatcgacacaaaaccttagaaaacaaacaaacgaaactacgggaaggaagcaaaaccaataattggtgaaagaagatgaaatcgaacttgaaaggatattgtagaagaggaaatcgaagaagaagctcacctaggatgatagctctctataatcagagagatcgcgctgctgcagatcggcaacaaacggcgttgcagtttttttttctttatgcttctcttctcttctaatttctgatttctgattggtgagttctttcttctttacttgcttattcacttttctttaccttctcaattaaaatatttcgcaattcatttctctctttacatttttacgagttatttattttccattaaattagagtaattattaatagcaaagtttttatggtgaacgaaaacgaatttcccaaaaaaaatcacattttttataaattagaaaggaaaaagagaaaaggatatggatcaaagagggattatatgctctagagatttaatgtgatccagatattgtaatagggattgcaacaaatctcttatatgttctagagatttaatgtgatctagagattgtaaatagttacaacaaaatagagatttaaacaaaacaaatatttaatgattttaagaaaactgttttgttgtaactatttatatttcgaccagaaataaattgttctacttgcaaaatacatcaatcttcgttattattatcgatttaatcataaactgtctaattcaattaaatttataagagcatggttaccaatacttttttatctactgtaacgaaagctaataatgattttgaatgagtttggtatgatttggttattcgattcactaaaatagtcgttttaaatctagccaaatatcgtataattttacttgttttgattatattaaataatcagttatttgaaaactttgttgacatgttaatattatatataactaaaacaaaatatagatattaaaaacaaagaaaatgttattatatagctattatcgtttttcataccatttaaattttattactggctttcatattatgatattgttgtacatagacaccactgctaaaatgcttattaacttgagattttgcttgtgagatttggaggctaatttttttctcggttaagcatttctcgcatcatatgccttccacatagtttgagcttttgttcaccaaatgttcttaccactctcaagaaactggcagcacacgaatatgctttccacatggtttgagcttttctcttggacaaaaactcgttcaccaaatgttcctaccactctcaagaaactggcagcacacgcatatgccttccacatagtttgagcttctctcttggacaaaaactcgttcaccaaatgttccttccactctcaaaaaaatggcagcacacggtggagtttaccacatttgaaaacaagtaaataatgtcttacataattcacagtcactgctttcttcgatcattttcaagaattttgaccgtgaaatttgcaataccatatcttcaagaagacatctaaaaggttttcgcaatctggtgattaggttaatgctcttttgtaatacatttctttcattttatatatgatattaacatttataacaaaagaaaacaatcatagcatattgcatgtcattgcaagtttgctatatacagtagttttaaaccgagtaaacttaagatcaggtaggaaagatgcaaataaagaagcaagtgataccaaaaatatatgtaaacatttaatatagttcttcaatctaattgacgattagaaagtactgtactagatgattacgatccaagatttttgtccacactaagaatatttcacaaaataaggtttgcaacagtaggattgaaatgccagtaaacagtgacattatctcgaaaaaatccaactcagaaatcatttactagctaataatatttttcaaatagtttagaattattattgttgtttatcattaacgcatacaaagttagttgtataatctttcaacttataaataatttggttttggacggaagagctttacgcaaatgtattaatttggttttgataatttttatttgtagactcgatttgtttacgtaaattatgaaagagaggcaaaaataaatatcataagatatagtattagaagaaaaggacataaaagtagtaattaaaaaaaaaaaggaaaagaaagtgtgaaaagaaaaaaggaaaagtagagaggaacgcaaccctgggggcttcttaataaacccctctcgctctcttgtctcttccttacgacaacctctcctgctcttcgttttctctctacgacgataaaacccagatttgggttcaagcttccataactttaaacccctctcgcgatccaggtatgtttcccaatctttattcccagatcttccagatctgaagctcctcttctattttttcgtagatttgatttttaggtttgatctatttgtatgaatggctcgcgtgttctcccgtattggtgattgtaatctaaaatgttgatttgatttaggttcagtaataagactagttatctgacctgtgttaacaccaattagtcttctcctagtctgctttcattgatattccatccttgttcatctgatacttattttttttgcttttattgatctgagaaggttgctatcaaatacttgggagcccccagtattattgaataacacagcctgacaatg

SEQ ID NO: 21844 - DNA, 3003 bp, Unknown
  misc_feature (1)..( 3003): 2750-1469P.txt file - cDNA_ID_2034666; gDNA_ID_1974091; Annot_ID_180595
tggaagaggaagaagttgaagttccggtcacaaaagaacattcagaggaaactactaagatggactctgacaaagcttctgctgaggcagctcctgcttctggagactgtgatgtaaacatgcaggacgccaaagacaccagtgatgcaactggtactgacaatggtgttccagagtctgctgagaagccggtgcaaatggaaactgattcaaaggctagtttctctcttaactgatactgcttgctattcgcttgtgaacatcaaataattatggatacttattaatggattgtgcaggctgaggctccaaagaagaaggtgaagaaaacaaatgtaccactgtctgaattggtctatggtgccttgaaaactgtggaggtcgaaaaggcagtggagaaggaatttgagatggctttgcaagacagagttatggaagagaccaaggaccggaagaatgctgttgagtcttatgtttatgatatgcggaacaaagtgagaatctttatttcgtcttttcattggcagtatgcatatgtaaagttgtgagtattgggtactaacgtgtcttgttttcagctgagtgacaaataccaggaatatatcactgactcggagagggaagcattcctggcgaatctgcaggaagttgaggattggttgtatgaagatggggaagatgagaccaaaggtgtttatgttgcgaagctcgaggagctcaagaaggtaatgcatgcatatgatgacactttatattgtgcaggaagaaatcatatttcaggataatgttttaacagaggagtgggattaatattttgcaggtgggtgaccctgttgaagtgcgttacaaggagtcattggaaagagggtcggtcattgatcagcttggttactgtattaacagctacagagaggcagctatgtctactgatcccaagtttgatcacattgaattggcagagaagcaaaaggtaataatttggctcaatcttggaagcacaaaaaaaatcttaaatttctcaggcttggggaaattgtttgatgttttgttgttgtgaaatgattaaggttttgaacgagtgtgtggaagcagaagcatggctgcggggaaagcagcagcagcaggacacacttcccaagtatgccacaccggctctcttgtcagctgacgttaaaagcaaggcagaggcattggacaagtaagcaaggctccttgtgtctttgtcttttaaaagaaatgctaaatctgataatagagagtgaaccagctatggatgttttacaggttttgcaggcctataatgaccaaaccaaagccggtggctaaagcagaggcaccacaagccaagggaggtgagcaggcggatgagggcaagagtgagccagagcaaccagcttctgccgaaccaatggagactgagaatcccgcggaaggtagtacctaaatgaatgacgagagagagatggtgttgtatcgattttgttcttaactctttttgatttacctagtggaacctctttttctggtttcgctattattcccggaaaaaatctatattgttaattcttccttttcgaaaacaatttttaggaagcatcttttttcttattgttccttgtggttttgtttttaatttgaaagtcattttttctgctcctctatataactattatggagtgtacacggattcgttctatgttggactgggctgtttttataaacagcaaatgaaatgcaatttggttctatatatattggagctttaaaaggcaactttgaaccccctaagcttaacatcttttctcttatatcttacgtgaaatcagtgtgacaaaactcgtcttcctcacttctcttccttaccattgttgtacaaagaacatcttccttgatgaagcagtcgtagcctttggcaacatctttgaggtcatccaggctgaagttgtatcgtttctccaatccaaacggggttaaacaaggatgaattcatttcctcgttatgagcacagaatgagtgcgactgctacgatatgtgattaagctgcctgcaccagtgaggacaatgaaaatctctaacataaatccatgaatcatctctgggcgccgcagataatggcatgttccagacaccacaatgcaattagttcgtgcatatcttatgtaccacaaattctgataacaccagccacttctctataataattttattaattttaaatacattgggtttaaataattatatgtagactcgaataaaaatatacaaaaacactgggataaaaaaaaaaaacctaagaaaaaaaaaggcaataaataaataatttaggcaaaaatatcacaaaaataaaaaggaaatgaaagtgtttttaaaataaaaaaaaaaaaggaaaggagaagaacattccagaggaacccaaaccctgtggtggtgtctgctccttaattaaaacctcttctctcttgctcttcctttataaaagaagctcttctcccttcctcttcactttttggctgcgacacgattacagatttctcaccttcacccagatttcggtggaagcttccagaacgcgaacccctctcgcgatccaggtatgctctagttgcagatcttctagatctgatgcttctctttttcctcacttttaggttttatttatttcttgttgccagattacttgttcctcgtacttgtgtttcaatatgaatcttctgctttcgctgcttccggatttgtattttagtttcaaactccaccaatcttcgttgtatgtattgttgatgtaaacccaaactggtggttttattttaggtttagtaatacgatggtttaaggctacctggcctgagttaccgccaattcgtcatctcctgtaatctctcgagctcaagactagtctgcttcgatcgctatctgatagtgtttttcttttttttgttctataaggttgctatcgaacacgtgggacgccccagtactgaagaacacaaagcctaacaatg

SEQ ID NO: 21845 - DNA, 3000 bp, Unknown; identical to SEQ ID NO: 9820
  misc_feature (1)..( 3000): 2750-1469P.txt file - cDNA_ID_2034746; gDNA_ID_1974075; Annot_ID_180363

SEQ ID NO: 21846 - DNA, 3000 bp, Unknown; identical to SEQ ID NO: 9295
  misc_feature (1)..( 3000): 2750-1469P.txt file - cDNA_ID_2034818; gDNA_ID_1972067; Annot_ID_178427

SEQ ID NO: 21847 - DNA, 3003 bp, Unknown
  misc_feature (1)..( 3003): 2750-1469P.txt file - cDNA_ID_2034901; gDNA_ID_2684220; Annot_ID_191828
agcacgccatctccatcgaaggaaaaaagtatctggggtacttatgccagaggagcagtttatgcgttacagagcagcaaaaagaatctcaaacaggtaacaggttcaaatttggtcttctggttatagctatagataaagtttaccattaatgggaaatgaggtttagcctgcacatttgctgtgtgatcttctggggttccacatttacccttatttggttgccatacctgatcttttaggccttgatttccccataatagttgacataattgtatttaatggaaaaggtatttgaatatgtttctaagtaattgttttgatctttgaagggcattattggttacctcagtggctcaaatggactagatagctccgggcttagctcatcagctgctgtaagtaactgaatcccgcctgtttttgtacagcagaaatttctccggaaagacaatttttactgctctttaatagtaactaaacatttttagcatatgagagtggtgtttacttgtcatttttggaaaatgaatcttgtatattattttatgatcgccagaaatgtgacaggttggtgtggcatacctgctagctctagagaatgcaaacgaattgactgtatccccaacagaaaatatcgaatatgacaggtatattcccttctaatgtaaccaagaagctcttctgtattgcttcatgagcagttgtttctctgtgaaaccagcaattagtgctgcaaattggtcaatttatatgtgacttactgcgtctgcaggcttattgagaatgggtatctgggtctgcggaatggaattttggatcaatcagctattttgctttcgaattatgggtgtctaacatacatggactgcaaggtaaaattccttgatttgtaagtgatatagtgtgcaaaaaagcaagaagcttgttcatgtggcaaaaccaagactgttcaatgggatgcctaagatgtttttgatctctaaactgaaaatgactcacgatcaaatcagatctacaacattctcattgctttcacgagaaaataagtgtttaatcttttcaattgcttcgattttaatgtatttcaatgctgagttcacttcttcctaaaatgaaaatgaatggttagaatcaggaggccttgaagaaatccttcctaaccagccatagatagggaaactttattttcttccagaaactgccatctcagaaaaactgtttgaaatatgcagactttggaccacgagcttgtacaggctcctgaactggagaaaccgttcaggatattgttagcattctcaggcttgaggcaggcgttgaccaccaacccaggatataatctgcgagtttctgagtgtcaagaggcagcaaaagttcttttgacgtatgtgcaaatctgtttgattcatatttatctacattttcgcttatttagatttaaatttcagtggaaatgctgcaaagtttatttctctattgcttgtgatactcatttttctgcatcacaagattcacacccttctcttgatttactttttcttttcagtgcatctgggaacagtgagctggaacctacgttgtgcaatggtaaaaaaactttaagtgtggactttaacttattcgttgcatgctgattagtttttctttgttgccatgtctctaactgtcccactgaatagttgagcatgcggtctatgaagctcacaaggtaagaaaataagattcttaagcttttggtaaaacaggttccacctatatcaggcctatgtaaatatgtaatacaataatacttgttcgtgcagcatgagctgaaaccggttttagctaaaagagcagagcattatttctcggagaacatgcgagttatcaaaggcaaatgttcttgaattcttgtagatgtctctttatgtgcatgaatgattcattaagctctttatgatgcttaacggacttttatgaatgtttgttcttaaatttcaggacgggaagcctgggcttcagggaatcttgaagaatttggaaagctaatttcagcatccggcttgagttccattgagaattacgaatgcggtacattacactctcttttcttctctcccaaatgcaacatatcctatagtgaatacagaccactagtatgcttacagacattattctctcttagattcattattttggttttaaattctgtgagttttgtgaaggtgcggagccactgatccagctatacaagattcttctgaaggctcctggtgtatatggagctagattcagcggtgcaggtttcaggggatgttgtctagcctttgtagatgcagaaaaagctgaggcagctgcttcatatgtgaaggatgaatatgaaaaggcccaacccgagtttgctaacaatctaaatggaggaaaacctgttctcatctgtgaagcaggtgacgctgctcgtgttcttctctgatcaatcctggagtttttggtttcttccccacttaaactcgatttttttgtcccttatatctctcacgcttattgattctttgcttgtttatctctttttgatcctgtctgagaaattctctggtctctttggtcggagtttcatcattgcttgatacattttttttgctacaaatacataatgtaaatcattctctaccgttttcgagtcgatagaagaatcgcaaacttcaaaaatgtgactaacatttctccataaatttgttaaattttcaacaattggtgaatttagttctgtaattgatctaacaaagacactatacaagtatgaaattagaaattgaaatcgaaagttagttattataatcttgtttgtataaaatagtgtatatctcaaatagagatacagattagttttttgtttggacacaaagacccccgccaaagtattgaaattcgcgcctgagaaattctccggtgtggctctctagggttttagcactttaatccatttgtacttgtaaaaatccctaaaaccctctgggcatg

SEQ ID NO: 21848 - DNA, 1116 bp, Unknown; identical to SEQ ID NO: 9289
  misc_feature (1)..( 1116): 2750-1469P.txt file - cDNA_ID_2034901; gDNA_ID_1972067; Annot_ID_178386

SEQ ID NO: 21849 - DNA, 3 bp, Unknown
  misc_feature (1)..( 3): 2750-1469P.txt file - cDNA_ID_2034901; gDNA_ID_1563385; Annot_ID_147584
gga

SEQ ID NO: 21850 - DNA, 3000 bp, Unknown; identical to SEQ ID NO: 9310
  misc_feature (1)..( 3000): 2750-1469P.txt file - cDNA_ID_2034982; gDNA_ID_1972068; Annot_ID_178482

SEQ ID NO: 21851 - DNA, 3000 bp, Unknown; identical to SEQ ID NO: 15417
  misc_feature (1)..( 3000): 2750-1469P.txt file - cDNA_ID_2034990; gDNA_ID_2926133; Annot_ID_197058

SEQ ID NO: 21852 - DNA, 3003 bp, Unknown
  misc_feature (1)..( 3003): 2750-1469P.txt file - cDNA_ID_2034990; gDNA_ID_1972068; Annot_ID_178480
atacattaggaagggagcatatgataagtttttttttctaactttacctaataatcaaatttggtgctctctattattgtgacgtcaatagacataaggataaatataggaaataaataacattaaattttataaacttttatgaattgtttttaattcaaaaattagttcaaactacataagcgattttatacaaactttatgacatgtggcatatttttctatgttttatttccattttcattctcacttgaaaagaaatgatatacataaggtatgaattataagaaaagcttataaatagtagtttacagttttacattgatttttattttatttagcatgttataaaataattattcttatcatcaaaatatatattttcaggttttttttttatatgaagatacatcacacaaaggatctattcatccaccatttttattaagtgatgagggtttacagtcatttttgtttttgatttgcttgggcttttcttatttttgctgatctgttcaaaaaatatgggcatgattatgagacctgatttactccatatttagcactttatcaaggttgtaaatattctttttgttaaattttattagtgttttcattgttttttgttgcatttagtatccacgtgatttttcttgtgttttagaaatcctatagtgtctttgtgtgtgtgtttttagttatgtgaagttaaaataatggaatacacacatgtagatgctaagaagagaaatgatgatcatgaacaagtccaaagtgtcagaaatatcaattcggatgaaggccttactttcgaatttagattcagaaatttagttagctttccactgatggtgatttcaagccaaacggaacagaggtttaagaattatcatcgatttagtagacacatatcattttcatgcttaagaaaagctcatccagaaattttccttcaatgccagaggttatattaacttagtgcagtaggatcaacatacaattagagactttttaatgatgtaatcatctaagatatgatccactttattttggaataatccggtccaaacaaatttatattcaaggattttttagacattttttaatatagtgagatcaacaatttttagacatttttaatacagtgagaccactagagactttttcatgatatcattatccaagatttgacccgttttatcttgggtcgaccaggtctaaacgaatttgtatttaagcaatttttagacattttttaactgaaatttgttttgtgaaggattcttcaattctatcatttatatttttgtttatgcatttttcttatatctttcaccatgtttaatgagtagtcttttgtttgatcatgagttatgatagattaggataatttgatagttaaatgatgatgatttatattgcttattgtagatttcttcatttaggttaatcttattattatgtgcaccgattatgtggttcataagtatctggtgaacattttattttaagtttttttgttaggttatacagctaacattaaaaaatagtaagaaaatacaagggataatatagtgaaaaaacactgatagtgagaacatatttcctgaagtctctcttcacttcatttggaaatggaataacttattttggcaatgagatgtttgattactgaacaataacatttggtggtttttgttcggaagatttctaaattggtgaaaatagagcagcatcttgtggggtttgatcaacatatacgaatgaagtaaaagaatgcaaagaaattgcgattaaacactatgcaattaaacctcattatggtcttagtaactgaataatctactcagttactaatgtataaatatatttttgctttatgataattattaattattattcatgtaaagtttaaattccaaataaacatatggattagtcatacctcaataattactcttttaatagtgcataatatttagttacttaattacttcaatcaagttttttttttgagttttcttgtcaataaaaaatgtcccgtttttttttattttgcatcaaaaaaagtatatataaaagaatacagagtaaaatagtattttaaacataaacttttcactttaacaaaattttctacttcaattcttaactagcggcacaatacttatttattttaagtgtttgatgatactttttctacatgtaaaaatcaattaacatatataaggtaatttttcaaacaaaaatataaaaatttcaagtatatttataaaattaaaatatatcaaaactattaaaaaaaattaaaactaattttattttgcacatcacgcgaggctacttctagtgtatatatattgtttgatgatgttgtgttttatatagagaaaaaacaaactcatagcataatgctttttaatttcgtcagaaaagccaaattaattagacaaaactacatttttcttctaaccacaccttatagagtgcttttttctttcaagtgcgtttctatatctgtgacgaagaaatacgtatcgcactgctttttcttttctttttttcttcaaaaaaagagtttgaaacaaacttaatggtgagaaataagtagaaccacacataaaaagctggaacgcgtcgtacattcacgcccttactttaatctatttggttctgtttctttttcttctgtgtctcatattatatccttccatatttgctgtcaaaaaccttttaaaagtcttattattattttacttgctcatctccttgtattaagaatcttgttttgagtttttgtgaaagcgttactctttaaataatcaacaaactcgttggctctgcaaaaccctcatgcatgtgctaagttccaagtaagtgtctatagctttctgctccaacaacaaaaagaaaaagaataacatcatccagtgtttgatccatttcttgaatcttgtaaaagggttatgttcttttgatctctctgtaacaatttcgaaaatg

SEQ ID NO: 21853 - DNA, 3003 bp, Unknown
  misc_feature (1)..( 3003): 2750-1469P.txt file - cDNA_ID_2035028; gDNA_ID_2926133; Annot_ID_197065
aaaaattgtttagtattagtaaagctatttgcaaattaaattctaaacgcaaacgaaaataaacaatcatatccacaatctttattaaggagctatatgatgagaatgcaaacactgagatgtccattagtcaatcccaaaatagaaatgagcataatcatccatccttgatcaccatacttggcagtgaagtagaattccggaatgaggaaaaaacgcgacaaaatcgcaactgtgagtctttttctattctcaattttgagccatttcaccagcggtgtgtatcttccgaccaaatcccatagtacattgctacgaggccaagcgtgtaccatgttcctagtctgtgttgtcccgtgttttcatataaaaacctgggtaccagggataatgtcaaatcgtagaggaggaatagattcactgcataatccttcataagcggatttacttcagtagtacttaacaatgggaagtttcggaaatacataaccatttattgtggaaaacatgtaaccgatcatattacattttcgtgtattgctttttgattcgcggtatgagaaaatcgtgattgttccaagctcaaaaggttcgtataccacaatgagtatccttaaaggatgggtaatcctacggagccaagaaacatagagaattcaactatagttttttataaccaaaacataaaacttcgaaaaccaaaacgaaaacaaattggaaaaacgtggtagtaataatcttcaagtgtgagcatattgttccaagaaatgttgttccaactccaagaatacagcaaaaaacagtgaagactttagatatgtcttatttatgttttcttttggaaaaatgtaataatttgaaattataagttgtgtcattattcgtttatgtatatcatagtacaatatatgatagattacgttgaaagagtaagatagatagataatataatgtttgatatagattttctcgtcatacccaacaagtaaacaaaaaaccttactaactgcaacaccattggaaacttatcctcttttcattggtcaatttcttcttttcgctattgtttagtcgaactaaaacgtcattaaatatcaatcaaactacagagacattatttttgtttaacaatacaataacatggacttcaaattagttttagtggaaataatgattagtactaataaaattcgatcgcctgtcgtaataaccaactcagctcaatgtcacatgctaagaagtaagaactcctgattatattttatttttaattctgttgctagattaattaaataaaataaagtcaggaattttgttttccttctttactcttttttttgtgccgacgtcaagaacctagttgaagattgaaaatatatattagatacaatttttaattatatgttatcttttttttttttcttgtctaaattatatgtatcttaaaatcgttaaatcacaatggtttttgtggagtcaagtcaaatgcatatggtgaatgattaggagcatctaacttctggctgatagctatttgacggctacgatgcatctgtcatataaaatggaataacggccagtagttctcatagaccgctattattttggccaacagattgatcgtaagaaaatataatagttgtatacattagtctttttggacacaaaatttttgatgaaaactttaacgaagttgagacgaaaagaaaaaaaaaaaatgtttctcatgaaaatatagttacattacataaggaatgcgtatggtaaatgtttgttttttgaaagttttattatgataaaattattatattagatttatattttttttatttttttgtcgaccgttattaattatttttttattttttgttcaaagatattaattgttgcattagataacataaaatatatataaaaaaccaagatttgttcacaagataaaaaaccaaaccaaatccaaatttcataagatattttctacactaactaaagtacttcaatcgaacgattctgttacaactttgtaatagtaaataagtaattagatttctgagtaaaacatagattatcaaagtcgcttttattattgttttgtttgcaagactcgtgcttacaaatctcccattgtaatcaactatcgttttctagagtttgtttcagtcattcttacactcttattgactactcttattgattattggaatttttttttctttttttttttcaatctttgcttttattcattgaaacaaagaacaattacaagcataagagttaaagaactcaaaaattaaaacattacaacaaaaggtattctccaataccataaaaaaaaaatctaaaattcatcgatttgaagtccatgagagttttaaggcaaagacaaagaaacacaatgcaacatatgagattatagagaatctaaagatcattgttttattttgttttattttgatcgaaagattacagaaaatcaaggaattgttttattttgttgatatatttttgtggtaatatttttaaaattactttttttctttcatataaataaaattcgatagaaattagtatttatatatatatatatatatatatatatatatatatatatatctgtatctcatttattcaaaattatcatttgtgcaaatcggttaataaatgtcgtttatgacactaacgagtaatgagtggtgataataatcaattcggtaatactctcacatttataaattatattaaaatattcaaacggttaactaattatattactttattttttgtgcaacaaactaattatattacatgagaaaaaataatgctgtgagaatgcggtacatgacagccacgtatctctaacatatcctcttcccgaacattcaccttaataatttatatggtcgttgaatgaaatcgaatcaaaaaaaacaaaaatccccaaattaccaaaatcctcggcgacaaagaggagagatagagagagagaaagaggcgaaaataatg

SEQ ID NO: 21854 - DNA, 3003 bp, Unknown; identical to SEQ ID NO: 21853
  misc_feature (1)..( 3003): 2750-1469P.txt file - cDNA_ID_2035028; gDNA_ID_2926133; Annot_ID_138829

SEQ ID NO: 21855 - DNA, 3000 bp, Unknown; identical to SEQ ID NO: 9308
  misc_feature (1)..( 3000): 2750-1469P.txt file - cDNA_ID_2035028; gDNA_ID_1972121; Annot_ID_179004

SEQ ID NO: 21856 - DNA, 3000 bp, Unknown; identical to SEQ ID NO: 9308
  misc_feature (1)..( 3000): 2750-1469P.txt file - cDNA_ID_2035028; gDNA_ID_1972068; Annot_ID_178469

SEQ ID NO: 21857 - DNA, 3000 bp, Unknown; identical to SEQ ID NO: 9317
  misc_feature (1)..( 3000): 2750-1469P.txt file - cDNA_ID_2035036; gDNA_ID_1972068; Annot_ID_178467

SEQ ID NO: 21858 - DNA, 3000 bp, Unknown; identical to SEQ ID NO: 15437
  misc_feature (1)..( 3000): 2750-1469P.txt file - cDNA_ID_2035053; gDNA_ID_2926134; Annot_ID_197084

SEQ ID NO: 21859 - DNA, 3000 bp, Unknown; identical to SEQ ID NO: 15437
  misc_feature (1)..( 3000): 2750-1469P.txt file - cDNA_ID_2035053; gDNA_ID_2926134; Annot_ID_138834

SEQ ID NO: 21860 - DNA, 3003 bp, Unknown
  misc_feature (1)..( 3003): 2750-1469P.txt file - cDNA_ID_2035053; gDNA_ID_1972121; Annot_ID_178999
gtaaccgctggaccgagtttagtaatgatcgggctcaaggaaccgtgggtttcaggctcgatatagtttcgactattcggtttaaactccataggtggatcagtaagcatcataggatgcacgctaattgcaacatcgtggttggaagagacgggttgatcttgcccaagtttaaccataaacggtgtccagtctacttcacttagaaagattgattggtttgttatttgctattctctttatattttactttccttttgaatgattttgctttctttacgttttgtaacttggatttgggagtttggtttttctcattaaatgtatgatctttgagttaaacatatcaaagaaatcatttggtaaaagtaaaaacgcaaagcaattggcagatagttcaatctattacctcagtcttcttgagtctggcaaacagaataagttatggtttcctcttgctcgaaatctgagcttcaacaatttgccttctccattgatgaattgggacctgaataagaattttttgtaagatgaaacaatgtttatcggaagcaaaagcagagtccggctctgtttttttatactggcttatgataaaaaatcaaagcaaacttgggatcttggaatcagatggaagtgaagactcaatcgaagagaaagagagatgcttacagcaggaaaaccgccgtaatcccctggttccgtaatgtttttagtaacacaactattagcagcaagtcgaacctatagtcggaaaccaaaaacggatttagatgaagcactgcacaatttcattactccaattatgtttctatttttttaccttggatacaatggagacatggtctcgaacagctactcgtcctcctagtgctacaaagtcaccaatcctacaaaaaataattgtcgaaaagacgagaagcttatagtttcaatcaacggaacataatagttatttggttgctgggattagaagcatttactctgctgatccagctatgcctacttggccacagaacaagcaacatttgccaataatcacattgtgacctatctgcaatatttaagtaaacagaatagcatctcagttgtcatttacttgtgatctatgggggagttgcaagatagaatcgaagagacacctgaactaagttgtctatcttagtatcatccccgatcacggtatctctccagctgcataaatagtaaaggatatggagctagaaaagagctttacagggaactagttcttgaaatattctgttacctgccccgatcaatgcatgtgtttgctccgatttccacacgattccctatcttcacatttaaagtctagggagagcaagaaacagaacaaaggataaaagtgatgcacaattgttatccagattcaagagagcaatctaggtgtgcttacttgaggcttcttcaccatgtttccgttgtcatccacgtaaaacccaaatcctgaacagttaaaaaccaatctcaattcaatgccaattctcagaagataaagaagaaaacatggacttggtccataccatcttgaccaatgcagactccattatggatgacacataaatcaccaatactacaattgctgactgaaacattatacctgtagacaagtatagattctttcaagattctcttcaaaaacatgtataagacattaagcaaaaccgttacccgatctttgtagaagggccaattttgactgatgatccaattacagtgttggatcctatatgaacctctgctcccaatatagcttcttggtgaaccactgctccaaactcaaccagagccgaggaatcaattagggccgaacgatggtacattcctcctccgtttcgccatcttagaaaacctttctcaacattacctccactacttgtctctaatcttgacagttacaacaaaacacaagaagtatcagcaacaatcatttacatagaatagtcaccacctttacacatataacatctttccaccatctaaatatcacaatccggactctttaatagcgtaaaatgtttcatgcaacaattgtcatcaatattcgttcatcacaatgctgttaaatcatatacagatcatgaacatctttcccaagcatcataataccacacatgtcagaccttatacacgaaactgatacgaatctaggaatttcactgcatattctcagaggcattccaacaaacaccttgcgtacacgataacttgataagataaatgcaaacaaaagtcaaaactttaaaggtacaaattcttaacaagactaaccgttatgtggagaaacattaacagtgacggattcagttgattgatgagagcaaacccttaaatttcggctactagagaaaaacctagaccgcttgttcaaaaagacaccatgagtggacactgagaacaatgttcgcaaactatttgccatagtcaacaaaatttatagagattcagaagaaactgaacaaatttagcgacacgaccaaaaaaaaaaaaactttgaacttgcttttttttttttccctccaaagctttaaactctttcttttaacaaaacaaattagaactaaaaaatcaacatttccatgtaatattttatactcaacaaacaatcttgaaaccgcttcatatcacttttgtaaacaatgttactcaggattggctattatgagttctaaataaaatctgatgacaaaaaaaaactattttgatgaatttataaattttatgattccccgaaacctttgaccaaatatgttttttaatcatattattatgtcaatgattacaacagcacattttaatttcattatctagacaggcctgcctaacctatggaatattgaagtttgaacataataatttgatttaaacaatcttaattatcaatgactaactgtagtaattagactttgaatcccactaattccaatgaagattatattaagaaactcaaagaagaagaagagcaaagaaaacaaaaacatg

SEQ ID NO: 21861 - DNA, 3003 bp, Unknown; identical to SEQ ID NO: 21860
  misc_feature (1)..( 3003): 2750-1469P.txt file - cDNA_ID_2035053; gDNA_ID_1972068; Annot_ID_178462

SEQ ID NO: 21862 - DNA, 3000 bp, Unknown; identical to SEQ ID NO: 9320
  misc_feature (1)..( 3000): 2750-1469P.txt file - cDNA_ID_2035097; gDNA_ID_1972121; Annot_ID_178988

SEQ ID NO: 21863 - DNA, 3000 bp, Unknown; identical to SEQ ID NO: 9320
  misc_feature (1)..( 3000): 2750-1469P.txt file - cDNA_ID_2035097; gDNA_ID_1972068; Annot_ID_178451

SEQ ID NO: 21864 - DNA, 3003 bp, Unknown
  misc_feature (1)..( 3003): 2750-1469P.txt file - cDNA_ID_2035112; gDNA_ID_1972068; Annot_ID_178447
tttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactgtgtatccataaatgggtgaatggaaagtttgttgttgagccaaaaaaaaaaaaaaaaaaatcatcagttcatcatattggtagtcttgtttgataagttctgctttttttaccttccagttttgccatttgatgttgcaatgagatttcttttgctaatgttttaaaataacaaagttgttgctgctagtgtttccaagttgtgtttgctgaaattagggtttgtaacttataagagaagcttgatcgctgctttcgactaaagggaattcaataacaacaagtttacttgaagaaaaatattaaaacctagaagaaaagagttacacctacaaataggataaaatccacataaatttctgttactaaatgtatcatagttttgtttcttctatgtatctacatatactcaaaaatttcaaagcattgtgacttaagggccagaagaaaacttgaagaaagattaaaacctattagcaaagagttaaagatccacataactttctgttgctgaatgtatcatagtttttggtttcttctgtgtcatatatacagactttctacagaactttttgagcacaaagcattgtgactttagagccacgagtaaaagacgaggcaaaatgtgtatcacgtccactaaccatataaactgtttcggctggaagaacacggttccactcgaatgactgatcttcgttcaatactctctctttctttctgtccacaaagaaatatccttcgtgaggcattcttatatgacccctccgaccactttcaaccaactcggttctcagtattttcacttgatccgtcgagttcacatccacctcaataaatctcttcagacctttacactcacttgaagctgccaccacatatactttaatcttcttcttcgggtcagtgatctctttgactgagtttgacgctggagattgctccatttgaggcacttgaaccgtcacagacgaatcttgaatcttactggtctcttggataacacgtctgggaacaatcacaattgtatccaagggtttaacactgttacactcgtatgactgatcttcgttcaatacttgattattgtgcgtaaagatgtacccttcttgagccagtttcataagacctctcagtgttttcacctcatccgtaactttcacttgcaccagaatattcgttgggacttcattcataccaggatatggcgacacatatactagcatctgccggactcttttttttccgttagtgatctttttgactaagtttgactgtggaaattgcttcgttggaggcacttgatcgttgttgttcttactcgcaaacttcacagacgaatcttgaatgttaacggtctctttgactgagtttgacggtggagattcctctgtttgatgcgcatcttgaatcttactgatgtcttgggttgtctcaggccgataactgtaaatctttctgatctcttcctctgtcaaaggccaatcttgctccgcaaagtactcttcaactgaaatccacggtgctggaggagattgctctgtttgcgggatttgatcgtcgttgttgtgaatagggttcacgtcaggagagacttcgagttggatttgagaatcgtggaagatctggcattggtcgaggttaagatcttctcgaagaataaaaatgccgtcgacgataagggtttgtttcgaaactgggacacgttgagacttctcgatcttctgtttgaccactaacaatgtatctgtgcgttccacttcaatctcgaacgatgaaccacccagaatctcgaccacaaacttcatgactctatcaatggtgtttcaagatcaatg

SEQ ID NO: 21865 - DNA, 3000 bp, Unknown
  misc_feature (1)..( 3000): 2750-1469P.txt file - cDNA_ID_2035268; gDNA_ID_2684231; Annot_ID_192273
ctccactaaacaaagctcgatcatgaagaatgataaaagctcaagctgaaaaaccaaaccttatgatcatgttttgattctttatatatcacataagacagaagattatcatcaaagttacacaaacctttttgtcagattgtgcagctttgagaaaccgtctcatgaacacatatggagttggcagacagaaattgaattgcaaggtattcgccattaacttctcctgcaagacacaataatgatcatccacatataaagcagagcatccatggttataatcaggacaagatttagtgaaggattttaccatatcaagaatctctgtcctagtataagccttgtcagagatcaggattagatcatcaacaactggaactgaaacttcttcatatttgcaagcaagtaacatagctgttacacccacaagctgaagctttttcctcgcgatatgttgatgaaccgcaagaaatctgtcaatgagattgattgtcaggtaaagcgtctcctccatcagctcaaacttgtaatgtacctgcaacaaagattcacagtaagctttacagtgagacaactaccaacaacagagcaattttatgttcatgtttttgtgtgtgtatatatatatacctcaatcaaccaatcaaaaaggattcctctcatcctctcgttaatgtcatgttgattctccatgtagttaggcgggacacagctacgacactgcaaaataattgaaaaagtttcaatcttgaagctagaatgatcataatgatacagaaacagaacactaaaagttacctcatttttcttgtagaagcaatatatgtcattaatgtattcaactacagataaaggattgttcttgtcacagctgtctatatccatcacagactcttctacttcagcatcaatatcatttgaatcttgcatttcaatcccttcctgcagaataaagacaacaggtttcttcatccgagtaaccaacaaaaaatagtggcttaaataaaacatgttattattattaccattttgtcaatctcttcaagcattgcttcagtatgttgaacaaacattggttcattaaagtctccttcttccacatctgttatgattctatctaatgcttcgtttgaaatcaagtctggtttcttggtttcctaaccacaaaaaaaccacttggaattagacaacctaaaccatgtcatgttttcaaatactaaattcagatagaatcaatataaaggtacctccttgtggatttggagattgttctcagctaattgagcagcaaatttcctgaaattaaataaagaattaaacaaactcatactacaattttgaaatcgaagcagaaatcaaatgaaatcactcacctagtaactggtcgatgcactggaacaggtggaatcttcttgttacaaatcccatttttcctgagaaaacaattggttactaagataagtctatgcaacgtttttattaaaggatcattgaaagaagaaagtaataaaaatataattactcagtgaatggtctcttgacagcacaaggatagaccggagctccgatgatgttcttgtttatattactcagtgcccttcttgtctgtccattcgtcggaattacctttcctccacgtaaaccccctaacattggcaaaatcatctttttagttaatcaaacaaaagattgatttttgattaaatgggtcttcttgtttttaattctgatctaccttgttgtcgattcatcggtccaatgactccgtgtctgttctcatccgatccacccattattatcttccgtatctgagaatcgcagaaacactcgcatattaacaatccgaattaaaaattgggtcttgaatccgatttgagaatctaaaagactcgacgatcaagaacaagatgtactctcttaaacccatatgaaatcaacactaaagtatttaccttgaagctttcaacgaaactattaacctctctctatctctatctctctgtcagaactcagaagcaaaatcccataacagcaaacacaaatcaacctctggctctcttcaatgatcttcaagagtctctctctttatcttctttctctcacaacgaaaacaaaattgaagaaaaagtggtaaaagagactgtagagagagtaatcaaagatttcgaagacgtgaagagcggatatatgtctgcaacacaccaaaaaaaaaatgttgttttacgaatcgttatctttttttcccctttttagaatcaacggctagttaatcttaaccgttggatacaacctcagaaaaaaaacctaatggaaaaagagaataggagcccaacggctatatttgtaaccatgtgcgtttttcaaatttggcttattttcttcgttattacttattactaccacgctcaagtctcaaaggtccaatggtcaatgttttatttcaatgtcaccgaccaccaaccgcttcctcattattaagccaatctaaatattaataccagtcgatttgaccccaaaacaaaaaacaaaacttagaccacattattattaacccaatctgataaattttaattttacccgattctgatttttaatactcaagctagtagatgatttaaatctttaaaccttagactaacggctcttcgcctttttgctttttcctctttacatctttttctccagtagctttgttagtcaacacattttccaaaaaggttgaaaataagtcaaagtacaaactgaattacccaatacggcccaatatcctgattagagagttaggcccaatatatcatcagatttgcaatcgcaagtctctttcaacttctcgtcgaatgttatactctcctcagagtttctccggatctttcaaaaacaattccggtgaagatgaatcagttctgtgattcgtgatttatgttactcaatcgatttctcatgttatagtcaccgatctgtatcgaaattttggtgtggattcatcaagcttctcaaatg

SEQ ID NO: 21866 - DNA, 3003 bp, Unknown
  misc_feature (1)..( 3003): 2750-1469P.txt file - cDNA_ID_2035268; gDNA_ID_1972155; Annot_ID_179471
gtactccactaaacaaagctcgatcatgaagaatgataaaagctcaagctgaaaaaccaaaccttatgatcatgttttgattctttatatatcacataagacagaagattatcatcaaagttacacaaacctttttgtcagattgtgcagctttgagaaaccgtctcatgaacacatatggagttggcagacagaaattgaattgcaaggtattcgccattaacttctcctgcaagacacaataatgatcatccacatataaagcagagcatccatggttataatcaggacaagatttagtgaaggattttaccatatcaagaatctctgtcctagtataagccttgtcagagatcaggattagatcatcaacaactggaactgaaacttcttcatatttgcaagcaagtaacatagctgttacacccacaagctgaagctttttcctcgcgatatgttgatgaaccgcaagaaatctgtcaatgagattgattgtcaggtaaagcgtctcctccatcagctcaaacttgtaatgtacctgcaacaaagattcacagtaagctttacagtgagacaactaccaacaacagagcaattttatgttcatgtttttgtgtgtgtatatatatatacctcaatcaaccaatcaaaaaggattcctctcatcctctcgttaatgtcatgttgattctccatgtagttaggcgggacacagctacgacactgcaaaataattgaaaaagtttcaatcttgaagctagaatgatcataatgatacagaaacagaacactaaaagttacctcatttttcttgtagaagcaatatatgtcattaatgtattcaactacagataaaggattgttcttgtcacagctgtctatatccatcacagactcttctacttcagcatcaatatcatttgaatcttgcatttcaatcccttcctgcagaataaagacaacaggtttcttcatccgagtaaccaacaaaaaatagtggcttaaataaaacatgttattattattaccattttgtcaatctcttcaagcattgcttcagtatgttgaacaaacattggttcattaaagtctccttcttccacatctgttatgattctatctaatgcttcgtttgaaatcaagtctggtttcttggtttcctaaccacaaaaaaaccacttggaattagacaacctaaaccatgtcatgttttcaaatactaaattcagatagaatcaatataaaggtacctccttgtggatttggagattgttctcagctaattgagcagcaaatttcctgaaattaaataaagaattaaacaaactcatactacaattttgaaatcgaagcagaaatcaaatgaaatcactcacctagtaactggtcgatgcactggaacaggtggaatcttcttgttacaaatcccatttttcctgagaaaacaattggttactaagataagtctatgcaacgtttttattaaaggatcattgaaagaagaaagtaataaaaatataattactcagtgaatggtctcttgacagcacaaggatagaccggagctccgatgatgttcttgtttatattactcagtgcccttcttgtctgtccattcgtcggaattacctttcctccacgtaaaccccctaacattggcaaaatcatctttttagttaatcaaacaaaagattgatttttgattaaatgggtcttcttgtttttaattctgatctaccttgttgtcgattcatcggtccaatgactccgtgtctgttctcatccgatccacccattattatcttccgtatctgagaatcgcagaaacactcgcatattaacaatccgaattaaaaattgggtcttgaatccgatttgagaatctaaaagactcgacgatcaagaacaagatgtactctcttaaacccatatgaaatcaacactaaagtatttaccttgaagctttcaacgaaactattaacctctctctatctctatctctctgtcagaactcagaagcaaaatcccataacagcaaacacaaatcaacctctggctctcttcaatgatcttcaagagtctctctctttatcttctttctctcacaacgaaaacaaaattgaagaaaaagtggtaaaagagactgtagagagagtaatcaaagatttcgaagacgtgaagagcggatatatgtctgcaacacaccaaaaaaaaaatgttgttttacgaatcgttatctttttttcccctttttagaatcaacggctagttaatcttaaccgttggatacaacctcagaaaaaaaacctaatggaaaaagagaataggagcccaacggctatatttgtaaccatgtgcgtttttcaaatttggcttattttcttcgttattacttattactaccacgctcaagtctcaaaggtccaatggtcaatgttttatttcaatgtcaccgaccaccaaccgcttcctcattattaagccaatctaaatattaataccagtcgatttgaccccaaaacaaaaaacaaaacttagaccacattattattaacccaatctgataaattttaattttacccgattctgatttttaatactcaagctagtagatgatttaaatctttaaaccttagactaacggctcttcgcctttttgctttttcctctttacatctttttctccagtagctttgttagtcaacacattttccaaaaaggttgaaaataagtcaaagtacaaactgaattacccaatacggcccaatatcctgattagagagttaggcccaatatatcatcagatttgcaatcgcaagtctctttcaacttctcgtcgaatgttatactctcctcagagtttctccggatctttcaaaaacaattccggtgaagatgaatcagttctgtgattcgtgatttatgttactcaatcgatttctcatgttatagtcaccgatctgtatcgaaattttggtgtggattcatcaagcttctcaaatg

SEQ ID NO: 21867 - DNA, 3000 bp, Unknown; identical to SEQ ID NO: 15025
  misc_feature (1)..( 3000): 2750-1469P.txt file - cDNA_ID_2035675; gDNA_ID_2684254; Annot_ID_193069

SEQ ID NO: 21868 - DNA, 3000 bp, Unknown; identical to SEQ ID NO: 15021
  misc_feature (1)..( 3000): 2750-1469P.txt file - cDNA_ID_2035675; gDNA_ID_2684254; Annot_ID_138074

SEQ ID NO: 21869 - DNA, 3003 bp, Unknown
  misc_feature (1)..( 3003): 2750-1469P.txt file - cDNA_ID_2035675; gDNA_ID_1972137; Annot_ID_179139
tcagaggtaatcaattttttacttaaatcgctttttttttcttactttcggtgtatctactacgtgtgttgtttgctggttatggaaatgaatgttgtacgtcacgttatactatagatatatgtgtgtttgtgtgtatgtataacggaagtatttgtatccgttgtggtcttggacttttggtttggttctaagatacttatttttaaaaacttgtatcgttgagttggttttctagatatgcttaatgggagtatgtgacgaaaaaaaagtatgatttctgtaaggcaatgcatgggtttggaaaattcgttttctcttgtcatgtgggaggatttgaatttaattttggcttatttttgcaattgtgtgaatgagaccaaaaagagacaatgaagaagaacaggaaacgtaccaaagatgatgtgtatcattaattgatttagtcgggttctgtccgggggaaaaacaaaaagagacaaatttgggattctgagcttcgtacgttgatgcttctctgactcttttgccttgtgtatttatgtgttctgtagaatctttttcgtgtaacgatttacatatattcaaatattttgctttatataaatttgcatcatggactggtatgaggtaaacatcgggaccaagactaagatataaaggacgtagccaattagttttttaggttggtccatgaaatttaacatggtattctaaccagagttttattttgtaagtgtgttatgttttatgtgttgcacatgagcacgtccttgatcgaagtatttaaaatttgttattaaagaaatgtgtaaatttatagggatgataagtgattgtgattgagattggtcatgacgaggaacatacgtaattgacgtcgtatttgtgttaagcttgcatcatgaagtgaagtacgtcgacgttattaataattatgatcatttagtactacttacgtactattgtaccctaactgccatttcatttgtcttttaacatttttacctaagtgacggtcatgtgaattgtctagtagactagtactgactcctcttttggctttctctatagacaaccttgaatttaattttaatttatgttaattacgtcttcattatcaaaccaaaaacttagaagatttctaagttttgtggagacttgcaattagggctcagctggtcatgttgttagagcgacataaaatgagatgaattttattagtttgttggattctacaaagatattggactacctaccatttgcattgaaaagaatatcccaaaagagacttttggttttactttagggatctctttttattttattttatttttttataaagaagagagtattgggaaatctttaaaggcccaaaccaaagctcagccatatttctacagttaagcccagccatttttttaccaaagaatgctaatatcatttttcagcaagattttattgaatcattcaactctctaattattgattagtcgcggtattaaaattgtgcttccccttttggaaaaaaatagagtaactgttcaaatccttatcatcctgattcaggatattaaaccttaaatattgtttgtcaaactcaacttctatcaatcattttttatattgttttaatgttaaacaactgtccatctatcttatcaacaagaagaagaatttctagccagacttataaacttgcacgacaagacattcatccttttttaattaatgaacaagagtaacgacttttacacttctcttgtcacaaaattattgaacagtatttacaagtattttataaaaattgctattggttgatatttttattggtgcatgtcaagatatttctggcaacaatcattagaacgcgaccataacatgtgctgcaatttgacaattctttatatctaaaaaatgacaatttgacctcgttggaatcttggatttgtttctcccaagcacaatatgttcgagctatcgtaccatttctgaaagtgtaattataaagactgcaatcatatatgggctcgtggagctaaatcatggcctaaagtttttttttaatcaaatggattttgaacttgtggtaaagttttcggatctacgaaaaattatgcattcttaatcaaacctctaattcgataagacaattgttttccaacaaagaatgtgtcaaaactcaaaaactcttaacaattgttttgaatgttttccaataataccacatcggtttatgtatcaattaatattccaaaagttgatactcccaacgatattcctatgacctagaatttgatccatatctcaaaattttacgaccgacaaatatattaatgttcttttattttattttatatagattaatggtttagtcatctacatgtattcattaatacacctatatactgtaatattttcacgaaacttttaaacatttacaaaaaatgaagagattaactttgaaacggaagagtgttaattacttaattatgtatgttttgtttgtttgtcaacgaagagtattatttttttatatactaatatgaagacaaaacatataattccatgtcacctcgtaatctcgtatgttgtaaaaaaaatatctctatccaatagtatttcactacctagtttaaatcgcattctctataatacgttaccatattccccaaattacccttagctatgaccatagtcgctggctcgctgcaaaaagtgaaaggggtatataggtaaaaaaggataaattaacagagagaggaagggctttggcgtggaagctcagcttttctccgagtcgggaaaatgtctttttctcgaaagaataaatctttttctcttctctctgtgttaccctcttgaaattttccgcgaaaaatctcaacttttccatctgaaaaccccccaaaatcaaacaattggatcttgatttttagctgtgatttagtgattaagaggcttagggtttgtggcgaaatgttggtacagagaagagtaatg

SEQ ID NO: 21870 - DNA, 3003 bp, Unknown
  misc_feature (1)..( 3003): 2750-1469P.txt file - cDNA_ID_2035703; gDNA_ID_1972105; Annot_ID_178715
taaagagtgttttgtcggagattatttttatttaattggtgatggtttatatgaaaatggaattaaaaaatgacagctaagacataatggagcccacagatgggaaagaaatcgaaagtggtcagcttcaaacatgtgttttgattcccgtggattcgattcgttcgttgtccttcttatggggtccgccattcacaaggcctattggcctatgcttgcctttttttaagactattttcaatttcttatattataaaatgccgacaaatactaattgaattcaaataaattttaaagtttaaacgaactaaaagtcctggtctgccatagcattttcgtactatacttcccatgtgcccctgtggccttgtcttggctctaaattcatggattattgtgaagtcaatagataattagggattcatgttaattcaagtaattgtgcgttaaacatgattaccaattatgtaattaggaaacattccttccgatcaatgattataatatagtataatgctgggaataatttaatctagtgctaatttttttctatgcaggtgcaaatgctaactaattcttatgtgtattgggttatataatcttcggtggggagggccaaacacgactaactcaacagtaaatggtcaaccatatgtggtatgggcggcggtacatgtcatgcccatttcgtcgaccctaaaatatggtaatgtagtattttttcacaaaggagcataataataatagcgttgataaataaatggctccatgcaaattatatataataaaattataacagcataatgatcatcaacatcatttattgctaaacatcatcatgttcatgcccccatgcatgattacgatggaagaatctgacataaaaaattgaaggtccaaattgacaacgacttcatcttaatcttataatctacatgtcaagaattttatataaataaaattgattaaatttatataggtgaaaaatttcatataaacgtgaggaggaggaggagaatgagataaaagggtccacctgggcccaaaaacaccaaccctgttgagagatgttaggaccctcgtgtgggctgggcccagtcaaaaatcattgtcttgttgtgtataacaaacattacaggttcacacgtgtgacacactaggtccttaaatgctatgaatatatgtgatctgatttgttttattttaccattaataagaaggagcttaaatcgaacaaaactgaatgataaaacaagatttcaccactgtatatatcgtaatacaataatacatgctgaaaaatattaaggtaaatgtgtagatgtagagaacaacatggcttaaacacaaccaaacccataaatttattattcatggatattggatatatgcattatatgcattattataaattaattgacctcgtattaacatttttctagaaattggtgcagggggtgaatcgcgtctacatctatgtattttactacatccccgtctgtaaggattcactggttgttcggagggtgcacatgcagaaggataccgatgatgatcacaaggaagatcaggcttcaaccctggatacccaattacttttccaaccgtcatgttcatgctgcttatgaacacacatgctatgaatgttgccactagcataaacctatttgttattttcatattgctcatgatttgtgtttatttatgtgtgtgggagaaatatatatttgttggtaagaatggtacagttcgtggtatttatagtgaataaataattgtgaaagagtcttatacaacttttacttaaaaggaaattacaataggatgttgaattgaccggtagaaaatgtacctacagaattctttagtaatacatgtattatagatatagtccttttttagccaaagtagtcaaactagcttttagatatgcatgttgtggtcatagtaatactaatacaaaacagttttatagccaaagtagtcaacaatatttgagttctatgtactcttttttttttggtcaaagagttctatgtactctaatatagtatatcaatatattaggtttcatgttcttccagtacatggaggtgaaaacaaagcacttttttcttacagaaatttttttacatcaataatatgcaaatatcataaactaataataattataaatacaccaaaatagtgtgtcaaaattggttgtagacaactattagaatgaacacatcgctgggctttttggtattgggttcaaagtatatataaaaattcatgctggttctttatttgccgcccaacataaattagttggacaagtgagaaggccttgctactcctacatgcgttacactattacagtattactattgcttcatagaaaaataaacctcgtaccaaaatctcaaataagtgtttcttgtggttccttatgaaaaattgttatacactattacagtattactattcaccgtttattgtcggaactcggaacaacgttttcaccgtccaattgttatacacactattcaccatatatacattaatacatcacacatcttctacttaagagtgtagtgtacattaatgataattttgtaattaacctttttaatgatggttaaaatgtctaattaataatttaatagtgacttacttgcttacgtggataaaagagagaccccacacaaaaattagattttgccgtctgttaaaaaaaaaggcttcttcagccgatttctccaaaaatcgtttttttttttttttttttcatcttccgttcaacgttttgcgttcgactcttccctgacccctttcaattttaaaccctttttctctgtctctcttgtccgaatcaaatccggttgctggaaaagggaagctttgtgcttttgtcgtcgtggtgggggaagcggaggataagaaccctaattttttacgaatcgtgagatctcctaagtttctgaatcgggtggtggcgattttgtttctttctccgcgatg

SEQ ID NO: 21871 - DNA, 3000 bp, Unknown
  misc_feature (1)..( 3000): 2750-1469P.txt file - cDNA_ID_2035731; gDNA_ID_1972105; Annot_ID_178703
cttcacaagtctggtggagttgtagccagggtcaaagaggtccgtaaaagatcaaggaactttaagattcaggtaaaattttcaatctcaaatcttttaatatcccttttttcatgcctttggaggtgtaactcagaactcaaaaactgaattttccaggaatatttttacggtttatcgaaagaactctctccgtatgccaatacatcgagtttcagtgatctgcaagtgttccgaattggtggtggaccacaagcgccaaaatcggctcttccagccgggtctacctcggtttcaaatccgttgcgggtgacgcctgtaaatatcgatgatcgggatctgctgcattctgttcttgctgtctcatacgcagaagaaccagaccagatcatctcaaggtaatctctaaaagttcttgctgtttccagaatcaaaggctttcgtgtatgttttcttcgtgattttgatatttctttctctctgttttttctttgatacagcaatgtttctgggtttgtgtatgtgacggaagttaatgtgcagaagaagaagataacgtatttagcaccatcgcctgggacattacctagcaagttgttggtcgctggatcattggcatggcttgagtcagtatgacttacttagagaagagaggagccatgttttttgcttgagagaatgatgcagcagctcgattatgtaacgttaattacaaatagcctttttcttctttatcaaatgcacaagtttttgagtttaaaagatcattattgcggaatagatggttggttgtaatttgatgttatgaagtgagcaaaaaataatgttgatttactagtgcgttagttctgtttgtttggttcagcatattcaagtgatgtgtgtagcatttttaaatttgataggtcgaacatatcttatgttattggatgatttcgaaatagtatatgataatgttcaaagtcacacatgtattattattggttattaattcaactaaattactatcacattttaagtcacttcaattgtattgttgtataagctctgtatttagaatcggatccgaagaatattagttggtctgtctaaccaagtcgcattaatcttatatgattctcctagaatagaaaagaatattttattcttatgctaattcaattgaaagataattaaaacggatatgttttgagttcaaaatgttaaaattgtcattcatttgcaatagacaaaacatatttagaaaattctaaatttacatgctacaagatcttctatatgctttaatagcctcatttttttttttaaccctgcacattaaatacagaaaatttcaatcatttgactgatgattagagatttatagatataagaagaaagtttcacttatcattgtgaatatgataaaacaagaataataaaaatatcgtataattaacaacaagaacaacaaacacaaaaaaaaaaacagaaagaaagaaaacaaaaaagagctagtcaacaatcgtgattcgtgatacaacgtgctagagagacgaccagatgagatagggcacgtgtcgaaatctataccgttacttttctaactccgtgctcggaattcgaaatcaacgggagacacgtgggttccacaatggacgttatttccatttcatgacaatcgagaaatagttaaataaaaaataaaaaatattttctaaaatgaatacaaaatcaattcgaattttgctttggaattagaatcatttttaaaacatatgaatatagtagtacaagaattttactgagtcaatgtccaattatcattaaagatatttgactctaatccattctctttctctaatttttctttaaagatattatagttaatcacatcatttactttaagagaaagatatccgaaaatcagaaaatgttaagatacattatctaatttcctttaattgatacggtttatgattttaatcaattttctatttgtacgaaaaacagtaggtataaagtaggtccactagtaggacccacctaagaaactcttttttaacagagggctctgttttttttttcttcctctcctctgaaactgcgacgaccacatctctgttctgtattccacttatgtttttgtgtttggttttattttccccagaaattgaataactttagcttttaagaataaaaaggaaaatttaaaattgaaatttggtctccttgagaagtgaataaatgaagaaaaaaaggaaataaaaaggggtttttggtaatatttaaaaattgtagaaatggtggtggtgggggaattttaagtaaaagcaagtctaaactcttccccacccacaaagcaaaagtcataacctttgacacttttttatctcaccatctctatctctctctctctctcacaaagaamcaaacaagacaaatctttctttctctttattttatcctaaaatttcctatctgatttcttcctcttgagctaaatttgttaccttctgggtattcaaaaagatctcattttttcttctagctctaaattttcagggagtttctttcttcttcttttgaagaccctttgtcatgagctaatttttatcctctgtgtgttgagaaagatctcattttttagctttaggattgagggagtttcgatttttacttagcacttttccttggaagtgatttggtggaactcatggtgattggtttcttcctagggttattagagattgagttctggatttttcacgcgccttggatttgatctaatgtactctcttttttcatgtcttaatctggtttagatttttattttgagatcttttgttatataggttgcaagttctgtattttgttaggctttttagtttctgtgttgattatgattctcttggtctaggagagatttgggtgttgttaactgtttgagtttgagaattgtgaaattaggttttttttttttggttctctgatctgaaacttgggtagaagaaaaacatg

SEQ ID NO: 21872 - DNA, 3003 bp, Unknown
  misc_feature (1)..( 3003): 2750-1469P.txt file - cDNA_ID_2035738; gDNA_ID_1972105; Annot_ID_178702
agaatgtttctaactttgaaccaatctctgttcattacgttccaattttgaaatgtcagatgaaaaaagagttgtgaacttttagaagattatattttgttatcgctagggtatagagaaagctgagattttacaaattgaaatgggtctttgagaatctgtgtaatagagaatctgtttgttttgtctttggttggtggatatgtccagtggaatgggaagagaagttgttgaggtgcttatggaccgaaacgccgacgtttcaagcgctagagttcatgttgctcctaagatagctgcagaggagactgatgaggaatttgaagtcaaagaatgcacagaggagaagtctctttctgagaatgcaccaaatgttggatctgctgagagagttggagctcagaaatcacctaaaacccgtaatggaaatgctaaagtttcaaaggtaaaactaattcataagatcttggttttgagaataacgctttgtagatggtatatgattgaggcctaaatccgattttgacccgtttcttaatgttttttttagcagcaggatgctcctcttctcgcggtgaggaagccattgcaacccgagaacaagaagcatattgatgacgaagataattgctccattgcttcttcgtatccttttcccatctctatcattttatacttgatacttatgtatggatgtttatgtacacgatgcttaacagaatcgatattgtttccttaacgttatttaccacagcgttgcaacttccatgaggatgggtaagtctggattgacttatggaagtgctccaacgtttaggagtgctcaacgtgctgagaaacgcaaggaggtaagtacatattctatctttctgcttccacatctcagttatagatcacataagctctttaaagccaacaaaaactcataatcagaaacataatctgcattaaacgtgtagaattcactctgttctgtatactgattggaatttattttgtggggtctgcttggctcagtattaccaaaagctcgaggagaaaaaccaagcgcttgaagctgagaggaacgagcttgaacagaggcaaaaggtaaagtacacatttccggtagatgcagtttttttacctgattctagattggttgtgaaacctcatagatttaaatggtttgcaggatgaacaagaagcagccttgaagcaacttagaaagaatctcaagttcaaggctaaacccgtccccaacttctactacgaggcacctcctgcgaaacctgagctcaagaaggtatccttcgaaccaaaactttatctttgttcagagctcagcattgttctacttatgtgccaaagtaacttatgttatgtttctttctagcttcctttgacacgtcccaagtcgccaaaactgatcctttctcggagaaaaagcttcagcgacgcagtcagctcgtcttcccgtgaagagattctgaagacagtctctaaccggaaccgacacagcactggaacagttcagaacaaagacgatgatcacaggaacaagaacaccaatgctgcgcacgacagccctcgtgtcagatcaggcaaaggtaaatccggattgaaaccagtgaacgagtcctcagaagaagcttgaaatttcaaaagatgatgctttgttggtctaacttgatcttgccggagaaaatgtaaaatcaaagactctttgtttttcggttatttccggtatacgtttggttcactatgtaactgtcttttttcgattttaagttttaacatgaaaaactttatgttgattgttgaacaactcctcctaatgttgaaatttgtaaatctgaatgctgttggatttaaatttagcagctaaggttattttcagaaataatctctaatcgaattatttacggactgaaaccggcatcaaacatttatcctaaaccgaaatagtcctaacaaacttctgataaaatccagagagcaaaccagtggaaagcaaaaccggcatcaaacatttaacctaaaccggtaaatcaaatatagaagctttaaaaaaccaaacctaaaccggctaaaatcgatagacctaaccaaccactagcagtttcccggccgccgcttgaatgatgaccactgcggtgcgttccaccgccataaatcggaatcggacgtaatcctcctcctctgctagaactccctcctccgcctctgctagaacttcctccaccgcctctgctagaactccctcctccgccgaaactgcgtccccctccgccgaaaccgcctccacctctgcctcctcctccgccgcctttcttaacaacgactgttaatttcggtaaattggcttcgattacgtcaccgtctggcttcaattctacttcttgaaacgggagatcatcatggtttggatcaacgaaggctaaacttgttgaagatcgcgagaccgcgtgagcaaagtggtgttgcagttgcaggtggagacagagaagaaggaataaaaacaaagatgctttcttcaaatccataattcgtttcgtttcgtttctttctttttctgtgtgacttacaatttatacaccgaattgtttataaccgcgtgactatatgactattctaatttgaatatctgaacgcgtattttaatatatccgactaattacaaaatatatcatgtttagataactattactatctgagacccattttcctgtcggcttctgagaaatatcaaagatggatttgtatacgtatataccaattttccataaacaatgctacaggtttcgttaaagaaacgaaatgttatcaatcatgcatgatttcatacttttgattatcatatagttttgttatgaaaatctttagtagattaaggaaatagaatttaaaaaaaaaaagagagggtaaaacagtaattttgtgttccgaaagtttaaaagataacagataatccgctcacactcgagcaaatttatcggagcctccctccaaaattcaacaatg

SEQ ID NO: 21873 - DNA, 3000 bp, Unknown; identical to SEQ ID NO: 9365
  misc_feature (1)..( 3000): 2750-1469P.txt file - cDNA_ID_2035748; gDNA_ID_1972105; Annot_ID_178697

SEQ ID NO: 21874 - DNA, 3000 bp, Unknown; identical to SEQ ID NO: 9364
  misc_feature (1)..( 3000): 2750-1469P.txt file - cDNA_ID_2035756; gDNA_ID_1972105; Annot_ID_178693

SEQ ID NO: 21875 - DNA, 3003 bp, Unknown
  misc_feature (1)..( 3003): 2750-1469P.txt file - cDNA_ID_2036236; gDNA_ID_1972138; Annot_ID_179191
atagtattatggttttttttatataacaattgttagtattagataataaatagataaattagcattccatctatttataaacatttccattctattatttttataaaaacatttttttgtaagttattacaaacaaaactgattctctaaaacattaaaatataaacaaaatgattgtttgtgaacttcttgcatttttttcctaattcgtttttcactgttggaaactttgtgttacaaatattttagatgtatgagtaaagtccgcaccaacatacatcgtgtgtcgatacaggcaaagtgtacggtctgacatatacggataataaaatatgtttgtataaattgttagaaagagacgatccattataaaaggtaattaaaataattttattcctgtgggaaaggaaaagaaaaaggccgcgtggtccaagtcagtcctcatgaccaatcattatttaacatagtatgatttattcatatttaatataaaaattattagagctcagatttgttttaaaattagtagtagcttaaaatttaggggttttcagaattagtctgaacaccaaaaaaaaaaaaaaaaattggttctaatgtggaattggttgtattgaataaagttgattgagaaagacacacagtatatgctaattatggtttagctggttgtttaaaataatagagtgattagttggtcgcttactgacaaaacgacagtgtctgacttgcaaaactggaatgaattttgtagttttccgttgaattagcagacaattttcaacttaaagatgtttactctactttttttttaatttaaagcaaaattcttgtaatgtttttttttattgtatcctctttcatataataatttttaaatcctgtaacgaataattaaagcaaaacatgttgtcactacagtaatccgtacataacaaaagcaaatatacaatttttattaggataaattaggtatctttgattttaaaaaaactatattgaaattataaatatgctttcattttcaaatataaaaattctctaacgataattatactgagtaagaattacaaaaaatgatttaacccttgaaaataagtggaaataaaagttttaaaaattaaaacggagaaaacttaatacgaaaaaaatctataatcattgaatagtgaccttcatataaaagaccgtaaaaaaaaaaaaaaatgcgtaacctatattcacgatagtccttactctatttaatttccacagtaaaaaaaatcgtataaactattttttgagcattgctcttgagtaatacatttaggttaccaaatcatatgaaaatataatagtttctctctaattattttctcaatattcttaatctgatttcgtatttatattaattgtccagactccagacaaaagggatgaatcatggctggatttagctgtcctacctgttaatatatctctactgtctagtaacgccaaaacctgacagttagtgatatatattagactaattagttattccctaacccctgtttccaattatattactcacatatatacatgagtttgtgataattaaacttgatctacttaaacgtaggtgatagacaaatagcctaatgttttttgttctctcgcatcttttaccaaataccgtgtggtggattcaagttctccatagaacattttaaatgttgacaagacaagaatctattggattaaacatacaaatgggaaaatttatctattgaaatgttatttaagttagataaatgcatcaacaaattgacgtatatgtacttaactgatatatatatatatatatgttaatgtgtatatatatatatatatatatatactatgttaatgtatatagttatagttgcaaaagaaaaaagaaagtgttaaattttggaatgtgaaatgttggaggagaagatggagagagtgtgaggtgggtcagtgctgcttttggctctttcattacattagtcagattcccatatgacatgagactttcgctcttcctcagaaatagatcccttaatattgtattctagaagtatatttgacataacggaatcaaaagccaaattgaagagctatgtggacttttctacgtaattaatttaggtcttaatatacttagtatacactctcaaaatgctagtaattaatatagcaaatgacgaatatgtagattgatgatagttcaactagtcatgtaatgatgtgaagatacaaacataatatgcatttgaactcaaatcctatcaaccataagtaacatttgggtacccatatttataccaaaacgtaacagccaattaaaaaatctggtaaaatttcatagaaaacgacgtaatcgtgatacctttgtttactactaatcttgatactttatgatttacatccatgtgaaaataaaatcatgtagaccaaaaatttctcatacaaaaacattaaaaatagaaataatggttttgcaatattttgttaaaacagttaatttttttaaaaaaatacacacgtatatattcatagtttatatactttataggcttatagcatagttcaatagaggtacagacaaactgaaaagaaatgaacctaactatctgtcttcacctcgattatttgtcgtctgtctgactattttaatttaattctaataatttatgaatgtgactagtttggcttataggcaaagatcaatttttagagtggggttattgaatattgtattctaacggaattgtatgtattttcaaagacacggtgacatccactgtcattcaatttctatttgattttgttacatttgagtttcaatgtattattttgtctaaatcacgagtaaaacaaatacgagccttttatctctgattttgatgtatttctcataaaaattataaacaaaataattattcccaaaattgttttatttctctttcatctaacaaagagataaagaatcagaagcattttgagaacaatataatg

SEQ ID NO: 21876 - DNA, 3000 bp, Unknown; identical to SEQ ID NO: 9506
  misc_feature (1)..( 3000): 2750-1469P.txt file - cDNA_ID_2036242; gDNA_ID_1972138; Annot_ID_179189

SEQ ID NO: 21877 - DNA, 3000 bp, Unknown; identical to SEQ ID NO: 9510
  misc_feature (1)..( 3000): 2750-1469P.txt file - cDNA_ID_2036267; gDNA_ID_1972138; Annot_ID_179183

SEQ ID NO: 21878 - DNA, 3003 bp, Unknown
  misc_feature (1)..( 3003): 2750-1469P.txt file - cDNA_ID_2036273; gDNA_ID_1972138; Annot_ID_179182
aaatgctcgttaacttcacaaatatagtcatttctatttatcacattccgagaaattatgattacttgaatgcattaatgttaaaaatataatgtttgttgcaatgctaaggttttttttttttcattctaaattttgttcttatttttttctctaaaaaatgagtagaagtaaatatagccgagaaaaagattgcgatatatagaagcaaaagtcacctttctatgtgatcaaattcacatcgatgtttggtaattgatttgctttaatccaacggtcccacttttacatcgacttcatctactatacatacatgcatgggtcttccaatacatgtgtgtagcgttatatacataaacatatatagtgacttgtataaaaactaaatgtaaataaaacataacaaaagtaatggaacagtgatttagtgatgtgtggtaactggcgagtgctttggacatttttgtataaccgaaggtttaactaatcaagattaaaaaaaaaaagaaaattaatcaagattataagaaagcacaaaaaattatcaagattataagagcaaccccatcggttcaaataaaagatatcttagctatatcttagctaataaactgattaaatttaataaaagcagctaagattagttaagatttatatcttaaccaagatattttcttaagtttaagaagtggacaggtgttgtgtatttattgggtacacaaataaacaaaagtaaggaaaaaaaaaccattggaacataaataatttaaattttttcccttaagaactttttgcttcttaaccaatggagcataaataaattaagatattctctaacttatcttaactttgaaaaagcaaaattttaattttaaaaaaggttaagatccaagattaaaagctttaacatcttaaccattggggatgctctaaaggaccatgcatccagtatcttatgtgttggaacaggtgtatccgtatatgtatgtaactatgtattatgtatcgtaatttgtacgtaagcttggtgccctggtctacagttccctagttaagattctattttgacaacaaaattgatgattccaatcatccatatttgttatagggagaaattgagcatgctatatacggtgatatatatgatatttatttaatatattgaataacaaacacagaactagtgttataggtgcaggtatgtaaatataatgtgataaacattttttatatagattggaaagaatacgagattgttgttgctctgttagaacgaacaaacagaactagtgttataggtgcaggtaaggtaaatataatgtgataaacattttttatatagattggaacaaataaacatttttctgttagaacgaacaaaggcctgtcaaaaagaacaaacctgatgtgacatattacatatatgattataattgattattgtatatatagtattgcatgactatctttacaagatttcaatacgaaaataaattaaaaggagaaaatttataaacgaagcgatttcattctcggtaaggttttccgatatgtctcctaactaaatcaaagccttgtaattgaaacttgtaatgattgttattctatatatctttgaagaaagcttcggtattggacgtacttaatataattggattttatttaaattacaaaaatcactgtataattcggctacatgacttaatcaattatttcacgttgaaaacaatactatatcaacttcaaatacactccttgtgtatggattccacaagttcttttctatctatagaaatatagaatccacaagttctatctacttttattagaattttttattgttcgttgttgttaacataattataagcaataaattcaaaaaaaaaaaaatctaaaagacacaaaatttccatctttgatagggcttcggaatcattaattactttttacaaacaaaaaagaagaagatagggcttcggaaattattagaaagatggaaggatattgtattaaatttggcttcatattttcctttggtttgcggccatcaagtactagtactactcagtacccacaggccacaggaaaaaaagtagtactgctttattaagtgtgttacgataaatggaaagcgttttagtatgtgattacaaattgttgtatgtgatcattaattagttattggtccgacttctaagtttaaatattttcagaattcagttagtttaattatacatgttagacgaaatgactctttttgagccaatatataatgtatctgaatttttcattttgaaaaatctttttataaaataataggtcaacctcgaattattataataaaataaataatttgcgttactatgaaaattaatttactgaatacagtatatagagagagatagaaatagaggaaaacagtggataatacatgattagttgatactcatgtgcagcgagtctatatatattatatactcatgattagttgatacatatgtgacgattagttctacgaatcaatctctagttttcgtcttaaaatcatttggttttatagaatataagaaacaaagaaaacaggaactttcgcgggagacagaagggtacgtgaagagaaaaacacataaaagtgataagggcttaacgtaataatactacaacaaaacctctctacgtacaacgagtaataacacatgaaaatagaaagtcgatgagacatcgttttaaggttagatcgatgaagaaatatctcaggccccacccctgggacccgacccgacccgacccgacccgacctttgtctcctctccttttaaaaactctccattgcttctttgtcttctctcttctataacataactcaagaaattaaagaagatagatagagagagagagagagagtaaaaacctaaagggtgatatacttatataaaaattaatttaagattgtgattaagtggttcactatatttaagttactttgaggagctactaatcatg

SEQ ID NO: 21879 - DNA, 3003 bp, Unknown
  misc_feature (1)..( 3003): 2750-1469P.txt file - cDNA_ID_2036309; gDNA_ID_1972138; Annot_ID_179197
gcattgtttattcacaaaagaatcgatacagaatggggctcgtgtcacatatatacgtatttgggtttagttaacttatcaaactttaacatatgtcgatacttccattctcttatcgatctccttgcattgatcttttttcttcattgtttccaaagtttcacatttaagcatatagctagacatgtttcctaaagcagatgaagttcatgaaaggatgctcaaaatgttgaccactaattaaccttgtacctttgatttcttgatgcatgctagacaaatctcataaagttaaattcaccgaaaacaaggataatccacaatttagcgcattgacagtactaaattttgtatggctataacaccgcaaactttctaccattatataaggaatacctggctactaattatatttttacaatgagaatagccaaatgtataaaagagtgtattaaggaataccaaactactgtcatgactatcgtctactttctatcctagaatcagtgagccagaaagaccaaaaaattacatttcgctataatatcaagaagtaatcagaaaacttctaaacttttaggcataagataggaaaacatcaaaagttaaagggtctaaataaatcagacctagctagttagagggaatttctgcgagtcgtgattccaaacagcttaaactataccctgttcgattaacaattaacaagtgtattttacaatcagtcatgtagcaatatagaatatttcataactaatttaaatcaatactatttagtacagtttttattatctcgctgtgtaaaaataaagaataattaaaatttgatatacaatgttcctaactaattttctatacaaatacataaatattcacatttttacaatgatcatcagccaaatgtacaaatgagtgtggattattttatgcatgaacacattcatgcatgcacacgtacgtatatgtataccacctacatagaaaatggctatatttatagaaaaagaagagatggcttatgtggcaaattagtgccaaaacacaacttttgtgaattgtgacctcaagaggatttggtcgttctttactgcaaattgtttgtttatgttcattgttctaggagagtcttctattagaaggggcacatattaagttgagtgtgtgtttaacaaatgttttacatatatatatatatatatatatatgtatatatatatataaatctttttctttataacttacacgcacattaacaaatttgaaactaagttatgacatgatagccgtatatcaaaaactaatttatactatttattatgaattcttaaccaacaaatcactattagttggttttataaacttggttaggctttcaattctaaaaacaaacatcatataaatagaaaagataaaagcaaactgattcttgctatttaagaacaaaacaaaactatttacttattagttaaatgaattttataatctaccttcgtgaaaatacccatttctgatattcagttataataatgattaatccctcaaccaatagggagttggcatttcgaaagaattttatatcataaagcttgtacaaacagataaagaatcaaggatgatttgattattatgacttaaatgcatattttattaaatcaatgaataagagtaagagcactcttggaaaagtggtcaaaatgctacctgtttaattctttgtaggtgtagtagtctaatgcctaaaaaaaaataatttgtacaaaaatctgaatacaaaaatataaaccaaatattcttttaataattttatttcgtttattgatttgtttagctaatctattgattttgcttattaatttgtggggtatcttaccaacttcctccacaaagacaaactagcttcaaaagacaaggtagtcttttatcttccgttgtcgacttgacaagtactttataaataaataacaaaccgtcaaattggcgaatcaatcttgagaattagtgtcgacataaattttattattgtacattatacaatttagacgataaatagtccaaatccattgtcctcgagcagggacgactctaaaatatgggaggtccaactgtccaagccaaagaaaatgtcttttggatatttgtagatagtttaaaacaatgagagaacatttaaaaaaattggggacaatgttttggatatttttatatagttttaaaacaatgagagaacatttttaaaatattttttaaattgaagacatatatttacaaaaataaaaaatttagtgattttagacccatatttcaactcgtagaggatgaactgatgcatgattagaaatttagaatcctgaccttaagtcacttgtgtttttttgctcaaaaaaaaaaatctgattatttatttttaagcccaaaacttagataatcctttacctttttgctttgaaaaagttctgattaaaactttgtgggcaattttcttgaacttcatcactatttgggctttttaacaaactcacttatggccagttttatagaaccggcgtcgtatgatacaagcccttgcacgacagcgtatctatgaaaaataacaaaaactgaaagaacaaaataaataaattaattcggacaaaggtttaaacttaaacccaaccctggtttcttcttcttcctcagtgccgccgtaaacaagcttcgccgtcgattttctcctcctctgaagaagaagataatttaatttctaaagtaagtttgcttctgattccgttaatagtctctatttcgaagattgtagtctcttaggagaaaatcttagtaagattgtaattttgctctgcttcacatgatgggcttaaacgatgatgaagcccacataggccattctgcaatttgagacgaaatccttgctttcaaaatatatatacattaaacctttcattattttgctcttcttctccttcttcttaaaccctagtcatcgagaatccagtaccagtaaccatg

SEQ ID NO: 21880 - DNA, 3000 bp, Unknown; identical to SEQ ID NO: 9816
  misc_feature (1)..( 3000): 2750-1469P.txt file - cDNA_ID_2036339; gDNA_ID_1974075; Annot_ID_180371

SEQ ID NO: 21881 - DNA, 3003 bp, Unknown; identical to SEQ ID NO: 17496
  misc_feature (1)..( 3003): 2750-1469P.txt file - cDNA_ID_2036371; gDNA_ID_1974075; Annot_ID_180349

SEQ ID NO: 21882 - DNA, 3000 bp, Unknown; identical to SEQ ID NO: 9571
  misc_feature (1)..( 3000): 2750-1469P.txt file - cDNA_ID_2036400; gDNA_ID_1972155; Annot_ID_179463

SEQ ID NO: 21883 - DNA, 3003 bp, Unknown
  misc_feature (1)..( 3003): 2750-1469P.txt file - cDNA_ID_2036698; gDNA_ID_1972168; Annot_ID_179801
aagaagaggctgcaaaatcatatggaaacaaacaattgaataccgaatcgaaacataaattagataccaaaaagaaccaatctttcatgaaattttacgattgttagaagttagaacctgttctacatgccttgaaaaaacgcatcttttcaactagattgatgttacaccgatagtttcttcataaaccacattaaagatgctatcattcttacacatagctaaaattggcaatctaaaaagaaaacaaggtcacaccaaatgcctaaagtttgctcttttaaaaactaaaagatacagaatctgcctttatttgtagaaccttgtcaaaactagcccacgataagaaactagaccacgattcaaatactattgagctgataacggtgatgtaatttggttgcaacacgatttcaattgaagaagaagaagaaatcttaaggaaggctctttacctacgaagccaattgagaaaagcttccaacaaacccattgatgatgatgattcacaaaagctccgacaaacagatccgcctgagagaattctcctccacggatctctctgagaagcttcttgtcctcgttgatctctgtcgatgatatctctctctctctctgtccagtgacggcgaattaaaagagtcaaagacaatgaatttggaccgttcgattttttatctggtataccaaatcaacggtacagatcttgtttaagtttttggttgatagaccgagaatcatggggttgctatttaaaataaatattttaaatttggattggccaatcagaggagagacacggtgacagatacaccagaagttcggaagaatgaatggatgaattactcaaccactcgcgtttatgaagcgcgtgactaacacgtatgtaccgtccgttgtttttttttggatgggtggtgccgccaaagattttggcggtgatatgatattggatagtgatcgggaagtgcacttacacgtgtcatttccaataatttatgggttgaaaacatatgtttgatgagttcttagtcatgggcctttatttgacccactagtgatgagtcgacccatcaatgattttctcctttttttattttcttgtagtatatgatgtttttgcttacactttgcatttcccatttaggacaaattaacattgaaatggacaaatggtattcaagtcatgtttatcttctacaagatacactatttgctttgtttaaattggggtaagttttttgattaatgaaaaaaaacattatgcttaatcggaataagtaaaacataattcaaaatagctttcacttgctcaaagatacaattatcaagagttggcttcattaaactgtaaacataaataaatgaacagcggagatacaaaaaaaaggtgaagaatgaattggtcaaccactaaagcagttataggtttaacacttttttattgcatgattaattatccaatagttgacaaaaaagaaaaaataattatccaattattgatttataaaaataaaaaaagttctacactagaacatattttaggaaccagagctgtaatttaatactagtttaatgtgtatgtttgatttatttgttaacaagaaatattagtaatattagattttatcccgcggtacaccgcggtaacaatttatctttttaaagttagtataattttttttttcaaattgtatctatctataatatatttttattttatagtttacaattgttattaaataacgtcctgccaaactcatcccgccaaacctgtcccgtaaaaaaaccatttatttatattaatgttgatcttatttatgatatgtttataaatcattgtctaaatatttttgtcgatgcgagatgttgaacctacacattttttgctaattggttaatatatgtttatttttaaaattttgaatcataaaatatgacagaaaaaattaagatttttttaaactctatatattatataatgatgttaaaaaattgtaatatatcaaactttttataagtttaaatattaataatgttttataaattttaaatatataaataataatatttaaaaaattaatatttttgcttataaggtaatgacataataactctaaaagcaaagatttagaagatttaaatttttaattaaatattttcattaataaataattaatctcagtgacatgacattgtaaataagttcaaatacaaaatttatttatttaaacaaaaaaggtttagtaagaataatatttatttaacaaaaaactttgttttaaaatattgttaacaaatatgtttatgctaattttaagggattgatttgaagtttggtgggattaaatttgattgataatgtgattgacaatttaaatcaaaaattttaaataaaattaattattttgaaaaaaagatttaatgctaatagcattaaattgtaaataaatctaaatttaaaatttatttgctaaaatgcctgcaaaaatgtatatataggtcaacaaaatataagtgttttcatcgaattacttttacttgtcgtctaattttctctcatttgttactattttaagccatttttaattgaaagaagtggtacatatatagcattaatgaatgctatactcaaggagaaagtatattaacgggacaatcattaaatttaccagaacgacaagatcccaataaaatgaaataaaaccaaaaaccaactcagatgagtaaacaaagtatcattcatcggtctcgtcttttggtcgcacgtctgaatccatcatcatcatcaaagacctctctttgttcccgtgacagatccttcttaaccaaacctcaccgacccttgtctttatttccccaattctactcctgggtttcgtaattacgttcccaggttcgagctttcttctccggagaatctgaaatcgaacaatttagtgtctttttctcagacattgtttacttctgagaaagcttaggtctttagactctcattacatg

SEQ ID NO: 21884 - DNA, 3003 bp, Unknown
  misc_feature (1)..( 3003): 2750-1469P.txt file - cDNA_ID_2036748; gDNA_ID_1972168; Annot_ID_179789
tttattatattcgcaagtgttataacatgaaaaaaaaaatttagatgtaatggcaatggtctagccaaaatagtaaaaacaaaattaaaaaacttctgtatttaaatactgttttaaaaataaaaaattagatgtaatggcaatggtctagaataaaaccgtattaaaaaactagtttggagtaaagaaaatacggttttattctctgacaaaacatatattctctttattgttattgaatccactctaatttttttggttagaatttaaattgaaaagtatggaccaaaactcatacttcttttttcacaacataaattctaaccaaaatattttttctatatgagtatggacctaaatttctttctttttgctgtatctttacattccaaggttcgctaatgtgttagcagatttttaggctaaaaatgtcttattgtttgtaatgctacctcctataatgaagttcaattctttcagtaagggaagtaataataaaagatgaactgaaaaaaaagcactcaagaaagtccaaattgttttggatttggtcataaatctcatggtgacatttatgaattatctataaaaattctatatcaataaaagttgacaaaagaaattatatatatgtatcaatcaattttcgatttgagataagcataattttattcatttttcatgtggttttaattgttctcacgtatatgtttgaccattgaaatcaatcagttattactgtttggcgcgaccttaactagttagtcatcgaaatcaatctagaagactaaaacggaaatgagataattattaacgtcaagaactttctattcttactaaattcaacgtaccatatctagaataatggattttatcttcactaatctacaattaaatatttgttttttgttaaatgacataaagataggccggagcttctacttctagcatattaaactagccacgacatggagttatataaaatttgaaaattaagtaagaaaatatcaagttgctcaaaaaaaaaaaaggggtaagaaaatatcaaaagagctattaagaatttggtaagaaaaaatcttaggtatctgaaaacatggcaagaaaaaaggaaaaggagaattattcatgtccgaagaagaatatatgtttatgttgttggataaaaagaaagatgatcacgaatattttggagttgggatcttgaccgaagaatgttgggttacttaataaatcagcaattaaaaatgcttcttctttaaactttcggtttctgaagatgagtacttcattatctatatgtattaagataacgataacgcttatcaacattcaagggtttatctatcattttccagacctaccaaaaaagacctttcataataatttcataaagccaatgaaaacaagattaatttttaaaaaaaaacaattgagtgatcgaatctcgtagacaaaaaattattttacttattttttgaaatttatttacatgacattaggttaaatggttaaagaggaaagttttgtttcagtttcaccatgacatgtcagaaatttataatttatgtttccacataatcagcaaatgatttaaattcactatccataactcttttttaaaagtaactcttatattaatcgtacgaacttcgaagcaggctggatacacgattaccgactcagttaactgtctcttatgcatatgatcatgtaatctcttatgcatatatgtaaaaagcttacgacacgtgtgacgtattttacaaatgtgaatggaattaaatattcatcatgtgtttgaaaagtgtaagaagactttactaacctcttttccctattcttttgaccagatttttgcataatatatatgccttattatcccatgcgtgttttatgagttttttttttctttttctgaaagattgtccagagtattttatttattccttttcatttattttgtgatcttattatgttagccatttttgttgattgtcacccaaaaaaagaagctaatatatggtcgtaactcgtaatgcatatgttcgtttattcatttatttttcgatagatcggtggtaccttactactctagattgtggaaataaacaaaataagcaattcaactatgacgtgggatgaggttttctatcttcgacgacattctagaataccttacaaaactacaccattcaactgtttttgataaaatatttggtttagtttcacaggtatactttccattcatatgcacgtgaagaggatcattaggtgaaccttttccgctcttgcatatatgcccaccaccaaaccaagtttatttaaccctcgacgaaatgtttttttctttaatcattacacacacatttatattattgagatatatgacttgactatgattttttcacattatattatatatctttggttggctataaatctactcatattacatgcaaaacatggcgcacaaataaaactttcttcgcactaaaacatacgataagcataaatgttcgaatagcccactcattgtttaatttgaaacattttcgaaattaaatcaaaatgtgtatcgtcttgttctcatccaacggtcaccttttttccgtggtcacatgatattttgcttttttgagcaatcattcacacacagcaacaacatcaaataatttagtagggccgtaaaattataatctaacacggcatgaataaagagcatcttcttatataattattactaactaacataaaactataattcaataattaaaatttgagcgatatatatgactcgttttatgacgccataaaggtagttaactttaccctttataagtttctatggttcacatttggcagcatctcgctatttgtcaactcgtgtatcactataaattcacctaactggcttcatctgctattcatcctcacatcttataattctctatctctcttctcaggctcccattatctttctctattttgcaaatcagtatg

SEQ ID NO: 21885 - DNA, 3000 bp, Unknown; identical to SEQ ID NO: 9676
  misc_feature (1)..( 3000): 2750-1469P.txt file - cDNA_ID_2036781; gDNA_ID_1972168; Annot_ID_179779

SEQ ID NO: 21886 - DNA, 3003 bp, Unknown
  misc_feature (1)..( 3003): 2750-1469P.txt file - cDNA_ID_2036810; gDNA_ID_1971867; Annot_ID_58444
aggaggtagagagagaaagttggcgggaaaaggtggcggacacttcttcttcttcgcatcagacaagagtttgcgagaaaagggtttaactttgggccgaatattgggcttattaacccaactcatcactttaggtttatccaaattaatcataacattttgggccgatttgataagaaatcaataatataggtccttttgtgaaagaaaaaaaaaaaaacgaagagcacaaagtgaaatggggaattgttttttgtagagccctaaatagaaaatctccaactgtagtgaaagtgaagaagaagaagaagatggtggagatctgaaaatatgcgatagatctgacgaatgcagatctaaaatggtctaattctataccaatctcctctctcattgtttctactaagttcaagttggtgtactgatcttattttgtggcggtgtatatacagtcatctagaggaagggagaggatgatgatgaaggaagacggtagaggaaggaatccaccgtcgcgacatctttgggttggtaaccttcctcatgggatacttgaacgagaattagccgatcggttcttaagatttggtgaattggaaagcttagcgtttcagcctggacgaagctacgcatttgttaattttaatcacgatgaggatgcgttcgctgcgattgagtcgcttcaaggcttcccactctctggaaacccacttaggatcgagtttgctaaggcggttagtgttgaaaactcctttttttttttttttttttccaatgcttgcttaatttggcttggtttttgagtcttgaggttgattagagatgacatgaactaacttattaggagtgattgaaagttatcagttagtgtgtcttcaatagatgactagttatgtgattacttacacgtaaattagttccagtcagtaccattctagaaattaatgattgttgactacgcaaaggtaacaagtctcttaccttgttctggataagttgttactcggatgatacttaatcattgtctaagtttatagaacttagcaatcagtaccattctagaaattaatgattgttgactacgcaaaggtaacaagtctcttaccttgttctggataagttgttactcggatgatacttaatcattgtctaagtttatagaacttagcaatgagcaaaacaaacgaagatggtggtatctcatttttgtctcctcttcataggcctcacactttattattacaagaagttttttttcacattaactgtgaaagttctgtagtttctatatatggaaacttagaatcattctttattaaaccatatgcctccacatcaaaagtatccatgtgtaaccgcacaagcattcacctttatcattcacagcacaaacattcacctttatcattcacaacacaagcattcagccattacgttgtgaagcattcagaatgttattgacaaataatacaaacttggtagttgatcccaagttggagttctttgttcatttaaagatgctcttagctcacttgaggtcaagtgtgttccaggaacatcagcatgtgttgaagggaagtggaccagtgttcaactagatcttacaataaagataacagaaaattgtcaataagctttatggctcttagagttaatgtttacctaacaactttggatgattccatatgcttcagcgtcagggtcacattcatgcaaaagtcataaacccaagttaatagaattatgttggcattggtccacatgttgtaagtttgattgcgttgctgcctgacttcagttgcctctcagtacttacgaaggtgtgacttgatcatctatattgtgtctccgagtaacttttcctgccttctattatgtcattataaactgagaagttacagagtatagaactattattcagctagcagttggtgacattttacatattttctccataatatgtgagtaacaacccaccatacgttcgaggcattgttaaagttcattctcatcttcaccatgtttcatattcctctgcaacttgccagtgccaaacagatacatgcttttgaaatggttacctatacatagacattgttaaaagcagaatttgattcgtatgtaccaattccagcttgcaactgcccaataaaattgatcattgttatttttttagattatacaaaaattgacagggccaaatatcttaagcttgatgattgtttgtgtttatgacatgtttactttttgccatgattacatcttggtcatgtcttaaattctccatggctagtgatgatgtgtaaaattgaggagctaaatttgtataatgtttaggattggcctattgtctgatacctcaatatattaatattgtaacttatacattgcagggatattctttagctcaaattaatcaccataggcagctcttccttccttagacttgctgataactagatactcgagttttttcatcggttaatagtttaaagagtttctatctgctttatattgttgatattaatgcatattagcttttactaactgtgaggcagaagcgttttctgttgcacagtgtttgttgcctggtggactttcttacccagctgtgttagatgggcatctcattatctagttatgaattaaaatagcgtatggattttaataatcttgtgatggatttgaaacttgattctatttattatttctcttgataacagtagctactgcatagctatttagtttgttacttgaagtaccatataaatacactgctgaagtttccttctgattagctttcatttagagcctactgaagctgatgctttattttcttgatcatgcagtgaagtaggccgttggttaatacttctatctttgtgatactctttatcgcaggaaaagtcatcaactggatcacgcactgatgatatatatcgccatgatgaacagcggtctgcagcaagagggtcgtcttttgtccaaagggactccagaatg

SEQ ID NO: 21887 - DNA, 3003 bp, Unknown
  misc_feature (1)..( 3003): 2750-1469P.txt file - cDNA_ID_2036810; gDNA_ID_1971867; Annot_ID_176511
catagtctctgtatacccattcggctagaaatccgaggaagcagcttctctggaagatccatagtgtttgctattcccaacacaactaatttggagttaggcttggtaggccaatcaagaatgttgtataaaacagactggtttctagttactagaagatcaagttcgtcgatgagaagtatgcaaggcttctcatcctctttaccaatcctttttccttctgcaaacctctcatttagacactgtagagctttcttccaaccgactcgatgaccactcaatgcttcatagattacactgtaaatgttctcaggtgaagccaatttgagaccattgatctccacaaagcaataagggcttacgcttccctcttcaacctcagccttcagattcttcataaccgataacacactaatagtcttcccagtcccgggaacaccatgaatatacatacatcttcctaaacactgatcatccgagattgaaccttttataaacgaagtgatctcttccatttctttgcttctacaaggaagagacttaggacgtgtagccaacaacaaagtagctttcgccttttctaactcactctgcttatgacatctcacatgttcaggaatcagcttcatccccaccttctcaaccccaaagaatctccctttacgagagttcgcacctcctcttgcactagtcaaacctcctcgcttactcttcaaaacttcatcatcaagctccatctcttcatcactatcatcaacctcctcctccttcctaccattccactcttgatcactatcagaatctccatcagccaattcagccaaacgcttaaagctacgccaatgaacatcatactcatactcacacaagaacacatcatcaccatcattactagctttcgaaaactccttaggacacttgacagaacaatgcctaagaatacattccatctctatatcagcaaaatcattcgtcaaataaagctctcgtttcagattatgcggttgacgccccgaaacggtctcttcaggtatcatataccaacgagcacgaatccaatacacaccatcatcaacttctttccataacttgtcgattcgagcagcccatagatcaccggaaagtagcttctccctcatagttctcgctaacttcttcccttccggtggcttaggaaggtcaagtgtttgactttgaccagactttttaacctcacagaattgacagatccaatcaccttcaggaacttccttcaatggcggtttcaagcatttcaaatgaaatccacctaaacaatcatcacactcaatcattatgttagtatctgatttgaaacaaatctgacaatcttcaatttctggatcttcttcttcatctgaattcgaatcttctcttctcttaacgtaaacatcatcaccgatttcgaattcggtttcgtcgaattcgactttattgtaataaactctcttcttcttcttcgtcttcttaatcgtctcagatctaattggtgaaacaggagtgaaggaatctatcttcttcttcttcttcggagtttctgttttcttcgacttcgatggaacgacatcagtggttggttttctgggggcacgttctcgttttcgaattagattcattccttcgattgggtcatttcctggagcatcaattgggtcatttcccagatcgattttacgagaaacatgacgagcagatctacggagaggagtgtgagtttctggggtttgaggagtgtgtgaggttgaagatggagatagatacgatttgcgatagatgttagacggagttttggttggggatttgaaggtttttgctcttggagttgaagccattgatggtgtaagctagggtttttctgggtgaagaatgaagagtgaatgaagaggaagaagaagacgatgatgatgatgaagaaggaggtagagagagaaagttggcgggaaaaggtggcggacacttcttcttcttcgcatcagacaagagtttgcgagaaaagggtttaactttgggccgaatattgggcttattaacccaactcatcactttaggtttatccaaattaatcataacattttgggccgatttgataagaaatcaataatataggtccttttgtgaaagaaaaaaaaaaaaacgaagagcacaaagtgaaatggggaattgttttttgtagagccctaaatagaaaatctccaactgtagtgaaagtgaagaagaagaagaagatggtggagatctgaaaatatgcgatagatctgacgaatgcagatctaaaatggtctaattctataccaatctcctctctcattgtttctactaagttcaagttggtgtactgatcttattttgtggcggtgtatatacagtcatctagaggaagggagaggatgatgatgaaggaagacggtagaggaaggaatccaccgtcgcgacatctttgggttggtaaccttcctcatgggatacttgaacgagaattagccgatcggttcttaagatttggtgaattggaaagcttagcgtttcagcctggacgaagctacgcatttgttaattttaatcacgatgaggatgcgttcgctgcgattgagtcgcttcaaggcttcccactctctggaaacccacttaggatcgagtttgctaaggcggttagtgttgaaaactcctttttttttttttttttttccaatgcttgcttaatttggcttggtttttgagtcttgaggttgattagagatgacatgaactaacttattaggagtgattgaaagttatcagttagtgtgtcttcaatagatgactagttatgtgattacttacacgtaaattagttccagtcagtaccattctagaaattaatgattgttgactacgcaaaggtaacaagtctcttaccttgttctggataagttgttactcggatgatacttaatcattgtctaagtttatagaacttagcaatcagtaccattctagaaattaatg

SEQ ID NO: 21888 - DNA, 3003 bp, Unknown; identical to SEQ ID NO: 21886
  misc_feature (1)..( 3003): 2750-1469P.txt file - cDNA_ID_2036810; gDNA_ID_2926155; Annot_ID_139491

SEQ ID NO: 21889 - DNA, 3003 bp, Unknown
  misc_feature (1)..( 3003): 2750-1469P.txt file - cDNA_ID_2036835; gDNA_ID_1971867; Annot_ID_176501
ttcgtaaattttgagagtagtttttaaccaacttacaccaccaatttattagagtacatattttgattttcgatatgcaatcttgttaccaactaagttgttaattaggaccatatactcttagaaattgccagctaatttgaacaatgaccatttaagtgttttcaaataatcaaatcatatccatataaaaataattagtcaactaatcccctattaagaaaaatcaacaattaaaacattctcatttcctcctaatgaataccctataaatacccactaaaaacttacatttctcccaccaatctcaaagcaaattaaatacactactacttcttgagcttttaaactacacaaacaaatggctccaagaaccccccttgcactcttcgtttctctcaacctcctcttcttcacttacacctctgcaaccacagggacttgtcctaaaaattccatagagatcggtacttgtgtcactgtgctcaatctagtggacctaacattgggaaacccacctgtaaagccatgttgctcgctcatccaaggcttggctgaccttgaggccgcggtctgcctttgcactgcagtcaaggctagcattcttggaattgtcaatattaaccttcctatcaatctcagcgtactcctcaatgtttgtagtaggaatgctccaaagagtttccagtgcgcgtaagttgaatacctatgacatacctatgaaacaaacgaatcataccgatgcttgaacatgttttcttacctacttgttgttgttctaagatgtttgttttttctttctttcttggattgttaataatgaacgtacgacgttctgatgcaaaataatggaaaatggggttgtgtgtacaatcgacaagtttgtatatactcctttactttgttgttcctttgttttgttgttcctcttctttgtaactgtgtatttcaaatttgcttaataaaaatataaattgatgttgtagcttatatatcctctatatatgtgtctaactcaaaaatggtaaccaaacttaacaatgattaaaaagtaaaattatttttttaatataaaactttaaatatgacagattaaacatttttttcttacttttgttaaagttagcaattgtttttaaagatatcttttatcttataaatcacaagtcacctgaccaattacaatttgccagatagattttttaaaaattaacaaaaaacaaataaaatgaaataatgataacaaggaaaaaattaaacatgaactttatcgacaacaatttctggaaactgctcacccatgatgcacgatccttcttcttcgcccacgatctcaaccttttatactcccacaaacatcagacaatttctcactcgatcgaatacaaaatataattctcctcttccttggtttcaaaaccctaatttcttttacagtgaatattttggcacttattttttctctacagtttcaatggttcagagtttcgataggaataattggttttaggggtgagaggaacatgaagtgttgaagacaaaattacgagaggtaattgggctatatttctatatcaacataatattttcttttcttttcagatttttgatatatatcaatacattgaaaagtaaactcctcaactccactaggtgctctttaccgctagaagaaaaaaaatgattcttcgacaatcacaatcaaattcgccaatgaagttgttctccaaggtaactttttcatagtctttttaaaaacaaatatttcattttttctataatggtgggaatagactgaaacatgaagaagcattatgctacacgattgtttttttgctcatcgtggtgtttttcaaattaatatgtgttgttgtaattcatttactatgatttcactttgacatgctgttttgattagcgtatttagtagatgtttgatggtttagtcatgtttgatgtgtatgttatatatcacttatgtcatttaaattcaaaaggtatatatcatacattaaggaataaagatcagcaaactaatgtgtaaaataattggccttaaggtgtatatgtgttaactaacatgctgatttttttacttcctaatgttttatgtggatttgtaaaactgtttgcagatggagatcatgaatgaattacttgatgttgaaaaaccaaagtactcatagagcagactaagagttaaagaaatacaggaaaagcaagatataaagaagtaaaacatgagatctttaaattaatctttgtactcaacaaactaagatcaatgtataattatttttatattaatctaacttaagttttagtaagtttgtggttaatcagtgacaaatgtgttaatctttgtttttatgcattaagttatctataaatgcgagttttttttttttgtcaaaaacatgcaagttttatgttaagtaaatcgttagcaaaaatgtactactagttctgtcataactcataactcataattcgttcaagaattatgaatggttgattgaaaaaataattttaccatggattaactctctcaaaggcccaagtccattaaaggattaaaaggaacctaacagcccatacccgacttttttcttttttgggctgttgctcttacaaaggattttttttgtaaagtaaattaatttagattttggaaatttaaaaaaaaaaagagagaaataattgtttctgtcaaaccatatttttcttttctcaaaaagacaagaaatacatctcctaattacaaaaaaagtatgtttttttaccgttaaaaaactttaaaaggtgtatcaatttaattttaaattgaccaaagacaaacgaaaatttaataaaattgtttggataaataaaaaacattatctgaaaaacctaaccgacatctctcctccaaccactgtgtaaaaagcactcaaatcacactttatcttctccgtcacattttcccgagaaacaaaaaaaaaatctcaaatctggcaaaaaatg

SEQ ID NO: 21890 - DNA, 3003 bp, Unknown; identical to SEQ ID NO: 21889
  misc_feature (1)..( 3003): 2750-1469P.txt file - cDNA_ID_2036835; gDNA_ID_2926155; Annot_ID_198349

SEQ ID NO: 21891 - DNA, 3003 bp, Unknown
  misc_feature (1)..( 3003): 2750-1469P.txt file - cDNA_ID_2036841; gDNA_ID_1971867; Annot_ID_176498
ctcatcaatctgacattccaaaatatgattccttaaagttaaaacacacaagctctcagataaagtttcaaaaaggaaacatctctaggtaagagaagcaagtacctggagaagaacagatctaatatcagaatgcacaaggaagagttgatccaattcacaatcattgtattcttcttcttcttctgcatgtaacacttgattaactgcaagataatcactcactcactcagagaacaaaaccatctccaaagatgtttgatttttgccaaatttccaaattgaacaagaagagtgtagatagagatatacctgtatctcttctggttatataaggttccatttcactatctagctttcactatgaattttgtaataatctggatctggagagtcgcaaacaaacagacaaacaaaaaacattacaaatcggtatctagatatcgcgtgcttcttcaattgagaaacaaaattatccagatttcgaagaaccaaaatctggtattcaaaaagggatttcgaaattgaaattgaaaacgatgatagagagattgaagagaaaggacctgcttaaacggagaattaggtcaagtatatgttgagttaacaggtatggttaccggtcggcggcgagagtagacgatttcaattgcaccgtcgttagggtttttgtagaagaagacgaagagcgggattttgtatttttcgaatttggggtttcaagtttggagaagatgaaagacagagagaaactacgcgaaattaaatgtttttttttttgtcttactataaaaataatttatataagtgattgggctaaagtttaaagtggcccgccctgtaattaatattatcaatgaagcccaatattatggttgttattacaagcttgatctgttacgtaattatggttcaactatgatttaatctacggtacatttttaaagattatttctataattatgtattaatattatggttatataatatatatatatatatatatataaatgaatgaaattgtgttattttaatagtatttacattttataattacattttcatattatgattagataaaaagaacaagacgttttttcagtagtagtataatattgctctaatattgctgcaatcttcgaatgagtatgtatgtcgccacaatattccgagttggaagtactgttgtggggtgggttttgatcgttgaataaaagacgtatgttacattctttacagactgctctggattggtgaaaatgttgtatacaccgatcaaatggccatgttttgaaacatacttagaagatagtgaagaataagcgtgagttaatttacttttttattttcagtttttcgtaatgccaatattaatatgtataaattggcacgaaatgcatgtatatatcctacactatatttatatatatatatatatatgtaaataatatttctccaacttgactttttgagccttttaatattaatgaagttgttggtaaacaaaaaatagctacattttttaatgatatggtactaatcacacccataatattttaggtctcgtttttctgatgtgggattttcaatgaaaatgatgatatttctagctattcataatttttctatgaaaacctaagcacaaaggtcgtttggtactatcggttatgtgataatgtgaatcaaatatttgcaaatcccataagtatcgggtcaactttcaaaaaataaaattacacagatgattaaacttggtttcagttgatgattgtttctgatcattgacgattttatgccactattatatgtattgtggtgaactggtgatcgatgatattgtggtcatgatcatcgacttgttacttattttttgttagttaacccaacgatttcagatggaaacatatattaacacggtgacataaaaatgattttgttcatcaaggattaactttaccttgatcaacaagacgatgaatcattacttggtttaaagtttaaactaattgaaccatatcaacatctttcattttcacttcttttagaaatactatgtttattaaagagaaattaattataaaattaaatagtaaaacagaaagttagttaagttagacgaatttggattttcacttttgatctcaaatttgtgtcaaactctttttgggacatttctaacgttggaattatacgactgagatatacctctatttaattaaaaatatatatatatccaaactagtctattgtccatcttgtaacccctgatatacagaattatttaataagtccatttgcgattacaaaaacaattatcacatgaaaatgaaatcataactttgtctttgtgtgagagttaagtatattaaattatgtttttaaaataatggttttatataagtcttccccgtgacaaacgggtttgttgaaggggcataagaaatgttcacatggccaacgtgaaagaataaagaacaattgttcctttttcgatatccttagttatgtacatattgggtaaccgaatgttaacacaaatctctatatactatatagacttaacatttggattctgtgccaagaaaacctttatatttgtcaatttttgaaattttaatcatcgtgaaggcccgtacatatatattgatagaattcataaatttgggagtaatgtctaacaaacttataccaccaaattgttagagtaaatattttgattttcgacatgcagttaccaactaagttgttaattagaacaatatatttttagaaattgccacctaatttgaaccatttaagtgttctcaaataatcaaatcatatctataaaaaaattagtcaactaaacccctattaagaaaaatcaacaattaaaaccttctcatttttctcctaatgaatatcctataaatacccactaaacacttatatttctctccaccaatctcaaagcaaattatatacactactacttcttgatcttttgtactatacaaacatatg

SEQ ID NO: 21892 - DNA, 3003 bp, Unknown; identical to SEQ ID NO: 21891
  misc_feature (1)..( 3003): 2750-1469P.txt file - cDNA_ID_2036841; gDNA_ID_2926155; Annot_ID_198347

SEQ ID NO: 21893 - DNA, 3003 bp, Unknown
  misc_feature (1)..( 3003): 2750-1469P.txt file - cDNA_ID_2036875; gDNA_ID_1971867; Annot_ID_176476
aaaactttctaacgatgaaataatctagtatatcaaatagtataaaatcttattaaaagactctagaagagcatatacattgctttctatgggaatacatcgatgcggtataattctccaaatcttaaagttaatatgatgagagataaaatacattatgattctagagtggaattaaaaacgagatggatgaacttgaagtttcatcatttcgaggaggagaagtaatgaatctcacatggataataagtgacatatccagaagattatgttcaatctttgactactaaagatctaaaagttgtataaagcaattcttatacgaatgtggtattagataaaataagttataattaggtattactgaaacttcaagacttgaagtctctttgtgaatataactcacattgttaagagaatatctatgatgcagagatggtaaaacagacgcttaaacttttacgcaagtattgttgtcctgtagacacaatattttgaaagaaattttggaactattataaacttaaatcgagtgtttttcaaaggctaagaaaacatatgagttatcgatgataagtaatactcatatactgaagtgaatataagatcttacatagttagtcaaatttaatatcgtttatactagaatataaaaatttaattattatctcgttattgttttattaacatatgattgattattaaaataaatggaagtaattttgattataagatctcattaagggagtaactgataagcaatgaaaagtaaattaaaagttttgaaagaactagaagtttcaaaagaattaaaagtttcaagagtatatttggcttaaccggattggtcatcctggtttaatgatgatgtgaaagtattgagaattatgtagacattaggtgaaaaaccagaagattctccctaatgatttatcaaatgttacttgctcagaaagcaatatgataatgtgatttttaccagtgtaagtaatttggactttatctattcgtaagtatatacaaggagatgattatgggttgatcacccactatatgacatttagatacctaatggttataaaagatgcatcgattcaatggacgcattgactcgattgttgcatcgacaagaaggtcatatttatccttgttataaacccgcaacatagagtttgcgagattactttcttgattaaagtacaagagtatttcagtgtttatttataataaccattattagatatccgttgggataagtgtttaacattttgaaattcatgttcatacacaaaatggtttagtaacatcgatacgcatcaagccaatgaataattaatacttttccccattattattggttttgggtcagaaaccaaatagttttcatctaaaagctttgaatgtgaaaagtgctccatcacagcacgcagagatgaaccctcaaaggaggataagaatacatgttggatatgaatgataaccaagccatcctagaagtatttatataccgctcgttttgaagactatcatattatatagtcagctattccaacataagggggagaatgtatacagctggtgaaaaagataaatagaaatgaattatcaatgatcctcggagtaaagaatgtatattaagagtccaaaagctaattcaattacagaatttagcgttgtaattgccagacgcatttgctgacccaaataaagtgatgaagtcacttataccagttgtaaatttaaatgctccagaatataatgaatgtcctgtaaggagcaatttcaaactgctattgagtcttaagatcgcatgaagcgtaatagaccttggttccaaatataaatatcctcgtaaaagtgaaggagcacaaaattaaaaatgaccaaattgaggaaataaatattttgatgatctcttgaagagagtgaataatctctaaaagagacataaacatgacaaatgaaacattcaagtacttgacaatgaagagatctagctagctatgtcatgtcaaaatataatggaatcaaaagcaaatcgacgtcgtaatatatttgcatgctatgagcagttgatattatagacaaaagaaggatcatgaaagaaagtctattgaaaagtgtatacaaagtaatgattagccaaaaatggaaaagaagaaatagacatataattataatctctagtagagatatttggactagtagtctatgcacatgatgtgtaaaaccagtggaaaataaatgagtctttatgtgaaagaatagtgaaattaatgagattttcacaaagataagaaatgtattatgaagaaatatattctcttgtggtggatgtaatatttttttaagtatctaaagtctggcaataagagacggaacactggatatgacatttatatgaaattcttgaaagatataatctctgaaggattaattatatgagaattatgttctctagaactctactcgatcgaataaaaagaaatatgtaacatgacatataatcatataaatgtatatttacgttgagtttgtcaaaatgtattgatcaaactaatatttgttttgaaaatcattaaaactcctacagagttatcataagtaatacgatgacaataatctatgataaaatatcactagataatgatatttataagtctatatgaaaaccatataattttgatcattaagattatggttattaattccaacgagatattgtatttgattgaaaatcatctcctgaagaagatgtttccgagggggagattgaatgatatgcgtggatgtaccctttttccttatcatagtttttatcccacatgatttttctatgacaaggtttttaacgagacattaaagaacacgcaaataatacacttgatgaatattaagaaattatatcaatcatccaaataaatattatacactaatgatatttagagaaataaataagatgatcaagatgaatcatctacaagattcatgagcagaacaatg

SEQ ID NO: 21894 - DNA, 3003 bp, Unknown; identical to SEQ ID NO: 21893
  misc_feature (1)..( 3003): 2750-1469P.txt file - cDNA_ID_2036875; gDNA_ID_2926155; Annot_ID_198332

SEQ ID NO: 21895 - DNA, 3003 bp, Unknown
  misc_feature (1)..( 3003): 2750-1469P.txt file - cDNA_ID_2036904; gDNA_ID_1971873; Annot_ID_176654
atgagatgaaatgtcttatctttatttagtgcaatctgagtattgaaaacaatttccccagtttttttttttttttacgtcaaatattgtgtgcttattttaaagagaagaaaccaacaaagagatattccagaggacacggctttgtatgtatctgactaagaacaagacacacatgaatgatgaaggtgttggtcgggattgatgttaaagatgtaccaatcacatcaatatatacatatataaagaaaattaattttaaaaatcaggctaaaaattaacgatacaatattttataaaaacattttctcatgagtttctttgaaaacacgatatatgttcacttttgatatgcagacatgcagtaaactttaaaaatatgttgagatgcatatgctcattgtctttatcttcttttctctcctttttttttgttaattatatatggtaaagtagacttgtaagtaaaagttcttatacagaaaaaggtcgattttttttttgggtcaaattttaacagatttttggaatgaaaactgacgtatcctcttacgaagtgctaatttaaattggagttgaacaagtctcatattgaattagcaaaaatttagagtcaaccaaacatctagacctaaaaaacttcatgaaatttaatttttccaatattgcaaaaccggttcaatcaagttatattggtagaaacatatagtgaaagatatgtttttctagatctactacatgaacagaaatggcaattctaatggaaaaaacagatggaaccagaaaaatagagtaagaacgaaaacttaaatatagaatgttgaaacaagataagtgtaaggatgcatttaaaaggaagagacgaggcaaataaacattatccttagacgaaaaaaataaaacaaaacaaaagagggaaaaaggatacatgaaaagagattgatcactatattgatggatcacaattcacaaaaagccaacccattgcctattgtacacttgcacgatactcgaaatttccaaataattcggaacaaaaaaaacagctatattcattttttaaaataatcaaccaatcgaatttagtcttaaattgtataattgttttaatcatttaggtttacgatcataattaggtggtcatagatgcctatatcgttgcattaattgaagaagggagaataataatcctaccatctatgatcctataagattgcaataaagctatatatatatatatatattcatatagtatatatgatctaatctcttgttaattactatataaattaggtaaaggttaccgtagaaaattacgtggaacaatgttgaaatgcttacataagttgactagtccgtgttgtttttgttctttatagaattatagtcaagaacggcgaattattaagttgtttctgattataaaataaataggttgttgtgaaatcgggggaaaaagaataatgaatacttgttaaatattggtcccctaataaatgttatttattttggttataagaaaaaaaaggaatgtgttgtggagaagagagcgcgagtggaacttgttgctacccaattgtcgccacacttcccacacgtcccctcttgtatcttttttttacttttcaccacttcctttgtcctctgtttttttcccaccattttctacttcatcaatctattccttttgtttttttggtaaaatatgtaaatatcatctatttaaaaataaaatatgaacgaatagatttataaatatacaaaattgaaattttaagatacttttaatcgaaaagagttcccaaatatttacgtaattaacatttttcaaagtttatttaggtttaaatgtaattttctggtgtaccactaactagactatacataatataaacacgactgtgaaacatgatcatcattagctgttgattatctactaaagaattgtttgttatctctacataagaatatatattgaacacgatttctattatcttttactaatttgaaatagaattgtttctagtaatgacacaaaattaattgactcaatctagtaaaccttggagcacatgcaaactcaattaaacaagtttaaacctttgtatttgcatttattaatcaaagcaaaactgtgaagcaataatttaatcaatggtttaattaagaagctaattagctatttggctcctttagattacgaacgggtgctgctacatctcctctctgtcattagtcattactaaatatttaaaccaagttcgaatctgtcttacattatcttatttcataaaatctcaaagccaaattcatcttttcttttgaaagtgctccctcaaaagctaaacctcaaacatataaaatagcaaattcattttaacaaaagcttaatgaattccacgtaagcaattacataacgtttttgcccctagtcagtagagtccctccttctaactccgagaaccagcgtccatgtctcgcggaccaaatgcgttcgtaggtaagacgcttgcacgtgtcgagatgtaatcggtcacgtgccaacctgggttggttgcatcagcatccgacgtggcgatgtgaatggccacgtgctacaaaacctatgtatagaaacacccacccaatccccaagcacttttattcattttctataaaaaaatttacaaggatcgtataatactactaacagttttttttaaatattttccagataaacattaataaaacgataaaaggcaaaaaataaaaaagaaaagaaagcaaaagcaaaatcaaaatcgatatatcagacaacgcctcgacctttctttctttttttccttctcatcgtctccgttgaacaacaccacacaaacaccagaagaacaccagataattcccatggtgaaccgagctcagatttgaaaattgaaggtcgtagacgaatcataaggaaagagagaagtggtttgagatttcttttttgacggacgaaaacggagataagctttgggggaaatg

SEQ ID NO: 21896 - DNA, 3003 bp, Unknown
  misc_feature (1)..( 3003): 2750-1469P.txt file - cDNA_ID_2036938; gDNA_ID_1971873; Annot_ID_176644
ctatattggacctgacatgttaaccgatctcactttcccattttatgaagacaccatccctatgtgggctgtcccggtaagtaaacttgtttcccaagaaacctttgtcttcattttgcattccatcacaaggaagtatttcgattttcgctgattgattatttgtatgtatggtgtgtgcgtgtagattatttgtatattggttccgatatgcatcttcatagtgtactattactatcgaagagatgtttatgatcttcatcacgccattctcggtgagttaatttctactactgatcaccctcaaatgtatctagtcctatagtacttacaatttcaaatcgaaatccatactatcatatattattgatgatcaacgtgacaagaatatttggaaattgcgtataggtatcggattctcatgtcttgtgactggagtcaccactgattccatcaaagacgcggtcggtaggccacgccctaacttcttttaccgatgttttcccaatggtaaaccggtatgtacatttctatggatccatctcacttatacgttaatttcccggtttatcatgagggaattgtttcttattttgtgcaaatcggaaagaaatgcagaaatttcatccggatactaaggatgttgtgtgtcatggagttaaaaagataatcaaagaaggttacaagagtttccctagtggtcacacttcatgtaagttgttctaaagcattaaaaagacaagtaacaacatctgaattgattccggtttatgttaaccgcttgattacggtatacatgcagggtcattcgctggtttaactttcctagcgtggtacttatcgggtaaaatcaaagtctttgacagaagaggtcacgtggcgaagctatgcctcgtgttcttaccgatactcatatcaattctcatcggaatatcacgcgtagacgactattggcaccattggaccgatgtcttcgccggagctatcatcggaatttttgtcgcttctttctcttacctccacttttttccttacccttacgacgaaaacggtattaaaccaaaacaaacaaaaaattaccatcatgttattgctttcttgataataataacggttgatgacaatattttaacaggatgggctccacatgcgtattttagaatgttggcggagaggagcactggtcgagccacgacgatgactcgaaccggttctcgaggaatgttgggcaacgacgttgagcctggcaactccgcgtcctcgccgcacgatcgccaccgtgaaagcactgattctgacttttgaaaatttcctccacaatgttttaaaaaaaagaagttaattatccgtgtaatttttaattgtatgattgttttcacttactgatatataatatgtatacttttcattaggttgacattgttgttcaccatgtttagaaaagtttgatttggagatgtttgattaacacgtacatgcttcattttggtttatataatggatatataattagtgtgttattaagttgatattgttgttaactatgtttagaaaagtttggtttggttcaaattggtttacttcgattccccaatttcctctcttgggttccggtttcaacttgcatccacattggatccgtagtaattaagaaaagtgattcttcgtcccaatttgtattatttttggggaaattaaaggtactgtattatgttttatttttatagtactctactataatatgagctcaccacatttttgataaaataaaaatatcttatgaagagtcattagtaatgttcaatgtgcatgattgtggcaactggttatgtttaatcaagtttcaatagttacgtctaatttggagaggaaaactttgggaaccgaacaatgtaacgtccggttgaagtaaaccggacacggtaaccgaaaattatccacatgggtttggtttagttttcccaataaggtccagattcatccgccttcttagggatccacttcagcttaacataaagaattttgcctttgcaaaagaattgctcccgacaaattagcaattagactaggtatcccaaaaagcaataacagaggattaaactctctcatcgcaaaagacgttacgcatccaatttgggtaacccgaggctacataaaactgaagcgtcccgtcagacgtaacactgttagcaatgagactagttcctctatttgctgatgcaccttctacgatcaaccgccaatcagagatcagactcaaaatattcaagattagttgttttcatctttcttacatgaactgtgattttgtgaacataattttgtttttcttctttcctcgttacagttttataaaaataatttgtgaattgcagcaagccatcaagctaggattatgttggaactcgtaaagaagttaaaccatgtcaaaggacacaaaataatcatattatacagtactaaacattctacatcaaataaaataaaattatcttaagtacacagctttctaaaacacaaacatcaacattatatattcggatacaaatacatttatactaatttccaaattgtattgttttatcagatgtaacaatactttaaccaattgccgacaaaaacttagatctttttaataattaattaaaaacagaaaaaccaatcttaaaatctcagaaaaactttaatttagatacgcgtaaacagctttatatgtactttttttgttgtcattacgttaataaaatataaatctgatggtaccaaatttataaatataaattacctggcgatgaatcatcatctctgtaaatttctccagctcactttactctgcagagaatctaacgtttcatctttattttatttttatacaaatcacaatttatttttcttattaataataataatagtgattatgttgacgattaataaaggattagtttcgaattatcaatatataaatccgtccaactaacctatcccgtcgttatcgaaccaatg

SEQ ID NO: 21897 - DNA, 3000 bp, Unknown; identical to SEQ ID NO: 8756
  misc_feature (1)..( 3000): 2750-1469P.txt file - cDNA_ID_2036952; gDNA_ID_1971875; Annot_ID_176701

SEQ ID NO: 21898 - DNA, 3000 bp, Unknown; identical to SEQ ID NO: 8754
  misc_feature (1)..( 3000): 2750-1469P.txt file - cDNA_ID_2036956; gDNA_ID_1971875; Annot_ID_176700

SEQ ID NO: 21899 - DNA, 3000 bp, Unknown; identical to SEQ ID NO: 8753
  misc_feature (1)..( 3000): 2750-1469P.txt file - cDNA_ID_2036973; gDNA_ID_1971875; Annot_ID_176692

SEQ ID NO: 21900 - DNA, 3003 bp, Unknown
  misc_feature (1)..( 3003): 2750-1469P.txt file - cDNA_ID_2036987; gDNA_ID_1971875; Annot_ID_176688
atgtatgttcgtattcatctatatacagtaatgatgtttttacccctggtccaacgtcggagacgccatggagagcttccgaccaccactcgtacggcggaacaccgagccttggaactcctgtggctttgtttacgagttgctggactttttccttaagggagagacgtgagaccaaatctttggcacgtgcttcatacgacaatgagacgttgcagaaaccatacttagccgtcgctggggcacttatgtcacacgcaaagttcttttgagactcgcaaagtgatgaaactagagctatgattagcagagagagacgcacaaatcttctaatactcatctctctgttttttttactcttatggaatagaagacagagtgaggagctagttttataggcgggaagagaagctaattagctactatttacttcattaaaattaaagtttaacatttacttccaactttaacgatgacataacatcacttgttggtgaatattttataagagaagttaaacctccatgtgatagtgtggaaggaccaaggaccatctctgtttgtcttgcatataagagtgagccaagtgttttccacaaagtgatgagaggacaaaatgtgaagtttaagaaaagggttttgaagagtggcttcaaagatactacacaaccattccaaatgtctgtttcatgtctctggtcctaaagttagagaagcagatcttctatgtctctaagttccacagttccaggagtctttttgatgtctggttggttcaccactagctgaccgcaagcgccgctaatatcctgacccatttctttgcgaattgtagtccggatcttgtatgtttccctcaggattttctggaatcttgacacgccttgtatgctgcttgtttcgaattggcttgtggatccaattggattaaatggtatcaaatttatgacctgttcaagaaaagagcacagagtttccataaaaaatatcatcagataattgcagaacctttaagagtattaagacatcgaagatttaccacttgaaatgtctttagcaattcgcctagtagatgagcgtgctgctcttgatcatttactccatcaagcattatgtactcaatgaagatcttttgttgactgttaaatccaatgacaatgtggcataatgttataatcgtcaatgtaactgaagggattgtggttttaatatttaacagcaacgaaccagtcaagagtacatgaactacctgttcttttggaaagtttgaagtgcatccataagcttttgtaaaggaaaggctctagctgctggcatgatctggcagcggatttcttgaactggtgcatggagggatactgctaaacttacaccgggtagatcattgtgtagcttgttaattgcgtgaacaattccgacctatgcaaatgacattaggatacagggaaatttatttgctaactagtaaaaaaaagtgtcaacacaggcagcattgcatgatttagatttatgcctggaatatacggtacaagcattacggaaggacaaggaaatcagaagaaaatcccaaaacaccaaaatttaaaagtaaccaactagacaaaaaaagctgaaagatgtcttggaagctgcatactgcgaggtttaatggattgaagtttatctatcagttccctttatcaaattccataatctaaagtattcctacaaaattcagtgaataagtttctctgttttacgaatgtttcaaggtagctttctgagtacttacagttgatatggtaattcttttgggcgacagctgaaatggttggtttaacatgacacgaacagcttcaacaacagcattgtagttatttaaaggttctcccattccctgatcacaatcatcaaaccaaggcaacaactggtgaataaaattcatcaatgcagagtatataaaataaataaccataaggcaaggtgcacatagtgtagataaaatgcaataacagaagcagaaatataccatgaaaacgatgttgcgtatatcagcaatgcgagaggcgtgaacaagctgctccacaatttctccagatgttaaattgcttttaaatcccatggtaccagtagcacagaatgtgcaacccatcttacaaccaacctattgataaatactttcacatcacatgtctttcattcgataaaaccaagataacattgcgtgataaaaatcaatacctgagatgaaatacataacgtagatcttatacctccaggacgtggtttccctcctaacatccccaaccgagtatcgtatctcattaccacagcttccacaaaagctccattcttcaatttcaaaaccaaaagcaagaatccaatatgagttcgtcaggaaacagagacattacaagtttttcagaatccataaaagcaatgtgttgtatacagtaacagagtatagagtacctggagcttgatgagaagctttgaggtggtgccatcggaggaatgaaatagcgagtgaagagacgaagtaagagtcttgaacttggaatggagaagagagtatgcagcggaaggcaatgaaggaatctcgtcccaaacgcaatcaggattctgaattacatacttccagatttgaatcgcgaatttagggtttattcccgctgattcaaattccgatttgatttccgaagcatcgaacaccgatttcaacttcatcgactcttccttgggaattctccgctcgccgtcgccgattttaaaagccctaaacttttaaagcaaatcccctccgtcacaacaaaaattcaaagaagaagctaaaaccggtttggtttttggtggaaaatctaaacccggtttgattttgatatttgggggaaaagtaaaaaccggtttgtcttaaccgtttttgtcctttgtggtggacgagccggaatataaattccccaattttcacttccaacattcctcagctgctcgatctctctctgatcacaacaatcataagcgatg

SEQ ID NO: 21901 - DNA, 3003 bp, Unknown
  misc_feature (1)..( 3003): 2750-1469P.txt file - cDNA_ID_2037011; gDNA_ID_1971875; Annot_ID_176679
tgttccaagttgtgtgcaagtctgagtaatgtcgagtattaaatctaccagaatgttatttgtttcttgcattttcttttcattcatttactctttttggcttttcattcttataaattactgatttaattagttgatgagacaaaaacttgattctcgaaataattgtttcttgttggcatttattggtagccacattgcttagaagagtccttcaaattcccaataaccttttgttactttcttcttagtcaattcttttaaaaaagacagacaattcatatgatggaggtgtcctaagacaaagagagggtgtcacgttacaaaaaaaaggatcgcttttgcggcgactcatttaatgatttaaactcagtcgatatctattttgtagtcgctgccaaccaagtgccgaacagggtcatatgtcaaataacatagtctcttagctcttacaaaaagactgctgaaaactatattagcctcctaagtgaaacatagcaagtgttgaattaaataagaaaaacaaatgttgtgcctgctctgtcttggaacagagcaaaaaatgcttctcgtttcagttccagaaaatttcttagcttaaagaaaaaactcaatcgagaatcccattactaattttaattcagtagcaacaacagcttttttcatgatatttattaaaaagtggaacgttttatctaaggaaccaagctttacaaagaagcattgtggtaaagcatctggtgatcatgttgaatgattttagggcttgtttaatgagcgtcaacctccatggaatccatgaccacaaagacttggtagatccatctataaaagagtatgtaattcatttgttaacgaacgtctttcactgcgatggcttgttgctatgcgtcactaaggacagcactagcctcgaggtggatcaaaccaagaagtagttaccacagactagaaaggtatgctcttggatacgacaacaaccgtaaccacaaaatatcgaggtatttatttattacgatcacaatgttgcgcaacgagttcttaagtacgaaatcttcgatcttaagtgtaacatatgaacggttcttgatgtcactcctggtactggtatatactaaactatagttttcggggcgtgtccgtgaagggtaacaattactttgttgctcaggaaagattggaaggagtgatgacaaatgtttcactttgctttgatttttacaaacgagagttttggaccgaacatgcatctgccgtttgaatcttatcctgacgatgctgtgactctatcttctgttagagaagaaaagcgtgtagtgttatttaagaggtcgaatgcatgtgagatggagatatggattacaactaagattgacccaacgcggtgtcgtggagctacttcttgaaactggataggtcagtgttcaatgaaagattgaggaatatagatgtgagcttattcgtggacgagaagaagaaagtagcattggttttctgtaaagacagagaagattggaccaacttcacagcttatatgattggaaaggatggatactacaaagaagtgtatctcggagaatctactacatcttggccatttgtgtactcttatattccaagtaggcccggtctctacaaggatggttttttgtttagtttcttgcatctcttttttaattcatatattaactctttggattttcttgtttagtagtcagtcatttagaacaaacatgcattacatttagattctaaagatttgccttcatttggatccgcctttatgataagcactaacctcaaatattgcaagggtataaaattttctctgtttgaagttaaatgcctcaaagcacaaaagaccttgtgatgaattgtcgatgacagacaaagagactttcttgattaactagtcttctttaggatccaagaagaataacagattttctcctgtctgttattgtatatagttcgtgtgtaagaattgcttatctgatcacggaaacagtaccctagctagttacgtttatctctgttgcaaactttttaaatgtttagtggtgaactaattttgaaaaattcaaatgaaaagggttgtttttgttgtgggctttcatttagtggcctaattctaagaagataccttgaaatggtcggtgctggtttcattctattccattaatatgatggttcctgctacatgcacaacattttagtaacccaccattcttttcttcacattctggaaaataatgcagaaactgagattggtgctctggtccttagccatggcaaatataagctaatgtgagtttcttcatcgaccaaagagtagaaaatcgctgtggtctttcataagaacgaatataaaaaaaacatgttaacctcctccaaatgcatcacagcttataatttttgttatcacttagtcacattaatacattatcatactttaaaaattttggataacagcacatcgacaagctagtttagtagaaatcacaaagcataatttcaactctgcaaagttctgattttaaaattcgtaaattttttacagttttaataccgagagcttatcatataaagtcatggctcattattaatgtcgttattttcggatttctctttaattggctaaaaagcaaataaattaggtaatttaaattcagcttaattagccaatgaaaacagagttaatgcaaaagttcatcaaacctccgaaaaagcgaaaattaaaaaagatgagctcatcagaataccccaaatccagaaaccccaccctttcttcaattctcacatctctctctcttcgctctgaagcaaagacaaatatgcaaaatcctctctgaacaaaattcactttggatttgcagaatttatttgctctaagttagagtgaggagaagcaactgccaaatctctgtaatgcactgtgaagatctcgaagaacaacaagacgaagaagaagacgaagcagcgagacatttctcgtagataatg

SEQ ID NO: 21902 - DNA, 3003 bp, Unknown
  misc_feature (1)..( 3003): 2750-1469P.txt file - cDNA_ID_2037157; gDNA_ID_1971974; Annot_ID_177559
taataaactaagagcttctatatacaaaattcaagacatttttggatttggtttgacttggactcgtttggctctgctgtacaaatatactccagctagtgcagtcgcggtacctgtttatttaacaagtgattatatattgcttcaataaaatgaacaagtgtaacaaatcctttactaatatatactactagtagttgtttacctatagagttaagaggtgagactggagttttgaagaaaagaatggatgatgtaataaccaccacacgcttcacgcagttccctacagagtgtgttactggagacaccatctccaatatcatatacgatacctacaacaacaaccccaatttttatgtgttgattagaagcctaacactaaccgactttacaaaattcagtacagtttttctgaaacggaggaactagacggaccaacctgttggtagctatgcaagcaaacaccagcaagtagagacatgatgcaaaactcttttaccgacaaaccctggcttgtctgtcaagcaaccacatacaaacacacattagttctttctcttttagatcatctagctatatcggtttatgcttttccacttactgctacttgtaaatgcgaaggagtaaccttgaacccatcgatgaggattgctaaaggaaccagtaagataaaggagataatggttattatagagaaaaggttgatgttgtccaaagcgtcctgtttcaatatacaaacattaatagatttcgattactagtttctttcttgagatcataaggataacttatattcaaactcttttacctttccaaccatgaattttttactgaggacattgcgtgattgattcgtcacattagaagccattgcactgcagaaaccaatcctggtttatcccaataccatgaattaatcaaatcaattaaaacttcatcaaaagtttatcaagaatactattttttttgttcttgttcttgttgttcataccaattgaaagaagcttctgtgaaagatgctaaagagactccagcgacaataggtaacaacgaacaaacaatccacagactcggccactggacattaatcaaaatttcaaagattatgtctgaaaatataactctcttgtataatctaaggttatagattaagtctgaaacagagcgtatctttgttttgcttacctcaccgagcaagagaacagaaagcaagacggtgaagaaaggctccattgctttgatagtgtgggtgaaagagacatttactcttcctaagctcacatttgttaacaagttccctaacgtgtgagctactgctagttgtacgatcaccgtaaactggagaggattacaattgaatgaatctctctgtttttagggtttgacggaatcaatatttgatttacctgagaaggagaaaatttggggcgtggatggagtttaaggagccacattatagcaatcatcaacgttccacaccctaattgaaatgctgttacagtcgctggatatggataaaccctaagtacctggatcgatgaatgaacaagtttcatacttgtatgaagactgataataggttcgagtactgcttcttgcattgaaatggactgtttaattaaatgaagcaaagaaggaacctgtttgttgaaaatgttgtagtagatattgagaaggtaccaaactccaaacatgcctcctagcttcaaccctttaaccaaacttccagattccaaatctcctccttccacattctccggaactgtagctgacttgagcttgaagccattaaatctaaggttcggtctccaaggataagagttagaagatgaaaaagctctgcttcttctgctcaacgctgattcaggagtagacttggcaaggaacaatggagatggaagtcttggatttggatttagaaatgtgagagcgaacataattttttcctcttatcagatgctccaagatgtgcataaatcctccggcatttgttggaatttctcacaagtaaccgactcttgctaactttttcttcttcctctattggtaagagttatgttacatgagtctacctcctcattttcatgtaagaagaaaaaagtttgttttgtttttggatatactgcaaacttgatattagtattatttagaagagttgtctttattatgtgacttttctctcgttctactatctgaatgtttttgagtatgataaaaataactcacatgccgatgccgacatttttttcaatataacattggctcgattttatttatctttcctcataagagccagtggtatttgccggtattgtttcttctcatgttctccattccatgtgtgttctgtaaataatgttatggaaatgatttgacatacttggtcactcatttctttacaaaggggccgtggttttcttcgtttataataatatcaaaaagttggtaacgctataaataattatttaaaataaagtttacgtacgaacatgacaaattactgaccacaacaccaattgatttttagtgtggaatttgaaaatgtcaggggagaattgtatggatgatatgaaaggggccgcgttgaaacatgtggatgttgtattgtatgctcctgagtccacccttttctttccgtgttatttcatactattacaaataaggttggtcccattgctttgatcacattattgattataccatttacttattatgtcagtgttggtacaggtcattgatcacaatttgggctttaaacggagaggatggaaactgaattctaaatacatttcggcccatttagggtccataaccttctacgccaatcagaaggtacgtcgacatgagcaacttggtcaattttatgacataaataaaataaaaataaaaaaataaaaatcgatctgaggggttttagaaagaaaagaagaaattcgggagtcggagaaattgtcgggtggatcgatgaatacttgtcagtttatggataagcagataatg

SEQ ID NO: 21903 - DNA, 3003 bp, Unknown
  misc_feature (1)..( 3003): 2750-1469P.txt file - cDNA_ID_2037211; gDNA_ID_1972155; Annot_ID_179457
acagattttgtttttccattgttttggatttctagattctagttatatgttggtgatagatttttcctacatctcgtgattctcaaacgcttcttgagctcttcgtcgaatcgggactgtgatcgggacttggtggagaagaagcgatgataacaagatcgaatctagcagaacagctcagggaatatcagattagatcaaagcatgattgggcctccgtttctttcttctcttccacctccaatttctcttcctccaggttagagatctccggcttatcctttcctttttaatctgctgtgatttggagctgcgtgcttagagttgtatttgaaaaattgtactttgtgatatttaattcaattggaaccgtaaatttctcatcttttaagggattgtcgttgaacattggatatctatgtgaatcctacacaaggaactataattttgacttgtccacgttgaaccatctttgacaatttgacatacacttttcattcttatcgactctgttgcaatctggattctattgttaaattttgacaatgaacattctatagtggtacttatgctattcgtttcgtttgcttttgattcagggttgatgttgtagtctttgtcatatgggaactagtgatgttagcactcgtggtgttttcagctgtatccttgtacttcaggcggttgcaacttgcttttatcctgctttgtgtcaccttactattactcctctgtatgaaaatcacaaagcaagtgagacatgctaggaagaagaagcgaaggatgcttcttcctctctctatgtaaagaccgaaaccattgagctgttgcgaaccgtttatcttctcacacaaccaaaccacaactcttctctggcatgagttttgtgcccatatgcattgatgaagatgacagctaagctcagactgactctgggacgcatcgcttttgtcctttgaagaatcgacctgaacttgagatatgaaaccagggactgcaatttcaaggcttagcttagacaaatcagaacaaaagtgctgtaaaggttgttttcctgtataaagtagtatgggaggttgctttatttttcctaggcacgatcacggattgttaacttgagcgttttgtgattaaagatagtttttccatctatctatgttacacttaatatcatgatgaagtgatttagatttgttggctgtaaaaagtttttaaaaaatgatttgcaggattttcatgtgacgagaaaaagaaaaacaacgaacactcatgaaagtagaagagagaactataaaatgaaaagtagcaagcaacttgctcgaaacgctcacatgtttctatcattacctttgcgctctgcaactactttagtatcttgttaaagaaaaagtggtaatagttagtattatttgtaatgttatggtctgtcaatacactagcttagcttgatttgattaacttaatttccaaataatgagatactgtctacatggtgatatagctttgtcaaagttcattaatgacaatgacaaaaacaagtgtgttagtaaccaagataattgcatttagtcgtaattcatgttttgaaacggaaataattagaaagatcgaaaatctctagatatttgtagaaggtcagtacataactccacgagtggtcgtgatccaatttgtggacaaatttgaaaagcaactaaaaacaatcaaataagcacgaacatccttttccctccacacacatcaaaatccacagtttggtccatatattgctatatatatagagaagcagttaggcatttaattaaggttgcatacagacagatacatacgcaacgaaactatcaaagccgaagtaacacacacacaaaaatcatatgaagaaactaaattctaaagggattagactctccgaattgatggagaaatggagaagaaggaagaaagggcacttcgctgtgtacacgaacgaagggaagagattcgttttaccattggattatctgaatcatccgatgttacaggtgctattgcaaatggctgaggatgagtttgggactaccattgatggtcctttaaaagttccttgcgatggaagtttaatggatcacatcatcatgcttgtgagaaggagcatgtcccatgattatgatgatgtggagaagtcttccacgagcagcacctgcaagggagcttcaatctcttctctctttcgtggacagagccagcttcagtcattagtttcctaaccatttggagtaattgttaactttttttggagaagggttgttctattttgtgtataccaacatgatcttgtaataaattaattattgtaatgtatcaatgatacagtatcatcatttgattttgagtctttttttgacggttaaaacaacgatttgggacgaagttataggccctgaatggatgctgattttggattcagtttttgaatttagattttagtttatagattttagattttagtttcagatttttattattatatttttgtttcaaaaaccccaaaaaattggtttttggtttttgagaaaaataacgttgattgagtaaaaactagatttcctaaattttaggagaactaaaaaactaaaatcatgaatggaaaactacaagaaaataatttttctaaattgtagggaaaccaaaattttaaaatcttgattggtatgaaaataagtttttggaaaacaaaaaccaaaaactcttacaaaatctacaaaacattcaattcatgtatccaaacttcttaaagggcccaaaaaggaagaaaacattgtgaaagaaacagatatagaaatgggcctttggtctttaaattgggcctaagccttttaattgaggccttactaaaagtgacgactcacatggttgaatcaaatctcaggtagtaaattgtcaaagctgaggagaaagaaagctttttcggtctgaaattgaagtgcgaatcggggaatctagggtttcgagagagagataatg

SEQ ID NO: 21904 - DNA, 3000 bp, Unknown; identical to SEQ ID NO: 9575
  misc_feature (1)..( 3000): 2750-1469P.txt file - cDNA_ID_2037218; gDNA_ID_1972155; Annot_ID_179450

SEQ ID NO: 21905 - DNA, 3003 bp, Unknown
  misc_feature (1)..( 3003): 2750-1469P.txt file - cDNA_ID_2037225; gDNA_ID_1972155; Annot_ID_179448
ctcctctcatctgattaaacccatccagcaaaatcccacctctcgagagacgattgttgttcgatcttctcggtagctttgtgacaacagaatctagggtttcgttttttgttttgtttttgtttaattcttttattaaagtcttggttcataaatattcctgctagaaacaacaactgtacatcaccatcattaagagaaacccatctgcctctttctcaatctcataaatattctcaccgttcgcttctctcatctaaatgttctctctgtagcttctctctctctctctatctttttccatcttaaagaaaaccctttttgctccttaaggtgtacctctcgatgttacattcgacagaaaggaaatgagtgatttgtttttggatctttaacctttttgatcatgcgggtttgacaaaagagtctcttacagagatctttggcattctgtccacctcctctctctatatttatgtgtaataagtgtacgtatctacggtgtgtttcgtaagaggaggtgggcatactgccaatagagatctgttagggtttctttgtaaaacccctcatgatttgatatataaagatagtgatcaatatcattcggtgaatactactaagatctaagtttgaagaaaactaggtattatctcgaaactttaaccttttttgttatctgtgactgtgagcgttacttgttcttgattaagtaaaattcatttgaattttgctgtctcctttgatctatctgtcaaactttgatcttgatcaagactaatccgattgatacattcattgtaggaactcatcatctttttaaattgcaacggcgttgacaaatgtgagatttcagagtagtggtggcgtttgagacgtttacatcatctaggaaaggtaaattatttcataaagaaagaggacccattactccctacaaggtacaggtagattgaagtcataggagaatatggtaatgaaaaggagaatttactcttcctttttatgtttgtgaagcccacacagtgttattatgatgtcttgcttttttttttttttaatttgaatctatatactatataggaagagtgagtttttgtttgtttatataggagtatatttgtttctttattatctgatgagttgtgttcaatcctataaatggttcgagaaatatcgagttcaatcttaaaatggagtatttttcttaggcattattatgacgttttcttttgttatagtcggaatgtatacattttctgtatagtcacactcacatgtttctatagatgtatttgatgtaagtgatctaagctcagtattttcaattgaggtatatatatgctgagttattgttgtccttgcgcttattttgatattataggtactttgtttttttctcttacatttatagttacgttatagtcttatagactattcccacatttttgtgtttatttatatcggttgttgactaattaggttttagatggtaccaaaatgatttgcaattctatgtggaaatatgaaagcaaaacaagtttacaatacgacttttgccaagctcttagcattgttacgattattggattctaacgtttttttcttctttaggtaaaatgaggattttaatgttgagaaagtaagcttcggatttatcatgtaatcgtgatgatatgacattcgatgacttggtagatatgtataatcctcgacgtctctgttgtgcatctagcatggtttataggggctcattaaacagggtgtagatttatacatttaccataagtttgaaaaattacaactccacgtcaaagagaaaataaagaaaataataagaattcaacaaaaactttccctagtaacctcatcattggaagtgtgtcagtagcatttaaattatcctttcaaggcaaatctccaaacttttctacgcgatttaactatgcgcgtgactcccaaatttcctttctcgtttattatgtaggtcaaagttgcttttatcttgtaatttttttcttatgttcggtcaattcactaaaactccagtaattatttatctgtagtgtagcgtatgattattattctgcaaactctgcgtaatagagactttttaaaaaacaaatgcagtagtccaaacctactttctagaaagaaaaagaaaaaatgttctttagtttccctcctaaacggtgaaaagtctctttgtcgcaatttgtttacacatatcctgataaaacgagtttattgggctttatgttgggctcgtttattcagcaggtctgaacctcaaaactatattataaagtttaagcccaaaaggctttaaatatggtatcaacaacatatgcttatgctatgcatcattttcgcaaactatggtgttgtatgaattagtgggttgttcaagatgttttttcttaagcgaaaacctatttatacagtttgcaatggatataagcttttgcaaagtctacaaaagtcacatctcaccacaaaaaaaaaaggtctacaaaatcacatgtatctttggaaaagtatccatgcttagatatttcatatttctgatccaattatccaaacaaacatgtcaacagataaaattaaaaaaaaagctaatcttttcaaaatatacaagtcaaactgtcagaatataacaatttagactagttgataaaaatatatttttgaataagaacattttagattaaattttggtaccataaaatgtttgatagaacgacgaaaccattttgacatattaacggcaatctcggggaagaagaagaagcggtagagagaaaaccgatgctcacagcgtttgcaagtcacgcgcgttctcacgttttcgcgtttgttaccgtcccaacaatcacgcgccgcctccgtataaatatcttacgccaatcacctctctcctcttctcttctcctaaacgaaaccttctccaatcgacccaattctgtttctcgtcgttgttattgttcgagctctgcgataatg

SEQ ID NO: 21906 - DNA, 3003 bp, Unknown
  misc_feature (1)..( 3003): 2750-1469P.txt file - cDNA_ID_2037281; gDNA_ID_1971889; Annot_ID_176829
aaacccaaagaacgcaacagatgccattataataaatgacagcctgaagcaatgagagccataacatgtgttcccttccccggaagcagtcttatcgtagatataaccgatcaatcttacagagaagatataggaaccaatgggactagccacggatatggtattgaagatggttcccatgtgccgaatcccgaacagctcagaggtgattgtaggcatcagagaccactgtgaaccataacaaacgccaactataacagaaccaacatagagatttccttgaaaaccagaggctatgattaggtggcctatgctcatcgttccaagtgttgcagccattagcaatggacgtggccatccctttttgtgtagcaatgcatctgaggcataaccagctccaaatctaccgagaaagttccatatactccacaaggagaccaatgaatttatctcaactgatgagtatcgaagagactcacctatttgtcggatgttgtttatcgttgaaagtccagagcccattccgcaaatcatggcaagaaataacaaccagaagcttagttttttcatagcttgcagaagattcaggttctcactcagtccagcttccactttactgtcaccttcagaactttggttaccggaggttgttgcctttggactgcttatgagaggggaataatcatgtggtactgttttttccatgccgtctcgttgtgctcttctcgcaataagtagaggcaaggcaagcatgacgagtagacatacaagtgtgacaatgttggcccacgatgacaacccaaaagtgttcttcaatatgataatgatcataagataagctgcgatgattagagatacagctgaaagaccatttaaatgctttttatcatcggctacgcttgtctcatagatcctgaccagaggcatgaccaagagtgagagcactgttggtgttactgccagtaagagaatgaagctggccggatctccagcgcacaatgtctcgtacagttgaatcagtatcgctccacttagaccaagaaaaccctgcaaagaaagaattagaggtaagcttggatgcttcactataatcaaaaattccaaagttgaaaccatgaatctcccactattaacatactttggggtttagttgaagtttctcatcttaaaagtggaggttgcatcctcatttgcaaggtttatcagaaaagaacaaatatttactacgcaatatatatcaactagaagatctagatctcgattgatccaaagttcaaagcatcaatctctttccaaatgttaccaaagcctcctcatttagactctaccaggatcatcatcatagccaaatattggtctttaggtcccaaggaaacaaactgagacgtgatccaacaatacagatccattcaatatatcgaaaagcttcatcaaaaactcaccttcataatgccaacggctgtaccaccatagtcagcgaaattctcaacggcactaacaacattagccgtattgaagaacgtttgcgactgagctgctaagaacataaacaggcacatcagcggcaccggaggctttctaataagtccggtaacagaagcccaaatgagaaagtaaccggcgaagcactgaattgccccaacagcaagcaccacccaaggtcctccagcgcctccaattcctcctccccgtccacggagacgattggacgtagcgtatgtgtataaaagcccagagaaaactccggcgtttgctccgatgtccttgaagactgagacggtatcgagggtggattgatcgtacgattgagtcgattttaggacagcggaatagattccgaaggtgtaggaagcgccgcttgcgcattgtatccatatactagctgtcatagccacccatttcgttcttagtatctccatcgccgccaattaccaccaccttcctcgccggaaaaaaagagaaagccagagctttttcccctgctcaaggacgacgaagcgacacgatcacaaaacttttttttctttttttctttattcaaacagattgattttggaaaaactatttaaaccttaatgggctggaaaaattggtatgggctcattagttatagaactcgtagtattgattttgtgagcccaattaactggaatgacacgtggagtcagatggagagcacacgacagccacaagacggcttgtggaagagagaagacggaacgaggttaattaacggattaaactaacggagtcaacgttgactggtcaaggagtattgagaaaactgtacggccggccaaggtcacgccactctctcgaccaatggttttataatcacgaggctgactcagctaatctcccgcaaatcacgagatttttcaatgttactcaattacaaaactattaacaaactcaatactacaaaatcatgtaatgtgattatttagttagtcggatcactaattaatgttttttcatgcattatactatggtcaacgacgttggagaagtaatcttgaatacttgacaacaaccaaaatattgattctttttttcctctcataaaaaaataatgtttaacaattgtaaatgatctaatatattatctccattcttgttagattaatttaatttatctctgttcatattttcacaatctaaatttcttttaaaaataatataaatgaaaacaaattagttagttaccaaagaaacagagacaaaacagatatttaaatatacatcccgccataaatatgatataagctatagttggttttcagctgcaacgtctcagtcacttctaatataataaaactcaaaatctcaaattgattaaacaaactggcttacgcagaagagtgacgactacgaaaatgtatcatgcctttaaaaaccttctctactcctttaatcggttccttcttctttcccttttctcctttcgcttcacgacgacgaaatttttgatttcagtcaccgttattgttgttgcggtggatg

SEQ ID NO: 21907 - DNA, 3003 bp, Unknown
  misc_feature (1)..( 3003): 2750-1469P.txt file - cDNA_ID_2037321; gDNA_ID_1971889; Annot_ID_58463
catggttctaaattcagtacttgtttggagcttgctgatatttgtcgagaagttggtcttcctcctggggtcctcaatgttttgactggtttcggttcggaagctggtgctcctttggcatcacatcctggcgtggacaaggtattggtctttgagaatacagtaaacataagtcccaacaaaattaactctaaaggctatgattaaacattcagtttaacgtctgcgtttcttaaacgcttcaatgctaagttatgatttcgttgcagattgcatttactggaagtttcgccacaggaagtaaggtcatgacagccgctgctcagttggtgaaggtaattccaatttttgaactttctgctgtatattccttctcctccttttgtttcatcaccaatgtcaatgacacattactcatggcattgttgcagcctgtttctatggaacttggtgggaagagccctctcattgtgtttgatgacgttgatcttgataaaggtgaatgtcacaaaaagtagtttagtggatttggagtttttttataataacttcttcttgtgctatattcaagatagtactaatgcttttgttgctttgagacgagtagacatgacttaaatttgcttaatcttaaaattaaactctttgtatgttttgacgccggcaaatgatagctgctgaatgggctcttttcggttgcttctggacaaatggtcaaatctgcagtgcaacttcccgccttcttgttcacgtaagtcccaatcttctacttgctttaaggttttacctgatcttcccaatatgacatgcgaatatttattactggagaagtgaatgttccaagtcatacgggaagatgtttccattaaggtcaatgacaatgacatttatttcagatcaaaccttctggtggatatgccaacagggatacaattgctgactctcttgtctaaatttttttattttatatcttaggaaagcatcgcatctgagttcatagagaagcttgtaaaatggagcaagaacattaaaatttcagaccccatggaagaaggatgcaggcttggtcctgtagttagcaaaggacaggtaaaatcccagtgatcgttttttctgtcttcatattatttgtcaatttcccatcaggttgcaatacaacaaccaggactaaaaaggaaaagagaattgagttctgtagtatagtgattaacttttgtccctctaattctgaaccgtttagcttttagagcatcaatcaaatcacatctagcatatgatatttcatcacgcttatcatgttcttacttggtaggtgtgcttttcttctatgatcatataatctgattgagctgacaaatgtaaatattacagtacgagaagatattgaagtttatctcaacggccaagagtgaaggagcaacgatcttgcatggtggttcccgacctgaggtattacatctccctcccttacctatccttgatgcagtttcttccagactatgatgatgaccttttatatcatatctatatttcacagcatctggaaaagggcttcttcattgaaccaaccatcataactgatgtaaccacttcaatgcaaatatggagagaagaagttttcgggcctgttctttgcgtgaaaacatttgccagtgaggacgaggcaattgagctagcaaatgactctcagtaagttaacgtttctccagaaagtgaaatctgatcaaatcccatccgctgacactggtgtttaaatcaaatttatcatttaagatcttatgtggctgaaaattattcattgattaatgacagttacggactaggagctgcagtgatatctaatgacacagaaagatgtgaccgtataagcgaggttagtaccggtttcttgaaccattcagatttgtttttaatgcctagcaagtgaaataacaataccatcaaataacacaaacaattggtgtctactttgttaggcctttgaagctgggattgtctggattaactgctcgcagccttgctttacccaagccccatggggtggtgtcaaacgcagtgggtttggacgagaacttggagaatggtacatttctttttctatctcgaatcttgtttttaaaagactatatcttgatggcttgtactgaacaaatcttggttatggctggtttcttgcgtgcttcaggggacttgataactacttgagtgtgaagcaagtgactctctacacttcaaacgatccctggggatggtacaaatctcccaactaagtaatgaatacattgtcatggaaatggaaaccaaaccaaatgctgtctgttcaaatctttgtgcttttattatcagtctgtctagttcggtcctgaaactcttttgtaaaacctgttgaatttataatgaataaaagatgctttgctgataattattggttgttctataaaggccagtattgaggcaccattttaggctctggtgcagcagtatcaagaacatgaaccattttatgtcaccttcaagtcacatcaaagttaaaactcacatggcaatcaattccaaatcataacttttttttttactataattgcttgaaataaacattttatgagatctgaagatttgtggattttttttccattttttaaatagtaaaatgtttggcaaccaaatctgaaaaagaggtaaagacgagaggtctcgcgcttatccttaaaggactgtggtgaatggtgagtgtgacttggagggaccccatcaccgcaacaatacagcttcttagatctcgataaccacaactaacctgtcacagtttcgattagatcttctcaaaaacttcacctttttttgtttttccagtttctcagaggagatcttccttcaaagctcaaatccttttgtctgaattgtgatactgctgtccccatttttctgcaagttgggaaatttctgtcaaagttttgtgggtctgttaaaaagatctgagctttgaacatggggagctcaatg

SEQ ID NO: 21908 - DNA, 3003 bp, Unknown
  misc_feature (1)..( 3003): 2750-1469P.txt file - cDNA_ID_2037321; gDNA_ID_2684202; Annot_ID_191253
ttgaacacgtctcatggttctaaattcagtacttgtttggagcttgctgatatttgtcgagaagttggtcttcctcctggggtcctcaatgttttgactggtttcggttcggaagctggtgctcctttggcatcacatcctggcgtggacaaggtattggtctttgagaatacagtaaacataagtcccaacaaaattaactctaaaggctatgattaaacattcagtttaacgtctgcgtttcttaaacgcttcaatgctaagttatgatttcgttgcagattgcatttactggaagtttcgccacaggaagtaaggtcatgacagccgctgctcagttggtgaaggtaattccaatttttgaactttctgctgtatattccttctcctccttttgtttcatcaccaatgtcaatgacacattactcatggcattgttgcagcctgtttctatggaacttggtgggaagagccctctcattgtgtttgatgacgttgatcttgataaaggtgaatgtcacaaaaagtagtttagtggatttggagtttttttataataacttcttcttgtgctatattcaagatagtactaatgcttttgttgctttgagacgagtagacatgacttaaatttgcttaatcttaaaattaaactctttgtatgttttgacgccggcaaatgatagctgctgaatgggctcttttcggttgcttctggacaaatggtcaaatctgcagtgcaacttcccgccttcttgttcacgtaagtcccaatcttctacttgctttaaggttttacctgatcttcccaatatgacatgcgaatatttattactggagaagtgaatgttccaagtcatacgggaagatgtttccattaaggtcaatgacaatgacatttatttcagatcaaaccttctggtggatatgccaacagggatacaattgctgactctcttgtctaaatttttttattttatatcttaggaaagcatcgcatctgagttcatagagaagcttgtaaaatggagcaagaacattaaaatttcagaccccatggaagaaggatgcaggcttggtcctgtagttagcaaaggacaggtaaaatcccagtgatcgttttttctgtcttcatattatttgtcaatttcccatcaggttgcaatacaacaaccaggactaaaaaggaaaagagaattgagttctgtagtatagtgattaacttttgtccctctaattctgaaccgtttagcttttagagcatcaatcaaatcacatctagcatatgatatttcatcacgcttatcatgttcttacttggtaggtgtgcttttcttctatgatcatataatctgattgagctgacaaatgtaaatattacagtacgagaagatattgaagtttatctcaacggccaagagtgaaggagcaacgatcttgcatggtggttcccgacctgaggtattacatctccctcccttacctatccttgatgcagtttcttccagactatgatgatgaccttttatatcatatctatatttcacagcatctggaaaagggcttcttcattgaaccaaccatcataactgatgtaaccacttcaatgcaaatatggagagaagaagttttcgggcctgttctttgcgtgaaaacatttgccagtgaggacgaggcaattgagctagcaaatgactctcagtaagttaacgtttctccagaaagtgaaatctgatcaaatcccatccgctgacactggtgtttaaatcaaatttatcatttaagatcttatgtggctgaaaattattcattgattaatgacagttacggactaggagctgcagtgatatctaatgacacagaaagatgtgaccgtataagcgaggttagtaccggtttcttgaaccattcagatttgtttttaatgcctagcaagtgaaataacaataccatcaaataacacaaacaattggtgtctactttgttaggcctttgaagctgggattgtctggattaactgctcgcagccttgctttacccaagccccatggggtggtgtcaaacgcagtgggtttggacgagaacttggagaatggtacatttctttttctatctcgaatcttgtttttaaaagactatatcttgatggcttgtactgaacaaatcttggttatggctggtttcttgcgtgcttcaggggacttgataactacttgagtgtgaagcaagtgactctctacacttcaaacgatccctggggatggtacaaatctcccaactaagtaatgaatacattgtcatggaaatggaaaccaaaccaaatgctgtctgttcaaatctttgtgcttttattatcagtctgtctagttcggtcctgaaactcttttgtaaaacctgttgaatttataatgaataaaagatgctttgctgataattattggttgttctataaaggccagtattgaggcaccattttaggctctggtgcagcagtatcaagaacatgaaccattttatgtcaccttcaagtcacatcaaagttaaaactcacatggcaatcaattccaaatcataacttttttttttactataattgcttgaaataaacattttatgagatctgaagatttgtggattttttttccattttttaaatagtaaaatgtttggcaaccaaatctgaaaaagaggtaaagacgagaggtctcgcgcttatccttaaaggactgtggtgaatggtgagtgtgacttggagggaccccatcaccgcaacaatacagcttcttagatctcgataaccacaactaacctgtcacagtttcgattagatcttctcaaaaacttcacctttttttgtttttccagtttctcagaggagatcttccttcaaagctcaaatccttttgtctgaattgtgatactgctgtccccatttttctgcaagttgggaaatttctgtcaaagttttgtgggtctgttaaaaagatctgagctttgaacatg

SEQ ID NO: 21909 - DNA, 3003 bp, Unknown; identical to SEQ ID NO: 21908
  misc_feature (1)..( 3003): 2750-1469P.txt file - cDNA_ID_2037321; gDNA_ID_1971889; Annot_ID_176813

SEQ ID NO: 21910 - DNA, 3003 bp, Unknown; identical to SEQ ID NO: 21908
  misc_feature (1)..( 3003): 2750-1469P.txt file - cDNA_ID_2037321; gDNA_ID_2684202; Annot_ID_137228

SEQ ID NO: 21911 - DNA, 3003 bp, Unknown
  misc_feature (1)..( 3003): 2750-1469P.txt file - cDNA_ID_2037333; gDNA_ID_1971889; Annot_ID_58459
gagagcgttagctagtgctgggatttccaaggaacaaataaattacataaatgcacatgcaacctcaacgcatgctggagatattaaggaataccaagcccttgctcactgttttggccaaaatcctgaggtagcttcagttctttgttacaaaattccgaagtgcctttttatgtgcttttcttgatctttctcgatgtggcagcttaaggtaaattccacaaaatctatgattggacacttgctgggagctgctggggccgtggaggctgttgcaactgtgcaggtaactcatttgactcggtgtatctacaaggaaggaagtgttgttgaaaccaagttttagcatagagcgaaattatgtgcaatcttcgcatttttaatgttaatattctgttgctatctacaggcgatacggaccggatgggttcatccaaatatcaacctcgagaatccagacagtggagtggtatgttagtttcatatgagttcaatacctatacaaagaccttttaatgttcgtaaaaaaaaactcttgggagttttaataatcgtactgtgaaatgaaattggagcaggatacaaagctgctggtgggtcctaagaaggagagactggacattaaagcagccttgtcaaattcattcgggtttggtggtcataactccagcatcatttttgctccttacaagtgaaagcgaaagcagttgcttgtactccaaacctgattgtataacttgctgtaaggtaaaaagttacatccattgtacatttgtgtatcatcagattcttagaggaattgaaggacagttaactcttttgacctttctatatttattactttggctgagatggatcattggcaataatgaattggaagtttgtgcaagttccctttgaagtattgtcggtccagaaatgctctaaaatgatttgggatggactaagaatttgttatgaagctgagtgtttaaattatgtgcagtgttttacaagaagtttcccatgttatgctagtgttacgtcgagggaatcaacagagtttgttcaactaccaagagctaagctaagtttcttaggatcaagatctgatgagccaaagacttggacaggagctaaaacgtgctagagatatcagagtttggattcgccattaaaattctgtttcttgtgataccttcttattggaaatctttgtagtctttacatttctattgtttaacatgaaatctcaaaaaatgccaaatcaattctcaattttaaatttagtagctcttgacagttttccctttgttaattacatatatagagagtaactaaatcatcttttgaaaggtaaaaactaaaaaaatatattccaagggcccaatgttttaccactttcatatgtaagcttattttctgttaaatatgtgaaagaaagaagaggaatgaatcagctgtgaaaaccaagagcaagtataaaaacatggctaaaagggtatcaatcagccttgtataagagagccataagtagataaagtttctacagtaaaaacaggaatatagagtactattccttaattagcttatgttcttctattcttcttgtgacctctatcttgcatttttgtgaccaccccacttgccttcttctttttggttgcatactctaaataatatccagactttgatgtctttatgcgctctgggttcttcttgtgacccctcttccttgtaattgtatgtacctgcagcttcttctgattttgtttcttatggatatgtttgtgatgtataaaattttgtgaagatgtttataaaacagttaaaaaccaaattaaccaatcatccttattttctcacgagccactctatgaaccttacgttatctcgatgtacctgtaatgagttagcaattactacaatccaagtcaataaaataacaagttggacgttacgttataaaagaaaatcaaacttatttgtgtgttcctaacaaacgcatgggataataacaagagaataaaagacagagtgataggatcaacggctattgtgcgtaggagaacacagctgctatataagccgcgtaacaggtgattactctgactacgacaccaacaagaaaaattctctcaaatgtgggcagttaagttagacacgtgtaaggtcgcgattcatggaggagacgtgctcttcccgctttttgtaattatttattactgttgtcataaataaaacactaaaaaaaaattaataaaagggaaaatacaaaacgtgatttatggatcaaatttgcattggtggtggagttttggttatgtaagacccacaccgtgttccctctatctaacgccgttaatcctcttttttcccccaaatcataccgttaattctctttgagtgctaaaatatcacgccggtctatgagattaaaatagtagactaattaatagtgctaaaaatacataaattaatgccaagagattcatcttaaaaaaaaggatatatgaaccaactaaatggtataactgaaagactatcataatcaaatttcatctgaacattgatttgtttgaactaattaattttaggattttacgttttcataattttttattttatttgaacatcttgtaagggtaaaatggtaaaaacaggagtagtaagagggtgaaatggttatttcaagtgtgaagcgtggggacgtgggtgacggtggtgatctgaaacagtggtctgccgttaaaacattaaattaaaacacgtgttttaaatgtctctatgttaattaatactataagagtatattttactaatttccgtatctgcaaccagcgaaaaaaaagtaataaagaggtcctccatttcttcctcgtgacaaaacgcacttggcagagaaagataaacaagaaccctaagtttttttataagattcgagaaaattcaacaactcaggaaggaagatccttttgctccaatttctcaatcgaaacgatttcaatttcggtttcaacgatg

SEQ ID NO: 21912 - DNA, 3003 bp, Unknown; identical to SEQ ID NO: 21911
  misc_feature (1)..( 3003): 2750-1469P.txt file - cDNA_ID_2037333; gDNA_ID_2684202; Annot_ID_191249

SEQ ID NO: 21913 - DNA, 3003 bp, Unknown; identical to SEQ ID NO: 21911
  misc_feature (1)..( 3003): 2750-1469P.txt file - cDNA_ID_2037333; gDNA_ID_1971889; Annot_ID_176808

SEQ ID NO: 21914 - DNA, 3003 bp, Unknown; identical to SEQ ID NO: 21911
  misc_feature (1)..( 3003): 2750-1469P.txt file - cDNA_ID_2037333; gDNA_ID_2684202; Annot_ID_137224

SEQ ID NO: 21915 - DNA, 3000 bp, Unknown; identical to SEQ ID NO: 8814
  misc_feature (1)..( 3000): 2750-1469P.txt file - cDNA_ID_2037366; gDNA_ID_1971893; Annot_ID_176880

SEQ ID NO: 21916 - DNA, 3000 bp, Unknown; identical to SEQ ID NO: 8810
  misc_feature (1)..( 3000): 2750-1469P.txt file - cDNA_ID_2037390; gDNA_ID_1971893; Annot_ID_176873

SEQ ID NO: 21917 - DNA, 3003 bp, Unknown; identical to SEQ ID NO: 21495
  misc_feature (1)..( 3003): 2750-1469P.txt file - cDNA_ID_2037583; gDNA_ID_1971974; Annot_ID_177584

SEQ ID NO: 21918 - DNA, 3000 bp, Unknown
  misc_feature (1)..( 3000): 2750-1469P.txt file - cDNA_ID_2037724; gDNA_ID_1971948; Annot_ID_177298
ataagattataaattttaaaataatatgtatgaaattgaatataaatattcaaattatgacacagtactcagtaatttttttttttaaatctacttttgacccgttatagtattttttcatgtattgaacagtttatattcgttttaaaaaattcaaattgtggcatatgcgaaaaaactctaattatttttttataacgatgatattatttttttcgcaaaaatagaatcatataaagatgagaggtgaactataataattaataaaaaattaatatgataatttagatatcaaatctaatttgttgattttaattggttacttttttggaaattaaaaatgtatttcgtttttgagttaaatttaattaattaaattagtatttgactttttaatttttaaagaaatgaattaatttactctttaaaattttatttctaatggtatacctatgtaattacttacaaaaaataaggttacattttaaaaattaatatgataatttagatatcaaatctaatttgttgattttaattggttacttttttggaaattaataatgtattttgtttttgagttaaatttaattaattaaattaatatttgactttttaatttttaaagaaatgaattaatttactttttaaaattttatttctaatgacatacatatgtaattacttacaaaaaataaggttatatttaaaatgtactttcccaaataatatagtaggataagtagattctctatttggtatttatattttctcttatagaaagaaatctaatcatttttatgatatttagattttctatttgtactgttgttactcacttcttactttcaagtttcaaccaacaagtttctcaggattttaatatttttttttggtcaaatattttttggtaaaaaaaaagaacattattccattttaaaaataaaaataaattattgtttccgatctttgaaacgctgcgtttaaggttcagggttttggattccgacacggtgaagaacaatgggatccattcctgctatcttcttcctctgctacacctgagaaaccctgaaaccctaattcttcagtaattagtttccaaagcagttaattttgggcggaaaatgtggtcttcgagaactctcaagtatattttcaggctaagacctgaaccaatttcttcctcatcgtcttctgcgtattcgctctctcgcatcaccggaggttctccaattccgtcgcagcagcaacgatcgattacctccacggcgccgcttaatggatggatggattcgatcaaaggtgtttttaccgggaacaaggatactcctttagaagaatcaaatctacccgttgaagctttcactcttctccgtaagtcttacatggatacgtgtgattgactgtaatggtggatagatcgatatactcatcaaagctattctctttggattgaaaattgaatttaggatttgctgatgaattgaagaatgctagacggttagggaaattcaagcagtacattgtgggacgaagcagcgaggccacttttgctgatgcatttgagaaacaagaagctgttattagatatcttggagctcttgatgctacaggagaggttggtttctttcttagcatactagagtccagctatgtatctgtcgtttctatcacacacacatgacttgctaacaatttgcagaatccttgaaaacaagaatttttttttggtacgttagtcaatgtctgactgtggcactaggtttcttgatgtgtagaatctccaagcgagtcaaaagcaagatgcggctaaacattgcaaatgcactataactgatgtggagaatacgctgtccaaatttacttgggccaggcaagctcacaagaagatgacagagttgaaagaaggaggcaaaccgttaccaaagaatatgggagaggtattcttctcactttgtatactcatatgcttttttagctccataagctcctatgtatgactgtgtggtcacgtttctcatttcttagacttagaatagtgtctaatgagattttgcaataacacgctcttcttcgttttgatcatcctctaaaaaaactttaagtttctacacctaactaattcccggctcaagaacagggttcccttataacaagagctcgtttgtaacttggtgtttttggttagatttgatgttcattggttagaaacaggagtcatcttgcactatgttggtattcttaagattttagtttacatttaggcagtttgttacttgttggtttactgtttccctttgtcctgcatccatttagctagtagttatgatgacactaaattgttatattggtctattgaagctgcaaaaaatgatggggtcaacaccaatggatctggcgagatcaaacttagccaaaagtgggcagatcagccgcaatgcactttgtccctgtggttccaaaaagagatataaaaggtaaaaactttgaagagctttcctttttcccggcaaatacataagactgttaatcaaagttgcacttctatgtaaattcatcattttgttgcttttccatttatcgttgtgttgatatatttgcactctcttcttccttgaagatgttgcggaaaggattgaagaacacagaagttgatccaaagcatctaaagatacgagctttcttttgtttgactcttttcttggcttcatttactatttaagattgtagtatttgtatttttttaaggttatcccataatcagttcatctgaatactttatttttgaaaaatagttcataacctaagttaaagtcacatgtttgctaagtatatcatttcgttgaaagaaacccaatccaacggctacaaaacagaacgtacaatagtgaatagttgatggtcaaacttgagagcagtctaaattcaaatccaacggttgagatctcttgaattgatctaaggctaaaaatcgaagtcatacgtcacgaaataagaatg

SEQ ID NO: 21919 - DNA, 3000 bp, Unknown; identical to SEQ ID NO: 8942
  misc_feature (1)..( 3000): 2750-1469P.txt file - cDNA_ID_2037739; gDNA_ID_1971948; Annot_ID_177292

SEQ ID NO: 21920 - DNA, 3000 bp, Unknown; identical to SEQ ID NO: 21479
  misc_feature (1)..( 3000): 2750-1469P.txt file - cDNA_ID_2037800; gDNA_ID_1971953; Annot_ID_177398

SEQ ID NO: 21921 - DNA, 3003 bp, Unknown
  misc_feature (1)..( 3003): 2750-1469P.txt file - cDNA_ID_2037860; gDNA_ID_2684231; Annot_ID_192278
ggacctatgaactgctcttttccttatttggtaatgtaaatgcaccatatgaagagggcaacatgttgtcccaagtagactgttgtaaaaggattaacgctatagaaatggacatgatgagaaatggttttcagcacagtcctatctcaaggctgaatgtggttagtttctgctccatatagataggtcttgacctgttttaagcagattaatcaaatgtaatattaatctggaaaatcccttttaaggcgatactatcaatctttacttcttcattgtgtatgtttgtgttatatatcagaacaatggacttatcgtttacactttcctttttctttcccagcttagagctctcggagctgaaggtatggtgaatgagatgatccgacacctgcaaaaggctgagaacctcagtgctcacagcaatatgtatctaggaacgcctacatacaacatagtgcttcattcacttctcgaggcaaacgaagtaagttttcatggtctaatagctttatcaaatttccactggaccagcatatatagcaatattgatcgctacttaaattacatgcagactgacatggtgatcaatatattcaaacgtatgaaatcatgtggctgccctgcagacgttgctacctacaatataatgattgattgttgcagccttattcactcgtataaatcagcttgtgccctagtttccatgatgatccgtgacgggttttctccaaaagctgttacatttactgctctgatgaaggtaataacaaagtatctgattacaattttaaaagtttgctgccattgtttctcaagaacttgctacaagtaagtattcagttcaggatgaaagaattctacacacagtacagacacataccaaattttcttgaaccatcgctcacgctcagaacttccaattttttttttggaatctagcagcttattgctgttcatttaattttaattaactaaagctgtgtatcctcttagattttgttgaatgatgcgaatttcgaggaggcactcaatctcttggaccaagcggcattagaagagatacatcttgatgtcttatcatacaacaccattttgcgtaaagcgtttgagaaggtaaagatatttgttgtaaaaacgcttaaagtaatgaaagtgaataaactgctttagtatacacataacttttgtctgcagggaatgattgatgtgattgagtacatagtggagcaaatgcaccgagagaaagtgaatccagatccaacgacatgtcattatgttttcagttgttatgtggagaaagggtatcatgcaacagctatagaagctttgaatgttctgagcttaaggatgctcaacgaagaagacaaggagagtcttcaggacaagaaaatagagctagaggaaaatttcgtcatgagcgaagaccctgaagctgaaacaaagataatcgaactgttcagaaaatctgaggagcatcttgctgcagcacttctgaatctaagatggtgtgcaatgctcgggggccggataatatggtcggaagaccaaagcccctgggccagagcactctccaacaagtacggttaataggtagaatgggaagtgttttcctgaataagagctggtgttgattatctgccatttcactaagctgctccgttttggttttgtatcctatacaaactagttagtgacaacacagttttggaggtcaccaatcgattcggttagatgagacggatcaacaatacggttagaagcatttttaagcggctacgaaccacctaaatacaaggcgacttgcgaaccatcaaatgcgagttttgttatttactttagattcttactgtaacttttgtttatttttacctttcaacaactgtgtatcaaagaattagccaaagatattccaattgcacctggttatacaaagttataagtatgttttctgaatatggatttaaccacttttgaaataaaggtaacaagtgcaatgcatatgatattgaaacttgatcacttgaaacaaagaagagaatatttactgagaaaacataaaggacagatggaaacgacagaaacaaacttaataatgttacaacttgctcctgtttttcttttgtagtttactcatccaaatacaaatcactgtccatagatagaggaccaatcctttacttagctgatttcaaaccatagaataccaaatttctaactaaagtatattgtacaacaatgcaaaacaaaaaataatgatactttcctaaattttaaataaataaaaagaagaagatattttctcttttaaccaaaatgatttatgtttgttacttaattacattactcactaactattatcttttacttaataactgaggccaattctcttcttctttgtcaactattagggacatttgttttttttttggccgacttggggacatatatctttgagtgttatatgtatgtgtattccattgattcatataaaggccctgataataatgtttttatcaatgtgataacaactaaagttaggcaaatatgagtttaaccgaattacgtataagctaatactcaatttaagactagtaaaaaaaatcaatgctgccgactgccgtcattaaagattttgatattaatctttgctttattttaccctaaatgtataatgtaagctaatatatatcaaataattgttagtcaaaagtcatcaaaattaacagatttttattaaacagattgtaataagatggaaacctctctataagaagtgctcaaaaacaaaggaactcaatttctctctctctctgatgattttgtttgtttgaagaaaagagaatattgttgtttgtctctcgtgatcgaaacaatgctttgtgattctcaaatacagtaacattttcaacatgctttgattccaaaaatccaaactttcattctctctctcaatctctctatatctccgagcagcgaggtagttgcacggcggccgccatg

SEQ ID NO: 21922 - DNA, 3000 bp, Unknown; identical to SEQ ID NO: 9570
  misc_feature (1)..( 3000): 2750-1469P.txt file - cDNA_ID_2037860; gDNA_ID_1972155; Annot_ID_179466

SEQ ID NO: 21923 - DNA, 3003 bp, Unknown
  misc_feature (1)..( 3003): 2750-1469P.txt file - cDNA_ID_2038322; gDNA_ID_2936586; Annot_ID_195118
caacattcatatgtggctcttagtcgacgaatatgtatgcgtcggctaatttggaaaatctgatagcggcatcccaataactatactcgtaatttagcaagatgattacatgcataaccactctgacttataagagcgagacatgtatatagtgtagagtgtacatacgtaagcaaacatcaatcaattttgtcttgattggtgatggtatattcattttttatgtagcatctctagatgctttcggataaaggtgatatgaatatgtttacaagaaagagaaagaaaatgatatatttctgaataatgtttttttggataaatcctcaataatgttgtttcgaatctatgatctctacaatattattaaacatatatacctacaaatttagcatctatacgggtaagacgaccattcatatatataagggatcatgaagacaacacaaataagacatccacaaataaattaataagccaacttggtcttaaaaatcaggcatcttattcttaacaaactttagctgatcgattagtatttgcactaaccaaagaaataataatttagtttactaacataattgcatatatatatatattatacaattagtagagtggctataaagcatgccacatgcacattctttaatggacagacatttgaatattgaagagtttatcgtaaactaaatgtcatttgaaaactgctaaaggtcttttattttatatactcacataatcacatcaagaatatgacttattatattcatcgtttttggtcgataataatgattctttacaataaggacatgttgagcatgtttataacttatttaatttgactcgttgaattgttattattttgttaatatgcttagattccacatctaaaataatatctaatgcagatcatatgtaatgcacattaaaggttttacctccgataatttaatattccaattaattaatatgcaatggcagtgtaactaacggcagccgttagttaatggagtcggttgcttgcttagtttttgttctcgaagcttgacttttgaaacagaatgctgtttaacctccttaaacggaatattctcttttttagtactttgattctattcctctatataaacctctctctctctcacgaatcagagatacgaagaaactaacaacaacaagaaaaaaggaatattccgatgaccagagaattcgaactggaaaacaactaccagctttgcgacgagatcggcagaggtagattcggaacaatcactcgctgtttctcacccgcgactaaagaattctacgcctgcaaaaccattgacaagcgcgtgctcatcgacgcattagatcgcgagtgtatagagacggagccgaggatcatggcgatgttaccgccgcatccgaatatcatcaggatcttcgatctctacgaaacagaggattctcttgcgatcgtcatggaattagtcgatccgccgatgacgatttacgatcggttaatctccgccggggggaggttatcagaatcagaatccgcctcatacgcgaaacagatcctcagtgcgcttgctcattgtcaccggtgcgacgtcgttcatcgggatgtgaaacctgacaacgtcttagtcgatctcgtaagcggcggtgttaagctctgtgatttcggatcagcggtgtggttaggcggagaaacggcggagggagttgtgggaacaccgtattacgtggcgccggaggtagtgatggggaggaagtacgacgagaaggttgatatatggagcgctggtgtagtgatatacacgatgctagctggagaaccgccgtttaacggtgagacggcggaagatatatttgaatcgatattgagagggaatttgaggtttccgccgaagaagtttgggtctgtatcatcggaagcgaaggatttgttgaggaaaatgatatgtcgtgatgtttctcggcgattttctgcagaggatgctcttcgtaagtcatcttttttttctcgattttttttttttttttgagtttgctcatcaatttgtaatggtgaattgcaggacattcatggatgatgaacgttggaaacctccaaagcaattagtcgaagcttttcagatatgtgattagagagtgtaattagagaagtcgtaatatagatgtgagtgtgtaattgtttgattcgaatagtcaaacgtagttgtgtgtttcagcaatcttcctacgttttgtcactagagaaagtatgttgaaaactttttgtaacgattcgccagattcagaataaaattgattttgagatcattgttgagagttaggtcaaaatctgaattcgattatttgctccccaagaaacaaaaagaaaagattactatggttggtaaatctgggccagtagaagggatctttcggaaattgggcctaactgatgaagtttagatattttgggctagatttgtcgaattttggggcccgtttcaggctaattatgatttgttcgagaaaaaaaaggtttcgaagtcaatgcaaaggcaaatggagttcaattattctccagacctggttttcacattaactaatactcaagtaattcgtctagactctaatgtatactagggtttttaaactaaaagggacatttcgtttttaaaaacagccgtggactgatttactaaataattcttttctatataaaaatatcttatagccaaaataaaatattattagtatatatgtgaaagaatatccaccaatgttaagaaacaaatctttttttaagtcaaaataaaatatggttggtatattgatatatggaagatacatcaatggtgagaaagagaaatgtcaaccttgaacctaaatgttctataaattcatcttttacttacaatccagaaaatcacaacatcttttttgaatagattttatagctgatacaacgagcaagagaaaatggccatcacaaagacttcagtgactcttttacttttaataataatg

SEQ ID NO: 21924 - DNA, 1705 bp, Unknown; identical to SEQ ID NO: 9363
  misc_feature (1)..( 1705): 2750-1469P.txt file - cDNA_ID_2038322; gDNA_ID_1972105; Annot_ID_178687

SEQ ID NO: 21925 - DNA, 3003 bp, Unknown; identical to SEQ ID NO: 21923
  misc_feature (1)..( 3003): 2750-1469P.txt file - cDNA_ID_2038322; gDNA_ID_2936586; Annot_ID_143873

SEQ ID NO: 21926 - DNA, 3000 bp, Unknown; identical to SEQ ID NO: 9147
  misc_feature (1)..( 3000): 2750-1469P.txt file - cDNA_ID_2038391; gDNA_ID_1972013; Annot_ID_177858

SEQ ID NO: 21927 - DNA, 3003 bp, Unknown
  misc_feature (1)..( 3003): 2750-1469P.txt file - cDNA_ID_2038414; gDNA_ID_1972013; Annot_ID_177847
aacaacgaaggaaaggaaaacgagtcgtcgtgcggttaggaaaccggcgacgagggtttttggtggggccaccgcggatggttatgcagagatggaggatgaacatgggaaagccgatgaagatgatgagaagtatcattttggggatactctcaaatggtggaaatgttaagttcttagatgcttacctttggtctttaccaatcttacgtcctcacttgtttccactgtgttgatttttgtaataccaatttctacttgtgagactgtaatatttatttatcttgttcttattttttttgtgtgaatcaaaataatcggcttcataataaatctttattcttgctagcttcttctttaagagtcgaggttaatgaaaacaactagttttgagtttttttttttgtgtgtcatggattactaatttactaccaacaacaaagtaaatattatgctagtgaaagaaaaagaaaaaaatgatgcatgaattcttaaattttgacaatattaaacatgaaattgaccaaatatttcatttttctcaaaaataagaattttagtttgtgtatatatagaatttagttaacaattatgtataacaacaaaaatgctaaaaatctatataaaagttactattagtttaaaaaaaaaaatagtattagttatttaaaagttattacttattagtgtttatttacaaatagtattaatgatttaaaaggatgaaagatataattcttattaaaggacgaaaataataattttggacagatttgggttttatatctgaaagactcaaaaacctatcgtcatttatcttcaacaggcggaataacggagatggccgccattacagctctcactctccgctctcctgtttatctcccatcatctgccacaagccctagattccatggcttcaccaatcaaccaccaccagctcgtctcttctttcctcttaaccccttcccttctctatcaatccaaaaccctaaatccatccgaatttccgcatccgcttcgccgataacaacaccaatcctccagacggagaagtcaacagctcggtcatcgacactcaccgggtccactcggtctctcgctactctcgcggctttagcaatcgctgtaaccagagtcctagctcagaaactctctctcgcaatccagacttcaagtcccgtaatcgccgacgggttacgattctctctcagtaccgccggacctgtcttcttcgcgtctctccgggatcgtcctccgggatacttgaacacgccgctgacggttgttgcggtggggataaagaagtggctagacatttacagtggggtattgatggttagggttttgctgagttggttccctaatatcccttgggaaagacagcctttgtctgccattagagatctctgtgatccttacttgaatctcttcagaaacatcattcctcctatcttcgatacgcttgatgttagtccattgcttgctttcgcggttcttggtacacttggatcgattgttcatggcagcactgggtagaaattggaagacttgagctaatggttttgttgaaacgttcaattgggaaatttctgcaacttgtttcccaagattagggaaaaatcagaatttgatgctgtgttggatgctcgatgagagttgtgagctttatcgtttttgttgttctctttttgactttgattctgaataatgagattttgggttgttgtttatctcctaattacatgttcagactaccgtttattgatggattatctgcgttctctcaactgttgacattgattaagaaccagaaagttaagtattgtagaagaataggcatgttgtgttatctgcattatttttagattttcgatatctagtttaatatgtagtagaatttatcatttgtatctaatccagatgatgacatgtatgtgaatctggcatgagatttgaggtgtttggagataagttcagtatttgcgtgtaacaccttgtcctaggccgagaacatggtgttctttaatgttacttcttcttcttcgttggttaataaaatgtttagtgtggatagaattggtatagagttttgagtagagttcagagtcttattgtttaggcaaaagcaagttcaaggtttcattgaaactccaagggaataagtaatcttaagttcaaggtttcaatgacactgtttctcgaggaaagaaagaaagaaatcagactctttggagtttcaataaaaggtcaatgaaagaaagaaagaaactagaagtttgaattggatcacaccatttgccaattcaattataaaattatgtacgatctgacaaaatcaaactcgttgaactctaacatgaccaaaatctccccaaatccaaataccgtaatcagacatggtcatcatacaatgcgaaaaaaatagtacaaccgagttagattcaatttcggttcataaccggtttagaaaccgtaatcggacaatggacatggtctcatcacagtgcagttaatctttgaactacaatcttacaaaatcacacaagttcgttaagttctaaccagacccggcccaattgggtagggcaaggtgcaagtgtataaggctcatttcctttttaaaaacaattcatataagacccaatattttttaaaaatacagtaaagatccaattttgtttttattatgaatctagagcccaaaacaattaaaactgtaacataatgaaaagtccaaagcaaaaaaacacaagttttttccctaatacttttatatttattgggccggggctggctctatcatgactaaactcaacctcaaatccagaaatcgtaaccagacatgaaatcacaagagaattaggaaaaccgagtaacgttcaatttcggttcataactggtttagaaagcagctctggtataggtcgttttagcttcccgacttcacttctaatctcagactctgcgacgctctttacaaaccgccggaaaaccgccatg

SEQ ID NO: 21928 - DNA, 3000 bp, Unknown; identical to SEQ ID NO: 9149
  misc_feature (1)..( 3000): 2750-1469P.txt file - cDNA_ID_2038459; gDNA_ID_1972013; Annot_ID_177829

SEQ ID NO: 21929 - DNA, 3003 bp, Unknown; identical to SEQ ID NO: 18613
  misc_feature (1)..( 3003): 2750-1469P.txt file - cDNA_ID_2038467; gDNA_ID_2926128; Annot_ID_196777

SEQ ID NO: 21930 - DNA, 3003 bp, Unknown; identical to SEQ ID NO: 18613
  misc_feature (1)..( 3003): 2750-1469P.txt file - cDNA_ID_2038467; gDNA_ID_1972020; Annot_ID_178050

SEQ ID NO: 21931 - DNA, 3003 bp, Unknown; identical to SEQ ID NO: 18611
  misc_feature (1)..( 3003): 2750-1469P.txt file - cDNA_ID_2038493; gDNA_ID_2926128; Annot_ID_196770

SEQ ID NO: 21932 - DNA, 3003 bp, Unknown; identical to SEQ ID NO: 18611
  misc_feature (1)..( 3003): 2750-1469P.txt file - cDNA_ID_2038493; gDNA_ID_1972020; Annot_ID_178041

SEQ ID NO: 21933 - DNA, 3000 bp, Unknown; identical to SEQ ID NO: 7690
  misc_feature (1)..( 3000): 2750-1469P.txt file - cDNA_ID_2038493; gDNA_ID_1621157; Annot_ID_173562

SEQ ID NO: 21934 - DNA, 3000 bp, Unknown; identical to SEQ ID NO: 9187
  misc_feature (1)..( 3000): 2750-1469P.txt file - cDNA_ID_2038545; gDNA_ID_1972020; Annot_ID_178022

SEQ ID NO: 21935 - DNA, 3003 bp, Unknown
  misc_feature (1)..( 3003): 2750-1469P.txt file - cDNA_ID_2038555; gDNA_ID_2926128; Annot_ID_196752
ggttatacataacaatattgatattaaccattcaacttcttctacgtgaggaagatatctgttgaaaatcacactttcactctcaaactacctcttccaacattcttttgaggtcagcactctcactctcttgtcactctgttttgcttttgttttctttagagagaaacaagaacacgtttaagagcatgatgtcttgataataaaacttgggtgattctcttacaagatacaaacacacatacttattatagttttacttgaaacacttacacacacaagcatgctcttaaacgcataattaactctgatttcttgcaagctactctactacatattgggactctaacaacaagcatgctcataaacacaatttatgtttctttttatttcctcacctactttgcagtttcaagatgcagaatctcttaatttttttattatagacataataacttctgtgaaagattgtaactaaatgtatatgttttattttggttgcatttggtacttgagaaagaggaactagtgtcaccagaataactcaaactgcacgtaattatcataaacaataaatatacaatttacaaacatcatttcagaatccattttgtttaatgaggttgaacctatcaccatataagctatttagaactcttgttgaatatgtttgtgaatccattctattgtgtgtttctttgttttgtaataactctggtcatgagttttgagtagagagacattaaaaaaagaagcacatttacaaaatcctaaaagttcattacaaccatcgaccaaaaggtttgttagacaacttatcttaatcttgttatagctaattctcacacgagaatccaaaagactaaaaatccataaacgtagatagaaagataaaccctaagatagataacaaaagagggcattacatccttagattaaccctatacaatccctaagatagcttcttcttcttcttcttcttagttggtttgagcaagcaccgaagtcacatccttcaaaacatccatctccgccaacaacaactcacatttcttagcgtccacaaccttcatcttctcttgaatcttcttcttagtctccagagacaccttgctccacttcttcttcacagaatactcatccaaaccgagattcgcgataaccggaacaagaaaagactcctcaaaccactccgaatctgctccaagaatcacttgctcatcttctataaccaaaggtttctccaccttcttctccttgctattagccttacccttaacaagaatagattcatctttcttcacaggagattcaacgttcataccatcagatccccaaatcaaaacagccaaacccaaacatttcttatcatgattcgattcaccacttttgttcttccggttaacaaaatacttattctttaatcttctaatcttgtcaaagaactggacatgactaacatcaaagcttatagatttcttggcgatatcaaaaaacgcattcttatgatcccaaggacttgtacctgtctcagctttgaaatcaatcactgcctgtagaagagagatctcatcttcttcactccatactctctgaggattcgcctttttgttatcgtcctctttcttaactcttttgacatgcatgtcccttgaggtgcttccttcaccagctcgcttcttccctgacttcaccgccggtgattcagcagcaccttctttcttcttccgcctggttaagacgaatgactgcttctctgagtcatcagaagaatctgtcttagaattcacagcggcggaaggagattttagggttttagaggaaggaactgtgacaggatctttgggtttgctttcttcagaagaagacttaaagatctcttcagaagaactctcaacttcgcttgaagaagcggttgctggactttccaaaggagccattggattttcttctttcagattctcgggtatgagtaccaagtgggaactgaagggacaattttagggtttgtgagttgcgagactttttatttttttacactgtaacatctcttatatttaagaaacaattaaagtaaataaagctcaacaacaaaaactaattaagcccaacaaaataaataaaccatcatccttatatgtaacactgtaacatgggaaaaaaaaacaattttttgcccaaatgtataagaaatttgtataacaaaattcatactagattttcttgttgtaattcttggtatacaaaatgaaaggtttctttgttgtaaaacaaaaatatatgtactaaaagtaattttacaaagtcgctttatatttttacatttagaaagatcatttgatcaagtgggaaacctttattgaaattaacaaagtggaaaagattgtaagtagtgaaatttagtgtcatctatagacaaaaaaaatgtaaattagaatttaggaatatgaattcggttaggattagtcgattaggtttattgagtaaactcaataaaaattactgtagtaatacttcagtactcggttcggtttatagttaccgaactgaaaccaaacgattattctaatttaattgaagttaccaatttttatcttaagtttaattaaaattattgaaaaatatgaactctctcttacagtaaaccgacctgaaattggtttttggttccaatttgacaccaatattttatcttgaaccaaatcgaaatttatgctattaaaattgaaccgagccgaactttactttcggtctacttcggttcaagaaatttcaatccaatacatatgaattctgaaagtcctgaaccgaaccagagtgtttaaccacaataaaagtctcttcaatggtctcttcttgagtatatcaatggtctctcatagtttcaacaacaccaataaactgtcatcttcaagttggagtttattacactcgttccttcaagaaactgtaccgtcgactttcagatttagccatttaggacttctcaagattttgaaaatg

SEQ ID NO: 21936 - DNA, 3003 bp, Unknown; identical to SEQ ID NO: 21935
  misc_feature (1)..( 3003): 2750-1469P.txt file - cDNA_ID_2038555; gDNA_ID_1972020; Annot_ID_178018

SEQ ID NO: 21937 - DNA, 3000 bp, Unknown; identical to SEQ ID NO: 7704
  misc_feature (1)..( 3000): 2750-1469P.txt file - cDNA_ID_2038555; gDNA_ID_1621157; Annot_ID_173587

SEQ ID NO: 21938 - DNA, 3000 bp, Unknown; identical to SEQ ID NO: 9186
  misc_feature (1)..( 3000): 2750-1469P.txt file - cDNA_ID_2038561; gDNA_ID_1972020; Annot_ID_178015

SEQ ID NO: 21939 - DNA, 3003 bp, Unknown
  misc_feature (1)..( 3003): 2750-1469P.txt file - cDNA_ID_2038779; gDNA_ID_2214546; Annot_ID_185426
tggattgaaaagagtgataaataaagtgatgtttgtacccttctttgatagaaatggaagcaatagtaacagtcaaagcgagaatgggatgattcatatcaatgccgtgatgatgtccactatgaattacctcaggagctgcggacagtgcaatctgcaaatgagaaaggaagggagaagaactctgtaaattgaatttattatatcccaaataaaacaaacaatggaggatcgataaaagataaacatgaagtgcaatatattctcatacaatgaagcaaggttgtggaggtggagatgagtaattaaaaaagaaagagaaaggagagagtggtggtcatacagataaaaggtctaaagcatgccaggcaataccagagccagtagccaaaagcatggcagagatgccaagtgctccaagcgtttcaaatttaccatgacctgcccttgtatgcatggggaaattcagttcattgttattataatgtatttacatcaaaggaaagagaagagaaaaggtaaccataaggatgttctttgtccttgggaacatttgcagctctgtaagacactagagcaacaccacttagaacctgagatataatgatgatgatcatgtgagaaacaaaaccaaaggaaggatcatctctcgtcctcagcaaatgagaattttcattaccacatcggaaacggaatgagcagcatcggcgataatggcggtgctgccgcagagataaccggtgagagcttttgcgacagataaacctatatctgcggtgagacctagccggaatatcttctccccttcttctccaggcttttgatattgctggtgatgatcagggtgaccaaaatgccaccttctggagaaatcgaaactaggtttttgcgatgaagaagaagatactcggagtggtgatgatgatgatgatgatgatggcagataacggcaagacatataatatatagtagacctacaaatcctcgtcggattcaggatttgaaatctgataatacccattttgatttcagctgagaaaccctctctccctcttttctccgatcagtttcccaaattgacttctcattcattgcgcggtaagatagacggcgctcatttttttaccgtttacttagttaccttttcaccgacgattgtaaaattatactcagtcaatgatagcttcattaaaggccccccatactgttctttcatattgggccaaatcaaatgttgggagtataacaaaaaatattttttttaaaacggtaatggttaattaacaacactgattgatttggtctctcttataaaccagaaataaccgattctagaatcgaaaacccgaacactgagtgaggtagatattggccggaattagagttgtctaccggcggcatcagcgacaaatggaatgtatggagttttgccgagtaaggagctgacgactccatacacaaaacacataaagctgaagacgaaaacccccgtgtgcccccacatcatcgccttcattccaaacccgcctccttgacccggatccagtattcgggtcagcagcaccggaaccgccaggagcacatccagcgtcaccgcctgcatcgcgttgaacctcacgtacctactgaaactcgtgttcctcaccactcccaggtacagcccgaagaatgccacgaagctcgcgtacggcaccgatctgtacaggttcaggattgggaagattggctcgaacagcaatcccagccttgggtactgcgcgaacaggaaccgcccgtactgcagagaattgaagaacggcagcgcgtacgacgctatcgaaatcacgcgctcagtcgccggcgtcggggtgtaggaggcgcgggtcgtcaaggcggttgcgcgtctgctagaggggcggatcgagaaggttgaggatccggggaaggagaggctgagtggtctgcatctgggagccgacaggggattagttagggtttggtggagagaaaggcacagagacgccattcttttatttttttgtttgggattttcgctgtttagtcggcagtgtcgatttgttgacaagaagagcaaaaaaaagtaacagctcaaacgctgccgttttcgaatctaaaatttggcccgcgcacactaacaacataattgggccgacttagctatataaatgggcctatatatggtactagagggcttcgtgaacaacagaaggtttttgtggcgccgacaaatgggaagcggaaacgaagaaatgtgatggcattgattgaaggcgagtcgagtcgagtcagactcggtcagagcgagttgagagagcagttaagaaacagtagcaggtagaaatgacggatgtgtccccactttcggaccagaccactttactccccgagttagcaagtgaagtgagaaaactgtctgtgtgtcacatgttggccactcgcgcgctatccccgcccaaggaccttaccgtcattttggttggaaactagtaaaaattagtttatttattttttgtttgttgttttgtcaagtagtatatttcttggaaatatcttcccttttctgggatgcttttacttggcgacccaaggaccaagagagaaccaaaaataaatctcacaaaacaaattaatacaaactactactatatactattattatttaaaaaagaatatgagaaaaagaaattgaaagctaaaaaaagaaacagtagtgcagagggcagaccgtacggtattcctgaagagcgaaagaagagagagagagagagagagaccgaccaaagaagaagctcctctcaatcactgtcgaagcatctcttcttcttcttcttctttttttcttctctctcagagcttttctaatcggcttctccggtaaatctctgtcgatccaccgatgagcttttgacatttactctcttattagtttcttctagtttggtgagaggagtttttactagtatcttttttactgtacaccaaatccctaaatttaaggacatg

SEQ ID NO: 21940 - DNA, 3000 bp, Unknown; identical to SEQ ID NO: 8334
  misc_feature (1)..( 3000): 2750-1469P.txt file - cDNA_ID_2038840; gDNA_ID_1971748; Annot_ID_175257

SEQ ID NO: 21941 - DNA, 3000 bp, Unknown; identical to SEQ ID NO: 8334
  misc_feature (1)..( 3000): 2750-1469P.txt file - cDNA_ID_2038840; gDNA_ID_2926195; Annot_ID_141255

SEQ ID NO: 21942 - DNA, 3000 bp, Unknown; identical to SEQ ID NO: 8334
  misc_feature (1)..( 3000): 2750-1469P.txt file - cDNA_ID_2038840; gDNA_ID_2926195; Annot_ID_201403

SEQ ID NO: 21943 - DNA, 3000 bp, Unknown
  misc_feature (1)..( 3000): 2750-1469P.txt file - cDNA_ID_2038893; gDNA_ID_1971748; Annot_ID_175239
tttccgcctttttgtgattggataattattgaaaaaattaagaagatttcacttacattgttgtcaatattttttaaaaaaacataaaatcagattaaacataacttatagaggtaagttttaaataattgtgttgctgtagttaaaaacttaattttctgaatcagtatgaataaaactttgagagttcctcatcatttcttaaatttcttaattcttataatgatgatgatgaatagttaaaaaaaaacaaatgtccgaatatttgatattaacattattcataatttttctggatgattttaacattttacaatgataacctattgtatacaatggacggatctatagatcacaatgaccgacaacttaacatacagtaataatccgcaacacaaagatcatgttagaagggtcaacttgcagcaagaacctccaaaaaaactaacctttaatgtgtgggaaaaattgtatagtctgggaattgaagacgttaccttatgtacgagcactaacctttaatgtgtggaaaaaattgtccacttcgaatcgtatatacaattgcatcgaaatcacgaagagttagtaagacaacattgtaaccgctataaattcagggccaatctctttcttctatcttgcacataatctttgtgttgtggatgacgttttctcgtagcagctcgatctccttcttcatcctcactttttattcgctgtcataattaatcctacgatctcttcacacgtctcatccttcatcaagctccagagctccgacgaatctcgctcttccgtcgcttcctactgcgagggctggagattgaccgccgagaccaacaatgccggaacctgtagggtggttccgtctcaatgcgaaaactacgttaaaaactatatcaaaagcggccagttcgacaaaaattacgatgtactcgctagttacgccatacggtaaaacgatcaatcttgccggaaacggtaaggacgtgttatacgatgaaacttttctcgaatcttgagtactacaaggctcatggttacggataattcccatgcacactctattattagccttaatttggattttgtgttattatatctaacgttcataatgattgtttgactaacttcgttaaccatcaaaccgggagatttgcgcattcagatctggtttctcggttcaagatttttggtggcggactaatcggtttttgagtaatttgttaaccatgacttaggagagtgaaaaacaatgtcgagaagccatttttaccaaatgagaataaatacctcattctagttaattaagaaaaatttacatgtaatttatattacaaaatacaaatcaatcacaatggcctctcctcacgtccttccgatttttgtatgcatgtgagtatttatttctaattttcagtggtctgtatgaattaccatctttaaaaatacccatagaattcaaattaaccttttcatgataaatatatataatttgaaattttcctaaaagctaaggacatacatactaacaaaattagggggtagtgttaattaatctataaatatggtgatgaataggatagaaaacagtcaaacacaatagttttgctagctacagtgtgataagagaatcatgggataatattaattaatctagtattatttgtttgaactttgaatacattttttaagtatggaaatggatagagatacacatgaaaaaaaaaaaaaatctatgtattaagttaactgctatagttttaagttttaacactttgagaaggtgcatatagtaatcaatgtagtcaagtcaacactacatttttcaacatttatttacttactttttacttttatttctgcttagatgtttttattatgtgaataataaagaaaagtcatgtatacctcgatatatattaacacaagcattacataacaataaagcaaagaaaatagcttttcatttttcatctctaatttacaaaacattagtattctgttgttgtgaattgtgatatatttgatcatggccaacatatcatggtctcattttcttatactcatgcttgtgttctcaggtaatttcatgtttcccacttccaaacatcaaaaagtagttttcatctttacattacattacacatctaagcgtgtacacatatacactatattgtttcacatcataacatatggtattttactttttaatattttcagtggttaagaagggtaagggagatcagactgataagtattgtactataatcattgatccaagaactccatgtgaccttgttgattgtcgcctaagctgctatacggggtacaatggagttgggaaatgtattgcatccaaagctagtagaactcctaattgtgtgtgtacttataattgttaaagtggcaaattctaaataataatgttttataattaagaaaatattttccataataatctatatgaataaataaaattggaagttcttcagcccttcttgtaattgaatatttaatggaaacattgaggtgatgatttcagccaccttattgttaattttcaaaattataaaattaatcaaacatatatagtaatgattggaaactttatagagataattttttaccaactctcaaaactatataaagatgcaaaaagagggagcttataacctaaccactaatgaatacattgctttgccatgttcaaaaacgctgccaaagtgaccgcatctgattagcgtcgtcatagcgcgtgtaatgacaatttgaacaataattcattaaaatatggttatagtataatttttggaaatgttttgatttacctctattattaccaaatcaaattcagccagtgaagacgttgtagttctcaacaaaaatcacgtgggagtgtaaatacgacaataatgttccatctttctatattttaaattcgcgacctatcttcttctttcatccaatagttgaaaaacagaaaaagcctctccaatg

SEQ ID NO: 21944 - DNA, 3000 bp, Unknown; identical to SEQ ID NO: 21943
  misc_feature (1)..( 3000): 2750-1469P.txt file - cDNA_ID_2038893; gDNA_ID_2926195; Annot_ID_141243

SEQ ID NO: 21945 - DNA, 3000 bp, Unknown; identical to SEQ ID NO: 21943
  misc_feature (1)..( 3000): 2750-1469P.txt file - cDNA_ID_2038893; gDNA_ID_2926195; Annot_ID_201389

SEQ ID NO: 21946 - DNA, 3003 bp, Unknown
  misc_feature (1)..( 3003): 2750-1469P.txt file - cDNA_ID_2038917; gDNA_ID_1971748; Annot_ID_175228
ttcacttcaagtggtacagagtctttttttttttttttttttttttgttaaaccttgctttcattcaatggaacatagaacaattacaagaaatagagtttaagaactcaaagattaaagcattacaacaaacggtattccccaataccataaaaagaaagataaagtgcatcgatttgaattccatgagagctttgaggcataagcaaagaagcacagtgcaacatgtgaggtcacagtaaatcgaaggatcatcctcgaaatagtcgaaggacaacaggttggtcacggtcaagggacgtagtgacgttgacaaagacatcgaagctatagatctcaccggggctagctgcaatacccacggaaaaaggatagcaaggattcgaaggactatggttctatagtcggttaaggttagctttaggatccaacacaaaaggcaaacaaatctccgatcaatagcggcatacactatgagacaatgaaacatgatgatggacatagtgatgagcttgaaggcgatagatgagctacttggtgaccattgagcgatgaaaacccataattcaaagccacatttgacacaaaggcaagtacaattcagaaaaattagagagaaggtcttcaagactttggaatgaggccacacattcctagatatagctaaaaccaggattcgcaaatgataaatgaagaaccaaaacctccatggtgatatctctatcaaatggtgtccatggccattgataagaggagatcgacacaaaaagattaatgggcctaacatagaattaaagaaatcagatctgagaataaaagccttacaagttctaaaacaacagatgggcttgggcctgaaaggaagaaatgggccagcgaaagaaactaggtccactggggaaaaccctagtttcatgtcgaggtgccaaaacgctgaggtagagcggcggctgtccaagaaaggcgagatgatttgcagcgcaggagtcatctccgatgagtgaaagatcgttggaagcagactatgaccatggctcaagtaggtggcaaagatccagggggtcgcatccttttctacatgggatagctccgagcacgaatctgtccaaagagctgcagcagaggaatgggagaaggagagagcatgttgcttcaaccttccttccttgatttgtgttgaagagcgtcctggtagagatgcaaggtgaggtagattggttaacaagttatgggctggaataacaaggggaataacaagaggggaaaggatgggaaaaagcttcaaaaggggaaaaataaagaaggaaactaaggtaacgaaatagcgacgaaaagaagagaagttggggtcccgatgccggtgaacagaggcttcaccggcgccggaaagagtagtcgatgagagagcttcgataatcggacctgaaagagaaatagtttttactttagttagttttgtggtacagagtctctgaattggaattgacgttttagatatacaatggtatccatatatatatataccaaattaccaatggtataataccatcataaattcattatcacatcacttttattttagtgaatgaagatgtaaatatgctattatgaaaaaaatttgatggaaaacaaaatcattgatataattgttttcactcgtacttaggaagactccctaatagtaaagcaaagttagacgatattgttttcgtctttggacacgaaatattttgaaaaccttccgacataaattaacggtgaaggccttttaaaagttttgtcgttaaaaatatgatttgacaaatcgacttagttagtgggtttctggagatgtgtactatcatggaaaagaacgagaaagatttttttttttaaaagttgatgtgattgggcccaattagaaaagttttcggtccatacaaaagcctagtaaggttgtgttaactagatcattattaaaaatatttttggttgattagtattattattaattggccgattgactgaaaaataatctgatatggttttgccatcttttttgaaataatcgttaaatcattttataaaactatccacatgtaaaacaatgcatgaatatatacagttgttaatcgtctaatattgttagtttattttgataattgaattgtactattcttgcagctgtttgaatggttagatgttgaatcttacctggtacacaaatcattactggttagagcacagaaatcatatatggaccggcacaacattgaaataagaaccatcttctctaatcaggtaactaaaaaggaggtcacgaaacctcaacgaagatgtgaacgcaaactaactctctcgtcacaactcttaaactcagtctctcgtcagtcgtcacaactctcaaggttttgttttagatttatatgtatgtaatacatgaatcttttgtttttgaacttatgtatacatgaatctaaaacgtgcatttttctaatctaatcaatatcttacctcctttttccaaatatttaatcgacatagtccaaaaactgtatgttcatccataattaataacaacaataggtcttgtaaaacccctttagtatgttgtaaaacctagcaaatctactagatcgcatctaacatatctgtttatcaaatttaacatgtgtaattatctagatttaaaagaatctctctcattttctaaaaaacaaattttatttttctttaacagacttttattttctaaacatcagatttaaattgtatttttaattatcttgatgctatatattgggaaccacgatactaacagactttcgttgtcgcatgtaaaatgttttttttttgtaatcagacttccaaccaccaacttagaaaagtatctataaaacagagaccaatcaagaatacacttatctcttttcttaaaagaatcttttttttttttttacttcattgactctttttctctatctctctagatcgaaagggaaaaggagatagagattgaagatg

SEQ ID NO: 21947 - DNA, 3003 bp, Unknown
  misc_feature (1)..( 3003): 2750-1469P.txt file - cDNA_ID_2038936; gDNA_ID_1971751; Annot_ID_175323
aattagtaattttcttcgaattagatgttgtttctccgtcgaatcgccgtcgtcttctttgtcttcacctctttctccgccgctcagaactccacgtgtcctctggacttttccgtccttgaaccgttccggcgtccgaaacccgatggcgccaccacctgccagtacctcctccaagggctacgcctcctctactctcaccatctccgtcagacgggttcctttctcccgccacctgagtctgctgcttcttgctgggctgctctccagtcttccgtcgccggtttcctccctcgctttgacgtccgatccacctgcggtttccagacgccgtggatttcgcaggggtgcatggacatcaccaccaggtctcaattcgaatcccttatccctaactcctccctcgccaccaccgccatgcgctgtaacacctctctcgagagcaataccccttgcgcctcctgcactcagagcctctccgcgtttcagccctatctctccggtccatccctcggtaatgtctccgactgtgcttcttttccctctatctacgccgctgctttcgccaattccttgggccccaccgacaaaggcaccgccaaatgcttgtttcagctcgatttggcttctcccactagctccggtgctaacaaagtcaaagttctagtttcttctttctctgttttgctcgtcgcctctgttctggttatcaccgcttggttctggtactgccggaggaagaaaagcaagcttctcaagcctcgggatactagtttagaagctggcacgcagtctagacttgattccatgagcgagagcaccactcttgtcaaattcagcttcgacgagatcaagaaagccaccaacaatttctcacgccacaacatcattggccggggaggttacgggaacgtcttcaagggcgccctgcccgacggcacccaggttgccttcaagaggttcaagaactgttctgctggaggggacgccaacttcgctcatgaggtcgaggtcatcgccagcatccgccacgtcaatctccttgccctcagaggctactgtactgcaaccacgccctatgaaggtcaccagaggatcattgtctgtgatcttgtcagtaacggtagccttcatgaccatctctttggcgacttggaggctcagcttgcctggcctcttaggcagaggatcgcccttggcatggccagaggactggcttatctacactacggcgcacaaccctccatcatccacagggatatcaaggccagcaacattctcttggacgagaggtttgaggccaaggttgcggatttcgggctggccaagttcaaccccgaaggaatgactcatatgagcacgcgggtcgcaggcactatgggatacgttgctccagagtacgcactgtacgggcaactgactgagaaaagcgacgtgtacagctttggggtggtgcttctagagcttctgagcaggagaaaggcgattgtgacagacgaggaggggcagcctgtgtcggtggcagactgggcgtggtcgctggtaagagaaggccagacattggatgtggtggaagacgggatgccagagaagggacccccagaggttctggagaagtatgtgctgatagcagtgctgtgctctcaccctcagctccacgcaaggccaacaatggatcaagtggtgaaaatgctggagagcaatgagttcactgttatagccatacctcaacggccaatccctctggtggcttgtagggaagagattgaccgctctgttagtagcagcagtggctcagggaagctcactagccccacgggatatcaggccttctcattcggaggtgatggcccctcagggaacacgaataccacttagatgagatatgtatgttgtagatattaatttagtgtgcattcatttcattctttgatgcttcttctgtcacttatgtaagtacagttgctttttccaataaactcatcttgttgtaacagctttggatgcaatattatacaggcttagaaatatatatatacacacatttcacattggtatcaaatgtcagaccacgacaaaagcttttgttggaaaaagacacgaaagatgcggaggtccatgaagatatccatgtgtgagtgtgcaacactttgattgatccgctccggtgatttctctgctaacgtcattaatcaactttgcaatgacattttggtgggtgggttatcttacattcttttcttttctttttactcaaatttttataaacaaaatctttctgaaagaagaaggaacgatcgagttacataagcaagatcgctgtatcaacagtcacgtcttttaatgttaacaagaaagataaaaaagacagatctgattcaaatggatctgcgtgagttttctgtttttcttggatgattaatgaatgattcacaagaatttcagaaaaaaaaactgagatcaaggttttgacaagaggccaaagacatcacgtgtctgtctctgtccaatccacgccagccactagcatgtgtgtgcgtattcagttttacttgtacatctttcttcttttttttttttaaatgtgaatttgcttagtgtatcttttagtatacacatagtggataagtagtttataaactcatttttgtttgaactcccccgagtgggctcaacgttgtcattagctatattctagtttaatggttatcatcagaaaatctgaaatcaaatttttggattgtaatccatggctgctcttggtaaaggacataaaacagctttcatctcttgaatggtaacaaaccccacaaaggatttcttgcctaaagggtcactcttacccataaaaagttttcacctttaattcttgtcctccgcttttccattttactcttcttgtatgtttctgtcttcttactcaacttttgcttcaggcttcgtctcttttgcaatttttgagttagccaagtgctcaagggagatacataatacctgaagatg

SEQ ID NO: 21948 - DNA, 3003 bp, Unknown; identical to SEQ ID NO: 21029
  misc_feature (1)..( 3003): 2750-1469P.txt file - cDNA_ID_2038951; gDNA_ID_1971751; Annot_ID_175298

SEQ ID NO: 21949 - DNA, 3003 bp, Unknown
  misc_feature (1)..( 3003): 2750-1469P.txt file - cDNA_ID_2038973; gDNA_ID_1971751; Annot_ID_175288
gatcaaggagacattaccgtcttggttcatctcggttcacggagaagaagatgagttgggaggtatggttccgatgctaagaggctatgctttagcctactttgcaatcctgagcagtgcatttgcctggggagtggactcctcatatcctgcatcaaaacgtcggccaagggttctgtggctgcatttggagtttatggtgagtgccttggaagggaagatatcactgggctgtgattgggcgacatggcaagcttacgtgacaggctttgtgagcctgatggtgcaatgcacgccggcttgggtgctagaggtggatgttgaagtaataaagagactaagcaaaagtctgaggcagtggaacgagcaagacttggctctggctctgctttgtgccggcggccttgggacaatgggtgcagctacagaactcattgtggagacttgccatcaacattagcttgacgtctttcaactttcttttctcgactaatctaaactgtgatcatgatcacttttgttcctgagattagctctctcttttttttttttgtttgtctatattgtatattatatttattatttagagcaacatgattcgctatgtgtcacagacactgactggggaaacaacattagattatgaaaggaaatgaagccaagatttttcagatttctttgagacatttttcaattgagctactagtactaagctacaccacggggtttaatttgtgaaatccgaaactagggagactaaatccgaatagatatagatagcctaagggattcggggctgcaacaaaatcactcccactcactgcgaagctcgactatggcggcgacgtcgctggttctgacgtgcgcatcccctctattcagcagccctcgggttatttctgctacgaagaagctgactacagagttgtcgatttctacaggtcagtttcgcggggtttaatttgtgaaatccaaaattagtttgtttcatctaaaatgatcctctgccgatgtctcagctaaattccgaagaagatgctcgggaaacaatgatgaagtgcttctagaaggaatgccaccggagtattacgatgatgttcgtctcctcatcctttttttgtctctcagtctgattttttctaagtcggttggttttttgataccaggaatggcaagctcgacagagagagaagaccaaagaactgcggcggatgcagcgggaggaagaagaagaagaggagagaaagattgaagaataccgtgaaattggcacgaggttgaaggaatttcccgagcaagacttaaggaaagccagaaagctcgtctccagcttcatcagagctgccgaggaagtcgaagaggtaaaaatcaaagtccccttccttccttatacaagcaggcaattattattattatgtataagacaatttctgtagagaattgaagaagcagccgagaaaggagaacttgacgagcttgtcctcatgatcatatggaaccggcttgaccttgctaggcgcgatgtaacatttttttccttgtgagttatgcgttttcatgatgaaatgttcccttagatcctgtgttgcttactttcaggatgagaaggacgccatcagaagtcttgatcttttgtatagaagagtcgaggtaattgtttctcttcattcttttctatgctataagatcttgagctgctgatgctttatatcaccatcttcaaacttactcatttgtcaaggaagattatcaactcgtattagtcagctttaggtgaaagtgaatccttatatcgggtgtttctctatccagacagagatcttaaaacggcaagcaagtcctgcaatgaaactgctgaatgatcttctaaatatgcatgatggctttgaagacgatgcttggctcaaggactgcagaaaacgaatggctgagaccttcccccgagaagaccccttcagcattctaatgccaccgggattcgacattgatatggtgcgtccctttttctcttttttgtttttttttattgataaaaacctctcaacagcaagaatcaatgctgtgtttgtagcatcaaggacagttgcgaccgcccattgagactgagacagacaacacccttctgagagtagactttgtaagagaagtggatgcactgctacaggaagtgaggatagaggaagacgctacaactggtagcaaaggagaagggcttgatcctgaagctatagcacttaagtttaagcaacaggagaagcaacgaaccatccgccaaattgaagccattcttgatttagccctcaacttgaagtggtaggcagttaactagaatatcaatctatacgccataataatttttttaagatagaccctagagttagattgattcaggcgtttttgtttagaaatgaatggagtctaaataataggttttggctaaaaattccaaatccaaatgttgctgactatctctctgctcatagtctccaccacaatcatctcttcctctttcaaagtatagtatggcctttacttttccggttccacgatacactccgccagtctcctaacagctcctcaaccaccgctctgtgtccagacggtggagggaggggacattgataaatttcggtctgggagctgatatggacgtgagaagcttgaccgaagaaggtagaggttaaaaaaacattttccgatgatacaagtaaaacgactgatttctggatctcagatcaaaaaaacccgtataaatgggccatgttgagccactaatgggcctcaatactatgagattttaagtgacagctctgcttcttgcatccttcaaagcataagtttgaacacccgcggttttgttttgagcggctggaatatgtaggacagaagatacaggtgaggataacgatctctcatcttaaaagatcaaaagaacggttcttttctttctttcttttttttaacccgatttttcgtcttgggatcatgcaggacatagcaatg

SEQ ID NO: 21950 - DNA, 3000 bp, Unknown; identical to SEQ ID NO: 8826
  misc_feature (1)..( 3000): 2750-1469P.txt file - cDNA_ID_2038996; gDNA_ID_1971898; Annot_ID_176930

SEQ ID NO: 21951 - DNA, 1123 bp, Unknown; identical to SEQ ID NO: 8363
  misc_feature (1)..( 1123): 2750-1469P.txt file - cDNA_ID_2039153; gDNA_ID_1971785; Annot_ID_175427

SEQ ID NO: 21952 - DNA, 3000 bp, Unknown; identical to SEQ ID NO: 9870
  misc_feature (1)..( 3000): 2750-1469P.txt file - cDNA_ID_2039230; gDNA_ID_1974092; Annot_ID_180638

SEQ ID NO: 21953 - DNA, 3003 bp, Unknown
  misc_feature (1)..( 3003): 2750-1469P.txt file - cDNA_ID_2039230; gDNA_ID_1620835; Annot_ID_169830
gagtttttaaatagatggactaatatctaactttttttataattaaaacttttatatttaaaaggtttttctattaataatttaactaagggtttttaaagtaaattggccaattcgtgaaggatatttcatttaaatccccaaaaattcatattcattatgctgtcgtacaatgaattgaaaatcgattaataagaaggtgggtaacaaaatttcctttagtttccttttatttaagaacaccactttacttctttcattattttgaccaagtttaactaggcccgtaaggagaaccataaagagaggacaagaccttgttacagcttacaaccaaaataaaggagaccacagttaaaaataaaagaggtttaaaaacacttctactaaaaaacatggttgataaaaaagttggcggtatccaattttgaaagtatgcaactaactatgcatcattcataaacaattacatatgtaacgtgtgtagtgtagacaaggtaatcgatattcgaaatgagcaaataaataaagaaattgtgattaaaaaatttttaagagttaatggaccagtctaacattatgtgccacttcatttttatatttcacatcaaaaccgaattcattttaattaattagaccgtgtccatttttataaaatattgacgggacatttcaacattgtgtatgaatgttataatattattattctcttcgttagccgaatggttcacattgacatcatagggacatacaaatattgactttttcgaagacacattacaatatatgtcgttttttgaacctcgtggccttgtcaacttataatttgcgtgtttgcgaagagataatcatcaccaaatgtatgttaaacatgtaagtaattaatattcaaaggggccagtatatcccacttaaacttatactatgtcagaaaattaattaatattattgaaggtattaaccatatcaaatattcgatcactataccatagagagatattggaaacttgtgatttcgattatttgttttagcaacaaaataatttctgtgaatgaaaagggccatgtggtgttggccgtggctcatacaaagtttaatgacaggtcactcccacctcactgttttgcctaataatttactacttaattatagtatagaatctttccgaatttttgtttgatttggagtttacatattcatcgtagttttaagatttctaaggtataaatattggtaggtgcatgcaatcagttgaactttcacatcatttcttgatcgtttgttgatttagaattaaacaggtgatcgtgagaaacgctcctaagcaaatatatagtaaatggaaatcgattaattcaaaaaaattgaagtattattattctattaccatgtttattatactatgtacttatttgattttaattttatcattgaaaacaagaaaggagaagcgacctcaatgattaacattcgtcggccgaatcaatatagagactttaaaaattaaaaaaaatggtggtggggtttgcagtctaagcttttaggttaagcctttaacatgtgattaactttccacaccaatggctctccaaaatcccggaaaagaagaaaattatttcgaaactcacttgggattctaaaaatgtgaaaactaagaataactcgctagtcacttccatgaaaaaagtagtggtaacacttaatttgaaattgaggaataacattttatttttgagaaagaatttgattgttagagtatgttattattagttttctaaataataataacatgttagaaaaatggtaatggtatgggagattttattttttattttttataatgagtaaaaatggtgagagaaatgatggtgaattgagagttgttggaggaggtggggggtccaatggcccctctttttattccttattaaaaagtaaaataaccattacatagttctgattaattttgcaattaatagaataatattaagagtaaattttacaagatgttattttgactaactttacgggtgcttcatacacaaacgtaaaagaaatctatgtacagatgaatagtatcatgcaaatctaaaaaaggttacaaaataatgtaacaagtactttatcaaaaaaaaattaacagtgaaacaaagcatgtagtgtgttatgggagactcatgtcttatccgtttcaagatccatgcaagaggaaacattggaatgtctctgtcagtgtctctactgtgaagaacattaagggacagtagtttttgtctggttcgttctcaggttctgcattgtaacaataccacacactcatcaatgtttctctttatgtaatgaatgaggatcaatcaaatagcttataagcaagcaagtgaaatctcacaataggctactgtgaaatcacaacaaaaaacaactttatctgtatcaggtttcaacagtttctttctaattgaacagaatcaaatctttatgccaatttcattctatctacaagttacaacaaagtaaatcattatcctagttatgctcacttgctcagtcattatttagctagctttctattgaagaataacaataatcaaatatcgaaaatgctatttctctgttggatcaaaggatttcagcttcaagataatgacaattgacacatttcaccattcttgatctctctttggttatatctactctaatttacatcaatttacttactttgaactgcctcactttcaaagacatgaaccaaattacagaaacggcgatgcaactataaaatttggaatacatgtggaatttggaatgagattattcgtttttatttcattttcttgaaataaaacactatatgccaaaatcaaacgtgggacctccttatgacacgtggaatttatgtgattcagacaaaagtaatcctagaagtctctgccattagaaccaatctcaagagataaggaaacttcacaaccaaaaacaagaacaacagacacatagagatg

SEQ ID NO: 21954 - DNA, 3003 bp, Unknown
  misc_feature (1)..( 3003): 2750-1469P.txt file - cDNA_ID_2039305; gDNA_ID_1620835; Annot_ID_57969
taataattgaaatccaatatataaaattcatgaatcaacaaaagcaaaattaaagagaaaagtaaacgtgaatagattgagagagagaaggacagatgaaggtgggtgtcggccgaaccacggacaccggtcggagtctcaagacaaaggaaggtttgcgtctggggaccattcacactacctcaatacaacacccatgccaactccaaatccattcttaattctttttattttcagtaaccaaaacataaatctactaatatcatttaatggaactaatttagtttaaagctttttttaatgttgctaatgaaataagcaccttaagtatattctcccattggtgatatgttttcttatcggttggtttgggtaattttcgacacttttggaaaatggacaacccatgttgtcatttccctttagattttcttgatggttatggtgtggctagtttttttttttcttattttcttatttttggtatttaagaagagaattataaaggaaagagaaataagtgtatagtttaaaaggaaaaaaaacaaaggaatgtaaaggcaaatacaagtgtatcccggcattagtttggttttgcgtacttgttgttgtgagcttcatgttctttagcgacttttcgtcacgttatctttggttcccttcacttattttttcaatgtaccatttgataatacatattttttcgttgtttctgaaatgcaacgtataatcttggcgtgattttacatatttttaaagaatacacgatgaacaacaataacatgaaacaaatgtctaagattatactctcccggaggagaacatgcattcacccatcctaatcctatgaaacagttattttacgttttgaccattgactctagagtagcagctgtattaaaatctggtacaaagagatttcacgacacattttaatgcatggcatcagatggatgccatttatgtcgcatacgctacccaaatatgcacaccatcaattaggctacatagggccataggatcgcatgcccaacaaggtcagacaaaccaacatcaaagtctacgtactaactttgcagcagcaggcgaatccaacccaaagaccaacaagtatcaagatccaaatcatgtaacctctataaacatctccttaaggaaagcaaatcttgcagttcttcaacaataacggccagtttaagctaaaacaatgaaaccatgagagtgctcactattcgagatgaactatacaagaattaatgtctcgatgttaatagtatattatctacgatcacaagtaagaaagctaacttgaataaagcaaggattcatccgcgtttgcttagaagtcttatctcgagttctagcctcattcccatcgttttgcctttaccttctcaaatgcattcatcttgttgatcctgaaaaactatatccttcagatacgaaaatgaacaacaaaggtttttgctttaatgcttaaaacctaatttatgtttgccatgtccttggtcatttccttttctctccatttgccatcctctccaatcaccttcttcaaatcttttaggctcctaaaaccatcaacgttgatgcatgatgataataaaggcaaactcaaatatcgcaaatttgcaactgatattagcacacatttttgcagtacatagactatatttgtattaattactctctattcccaaatttgttacacaatctctttcgattcttccaaaatttgttctgctttgacttctttttatttttttgataaacatgtgaagattcataccaattttaaagtttctacagagtacagagattcaacgaaaaaagcagaaagcagaaatctacaatctgctttgaccagctttgctttcataatttttactgtacagagaataataaccaacctaaatcagaattcaatatttcctctaccaacaaaaaagataaaccctgaaacgttttgtaagagaatcacgtgagagaccacgtgaccatttttttccctaagcatcgttaatcttaatgggctcaagaaaagtttcttaattggatcttattataatactgttgagtgagccttagtccattattatgacgtggcataaccctgccactttcagggtatcgatccacatctgccgttaaaacagtaaaccgccgtctaaactttatagcaaagaatctggaccgttgataaacccctaaataaacgggaggactgataacggagaacgtgagcatcctctgacaagaaaaagacaaaaaaagaagaagaaaaaaagcacatgacatgattctttcaccaccctttcgtcttccactctcatcaatctagattctcttctctcttctctatattccaaagcttttacatttcttcaaatcttattttccttgagatcaattatggcaggagagattcaggacccgtttagtcttagttttcaggtaaattcttctactacaatgtcacacttttacttgtttttcttctaactcttttcataattgctcttgacgaatcttggtaaattatgtatgttcgttttaagatcaatctaaatggacttgaaattctactgttttcagctttacttcaacgaaatttgctaaatttaaccgcttagtagcatgtatgcagagtagtgcttcatgtcttgggaaaaaagtcaattgctaggtcacattttgttagatttgtgtattcagtttgattaatgtgtttaagaaatgctaggtcttaaatttatttaatgtttattgtggagcactcaaatgaacataggcaagactctgaatgtatgtaatacgttttagcattgttcttattggtttgatgaatacaaactacaggggaactctatccactctggatcgatatcctttggaagattcgagaaagagggtttatcatgggagaagaggtcatctttttctcacaataggtatcttgaagaagttgacaagtgttctaaacctggctctgttactgagatg

SEQ ID NO: 21955 - DNA, 3003 bp, Unknown
  misc_feature (1)..( 3003): 2750-1469P.txt file - cDNA_ID_2039305; gDNA_ID_1620835; Annot_ID_169860
aatatttaatatgttaaacaataagatagaattctaagataattgaccacatgtctataaataaatttgataaaatatattcatacatagaaaaatagcatgataccaagaaaaataacgtgtcttacaacactgagaggatacagataaacagtataaatgagatacctacgtaaaaaataacatgttacgaaaaatgatatgtatcgaaatagtcaaatgaaaaaatgaaaagataatcgtccaacatggtcaaaatccacttttatcatatgtgcaaaaaagtaatcaacgagtgataatatgctgatatttgttacaagaattcgaatatgagatatgtgtatattgacatattgtgctggatagataaattatattagggttaactttacaagcatattttccttatgattactaattttcacatatatagattttatatatgactatcagttagtcaaggatttttgtgagaataaggtaaatggagaactgaaagaagataactggggaaaagtttaatgagagggtatggtggtgtcctcgtgtgcgtggctgcattctcgtggcatgccatctcaatgctaataattgaaatccaatatataaaattcatgaatcaacaaaagcaaaattaaagagaaaagtaaacgtgaatagattgagagagagaaggacagatgaaggtgggtgtcggccgaaccacggacaccggtcggagtctcaagacaaaggaaggtttgcgtctggggaccattcacactacctcaatacaacacccatgccaactccaaatccattcttaattctttttattttcagtaaccaaaacataaatctactaatatcatttaatggaactaatttagtttaaagctttttttaatgttgctaatgaaataagcaccttaagtatattctcccattggtgatatgttttcttatcggttggtttgggtaattttcgacacttttggaaaatggacaacccatgttgtcatttccctttagattttcttgatggttatggtgtggctagtttttttttttcttattttcttatttttggtatttaagaagagaattataaaggaaagagaaataagtgtatagtttaaaaggaaaaaaaacaaaggaatgtaaaggcaaatacaagtgtatcccggcattagtttggttttgcgtacttgttgttgtgagcttcatgttctttagcgacttttcgtcacgttatctttggttcccttcacttattttttcaatgtaccatttgataatacatattttttcgttgtttctgaaatgcaacgtataatcttggcgtgattttacatatttttaaagaatacacgatgaacaacaataacatgaaacaaatgtctaagattatactctcccggaggagaacatgcattcacccatcctaatcctatgaaacagttattttacgttttgaccattgactctagagtagcagctgtattaaaatctggtacaaagagatttcacgacacattttaatgcatggcatcagatggatgccatttatgtcgcatacgctacccaaatatgcacaccatcaattaggctacatagggccataggatcgcatgcccaacaaggtcagacaaaccaacatcaaagtctacgtactaactttgcagcagcaggcgaatccaacccaaagaccaacaagtatcaagatccaaatcatgtaacctctataaacatctccttaaggaaagcaaatcttgcagttcttcaacaataacggccagtttaagctaaaacaatgaaaccatgagagtgctcactattcgagatgaactatacaagaattaatgtctcgatgttaatagtatattatctacgatcacaagtaagaaagctaacttgaataaagcaaggattcatccgcgtttgcttagaagtcttatctcgagttctagcctcattcccatcgttttgcctttaccttctcaaatgcattcatcttgttgatcctgaaaaactatatccttcagatacgaaaatgaacaacaaaggtttttgctttaatgcttaaaacctaatttatgtttgccatgtccttggtcatttccttttctctccatttgccatcctctccaatcaccttcttcaaatcttttaggctcctaaaaccatcaacgttgatgcatgatgataataaaggcaaactcaaatatcgcaaatttgcaactgatattagcacacatttttgcagtacatagactatatttgtattaattactctctattcccaaatttgttacacaatctctttcgattcttccaaaatttgttctgctttgacttctttttatttttttgataaacatgtgaagattcataccaattttaaagtttctacagagtacagagattcaacgaaaaaagcagaaagcagaaatctacaatctgctttgaccagctttgctttcataatttttactgtacagagaataataaccaacctaaatcagaattcaatatttcctctaccaacaaaaaagataaaccctgaaacgttttgtaagagaatcacgtgagagaccacgtgaccatttttttccctaagcatcgttaatcttaatgggctcaagaaaagtttcttaattggatcttattataatactgttgagtgagccttagtccattattatgacgtggcataaccctgccactttcagggtatcgatccacatctgccgttaaaacagtaaaccgccgtctaaactttatagcaaagaatctggaccgttgataaacccctaaataaacgggaggactgataacggagaacgtgagcatcctctgacaagaaaaagacaaaaaaagaagaagaaaaaaagcacatgacatgattctttcaccaccctttcgtcttccactctcatcaatctagattctcttctctcttctctatattccaaagcttttacatttcttcaaatcttattttccttgagatcaattatg

SEQ ID NO: 21956 - DNA, 3000 bp, Unknown
  misc_feature (1)..( 3000): 2750-1469P.txt file - cDNA_ID_2039603; gDNA_ID_1971953; Annot_ID_177417
aacatcctcctccatctgtacagaaacaataccggtgcatggctcaatacgagagtggtggtgattcttcttgcaacacatcaagaattggaaaagaacctctttacttgccggagacggtaaagatccggtgcggcaacaaaagatgtaagagagctcggcgaaaaggatgagcagaaagaagagtaacacggcgagaagtacggcgccggagttggtgagggcatgcatcgtttgagagagagtgtgaaaaaataatgaccgggacgtagtgtagttaaagcaggagagttgaccggcgtttaccggtcatcagttgacggaggaggttgggttgatgatgattaatgatgttggaatttgttggcagggggacacatgagcaacttttttacaggtagcatcagctttttaaggatcataattatcatatagatgcattaaagaaagagaaatgatagttttataatttctgtcctttggtttttttacaggtcctttaatatgactagcgtatatggtagaacaatggcttctctgtgctatcaaagaagatcacaaaatggtcttgatttttaccattaatatgtacagtgtacatgcttaggtaagtgatcaactgaatatgaatttgtaggcgtaacacaataagacttccattaacggaaaaagttttttattataattttggggacaaagtgagaatcaaacaaaggattgttttagcgtacaagaaaaaaaactctgctcacatataacaaagattgtacctttttgctatcatagtagagtttctaaatagctgagaagtactctttgctgagttttgggtcgggtttcattgacttctcacccggcttccatcctgctgggcagacttcatccgggttttcctggatgtactgtaatgcctgcaacattgaaaacgtattaagcataccggaaatcgagtgaaaggaaagagcggtttttggagttgtgtgtatttatttgtatctttacctggagggttctcattgtctcatcaacgcttcggccaataccaagattgttgatggtggaatgttggatcactccttccttgtcgattatgaaaagtcctctcagtgctattccctgttcttacacaaacaaagttcttgttttcatttatcccaaacacttcgaaagtttaaaggaaggtagccaagatttaaaggctaacaattacctgatcatggatgagcactccgaacgactttgagattgatttagtgacatctgaaataaggggatagttcagatcaccaagccctccagatttcctgtctgtttggacccatgcaaggtgagagaactacgaggacacacagaaataagaatgaatcaaaaatttgcaaacagataagaacatggtgatgtcaaccaaggatgaggaactgagtaaaatgagaacatagtaaatgtatagtgatacttaccacactatcgacagaaacacctaatacttcggtgttcaacttctcaaattctgaatgccggtcactgaaggcagtaatctctaaaagacataaggaaaaaatgagaaagattaggactcaaggatgagggaaccttggatattcaattttgatatacttctcgagcaatgctaacctgttgggcagacgaaagtaaagtccaatgggtagaaaaagagaatcacatacttctttccaatgtaatcagagagcttaacctgaaaccatacattcatcagttaccaattagtttccaatcacaataagacatatactcactaaataaaaaacactaaagactactcattcagcttcaaaactaaacttaatctcagattaactagaagcagcaactgtgattgataactgctgtaagtaccttgatgaactcttgatcaaacacagcctctgcctcaaaatcaggcgccttgtttccaaccagtggaagatcatcctataatcaccaaattaaaactcgttaacacatcaaatctaaggagaaagatcagtcaaattgacaatcagataaccatggtactataccaaaactacatagacctcatccgaacatactaatcagtcaatgagtatagctcatatgtcactcaatttcacttcaccagagaaattaacaaccctaaacgaaaatgtcactcaaatttctgaacttttcgagtaatctgcagaaacacggtcgcataacctataaatcgttaactatttccccaaaacctatagggctaacaagtaggaagagagtgaaatctataacaggctaatgaattcagatttcaatgacatcgaataagaaaagtatcgacatttagataaacttacggcctgggctttgacagcaaagctccgacgagaagtggagctgagggaagagcgtcgagcaaatccggagcggagagaagcagatgcggaaggagaagaaagggttcgaaggaaagaaacagatggagaggaaagtgaagactttgctggaaaaaccctagaagagggagaagagatgagagtagttgaagaagcaacagacgccattgctgctacacacactttgtgactctctgagtctgagctaccaaacactcttatctatctgtcaatcacctctctttgtagtggaagtatgaggtggagataagcctgacgacacccaaactcataaaacgacgtcgcgttactcaaaacgaggtcgtattactattgctgcaaatatgcgtcttcttcttctaccttgggtaactccgtctctccgttactttcttcctccgatcggtggttcagttctccaaagtatctaatctactcctgttgtttcaggtgcattgttgtgctctcttcacttggtttactttaaaaggcttcttcacttattttgcaaagttttgatttttagtggtttctctgttgtctcattaattctctcgatcttctcctttcaagtgttgacagttctgagagaagatataagttgaatcgcgtgaccggagacatg

SEQ ID NO: 21957 - DNA, 3003 bp, Unknown
  misc_feature (1)..( 3003): 2750-1469P.txt file - cDNA_ID_2039641; gDNA_ID_1971893; Annot_ID_176867
atatggagctttattatttaaatctttgataccttcttctgtaattatgaaacacagataattatgtaaattagcaggcaatggagtaaatatggtgacattatgagtcactgatctgcctaatggagtttgatgatacaacaatgaaggaaggtcatgtgcacttgtgtgacgtgagaatatcctccggcttgtttggtctttaaaaggaaaggacaccacaataacaattatcaattagaaaacaaaaaatactccttttattcttagtcaccaaacaaataaaatcagctccttttttcataccacacaatgggaacaaaagcaatgataaaagaagcccatcaccttcctttgcttttaaattattcataatttatgaaagaaacaaaaaaaattattatttttatttttgcttctcttccggtaagtcaaaggagataatattaagagtttagatattaatctcttaaattctgtgttcattttaagattttgtagcaaaagtttattattactaatcatgtggttgtactgcatgtttaaccaacatgaaagaatatgtattcattttttcggaatgcgaaataagagaatcaatctcagttcagttcaagttcgaatctttgaacgacatgcggtttatataaaaggaactatagtatataaatatatatttatatatatgcctcctttaatagattttcttatattccttctttgttttgtaatttatggagaatatttactatgtattcttcatgaagcaattttacaaatattcgaattttaatttttccttttttgaacgtctgatgatcgatcattcgcgtgcacaagaatctcatcagggcatgatagattcgaaattttgatttgctcagttacgatatatctttgattattcttcctacggcggtttaaacctaaaaacaagttttcatgttttattcacctagattggtttcaagtgtattttctaaccactatttttttcaagaaaacgggaaacaaacagaaactatttctggtgcaaaatatagtctgaaaatagtagaatgcaatccatatcaatcttgaaagatatatttttttaaagtgtacttgagaagaatgtaagaaataagagattaaaaaaggtacggagaagataacgagaaaagcaataaaatgcataacttttgtagtcataacgaaaaaaaggagaaagaagataatgaaaatagtggaagatcggtgtcttcgtgatgaattaaagtagaattgtgtgtacgtaacttttgtaatcatactttctttttcttcatcaactataagacgtaacaatgatatctataatgcatgcatatagttttaaaattatctaggttcttgaccaaggcttagttagctcggtaagtttctaagaacttcgatttaccaataaatcaagccaaactatatatgatctttcgcgatgccaattgatattctgacaggatcatacaatattgttgcttttcttgtatttatttatttgcgtatcaccgcaccgattcatatttattatagtatatagattggaaaaacaatatagagggactctttattaaagtaaaaccaagagaggaaataaaactgaataagaaaataaacaaacatgcttgtctttgtcgaacacacagatttttattacacaagtggttccgaactaattaagattcctaattttaaaataataaagagatttaaaaatgttatcttttgtgtttggtaggccattaaagctccaattatttgtcactaagtcagggaaggagactaagcataaagacgccactgcataaaccttatggtcccctcaaaataaacctaaagttgtaaaagaaagaaaataaaaacataacgttgataaaataaaatttgaagaaagaaaatcctacatctttgtaccacctatatgaacctaacttatagggaaaaagacattgattcttttgcagacccatcagcgtgcatgtccaaaaagatgtgaaaatggtttcgaaaattatggattggtcatgatcagttagacgataattcgggctatgattatgaatatatatttatatttaaaaggatgaatcttttcaactttagatattctaattatagtataaatcatgatcattttatcatttacgacatgtttaaatcgccgtaacatacatagaaacatatgaaacgattttacatatatgacaattcaatttatatatatactacaaaacgtacggttctatatacactacatttatgataaacttcgaacttgtctatagtttaagaaaatctgttgctgctgtcaaaagcactaaatctttgatcaaccaataaatcaaaagtttcccacgataccaaaatttaaagaaacgggggaaaagtatatttgttctgttaaaactatttattatttgaaccctaaaacataagactctttccaattctggaatgcaaataaattatacaccaccggaataatcgactgaacttggtacgtgtcgacatcggaaggtatttcagctcttggtagatgacatcacgtcgtgcgtacctcagaaattaaagcgcacgataaggtcaccttctcggctttgccaaagatgcatctctctcttgcgttttgtttgtcgttaaacgtttcgttcctttaaattgattgtgattatttcttaataaacttgattactattattaattctttaacttaaatattactctaatggtgatgccgtgatggtcacaaataaatgaaatagaaaaagaccaaaacaaaaaaaaaaaatccttttttcctctcttttacatgatgggaactcttgacctttaagttttttttttttgtgacaggaagtgttcaaaggaacgaaatacacttcttcttccatttgatgtctgtggtccgaatgaaaaatatctctgtattaaccagaaacgtgtttcataagcatctttaactcttcagctctcaaattcttcatg

SEQ ID NO: 21958 - DNA, 3003 bp, Unknown
  misc_feature (1)..( 3003): 2750-1469P.txt file - cDNA_ID_2039691; gDNA_ID_1971785; Annot_ID_57993
ggaaataaaaatacattcacaagcaaacaaatggttgcaccaagaccaataagcaaaatcctgtaataagcagtgcttaagaagtctcttgagttgttcccggaaacaagaacgatacaatatgtcaacttgaacactctgaatgcgtattcgtatggtttcatggacgcgtatagtttcaaataactagcaccaaaacctgacatagacaaagaaaaattaaatgttagtatcctcattgtgtgtaatgaaattgtggcgatataaatgttgcaaacctgcaaggaatatgcagattacgatgatgacttcttcaaactctcctgctaaaacagagagctgcgcgacgccgagagcaagtcctccagctaacattgtgcctaatgctctattgaatcctttaaccaaagttgctcctgaaaattgaacataagagtgactcaataagtatgagaataattgatctgaaaatgtaaataaaacagtaaaatgcaaagtcaataagtaaatctgaacagagaaaatagaaaaaatctttgaatccacttatacaaaaagatggattatacaatcaaccaattgatgtctttagttccatcaaatggattccataaacagaaaactcgaaaacagtgaaaaatattcaatccaagtaacaaacaagcaaagaaagtataagagttggtctgaaaatgtgaataatacagtaaaatgtaactcaataagtaaatccgaacccatcaaaatgaaagatggaatccaaaaaaaggaacagtcttaggattaaaagaatctttactagatttgcttcacatgcgcaagtgtcttgagttcaagattccaacaaaacataaaaacaaaactcaaagatccaatcaaaggatcataaactaggctatgagttaagaatcaataccgacgtaatactcgaaaatgagaacgacggtgagaatcgcccaaactgcgaatttactagcatcttgaagcggctctttgagaaagatgacgaaagaacagagtgccaaagcaattcccatcttgatggagaagtaaagtttcctacgatcagaatgtcccagcgcgtacaacttcgccggagcctcgtagagagccctccacgagcaacaccggaacttggagtcacggctatcagcgacgtcgcttgactgccagagaagcttctctgtgttttgctccggtactgatcccattttacctcccattagaaatgattctgacaattctacagaacctgagagattcttgtcgtccttacgaatagaaagatgtttatttatctatttatcaagatttgttttgtactacgcaattaatgcatgccttcgattcatcatctctaaataatcaagtttttttaaaaaatttacaatttggtgcatctacattacaaattttaataattgtccgatttataactttgatgtttttggttgaaatctaatcattaacatattaaccaccaaaagtgtccaaattttttgaaacagatggaatttaaaacgtgagaatttacatttgtggaccagtaatgcataaatggaccggtaaggccgtaatatgattttttgtgactattagttattcagtaaaaaaattaaaaatagaattatattatttcttaatttctgttcaatgtgttaatgtttcttaaactgtagactttacctttttggctcagctacataatattttttcatagttacccgatttagtaagtttttttgttgaatctaaacatcaacataattcattgtgaccagtaaaagtgtcgcagaaataacaacagatatctatggataaacaacctgagaattaactatagtggacgtgtgtaatgtaaatggaccaataatgtgacggtgaacaaatttacacacatatcttaaagtctcttcaagttcaagactctaataattgaattacagacccacagttttggagaagttgcaagtatcaaagagacgacaagtttcatggtcgtgacttgtgtgaatgtgacattttgaaactcctacttactaccgcatcgcatcttactacttcctaactatgctcaaaagccaagccctaccctacacagtgtacccaccctcacatgagatttttcctacttttttttgagaaacaacaattatttatgtattttgggtgagtttgattgttttatccaattattgtatgctgaaaataaaaaatatcgtgtgcacattatataataactacgatgtaagaagtatttcaaacttttactatatatactcatcgaatgatgttcatgaatgaccatcatggtgtctttctccttaaaggctttctcatctcatctatccagtgctacttcaagtccaaagaaagactcttctttggcctcagcaaacctgtgaaaataaagaagacgattttttaagatgaatcatgtgacataatgtaaaaagaatcatgtgacatatataatgtaaaggccactttctcaacaattatttgtttttgataaataaataaaacaaattgaggacatcttgcagcgtacaatatcgataattatattttgttaaaaattgtgttttgattaatacaaaaatttatttcacacaaaaaaatttattgactttgatcaaatcatgaacactaaacaaagatgaggtttttaatttttgtataaatacttgtggctgtcaaatgtcattcgaattaaatatgatatgattaatacttatatgttgagatctttgaattagtccctcgaaaatacttgaaacagagtctgtatttttaaaagtctacttctcaaagcttcaggtttgtattcatgggcttataataaactctgtattcttgacccatttaatgatgggccaagtcaacaaagcccataaatttgatagtcaaactactttgaaactccacccaaaaatgtgaccatatcttccttatccatattctcacaaaatctccattgttctctgagaaaacacaaaaatg

SEQ ID NO: 21959 - DNA, 3003 bp, Unknown; identical to SEQ ID NO: 21958
  misc_feature (1)..( 3003): 2750-1469P.txt file - cDNA_ID_2039691; gDNA_ID_1971785; Annot_ID_175452

SEQ ID NO: 21960 - DNA, 3003 bp, Unknown; identical to SEQ ID NO: 21588
  misc_feature (1)..( 3003): 2750-1469P.txt file - cDNA_ID_2040033; gDNA_ID_1971801; Annot_ID_175714

SEQ ID NO: 21961 - DNA, 3003 bp, Unknown
  misc_feature (1)..( 3003): 2750-1469P.txt file - cDNA_ID_2040042; gDNA_ID_1971801; Annot_ID_58086
tgagatacatgaagatgagtggaacatcggcgacaaaggtggctatgaaactcgagtgttcaggggagagtgttccatgttccaaccttttcatgagagacattgacttatctccggccgatggtattgattctgtctcctctctctgctcttttgctcacggctccgcacaaggcatcattcgacctttatcctgtttctaactattttagtaatttgtaaagttttggggtgtaaattgaattactatgtaaatgcaggggtcatattggaataaacaacaatgttttagttaaaaggcctgtataacaatgcaggcccaaacaaaaagatatgagcccaatagtcactgaaattgttttctcaaacccaaaaaacctaaaaccttaaacctccgtatgtgttccgtcgttagcctcctgctaatctccatctcagatcgcaatttctcccttttccggtcactgctccggcttacgactatagcgttccgagataaagttcggctgtgttaattaaattcgccgtcggagggattttacggatatggctgttgttgaatcgcatggggatttaggttattgtcgattgaggtaaatggatgtcgagggtttgctcaactcttcgctctccttatctttgaagctggttctatagattggttagtagatcttacaaattgcaaagattggagatttgggggatttgaataagctacatgttattcgggtatgtttaggctcgagggaggccctggatcatgctatctctgcgacacattcgcagattctgccattttccttcctctgcagccactggtattgcatatgtttcaacagagtccaatcagatccagggtttgaaaccgctcgaggaacctgcccttgtgaagcttaaatctgagcgagaccctgagaagctatacaatctctttaaagctaatgccactaaccgtttggtgattgaaaatcgatttgcttttgaagatacggtctctagattagctggggcaggtcggcttgatttcattgaggatctgcttgagcatcagaagacacttccacaaggtaggcgtgagggtttcattgttaggattataatgttgtatggcaaggctggaatgacgaagcaagcacttgatactttcttcaatatggatttatacggttgcaaaagatctgttaagtccttcaatgccgctcttcaagtcttatctttcaatcctgatctccacaccatctgggagttccttcacgacgccccatcgaagtatggcattgatattgatgcggtttcttttaacattgccattaaatctttctgtgagctgggtattcttgacggggcctatatggcaatgagggagatggagaaatcagggttaacaccagatgtagttacatatactacacttatatcggcgttatacaagcacgagaggtgtgtgattggaaatggattgtggaaccttatggtcctcaagggctgtaagccgaacctcaccacttttaatgttaggattcagtttttagtgaataggagacgagcttgggatgcaaatgatctgttgctgttgatgcctaaactccaggtggaaccggacagcataacatataacatggttatcaaagggtttttccttgcgaggttccctgacatggcggaaagagtttatacagcgatgcatggtaaggggtacaaacccaatttgaagatataccagacgatgattcactatttgtgcaaggcaggaaattttgatttggcttatacaatgtgcaaggattgtatgagaaagaagtggtacccaaacttggacacagttgagatgttgctcaaagggcttgtgaaaaaggggcagcttgatcaggctaagtcgatcatggagttagttcacagaagagtacctcctttcaggtcaaaacagttgctctcccttaagtccattttgtaatgtttacatgaaatggaacaaatttgctacatgtacacgacaatgcggccaaaagaattctttctttctttctcctgagtttattttgtatagctgtggtggaactggaaatgggatgtagcctcatattaggaggcacacttatcttccaatcagattcaactatttgttgttcaatgtgaataaagcttaggatgatttggaaacttcaatggagggatacccagtaagtcatggatgcctctacaatcttaagttgtgatagcacagaactagtttaccttttgtaatgctacttacaaaacatgttgttgatttcagctggagagcaaaatggcatacacaaagcagggaccatgtgctgaagaaaccaaaaggatcttcgtctgacgatgcaaaagctcttgagcacctggaaaaatgagttatgttgtaagcttcatctagccaaattaaaagcactaaacatataacaaaggatatcaacgttgatagctttttcttgatatagcacgaatgtaaacaacagagaatagaacagagacaacattaccagcaatgaatatttttattattatgtcgaataaatacattttcccacaagtgacagagcaaacaaaattcacatatttttgtctattacactttggtgtcagactgacttgttacgtagatttatggcggtggattataacattgtaactttaaatatcttttaacgtaagaaacaaaactccaaaattggtgtttatttttaaaaataaaaatttgagggggcatgtatgtttgtttagttgattcacgtgttctttgtgtctgaaaattctgaatttgatgattttgaaaaaggaaaaaaagatacgaggtatcctcaattccaaaaggatgaatgatacaactcatatatacaagattatagtaaaaagaagggatgcatataaagaaacatagacatcatcgccatccatcctcagatcagttccgtagtttactggatcacgacacacacacatatacacgtgtacatataagccattcttatcaaaatg

SEQ ID NO: 21962 - DNA, 3003 bp, Unknown
  misc_feature (1)..( 3003): 2750-1469P.txt file - cDNA_ID_2040042; gDNA_ID_1971801; Annot_ID_175709
gtattgattctgtctcctctctctgctcttttgctcacggctccgcacaaggcatcattcgacctttatcctgtttctaactattttagtaatttgtaaagttttggggtgtaaattgaattactatgtaaatgcaggggtcatattggaataaacaacaatgttttagttaaaaggcctgtataacaatgcaggcccaaacaaaaagatatgagcccaatagtcactgaaattgttttctcaaacccaaaaaacctaaaaccttaaacctccgtatgtgttccgtcgttagcctcctgctaatctccatctcagatcgcaatttctcccttttccggtcactgctccggcttacgactatagcgttccgagataaagttcggctgtgttaattaaattcgccgtcggagggattttacggatatggctgttgttgaatcgcatggggatttaggttattgtcgattgaggtaaatggatgtcgagggtttgctcaactcttcgctctccttatctttgaagctggttctatagattggttagtagatcttacaaattgcaaagattggagatttgggggatttgaataagctacatgttattcgggtatgtttaggctcgagggaggccctggatcatgctatctctgcgacacattcgcagattctgccattttccttcctctgcagccactggtattgcatatgtttcaacagagtccaatcagatccagggtttgaaaccgctcgaggaacctgcccttgtgaagcttaaatctgagcgagaccctgagaagctatacaatctctttaaagctaatgccactaaccgtttggtgattgaaaatcgatttgcttttgaagatacggtctctagattagctggggcaggtcggcttgatttcattgaggatctgcttgagcatcagaagacacttccacaaggtaggcgtgagggtttcattgttaggattataatgttgtatggcaaggctggaatgacgaagcaagcacttgatactttcttcaatatggatttatacggttgcaaaagatctgttaagtccttcaatgccgctcttcaagtcttatctttcaatcctgatctccacaccatctgggagttccttcacgacgccccatcgaagtatggcattgatattgatgcggtttcttttaacattgccattaaatctttctgtgagctgggtattcttgacggggcctatatggcaatgagggagatggagaaatcagggttaacaccagatgtagttacatatactacacttatatcggcgttatacaagcacgagaggtgtgtgattggaaatggattgtggaaccttatggtcctcaagggctgtaagccgaacctcaccacttttaatgttaggattcagtttttagtgaataggagacgagcttgggatgcaaatgatctgttgctgttgatgcctaaactccaggtggaaccggacagcataacatataacatggttatcaaagggtttttccttgcgaggttccctgacatggcggaaagagtttatacagcgatgcatggtaaggggtacaaacccaatttgaagatataccagacgatgattcactatttgtgcaaggcaggaaattttgatttggcttatacaatgtgcaaggattgtatgagaaagaagtggtacccaaacttggacacagttgagatgttgctcaaagggcttgtgaaaaaggggcagcttgatcaggctaagtcgatcatggagttagttcacagaagagtacctcctttcaggtcaaaacagttgctctcccttaagtccattttgtaatgtttacatgaaatggaacaaatttgctacatgtacacgacaatgcggccaaaagaattctttctttctttctcctgagtttattttgtatagctgtggtggaactggaaatgggatgtagcctcatattaggaggcacacttatcttccaatcagattcaactatttgttgttcaatgtgaataaagcttaggatgatttggaaacttcaatggagggatacccagtaagtcatggatgcctctacaatcttaagttgtgatagcacagaactagtttaccttttgtaatgctacttacaaaacatgttgttgatttcagctggagagcaaaatggcatacacaaagcagggaccatgtgctgaagaaaccaaaaggatcttcgtctgacgatgcaaaagctcttgagcacctggaaaaatgagttatgttgtaagcttcatctagccaaattaaaagcactaaacatataacaaaggatatcaacgttgatagctttttcttgatatagcacgaatgtaaacaacagagaatagaacagagacaacattaccagcaatgaatatttttattattatgtcgaataaatacattttcccacaagtgacagagcaaacaaaattcacatatttttgtctattacactttggtgtcagactgacttgttacgtagatttatggcggtggattataacattgtaactttaaatatcttttaacgtaagaaacaaaactccaaaattggtgtttatttttaaaaataaaaatttgagggggcatgtatgtttgtttagttgattcacgtgttctttgtgtctgaaaattctgaatttgatgattttgaaaaaggaaaaaaagatacgaggtatcctcaattccaaaaggatgaatgatacaactcatatatacaagattatagtaaaaagaagggatgcatataaagaaacatagacatcatcgccatccatcctcagatcagttccgtagtttactggatcacgacacacacacatatacacgtgtacatataagccattcttatcaaaatgaccaccttcctcctgaattctcattcattatataggcgtatatttcggaattctaagttttgttgctacgatcgagccagcgttctgtttctgtacgtctctctgggtaagaaagaaaaaatg

SEQ ID NO: 21963 - DNA, 3003 bp, Unknown
  misc_feature (1)..( 3003): 2750-1469P.txt file - cDNA_ID_2040045; gDNA_ID_1971801; Annot_ID_175708
tgctctgatgtgttctctttatcccggaaaacatgttcacaaatgacaaagacagaggattaagcgactcataagattgaaatctcctactgagttctaattttggctggttaagttacttggcggagaaagattcttctatatattgatcatactttttccggctctcccacttgtttccagttttctgaaaaagataatgttctattgactgctgcgaatcctaaagtcatttttgctgtggttcttggattgagtcaagcaatgtaaaatgcggcgggtgctgattcttgaatcattgatcttcatgctaaacaagacacgttattttttgtgataagagataaaacagagcaacttaatatcatcatacttcttgattaatctttttattaatttgaaatattaacttcgatttaaaaacaaatgcctatttcctttattgctggaaaattcattgaactttcaagaatcagtacacagaatccttggatggcactccgatattagaggaaaattaagtctacaaatgaaatacattcagagaatatatccataaatagatacctaaaaatttaagaaaaccaaacagagtgcatgcatttatatccaatgctgttatgttactaatgtgatatttgaatcaatcccttatgttgtgtgtttatatataccttaagacaatctgaaagtaatccactattcaactctgcttagatcgatccatttctcgttaaaatggtaagactcgttgcctatatctactaacattgaacctgatttttaaaatattaatcctctttttgtacatatgtgtaggattggtttttgatcgtactcgttgcaattttaggatttcccgggttaagctatagtgaatcagtgatgaaatatggagcggtcggggatggaattgtcgatgatacatctgtaagttattggtgtatatatattatatatcagtacaagcagcataattgtttagtcatcatataaaaaaaattaaacttttgcatggtatatgtgggcaaaaaaaaacaaggcgttccaaaaggcgtgggaggatgcttgtaagggaagctccaaaatgggaagtgtaaacgtaccagcagggaaggtgttcctcctcaactcccttcacttcacgggtccttgcatacccaaacctctccttttcattgtaaatccctccaccactttacttgattgatattacatgaatactcgaatatgaacctactcctccaagttaattataaagttacttttgctgatatatgtatatatagatcgatggagagatgatagcgcagagtgatccacagaagtggggaaatggtgagaacggggtaataccatggctcatattcgatcaagtagatggacttgcaatcgtagggcgcggcttgttggacggccaaggcaaatcatggtgggatattcattgtagagaccatcccggacccgtaagtttccttttttttaactttttatttttcttgggttataatgtatcctaacaaaccatctctatgtgataatacattttgtaacctataacgtgtcacagaattgcatctgccttgcaccaacggtaagtttgctatttacaaaaggaagtacgtagtatgtatataataacttggacgtctctataactatagatatatttctcgcagatgatgacatttagcaactgcggaaatgtaacattaaagagtttgagatttagaaatagtgcacaaacacatgttcttgtgatgggaagccaaaatgtgtatatcgatgatatcaaaataacatcaccggaggctagccctaacaccgacggtattcacatcacatcttccaccgccgtttctatcaatcattctgacatcgccactggtatatttccttacctaaccatataaaagatcaaacaaaagtttaatttgtttatttattctcacaattaattaaacaggtgatgattgtgtgtcgatcggagatcaagtgaataatttgaatgttacttttatgaattgcggacctggtcacggtgtgaggtgattaccatctccttatcgacctcgtaatcttatatttttcataataaaaaaatgagaactaataagaaattagagacagcattgggagtttaggtagaggaggaacagaggtaacagtggaaaacatacgtgtgtcgcacgttaacttcactggaacaacaaacggagctcgaatcaagacttggcctggaggaactggttacgtccgaggaatcgagttcttcgatatccgtttctcgtctgtacaaaaccccatcatcattgatcagttctacggttgtgcccctacatgcgttgagactgtgagaacctttttctttctatctttcaagttaatattaaatgtaaatgagctaatgtttgaatgtaatgtatcagatgaagggagttcacatagagaaagtgagatacatgaagatgagtggaacatcggcgacaaaggtggctatgaaactcgagtgttcaggggagagtgttccatgttccaaccttttcatgagagacattgacttatctccggccgatggtattgattctgtctcctctctctgctcttttgctcacggctccgcacaaggcatcattcgacctttatcctgtttctaactattttagtaatttgtaaagttttggggtgtaaattgaattactatgtaaatgcaggggtcatattggaataaacaacaatgttttagttaaaaggcctgtataacaatgcaggcccaaacaaaaagatatgagcccaatagtcactgaaattgttttctcaaacccaaaaaacctaaaaccttaaacctccgtatgtgttccgtcgttagcctcctgctaatctccatctcagatcgcaatttctcccttttccggtcactgctccggcttacgactatagcgttccgagataaagttcggctgtgttaattaaattcgccgtcggagggattttacggatatg

SEQ ID NO: 21964 - DNA, 3003 bp, Unknown; identical to SEQ ID NO: 21576
  misc_feature (1)..( 3003): 2750-1469P.txt file - cDNA_ID_2040066; gDNA_ID_1971801; Annot_ID_175698

SEQ ID NO: 21965 - DNA, 3000 bp, Unknown
  misc_feature (1)..( 3000): 2750-1469P.txt file - cDNA_ID_2040232; gDNA_ID_1971814; Annot_ID_175888
ttattctactagatcatgaaacttaaaatcgtctatcaaacgtgtacacaatacaaaaagtaatataggcatgtaaatggaatcaaaagaagaagaaagaattaggaggccattaatcaaaagacttgacgatcaaggttattacttattacgtagagtgaatcccacctttaagcctaaaatggagaagtttggcaatggaacatgtggtacaaaaccatcgtagtgaacatcttaaaatcctataaattatccacaaacctcacttcatttcagttcaccagtatccgtacaatatagtccttctttaaggacatatatatataacctcggacaaaatgaatccaaaatgttcaaaaacaaccctagccctcttcttcgcattcaccatcctcctcattggccacgctgaatctaatagccgtccccgccctagaacaccacctccaccacgaaccccaagaactccatcacctcctccaccacgaaccccaaaaactccaccacctcctccaccacgaaccccaagaactccaccacctcctccaccacgaaccccaagaactccaccacctcctccaccaaggaccccaagaactccaccaacagctcctccacgtacgccaccagtttctccgcggataccaccaattcttcctccaaagactccaccaaccgctcccccacaaacaccaccggtttctccaccaaagagtcccccaaattctcctccgcgtgcaccaccactttctccaccaagaactccaccaaatctcctccgcgtgtaccaccactatctcctccaagaactccaccaacttctcctccacgtgcaccaccaattcctcctccaagaactccatcgacttctcctccccgtgcaccaccactatccccgccaagaactccaccaacttctcctccacgtgcaccaccggttcctcctcctaatactccaccgacttctcctcctcgtgcaccaccactatccccgccaagaactccaccaaattctcctccaagaactccaccaacttctcctccacgagcaccaccagttcctcctccaagaatttcaccgacagctcctccacgtgccccaccactatccccgccaagaactccaccaacttctcctccacgtacaccaccgctatctccccctataactccaccaacttctcctccgcgtgcaccacctctatccccgccaagaactccaccaacttctcctccgcgtgcaccaccaatatctcccccaagaactccaccgagttctcctcctcgtgcaccaccaatgcccccaccaagaactccaccaacttctcccccgctttcacctctatctcctccgccaagaagtccaccaatgcctcctacacgtacaccccctgtgtccccaccaacttctccttcacggacaccaccagttactcctccaagggctccaccaaccgctcccccacaaacaccaccggtatctccgccaatagttcccccaaattctcctccaaagagaccaccgatgtctcctcccataactccaccaacttctcctccacgtgcaccaccacaatcaccgccaataactccaccaatttctcccccacgtgcaccaccaacgcccccagggacaccttcagtaccaccgccgccgaggactccaccaccgcctcccccgagtggtagatgccctaggaatggtatcccactacaaatatgtagcactatcctaaatatgttcgatggtttcctaggattaggaacggcgcaaccatgttgttctctcattcgtggtctttctgatgctgacgcacttgcctgcctttgtgaatcagtgagagcaccaagtcgcagtcttcctcgtaatatcatcaacctctttatgacttgtggtcgtagcattcccccaggcttcacttgcccatgaccacctcctttccccacaataaactaaaaaacctacttactatacacttaaccgtgattttcttttgtttctaaatatatactttgttccaataatgtaataaaaaataaaataaagtttgtacgggagtgttgattgtctttattttagattttgaatcacgttggagtttacaaatattactggaaaaaaaagtaattgaagaacttacatacgtaaattcaaatctcaaacaaaatgattgcattctgtttgatccccgcttcggtaaacctcaagtatattcattcttagacaatgaaagaaccctcagtaatcaaagattttccttctaaaactagatcatgcatggcatcggtttctataagtagaacatagaatttcaattgacacatcaagttattgttccatacaaagacggggatggagattttagaagttttcatttcgttagattacgaagacatagaattttattggaggctgaatgtggaagataaattttaattatttagaagacatgaaatccgggaaataaaattagtattgaagacgcacttgtgaaaaattatttattaatgtttattgtgtgtattgtgttccttgtaacatctatatcaattgatggtctatatctacttctgtaaatatgtaatttcaagttggttcatatatcaagtgttaaaaaaaccaaaattacatccattcaattcataaaaaaatgcatacattcatgaccttagatttaaaccgtatatactggttataatttgtgttgaactcttgaatatatgaaagaaagaaaaaacaaatctgaaaacaaaagaaaaaactccttggaagccaaactagacattttgagcgtaaagttgtacataagagagagaaccaacaacttgcctaaatctctaaaacctcattaattaaaaaagagtaatgttaggcaaaaaaaataaatgatacacaagtgtttgtgattccaaggcatctcttggctctataaatacatactacacaacatcatcgaaagcatccacactttcatatccacaaaataaaataaaaaaatg

SEQ ID NO: 21966 - DNA, 3003 bp, Unknown; identical to SEQ ID NO: 19063
  misc_feature (1)..( 3003): 2750-1469P.txt file - cDNA_ID_2040276; gDNA_ID_1971821; Annot_ID_176186

SEQ ID NO: 21967 - DNA, 3000 bp, Unknown; identical to SEQ ID NO: 3349
  misc_feature (1)..( 3000): 2750-1469P.txt file - cDNA_ID_2040297; gDNA_ID_1971821; Annot_ID_176176

SEQ ID NO: 21968 - DNA, 3000 bp, Unknown
  misc_feature (1)..( 3000): 2750-1469P.txt file - cDNA_ID_2040393; gDNA_ID_1971822; Annot_ID_176215
cggctccctcgggagtcttgtagtcgagaacctcatccgctcccaacgatttgacaaactctatgttccgggcaccacatgtagcggttacgtgagcatttgcaagttttgccagctggactgcatagtgaccaaccccaccagatgctgctgtgaccaggatgttcgccttcttgcctgtaccatccagcttcaaccccgcaggattagtaagagcttggagagcggttagacccgccacaggtaaagctgctgcttcagctgctcccacttcttgaggtcttttgacagtcagcttctcggttgcaacagcgaactcagcaagtccacctccaccctgaaagaacaaaatcagtttcccttaacatgtttcaaggtaattaaagtttctacttgtctgtctgaaaaaacttactagatggctaagaaccgctacaactttgtcaccagccttaaaattttttactcctgatccaacctcaacgacctctccagcaacatcagtagctgttcaaaacaaatatcaaaggttccaaactcaacgacctctaagcaaagtaacctctttcttctatacagaaactaaaatcttcaaagctattagaatacctggaatgcaggggaacttgcggggcagaaatgggcggatcattcctttctgaattttccaatcaacagggtttagactagtagcttctaatttcaggcaaacctcattactctttggtgttggaaccggaacttgaacatgctgagaacatattcagataaccacgtatttatcatcaaaagagtacagaatacacatacaggaatgcatcacaaaagaaaaaaaaaagaaaaaaacactacaaaaacagataatgttaccttttaatcagaaaaaaaatacacacatgagaacactaacttcacaaaataatcacttaatcagagacacttcacatatgagatgcatcatgcaatctagtggactctgcaatccaatccaatcgacaaaaacagagaaataatttaaaactatcactaataattcctcttttgtgagctactctcaccaccatcgtctcttttcttcattctctcatttcgtacataatctcaatcacattatctagcttaaaaggcgtgttctctgtactcaaattttccatagattcccagagcaacgagatccatatagaaaccgctagtgactacgtaagcatcagaaatgaagaaaatcatttacaatcatgattgtgttttatcatgtaatctagtagcctttacaatccaaatcaaattgatgaaaacattggatttttcaacatctgaggcaacaaaatcttctaagtttatcaaaaaatcaacgcatcggcagagagaagaatacaaataaaatcgagacggtatcgataaatacagagaatcaaatcgcaataacacagtagtttagaggaatatatagaaaagagagatgaaaacctctaatccggcggcgccaccaccgtaagagttgtactgaagagcgtgcatgagttttccagccatttttgaaggtttctgaacgacgacgacgatgatctctgaatcggaacaacggtgcttaagattttgttctcggttttacgcggagaggcttaaggggtaaaagcggtatatcatataaaaagtggttgtgaatttgccacgtcacctcaagtattgaaaggtgttatacggaaaaagaaaagaatctaccggtgcgcgaattcagaatttgccacgtcacctcaagtacgacatcatgggccattactggttgatctagttttgagttatcatgggcttgtttgggctttaattccactggccagtgattttaattatccaataatgatcttgggacgatccatttaccttattataacttttttttctgcaatgttaatttttctgttaatgagtcattaccagtcaaacagtttcctgctcagccactgtggttatggttaatatgcttgggtgttgtctggcagattccacagtggtctcaccatatatggttggttcctacgggtttagggactcgacttcttaatttctcgctcagcacgtcaatcgtttgtaatgtatttttttttttggttgtcgcaaccacacctaaaatctaaataaatgtttttagctaagagcataagactcatcctcggttgtttttgtttcttgcatttctccccatatgtcatgaatctagtttgattcttctgaattgcctaccaaatgttacataaattggtagtgaatttcttgtatcttttcgcaagaaattttctaccaaatttcgtctactctattttttcatcaaaattttgtaagtaattagtaggaaaaaaaaatccattttctaactcgatattcattgaagaccacttcggaaaaaaagaaaatcttcttactgtctttgtatatgagaatgaaaccatgtgatttttatgatattttttagagattatttataaatttagaccaactgtttatgtgttattttaaaatattgaatcattatttgttgttgttttcgccaagaatctttactcgttttaacttgtttgttagtttgtgtattgagtaggaacgttaagaaacaagtaaattttttcttttttcttctatttggaaaatgttattgtatgttgcgctaaatagttgtgtatctctatggaaaattttcaattttactcaaatataaacgcaaaaactgatgtttgaaatgactgaaaatatttgatgcttagtaatggtgattcgagaaggagtaaaatggtaaaagtaatccgtgtcttactacgtaaatcttttgcatttttcttttttggttaaaacgtttattcaagtctttcccggcaaggaaacaaaatctatacggacctacctttagaaaagcttaaccccttctctcttataaaaactgctttaaagacaaccaaaagaatattgaaccataaaaaaaaatcaaaaataaactcttgagcgatg

SEQ ID NO: 21969 - DNA, 3000 bp, Unknown; identical to SEQ ID NO: 9209
  misc_feature (1)..( 3000): 2750-1469P.txt file - cDNA_ID_2040507; gDNA_ID_1972022; Annot_ID_178108

SEQ ID NO: 21970 - DNA, 3000 bp, Unknown; identical to SEQ ID NO: 21459
  misc_feature (1)..( 3000): 2750-1469P.txt file - cDNA_ID_2040708; gDNA_ID_1971948; Annot_ID_177309

SEQ ID NO: 21971 - DNA, 3003 bp, Unknown; identical to SEQ ID NO: 19846
  misc_feature (1)..( 3003): 2750-1469P.txt file - cDNA_ID_2040847; gDNA_ID_1620691; Annot_ID_164793

SEQ ID NO: 21972 - DNA, 3003 bp, Unknown; identical to SEQ ID NO: 19846
  misc_feature (1)..( 3003): 2750-1469P.txt file - cDNA_ID_2040847; gDNA_ID_2926159; Annot_ID_198639

SEQ ID NO: 21973 - DNA, 3003 bp, Unknown
  misc_feature (1)..( 3003): 2750-1469P.txt file - cDNA_ID_2040893; gDNA_ID_1620691; Annot_ID_164777
cttacaagaccggtggatgagaaaagtcttatgtgacgaccgacgagtaacagccacgagtagaaagatgattaggaatatttcagtctgtttttgatcagttctcaacctccacaagaccgcaaccaaccaccatggtaaggaaatgattgttgtcttttcttttaaaaaatattagttattttagttttttttttttatgattgctaatttaatacagacacaaaactgagaatttgatctcttttaacagtttgttacttcacagtgaccatttgagaagttgcatccactgtccatccattctcatactgttaatcaaaaaataaaacaattatcgatgaatcaaattttgtcatgtttttgtaataaagtgctagtatgtatagtggagttcttaaagaatcttacaaaaagttattggtgggctatgctttttaggatatgacactaaagtaaagaaggctagcctaagaactcacactttcttctttactcttcttccctacaattacgatcgccaaaaaccctaaatttctaaaaactgcttttatctccaagtaagtttcaatattgatcttctgctctttttatttgttcaagctagcatgttgtttgatctttagcttttcggttggttttcaggaagttgaaaaagatggatcttagtggttgtagagatataatcagtagtttaccagaagccattagttgccatatcctatccttccttcccactaaagaagctgcttccacttcggttctttcgaaaaaatggcggtatctctttgcttttgtccctaatcttgatttagatgaatctgtttatctgaatcctgagaatgagacggaagtttcttcaagttttatggattttgtggatagagtgttggcattgcaaggcaattctccattacataagttctctctaaagatcggagatggcgttgaaccagaccgtatcattccttggataaataatgtgttggaacgcggtgtatccgatcttgatctacacgtgtatatggaaacggaatttgtgtttccttcagagatgttcttgagcaagacactggttaggctgaagctaatgctatatcctctcttggaatttgaagatgtttatctcccgaagcttaagacgctttatattgactcatgctattttgaaaagtatggtattgggcttaccaagcttctttctggttgtcccatacttgaggatttagttcttgatgatataccttggtgcacttgggattttgcctcggtgtctgtcccaactctcaagagactaacgtttagcacgcaagtgcgagatgagtttccaaagagtgtgtctattgatactccgaatcttgtctacttgaagtttactgacactgttgcaggcaagtatccgaaagtgaatttcgattcgcttgttgaagctcatatcgatcttagattgttacagggccatcaaggttatggtgaaaatgatatggttggcaatgcaacagattttataatgcgtatatgcaatgtgaagactctctatctatcttccaacactcttcaggtttgttttcatcatgaaaaacaacttgtaatctttttaacattgttcaaggatttgagttagtgattgcaattgagtgatgataatctagttgttgtggttgtgtttcaggtacttacttacagttgtgatgctataccaatattcaacaacctgactcatttaaccatcgagagtaatcccgaagtaggatggcagtcattgccaggtttgctcaagaattctccaaatcttgaaactcttatcttccaagtaagaaacaaaacccttggaaagcatttgttgactcaatttttcaaagtttaagaatatttcactatgtatgtttcagggcctcatccacaaagccaccgataaatgtggagacgtgtgcttgtgcaaacctcgtgaggagattcgcagttgcttagcatcaagtccggtgaaggttataaagatactgaaatttggtgaaatcagtgatgacatggagaagcagagagagcagatcaagtatttcttggagacaatgccgaatcttgagaagatgattttgtactacaatacaacaagtgttgaagatgtaactgaagtttcaagccgacttcagaggctagtttctaaattagcttcatcgacgtgcattgtccaactaatctctgataacctcagcttgtcatctactgtatcgacaaatgggctcctctgtttctaaagggtacctcttcggtttgaagatgaacctctttatctcagagatgattaccaaagcttagggagtaccctagcttgtcgtcactaaaataatcttctcttgtttctgcctaattatgttctaaagacgtgttatttaggctttgtccttattgacttgcaatgttaacttcagttttttcttgttacagttggtctgttgtgtaaaatgatcttgtaagagtaattggtaggagtaagcagacaacaaaagctgaaacatcccttttgtgtaaagatctgcaacaaaaccgaattaacattttatctaatcaaacaaataaaacaattatcgctaaatcaaattatgtcaagtaatgtttttgtaagatgctagtatatctgattaaatatattattttatctaatggagctcaaaatatcttccaaaatcttacaaaatcttttagccttttaggacaagacactaaaaaaaggctagcctaggaagtaggaactcacactttcttcttcactcttgcctacaaatacaatcgccaaaaaccctaaatttctacaatagttgagtcattttggtgagctatcttcactttagcctacaaatacaagtaagtttcaatatcgatctttttattttttcaagctagcgtgtttgtttgtttgtttgattcttagcttctcggttggaacacgtagaggaagattgaatcggtctcgtgtctttggttttcaggttgttgaaaaggatg

SEQ ID NO: 21974 - DNA, 3003 bp, Unknown; identical to SEQ ID NO: 21973
  misc_feature (1)..( 3003): 2750-1469P.txt file - cDNA_ID_2040893; gDNA_ID_2926159; Annot_ID_198625

SEQ ID NO: 21975 - DNA, 3003 bp, Unknown
  misc_feature (1)..( 3003): 2750-1469P.txt file - cDNA_ID_2041030; gDNA_ID_1621094; Annot_ID_170875
gcctatccctgataaagaaggtaacgactttaggactaaacacagacccttcccgttcttttgcaacgtctccgacacaggcttcaagatactcggcaatagagtcaagtgggctaactggaaattccacgtcggatttaccgcaagagcgggagtaactatatcgacggcttcggttcttgacccgagaaccaaaaggtttcgacgagtgatgtatagagggcacgtgtcagagacttttgttccgtacatggacccaacctacgaatggtactaccgtacgttcatggacattggagagtttggtttcgggagatccgccgtgaatctgcagccactcattgactgcccgcaaaacgctgcgtttttagatgggcacgtggccggaccagatgggacagctcagaagatgaccaatgtgatgtgtgtattcgagaaaaacggttacggtgcttcttttagacacaccgagattaatgttccaggacaagtggtaaacttacaaaatacagattactaaatgatttgtttacgtttctaggaactttgattagttactttaattaatttttgcagataacaagtggggaagctgaaataagtttagtggttagaatggtggccacacttggaaactatgattacatagtggattgggaatttaaaaagaatggagccatcagagttggggtactgtttacttcatgttctctttaatatagtatttaactttttggattgatacaattgttttgaaatccagaccaacctggccagttttgacctgtaaagattctttaacatatgttataattttttcaagtgaactcagtttgattttcgtttgagaattttaaaagaaatggagccatcagagctggggtatagtttatatattagcatggtctttcattttttatacataataaagtattcaagtatatcaatcttaatatatatgtaggtggatttgactggagttttagaagtaaaagcgacatcgtacacttcaaacgatcaaataacggagaacgtatacggtacactggtggcgaagaacactatcgccgttaaccacgaccattacctaacgtactacttggacctcgacgttgacggtaacggcaattccttggtgaaagccaaactcaaaacggtaagagtaacggaagttaacaaaacgtcttctcggaggaagagttactggacggtcgttaaagagacggcgaaaacggaagctgacggtagagttcgactcggctcggatccggttgagctgttaatagtaaacccgaacaagaagacgaaaataggaaatacagttggttaccggctgataccggaacatttacaagccacttcgcttttaaccgatgatgattaccccgagttaagagccggttacacgaaatatccggtttgggtgaccgcctatgaccggtccgagagatgggccggtgggttttatagtgatcggagccgtggcgatgacggtttagctgtatggagtagtaggtaattaatttaaagtaaaaataattaatctaaagtttaaaattatttttcatagtaagtaatttttttttttggtttattaaggaataaatttgtggtttgttatatgggaacaggaacagagagatagagaacaaagacatagtgatgtggtacaacgttgggtttcatcacattccataccaagaggattttccggttatgccaactcttcacggtggttttactcttcggccttcaaatttcttcgataacgatcctttgattgggtaaatacggtcttagacaaacaaactgatggcttatgtattgattgacttatgttacgtcaaacatatgatcattgaaaaaacaatttttagccttgtgactaagttattaatttgattttgattattatgtcttgaatgtattaatttcttatgttttgaatggtttagttaattagctttgatgctttttttggttcaatacttgtgattcacttatttctcaattttcaagttggtcgtgccatcggcaaaatcctttcattgtaacaccaaaacgtcgataaatttaatgaaatttggttaaattagaatcgacccacacggttgtatgagtttgttggtatattttattattctaattattattatttcttttttttaaaaaataaataagaagatgatttaattaaactatagtttaaaattttatctataacaatactatataatatatgagttgaaccgattaaatgtgatattggtttttgtaatagtaaaaaataataaaaatgttaaaaatgataatagtagcgataatattatataactaactaaaaatattttctattattttttcctaaaaaaactttttttaactgtaacaaatttttaaatttactcaattttatcgtaaaaatagaaaatggcacgttgtacggatcctaatcaaactatactttgtttttttttgtgtgtatgtgaaaatcatggttttaagttcgttaaattcgcatactttccagatgtccggttcaaccgatctaaccgaaaccaagcaagaacgaaatgggctttaaagcccagtgaaccaatcaatgaatgtagaggaacgagagtttttctgaactctgttaaatttcgtttgcgtcttctttccattctctgaattccttccatatctctctctgtgtgtcttctacaaagaccagatctctcatctgtgttttgttggtttatctcgaccaaagcccacacgtcacgttacgttaggttacaaaacaagttttttcccttataaaaaaaacattgataaaatcgaaaaatcaattcctattttgtttccaaagcaaatctatatatctattacccatctcgaattcgaccgaacccatgttctaatctccttcgcaacattggaaatctattttaaaaatccgttgagatatagttatataagtagtttggtgactcaattaggtttacacacaaagacatg

SEQ ID NO: 21976 - DNA, 3003 bp, Unknown; identical to SEQ ID NO: 21975
  misc_feature (1)..( 3003): 2750-1469P.txt file - cDNA_ID_2041030; gDNA_ID_2926162; Annot_ID_198829

SEQ ID NO: 21977 - DNA, 3000 bp, Unknown; identical to SEQ ID NO: 6481
  misc_feature (1)..( 3000): 2750-1469P.txt file - cDNA_ID_2041104; gDNA_ID_1621094; Annot_ID_170845

SEQ ID NO: 21978 - DNA, 3000 bp, Unknown; identical to SEQ ID NO: 6481
  misc_feature (1)..( 3000): 2750-1469P.txt file - cDNA_ID_2041104; gDNA_ID_2926160; Annot_ID_198724

SEQ ID NO: 21979 - DNA, 3003 bp, Unknown
  misc_feature (1)..( 3003): 2750-1469P.txt file - cDNA_ID_2041162; gDNA_ID_1621095; Annot_ID_170972
gttatataaaactgtggattttcttacttccttataagaaatgatcggatgtttttttgtatatatagttgtatactacctgtaaaatatattgaaatttttttaaaaaatgatgaatgatatctcgtaaatatttacttgatcaaatctctatacataatcaaatatttttagttaactctgtcttttgataacatttaagcgacaaaaaaatattgagaatgtttgcttcttgagaataagttgatgacgtttactcctagcttagtaaatttccgtgtcttactttttgcatttttcccaaaaaaattagacatggaccagtttttaggacaagcttatttggaggcaaagttatcatttcgactgatattggattgaacatggagatcgcaaagacaaatcatattcccggtatgccgaagagcttagagcggttatttggggcaaccaacttgtttgtgaataaggatactcataaacatgcccgcagcttgacaaaccagtttttaggttcgcaagctttaaaattaaggatgattcaagacatcgatttcttggctcgcacacacatgaaggaaggagctaggaaaggctgccttgacgtcaaggaaactgcaagcaaggtaaaaaaaaagtcaatccattttttacagtttttgtaactcataacaagattacattctctcgtttaattaacaaatcatcctatcaaatacatcaaacattacagatcgttattgaatgtctttcgaagaaagtaatgggagagatggaaccagaggcagcaaaggaactcacactctgttggacatttttcccaagggattggtttcgattcgcttggaatttcccggggactggtgtctatcgcatagtgaaggtgcatatttttcgatcatctagctttaatatatgtatagtactgatcaatatgcatgcataggatttgggtggaaaaatagatgcgtgcgttgtgttttgatgtttgtctcaaatagcaatgaccgaagtgcccaaagctagtttaaaacattactacacaaaatcgccatgcttttatttctttttcaatctttttcaataacattccctgagggctttcatatattcttgaactgagcatgtattttttataggcaagaaatcgtatgatgaaggttataaaggagacagtagttaaaaaaagagcatcaggaaagaaattgggggagtttttcgagaccatctttggagatacggaaagtgtaactatgagcatagagattgcgactgagtacatatttactctgtttgtgcttgctaacgaaacaacaccaggggtccttgcggcaacaataaagctcataagtgataaccctaaagtcatgcaggagttacggagagaacatgaaggaatcgtccaagataagattaagaaggatgagacagctgacctaacttgggaagactacaaatcaatgacttttacccagatggtgagtatcccaacgaaaccatatattataacttaacaaggatgcaaatatattaattaacatgcaaatatattattagatacgtaacttcctaaatataataatgacgacttacctaccgtttacttcctcgcaaatgaataagaaagaaaaatgcacgtttaatacttacttataggcatgccattatcaaccaaattaatttaaataataaacttagcaataatgcataaatatatatttagtaagaaaaagttataaaatatacaagtaatatacttgtttttatttttataacgaaaatatgagctatttatttataaatgagagtttaaagtcagaagtacatgcacttccaatgtattccgttttggtttaggtgataaatgagtcgcttaggatcacaagcacggtaccaacggtgcttagaataattgatcatgagatccaatttggtgattatacaattccggctggttggatctttatgggttatccttatgtgcatttcaatccagagaagtatgatgaccctttagcttttaatccatggcgctggaaggtgattttaatttgatgttcatcttttattttatttttacttacactaatcaaatttttaggaatttaagcatgcatatattaaactaaaatttcagggaaaagacttgagcacgatcgtctccaagacttaccttccctttggctctggtactagactatgtgtgggagctgaattcgttaagttgcaaatggccatttttatccatcatttgtttagatacaggttcgttttttctcatttaatgactctacgattcaagccaagtttaactgcactcaaagtttttttttacttacgtttattacctatggtgtgaaggtggtcaatgaaggcagagactactttacttcgaagatttatacttgtgcttccacgtggatctgatgttcaaatctcataagacaccaaacaggataactctgtatagtgttatgagagaataataaaattcagtttctatacctttcactctttctccttataacttttcatgtagttttggtatcatagccaatttcgatttttctagtatttgctttataaaaaatatatgttattgaaagaaagaaataaaaattgttaactgcacaaagtattgtagaataaaatacctgagcacacgtaccaaatttaataatatatagccaactacgcatatcttatattatataaatcagatgcatgtccacataaaaatagatattacaagagaagtataaaaaattcctccgtctgaccccatccacataaaaacacaacgtgctaattacacgttatagaacaatacaaaataatagaggtctcagcgagccaacaaacctaaatcatgcaaataatcttaaaatatatactaatcgacaagagagctcactagtatacaaagagagagagtgcctccctcagttatcctaaatcaatatctccaaaaagagttagaaagaaaaaaaataacttaagatg

SEQ ID NO: 21980 - DNA, 3003 bp, Unknown; identical to SEQ ID NO: 21979
  misc_feature (1)..( 3003): 2750-1469P.txt file - cDNA_ID_2041162; gDNA_ID_2926163; Annot_ID_198913

SEQ ID NO: 21981 - DNA, 3003 bp, Unknown
  misc_feature (1)..( 3003): 2750-1469P.txt file - cDNA_ID_2041166; gDNA_ID_1621095; Annot_ID_170971
atcttgacttcatctggtttgtaatttaacgacttgccaattcacctattgcccatgatctaattctttaaaccaccagaagttgtattgaactgattgatctattttttattttttttttttttgaatatttggaagttcgggcccaaagaccctatgtttctcagagacggaacccatagtagattaaattcatctcttttatagagagattccttccaacgtgaaaccattcctgaattgcttagaatcttttctaaattttgtaaactcttttctaaatttcagtttttttggcaggaaaatttgagagtagttttctacggaaaacttttggtgttaccagaaatgtttttgcgaaaaacttttaacgaaaaaattttgggcaagaaaatattgtcaggaatttttggtgataaatttacgtaattttttaaattttaattttaatattaaaaataaaataattatttaaatactatttttgtgcaaaaaaaacttttaagtactatttgtgaaaatttctcattttcaaattgccttaggattttatgtttctagccttctaggcccttttcggttatgtctatcaaactcaaagacaaaggaattaattggtcggccaagggacctttggttttggagttaatcttgaatatgattatatgaaatatgtcttaatatgattatatgaaatatgttaatcttgaatccaataaacgtccgagctgtggaaacctccagttaaaagatgaaatacaccaattttctcctttttcgcaaatctccctaagctcttttaaaaaaatctcaatccacgttttatccatattgtggaactgtgaacccaaaaaaaaaaatctgtattgtgaaaaacatcattaatgatacaaactacatcatattcactaattaaatcttgtaaatgtgatgcaaaaaatcatattttacataaattacaagtggtttgtaccatcctactatattatttgggaagtatattttaaatataaccttaatttctgtaattaattacatgacaatgtcattagaaaaatttaatcaaaaacaaaatcgtttaatgacgtcattaacaaaatcatttaatgacaatatttatttcttaattatagggcttattggatctaaagacggatcatcaaagattttctaaactgaagcaaaatatagtgaatattcaaatatctatctgttactaaatgataaacaaataagttaataagtcaataactatttagagtgacgggtttttgaatcaacattaataaaaaaaagtaaaatataattaatccaccgtttcaatacgagttaaatcattaatttattaaacatatcaaatcaataatatttttaaaatattattaatatgttgttttaataagagttaaaacttcagttttttaacaattgtctcatgtattcgtcgtataacgttacttaataacaattataaactgtaaaatataaatattttataaaaaataaaatttgtaagttttaatatatattacctttaaaaaataaattgtcctgcggtgtaccgcaggttaaaatctagttggggtataaatcgggaggatgatgtttaggccaatttttataaaacaagtgtcctgagtcttattgtatacaataggagtgtcaaaatgggtcaaaattcatgagtcaactcaactcaactcaacccatgaatcctaataagttgaaatttttgactcaaatgagttgatgggtcaaatgagttattgagtcaattggtttgatgagtaaaatgagttgagttgtaatggttaatggtttcagtggtttacccaattaacccattatattttgtaaaattgaattaaaccaactaaaatctctaaaccaatatcaatttaagtttaaccaacacatgtaaaccaatttaatacaatcattatttttccaaatttcttaaatatacaagcgatgaaattaagaaaaaataaaccggtgatttttccacaaaaaaacataaatccgttattttcccgccaaaaacgtaaacccatgattttcccgccaaaaacgtaaacccgtaattttcctgccaaaaacctaaacccgtaattttcccgccaaaaacgtaaacccgtgattttccgccaaaaacgtaaatccgtgattttcccgcaaaaacgtaaatccgtgattttcccgcaaaaaacgtaaacccgtgattttcccgccaaaaacgaaaaacccgtgattttcccgccaaaaacgtaaacccgtaattttctcgccaaaaacttaaacccataatcttcccgcaaaaaatgtaaacccgtgatttttctgctaaaaaagtaaacccgtaatttttccgccgaaaacgtaaactcgtaaaaagtgaaatccgtaaatatcctaagtttgatgatagtgaattaataattattaataatggtaattatttattattgtttaataataatatgaattaaattattacttaaatgggttaacccatttaacaactcaacccattttgtaaatgagttgggtacaaaatgagttgggtcaacccataactcatttaaccttaaactcatttgattatgagttgagttgagttgggttacccattttaacatccctagtatacaacttggttttaaagttactcataaacatgatcgtgacacatgtcaaatgtttatataaatatttttaacaaaaagatatatatactaatttaaaaataaattaaattttctttcccataatccaaaaacgaaaatgtataaaatattaaaaatgtataacgaaaaacaaaaactaacaaaacaatatataattaattttatattaatggttataattaatcaacgacttgccaattcacctacgtactactagttaatcgaccagagagctagactagtataaaagagatagtgcctccctcataatttttatatccaaaagactaggaaaaagaaaataacttaacatatg

SEQ ID NO: 21982 - DNA, 3003 bp, Unknown; identical to SEQ ID NO: 21981
  misc_feature (1)..( 3003): 2750-1469P.txt file - cDNA_ID_2041166; gDNA_ID_2926163; Annot_ID_198912

SEQ ID NO: 21983 - DNA, 3003 bp, Unknown; identical to SEQ ID NO: 18214
  misc_feature (1)..( 3003): 2750-1469P.txt file - cDNA_ID_2041353; gDNA_ID_1621108; Annot_ID_171667

SEQ ID NO: 21984 - DNA, 3003 bp, Unknown; identical to SEQ ID NO: 18214
  misc_feature (1)..( 3003): 2750-1469P.txt file - cDNA_ID_2041353; gDNA_ID_2926207; Annot_ID_202323

SEQ ID NO: 21985 - DNA, 3003 bp, Unknown; identical to SEQ ID NO: 18216
  misc_feature (1)..( 3003): 2750-1469P.txt file - cDNA_ID_2041364; gDNA_ID_1620619; Annot_ID_162214

SEQ ID NO: 21986 - DNA, 3003 bp, Unknown
  misc_feature (1)..( 3003): 2750-1469P.txt file - cDNA_ID_2041423; gDNA_ID_2936554; Annot_ID_194181
ttaagttctcactccttctgtatccatttcatctcatctttctttgctggtttaatattaccaaagctgctttcagaaaacgaagaagcagagtacaacaactggactcaggacctgcaataacatattggcaatgacaaaggtgaaaaacagagccatattttcttacctctttatgtcccttgctttctaggtaacttgtatatatctgtttaataaatcaagggtgttagccaatatgactgtttggtatgttacagggattgcatgcaaaagcgccttcatttatcggaaacaccagtgttactctttcttggaaagaacccacgaaagtgacgaaaccgttagcctctacaacgactgggtacaagccaaatcaactttgttagttttgcaggtttcttttcttgttttgcaaatgtggaaaaactaatgtttgtacgtttcatgtggctctaccacagaggaaaacggcctgcaaatggagccggtaataacgtgggtgcaaaaaaggctcgtgtgcagaatcaacaacaggttgtgaacaaaagatctgagggaatctcacacggtggtggtagaggcagtcacagaggccgaggccggggccaaggtcagggaagacacagtggtggtggtggcggccgtggccgtggaagaagaggcttctggtaatttcaaaggattctccatgacactcttttttgtctgttcttgtataacagagtatgtttatccttcttgttttggctcttttaggctcctaacattcgacaaacaaattaatctcttttgcgatttctttggcttctcctttatatgacaaattctttgttttcttttctctttaactaccctttctgggaagtcaactgtcctaaactcataatgcaatagtcagaaatgattaatgccaaagtaacagtaaaaaatattaatttataaataaccccttcaaccttctctgtatttatcaacttaatgtcactccatgttatatattcgacaatgtaactctgtgtttcaacgcccatgcatccttccaatggcacaacttgttctgtccctgacttctctctttctagcctctaatctttaaatgatctcatgaaactggtgtgtaacttcctacagaatccaacgaagccaagcccagagctattaaagagacttggtgagtacgtaacatgatggtgattctgttttgtggtttctgcagatatatgaccttcttcggattatttttcaatctgcagaagcaagtgtggaaacagatcatgcttctcacattaattcctttcctcattgtgaaactttcagagctattcgattcacgatcttggagacactattgttctaatgacgctgatggctgatagtttccacttctgcaactcttttgcttttggctctttcggtatacatatgtacataactttatagctttactgaattaagttcaagattttgtgtctaatctttgacatattatgaatctctgaagcttttggatacgagtggactaaagaatagcttggataagcgaggatttagctcatgtccgaagtgaaaaagaaactgcagagagatattcgcttgaacgcattctgcaagatggacaactcactagggaaagcttgaaaaagtaaaccactgatcgattgttttgctctggttcttgctttggtttttaatagaaaactaactgactttttacaggctaagggaatcacttgcgctgtaagtttttaaaagaagaacattctttctgttccattgctcttactggttctcggtttttaactttcaagagactaaaaactgctgtgtaggcggcagctgttgctccgagtctgaaggtgggaaagcagaacaaaagtgttggttagaaacataaataacgctttgtctagaaacctaaagaacgctttgtctcttcacttctgtgccaaaaaaagaaaagcaagaaacagcatctctcacattttcacaggtacacataatcattgattcaatcttggttctttagattttttctttctttctttcttgttgctgaatcttgaagttttcgggttcagatctacagggatgttacattcaacaatttgatggggatgtcgagaatcttagtgatagtgtacgccaaaagattgacatggaattgttcaacagagaaaatcttgattttgtttccctgcttcttcctttgtatcatatcccttcaatcattgtctttactacatttcaatgtctcacattgtaaaaggaaaaatgtacagagaagataaaatcttttgacatcgatacatagttatctttctatgcaagtaactctggtacagtccttgttctactaaacaagtatacaagttgtattttctagttccataactctgataaaacaaaattggccttggtgtctacattgacgtttaaagttgtataatgaacattattgatacacatattaaactagaaaattagaagtttgttcaaacgattttaaaagtcaatataatagtcaccaaccaatcatagatgcataattaaagaggtgtcaattcacgttcttctaaaatccagcctcagcttcatcaattttataattttaccaacctcaacaagtatttatttattctaatatatgataataaacctcgagggatattatgataaaactatataataatcaccggcttataataattagaaaggtggaccatttccgttttttaaaatcagactcaataaatgtgaaagtccagtgtttcaatattttaacctcagtttcatcaattttatataccttattgtctttcattattcttttacgtaaaacccttccaaaaatcatgttacattgcttaatttatgtgtgtgtgtgtcagtgtattgcttaatttatgtgtgtgtcagtgtatataaatatatgcagcgtaagaagagaaggatcagaccaaaactattgacttaaaacactgtttcaagtttacttccatg

SEQ ID NO: 21987 - DNA, 3003 bp, Unknown; identical to SEQ ID NO: 21986
  misc_feature (1)..( 3003): 2750-1469P.txt file - cDNA_ID_2041423; gDNA_ID_1620819; Annot_ID_169380

SEQ ID NO: 21988 - DNA, 3003 bp, Unknown
  misc_feature (1)..( 3003): 2750-1469P.txt file - cDNA_ID_2041439; gDNA_ID_2684234; Annot_ID_192359
agaccactacttcagtggtaccaagaggtggccccatttatctgccaaacatggttggaaatatttctaccacccctgaattcaagtcttcatttctcaatgtactacaggatttggaaactcatttatctctggactctacttcttcttcttctcagcagtttgatgtctcgtatgtattcttgcatcaattggctctctttttcatcagttaaaatctggttttttcaatacattaagttatttaattgggatgatttttgtttgatgcagaattgattctctcaagatttatacggatgaggaactcacagagatggctatgaaggaagcctttccggtacgttgcctaatcgtttgttgatttacttctcttcttctgctgtctttcaagtgtgagaacttgtgtcttgatgagtttggtttcttatttcattacaggaagattacctttcccaagaggagctcgaaccatctttaaacgtttctcatcagtaagtatcattaccagcctttcgttatttcttgatataatgtttccccttgtgtgaatccttagtaaaaacgaattggcatgtagcttctttctattagtgtgcttcgatggttgttaagttttttgtttacagtctcaattggttctggttcagccgtgcagccgtgctagctcccaatatatttcgaaagtcttgtagacaatatatatgttaatagcttagtcatgattagaaatcttccagagacaaagtatggttgacgtagacaattgtagaacgataacaaacagttaccttctcggtatgctgcagtgaaaatccattagctgggagggcaaaaaggaagaggacagtaaagaataccgaggtaaagaagaggacactaaagaatactgaggtaatgaagatgacagaaaagaagactgaggtgagtttatgtaacatggtcttggcatggctgggaattactatcttttcttttccagaggctatttgtgtttaggatctcttgataccaaatttacatggtcttgccatgatggctttattgcattttgttatgattgatatggtcatttttttgtttttaggaagcttatcttgtgaaagtcgagcagcttgctaaactcaaacaaaagcaggaggaggataaagcagctgtgacactgcactgcttcaggtctgtaattactattgcatagtctggtttgctgtgtaccttgtctgttttatgctgatgtttcttcgatttgaacttgttttcagcaagaccagtgagactggtaaagatgtagttgcacctccagaaggttttgagcagatgcaatctcttaggttcatagataataattacacggcaagtgatttccccttgcaatgtctttttagtgttgattatgctagtccaagttctaaagtgctcatgcatcctgctaagtattatcttcttcctatttaaacagaagttgaagccatctgacatccagggacaagtggatccgctatttcctgaagtcattttgtgtgttgagatttataacagtcgcaaggttaaggtactgtattgttctgtaaatctttgatgcgggatatagaatattgactgaattctcgtacatactaacaatacttgtgtaaatttttgttcagacccaagaatttttggttctaggacgtcaaatgttgactgagttgaaggacaatattcactgtgctacagaccaggtgatgcaaaaggctggaaagtatgatccctctggatacttcctcatagaagtaagaattcatctcgtttctgtatcttttgatgtttaagtaagtttaacttctgcgtcgctggtttaatcagatgctttttgctcgtctaggatgtctttcacaatgatttaaggaatccctcggctaaagattacagctatcctattttagattggctttggaactcgaaagatgaagctcttaaaaaatgggaatgtgttttaaccggcgaattacagaaaaagcagaaactggttctaggtgaagcgaaatctgtggatttacctcgttacagaactgcagacatgcagagtacacacttctgtgatataagattcagagtcggagctagttatgtctattgtcatcaggtaaaatcttctctctttctcttttggttctttaatttctcatcttgtgaaaacatttggcacagactcgagatattcactgattaaaaaccgtggaacagggagattgcaagcacacgattgtgattcgagacatgaggatgagtcatccagaggacgttcagaacagagcagcttacccgatcatgttctggccgaaacgtaggattcagaaatgcggtgtttgtaagataaagagagcttcaaaggttgcagtggatgacaagtgggcaagcgagaacagtagctatttctgtgatgtttgttttgagcttctacactcagaggaaggcccacttaactgtgacttcccagtgtttgattatgtgcatgagtaaagatgatcttctttgttgcataatatatagataggaagaatacgaagaaatagttggcattgcaagaagaagacatgatgagtcttgtcttggtaaatttgttgcataattggatatatataaaagattttcttgaaatgatgacatgacaactatttctgaatttagccattgtcaaaagctctcttcgttttgaagcggtagaaaattagaaatgtttatgtttagccaaattcaaaagtagaggagattccttgaatttctgttttctctcgctgtcttctcaatattcaaaactcaaattggtgtcttctccaatttagaaaacgttaaaaacaagagaaaataaaactaaactttttagaaccaaaaaaaataaaaataaaacgcatttgggatttctcattgtcatcccaagttcttggaacagccaaatactttttcattattagtttataatcgtctcataaaggcaaaaaggtttatttcggaaataagatg

SEQ ID NO: 21989 - DNA, 3003 bp, Unknown; identical to SEQ ID NO: 21988
  misc_feature (1)..( 3003): 2750-1469P.txt file - cDNA_ID_2041439; gDNA_ID_1620819; Annot_ID_169414

SEQ ID NO: 21990 - DNA, 3003 bp, Unknown; identical to SEQ ID NO: 21988
  misc_feature (1)..( 3003): 2750-1469P.txt file - cDNA_ID_2041439; gDNA_ID_2684234; Annot_ID_137673

SEQ ID NO: 21991 - DNA, 3003 bp, Unknown
  misc_feature (1)..( 3003): 2750-1469P.txt file - cDNA_ID_2041443; gDNA_ID_1620819; Annot_ID_169413
ccacacaaaaatagttccaaaaagttgggagcatgtactattttggattagcatgacctgttcaagtctagctccatagactttctctattttggtttcacccttcttacaaaaacacatatgaataattgattttaatgtataagcacgtggaaattatgtagtttgttgttaatctaaacacctaccacgcaattagctctgtagtatgtgtgatacgtattacagtggataaatgttttttgcttcatgttgaaaattttgtgagaagaaaccaaaagatctttggctctttcttatgtaactcttcccctgtcttattgcttgtgtgtaactcttcctttaacttcttcttcttcttgatgcttttgcttgagtaacaagtttgattgttgaaaacctaggatcatctaaataaatacagagaagccttattgatgatttctcaacttatagttcttttctttggttctgttcacagctgaatttttgggttttccgcttgtgcctcctttttacggatctcaaaatgcaaattttgagaaaggagttaattttgcggttggaggagcaacggcactggaacgttcctttcttgaagagagaggcattcattttccttacaccaacgttagtttagccgtacagcttagtagcttcaaggagagtttgcctaacttatgtgtctctccttcaggtttggaagatctactttgcctaacttatgtgtttcctgttttacatgataagaacatcaaatctgatttcttaggctcccatcatatcgtactaaaagttatgaaatgttccacttcaccttaatattagcctcatggactagtatttgaaaggcaatgattggagcatttttgattattcttttaaaggttctagctatagacctagtattcatcttttggttaagaagtagaaagtcaaaacaaaagtgggaaaaaggttctgttttgagatgtgcttagagatcctacccgttattctgttaaactccaacacgcaatgaatcaagctcacttgtaaaacaatggcttactttggaatcttgtttttttagactgcagagatatgatagaaaattctttgattctcatgggagaaattggagggaatgactataactacgcattctttgtgggcaaaaacattgaagagatcaaagagctggttccgcttgttattgaaactatctcttctgcaatcacggtaaacacttctcttttgaatatagcagtccaactaaatattaatatttgaaagcataaaatatacaggagttgattggtatgggggggaaaacatttctggtgcccggagagttcccgctcggatgctcagtagcctatttgagtttatatcaaacatcaaacatagaagaatatgatcctctaacaggatgtttgaaatggctgaacaagttttcagaataccacgacgagcagcttcaagcagaactcaacagacttcagaagttgtaccctcatgtcaacatcatatacgctgactactacaacacactgttgcgtcttgcccaagaaccagccaaattcggttagactttttcatccttctactaaacccaaacaaagaatttcattgattaactgtttctaattatcaaatcagggttcataagcagacccttgccggcttgctgcgctttaggaggaccgtttaacttcacattaggtaggaaacgtgggactcaagtacctgaatgttgtgacgatccttcaaagtatgtgagttgggatggtgttcatatgactgaagctgcatatagattgatggctgagggtatacttaagggaccttatgcgattcctcctttcgattggtcttgcctcagctctgaaattaagaacacacagaattctttgatgaacaactgatgtatgttggtcaaaaatttgagacaagaatactgataatatcatgtatgttcctcagtcctgaacatttggtcatttggatcatgtgttgtgtgttactgtgtttgacaatctgtattgttgttatggtaaataacggttgtgttgtatcacacactataacaggtttacgtttacctaaacatattaagttataattaatgggccacaggcccatattatataatgtagttgggttttgttgacttgaacggctccagtaaattaccggtctgatgattgattgacgaataaagcgaataaaccatcggttatacaatttaaccgggtttatgacaacttcagagaccttatatcagatttcaaatcttcttcttcttctccgcgacgacgacgagcttcttcgattgatgactgtaataatctttcaagtttaattgcatcgcataaagataaagcccaatcctttattcttctaaaaccctaatttagcgtttcgagaagccgcaaaattgagttttgttatttcaaaaaatcgaaacctaaaacctcaattctctgggaatttcaaattctcttttcagtgtaatcgtcgtctcttctcaattcgacctaccgagtaagtttatcttcttccatttaagttaaattttgactctttccagcatccatggtctcactgtgcttctctttccttcacctcttcattgggagctttgaatagcgttttaatctatgtttaatatagtaatgtcattgacactgtgaatgatgctgatggttgttcttgtatgtgcacatgaattgtatttctgcgtatcacttgcattactgacgttaatctagtttatcaatcaaattctaattcagtgattttattgacttgcaattctttgccaatgtattgttgaccattttctttcttgatccattcatgtgcacgtttaagaacatccttgtaaggtcatgctttgtgatttacctttcttctgttatgccttgtaagtaagtatagttttttttggtacttttgttcacaggctgtagtacgtttgctgctatcagaaagagataatcaagaagcagaaataaaatg

SEQ ID NO: 21992 - DNA, 3003 bp, Unknown
  misc_feature (1)..( 3003): 2750-1469P.txt file - cDNA_ID_2041449; gDNA_ID_1620819; Annot_ID_169411
tctacctaaaaattgattattgttttcttgtctcctagcgaatagaaaagagaaggagtacaaccttccggcctctcccatggcatctttagattctcttccggcgatgaagctcgtgagattcatattatctacccttttggtcacttctgtgaactcgcaaacgcaatgccggaatttcaaatcaatcattagtttcggagattcaattgctgacactggaaacttgcttggtctctcggatcctaacgatcttcctgcttccgcgtttccgccatacggagaaaccttcttccaccacccaaccggtcgttactccgacggccgcctcatcattgatttcattggtacgtttatttacataaggtgtgagtgtagaaaaaaagagctattaattattattaattacccttactctcttttttcattctatattagctttcttgaatagcaagtttgattgtataaaacctaaaaccatctacatacaaccatattaagtgttgttgagcctccttattggttcctcaacttacagctctctcttgtttttttttttcggttatgttcacagctgaattcttggggtttccgcttgtgcctcctttttatggatgtcaaaatgcaaactttaaaaagggagttaatttcgcggtcgcgggagcaactgcattagaaccttcctttctagaggagagaggaattcattctactatcaccaacgtcagtctaagcgttcagcttaggagcttcacggaaagtttacctaacttatgtggctcaccttcaggttgggaagctcaactttttcttctctgtttttggtgtttcatgttttatatgatcaaactatcaaaatttgattttcttatatgcttatattgctataagttgtaatactttattttgctgttttgtatttagattgtagagatatgattgaaaatgctttgatactcatgggagagatcggaggaaatgattataattttgcactcttccaacgcaaacccgttaaggaagttgaagagctggtaccgtttgtgatcgctactatttcttctgcaatcacggtaaacattcttgatcagccagttccgggaatgactaaaacatatttgtatctacgctgataattagtttggtaagaaaaaacacatgtacatgttacgttgttttgaaactgaatgttgaattcaggaattggtttgcatgggaggaagaacattcctagttcctggaaatttcccgatcggatactcagcatcctatttgacattatacaaaacatcaaacaaggaagagtatgatcctctaacaggatgtttgaaatggcttaacgatttctcagaatactacaataagcagcttcaggaagaactcaacggactcaggaagttgtaccctcatgtcaacatcatatatgctgattactacaacgctttgttgcgccttttccaagaaccagccaaattcggttaggcttcttgaatcctccaagagatttcttcacaaccaagtcactcatttgattcactaattaattaaccgattttattatccaatcagggtttatgaacagacccttgcccgcttgttgcggtgtaggaggatcttacaacttcaactttagtagaagatgtgggagtgtaggagttgaatactgcgatgatccttcacagtatgtgaattatgatggcattcatatgacggaggcggcatacagattgatatctgagggcttactcaagggaccgtatgctattcctcctttcaagtggtcttgcctcagctccgagattatgaataagatgtcattagatactcagattcttgatgaacagctactacaaggttgtctgaaagtttgagagacaagagaaagagtggaaaaaacatataggttcttaagtgtttgtgtcttcttcttttttgttccgggtaacggtgttaattagccttaggtgcatcatgcatgtgttggatcatgtattatctttgtattgtattgttttcgttagtttgggtaagagttagtatccttaattgttggaccatgtacactgtcatatataatttaactatatacaaaacaattaaatgcataatttacgcatcgcgtggccaaatttctagaatcaaatatggttttatggtaagaaatcagaacactatgtaaatttgattaacgatgggactaattcagaaaaataaataaatactaagtctaaagaaatagttgggaactggcggaaaaaaaaaagttggagagtctttaggtctaaacacatgttacatgtataaaaggaatttaacaaggttgtatacgtagttacgtacattaggtgtttctctgttcgtgtgtacaaccgcatatttttaatctttggatcatatagtgttgatgaatgtgtacatcaactattggagatataatgtattatgctgtatacgtacaacagaatgttccaaaaatctttcttcttttttttattttattttaaatcggccccaatggtgctataataaacgagaaagccaaaaatactacaaataaaagcctcagtgatgggtttatcgtttaagcgaaagtgacgaaagagaggaaactagacagatacgacagtaagttttggtcatcgaagatacgtattgggatccgctcacaagaatttgttgtgtgtctttttgctaaaaggccaatacgaaaatcgttgataattcgtttcatctaccgcaatcactttatccttgaccaaaaaaagaaagaaataactcaaatatcaattttataatcaaataaaaacttaaataatcaaccaatatacccgtgtgtgtcaaaccatactgcatcccaataattgatcttttaatcattctttattatcttatccttggtattgtggctagtggggtattttcaaaagacttttttgacaaatcaacatcacactattaaaaaagggatctcgacggagaccaaccttcagctctctggcaatg

SEQ ID NO: 21993 - DNA, 3003 bp, Unknown
  misc_feature (1)..( 3003): 2750-1469P.txt file - cDNA_ID_2041459; gDNA_ID_1620819; Annot_ID_169407
agttcgcttcttagacgtgccataagtttcaccgcttacggtttcagttgatgtttcgattctcgaatgtctatggttctatgtttattttttatttttaatggcataagaccatgttttatgagttacttgatgtaatacctaaactttcattttttgaaatgatatatacattcttattaaaatataataaaaaaatcttgatgtattattttaaagtaattttatcaatgaataagatccatttaacattaatgagcatgtgaaacttatctaacatacctttgaagcatattataatagttcatcctttatggttgtcttttacattaatctttttcctagtgatatctggacgaagacagatggtttcagtataagattcataaaatagttactttgatcaataaatttttcatttagaaaaaaaaattgctgacatatatattactcatcttttttcattagatatataaatatttatactcgcacccaaaaccaacatcgtactggtgctccttatagagttaaactcatggccattatctgcatgatctaaacaagagtgagtataaatacttagtgcgagcgaatatttccgtccatatgcaacacaaagcgatgaaccactaatttatatgtattttcaaccaatcaattatcatagcctagactacacatgcatattccttcaactagctacggttcactattctaggctatgataaattactatatcggcctaaagcataagtttgtgcacaaaaataaaattaataataattaacttgtgacctaaaaagcatataagtataactactatatttagctttatgaaccggccgggcctcccatctaatgtcgccttcaaagtttcatttgtggaagctcacatgttttctgatcactgtagccaccgaagtcttaggctcagagtctttccaacgttataaatcgatcatcagcttcggtgattcgatttcggacaccggaaactttcttcatctctccgacccaaatcatcttccccgatggccgcctcattatcgacttcattggtatgaacttctttttacaccatcccatattcgcagtttaaatcaaaacttcagaaatatttttcagtttttagtatgaataatcaagattcaacaagtgttcaaaaaaaaaaaaaaaaaaaaaaaaatcaagatccaattagtcaacttaatttgacagctgaattcttggggataccatatatttccccttactttggacataataatcaaagctttgagaatggaatcaacttcgcggtggctggagcaaccgcggtggagcctgaattgcttcaagagaaaggaattactgctaattacatgactaatgtaagcttgattgttcagctaagcatcttcaagaaaattttaccaaacctctgtggctttccttcaggtgattcctcacaaatctcaactcatcttggaacacaagggacaagcataagccaatctttacttgttttcaagattgcagagagattctcgaaaactcgctgtttattgttggtgagattggaggtaatgactataactacggattcttgattggaaaaagcatcccggagattaaaaaaaatagtcccccttgttatcaatgctatttgctcaacaattgtggtaataaaaatctttcttaaatcctgttcaatgatccttccctttttcttgttttgtttgggagactaagaattgaaccttgcaagcatgaacaacatggtacaggaattgttcaatttgggagccagaacgtttctagtgccaggaaagtttccaactggatgttctgctgcatatttaacgagatttaggacaacagatatgtaggactacgatgctttaaccggatgtttgaagtggcctaatgagttttctcagtaccacaatgagcagcttcagacagaactcaatagactccaaaaactctatcccattgctactatcagatacactgactactacgacattgtgttacatttttaccttgaaccgacgaaatatgttgccctttcttattccgtccccttaactaacatatatacagtattgtcacaattatttatattaccaaatttactcttttgaaggatttatggagagaccttcactgttgataagccatgtgggtctagaggagtgaaacattgtcgagttccttctgagtatgtgacgtgggacggttttcatttgaccgaagccgcctaccgatggattgctaagagcttgcttaatggaccacttgcgtctattgctttggccgctcctgcattttcctttttaagctgatctacggacatagatcactttcccttgagcacttgggacctgttgctgcgagtaaactaaaatcacgttcttcgtttaatcacattgattgtttttttttttttttgttggtttctctttactttgttttcaaattaatacacaatctcttgcttgtacaacaagtttatgggagtaaatctttaaactaatttttatttgtttataaaaattttctgaataattttctctctaagaatgtaattttttttattttttttgataaaaataaatgttgatatattaaaatagccatactagattatgatttgcagtggaacccaagcaagtataaatcatggtagataatccgtaactagctcgtaaataacctgcaaataacttatcactcatgaataacatgaaaataatctgtagatattttctagaggttggttagaacttagaagtccacctacccatcttaaaacgatacaaatacaaaattttctagtccataaaaagttttgtagtcttggcccaccattatttataaggcaacaacaaaatcattgagacatatactcaccagtcctttcttttgttgtttacgaaaaaacgaaacaagatgttttgtaaaataatataacattctaaaagccgaaagataaaaatttcaccgcggacttctcgtatg

SEQ ID NO: 21994 - DNA, 3003 bp, Unknown
  misc_feature (1)..( 3003): 2750-1469P.txt file - cDNA_ID_2041489; gDNA_ID_1620819; Annot_ID_169399
ttcttactggcataataaatgaaatccaataatggcctcatctcttgcattattcagtgatccaaaaagactttaaaaattgagtgacaaagacgaacgaagaccacgattagctcttcccatggcttcttcactgaagaagcttatctcaagctttctacttgtcttatactccaccaccatcattgttgcttcatcagaatctcgatgtaggcgttttaaatcgatcatcagctttggtgattccatcgcagacaccggaaattatctccatctctctgatgtcaatcaccttcctcaatccgcctttcttccttatggcgaaagcttcttccatcctccctccggtcgtgcctctaatggccgtctcatcatcgacttcattggtagctattttttcatctctataggcaaaaccacctgttatcatttgctctaagtctttcttacgtgaacagcaagttatacttcttcctgatctttttttcttatgttgtcttactatttgaacagccgaattcttgggactaccatacgtaccgccttactttggatcccaaaacgttagcttcgaacaagggatcaattttgcggtgtatggagcaaccgcattggaccgagcgtttcttttgggaaaaggaattgaatctgatttcaccaatgttagtttaagtgttcagcttgacaccttcaagcagattttgcctaacttatgcgcctcgtctactcgtggttagaaacttagccttgtcttgttttgttttttaacagaaacgtgcccttgttcttttctatgtctatggactatgatgatgagtctagctagcttggttctaacagggtttatttcgtttcttgtctagattgcaaagagatgcttggagactcgctgatactcatgggagagattggaggaaacgactataattacccattttttgaaggaaaaagtatcaatgaaatcaaagagcttgttcctctaatcgtcaaagctatttcttctgctattgtggtaacaaatcttaacattgccctccagtcacaataataatcacattatattttgtgttttatattttaaaaaattaacacaaaactacaggatttgattgatttagggggcaaaacatttttggtacccggaggcttcccaacaggatgttctgcggcgtatcttactctatttcagaccgtggcagaaaaagaccaggaccctttaacaggttgttacccattgctcaacgaatttggcgagcaccacaacgaacagctaaagacagaactcaagcgactccaaaaattctatcctcatgtcaacatcatttacgctgactaccacaactccttataccggttttatcaagaaccagctaaatacggtccgtgaaatttcaaactctgtcgttgaccctcacggattaattcattaacagatattttgtttgtctttttcaatagggtttaagaacaaacctttagctgcttgctgtggagtcggaggtaaatacaacttcactattggtaaggagtgtggatacgaaggagttaactattgtcaaaatccttctgagtatgtgaactgggatggttatcatttaaccgaagccgcctaccagaagatgactgagggtatactcaacggtccctatgcaactcctgctttcgactggtcctgccttggctctggtacagtggatacataaagggtattctttcagcagtaagaattcattcgttgtaaaaaatcaaagaggaagaaaattatgtgatgatgatgatgatgatgatgattaacaaaaacattgcttgtacggcaagacttgactaatgacaaaacttccgaggatatatggctatatgcatatatcttatcactgaaaaataccacacgcaaatagaaaatcctatatatacggttcgtagcactagttgcactctagttacaatgttgagaaaatctggaagtacgtataattttaagaccattctaagtttataaacagttccctggaagatgttggagaagttttggatgagttgagtgggacaaacgacagctaaggatttaaataatttcataacatccattgaactgaaagattaagaacataatatactatttgggacaacttacaatggatggatataacagatgagaacaagtgaggttcattgattacacattttggtcatttaattttgaaaaggttcaaaattctaaagtcttgctatttagagccagggttcctccggggtcacaaccagagacctattatataaaaaagaaaattatttaaaatttcttatttggattacactaaattaaaagtgattaagacgagagactagcccatttgtatccatgcataaacttaggtgtctttttatacgtggcactaaagtacgacttagccatctaatctaaagtggaagtttctgaagttacttcattgaacactcaatagtcattaataaacctgaccattttcctcaatttactaataggcgttgggataatacataaaatccaataactaatgcctcaaactctgcattagttaaagattctaaaaattgagtaatagagacgacaattctcctatggcttccctcatactatcgcgtgcgtcacatatctccataaccgtttcataattgttctctttctttttcactcattttataatggattagttaaagaatccatttatatgattataataagtaaggaaggccaaatagaaaaaagaaaaagcaacgaaggaatatttcgttattactagtttcacgaattctatcatcgaagaatccaatttcgtgatggagcctccaacttgtctgacgtttctgccgttaacttctttttctcatttctctctttcttactggcataataaatgaaatccaataattgccacatctcttgcattattcaatgatccaaaaagactttaaaaattgagtgacaaagacgaacgaagaccacgactagctcttcccatg

SEQ ID NO: 21995 - DNA, 3003 bp, Unknown
  misc_feature (1)..( 3003): 2750-1469P.txt file - cDNA_ID_2041493; gDNA_ID_1620819; Annot_ID_169398
tctgagcatacattggcacacatccatttccccagtagcctttaggcaaaggtggattcatcaatctccttatatttatcgaatacacaaatttcacattctccttttcctcagtctttgcagctcttaccctgaatttcgatattttattgtttcagatcaaacacatttcaaaaaatttgattgaatcaaacatagtgaagaagaggttacttactttgcacgccaaatgtaagcaccaagagcttcgaatgtggtgaaattcagacccgatttctcgagtaattgagccttcaattgatccaaagaatcgtcggtcacaaagaagcagtctcttttgacgtctccaatggcttgtccatatggatcaaagtccttatccaggctcaagaagtcacgaactggagctccaacccaaggcttctcccttggaccaagtaaacgttctctgtcccaaaccggttcgatcgaaatctttgtcgctccgcgagctaattccgccatagcgttgaagaacagactcgcacctaacccatcgcagatcgcatgatgaatcgatgcacctagaacccaaccaccacactgaaacatagtgacctggaggatacaaggattgaccattccttcctcccgggtcggatccggtaccaatctctcgacgaaacctggatcgggtccatccaaatacccgactgactcaagcgtacagttcactgtagcgttgactaaaggcacgctttgaccagcggagcagagtagttcaaatcggttatcggaggcagagcgacggagagagccagcaagagggtagtagtgaacgagagcggtggcaagagaggcggatacgacggcagaggggctttctccggcgacggtggaagaggaggaggagtagacgcggaggtaacggaagctgacgtggaggttgttatcattgtcgagatgggaaagagagagagtttggtcgttggagagtggttggtgagaaggttgaaccagggctatatcggtaatttcaagtgtcgccataccttaataataagaatggtatgggtctttgttacttccaaaataagttttggggtccatatttataagagaagcaaaatcaatgccttgaggggacacagctcacgagagtaggcttcaccaactaccaaacggtcaagtcccatgtccaaatttctcacctacaacagtttcaaacaaaatcattttagtctttttgttattcataccatacttcatacttgtcttcactgtttttatgatcgagttttgtatgagtcttttcaaaattcaatcatgcttcttgtcttcagtcttcactgtttttctcctccacaagattagtatttttttttctttttttgtgcgtaagatagagttgtggtcgaaaattgtaagaaaaagaatctagcgtcaataatacaattggtggaaagaccaattttgaatctgattagggaaaaatgttgactagtgaacaaaaatttcttggtaagaaactataatttttttttttcaaaattataaattagaagtcgagagctattggaagtcggtggaactaaatggttgattggttcattagtaaaacacacgtggtgccactacacttttttaatagttacttgactggtgctgtttgcaaagttattatgattgatgattatttttgaaagaaaattggaatataaattcggttaggtcagtattgtcatgtatttgttaaaccactgtatattatactcctagcttagtttaatttatgagatttaagtggaattcatactaatcaaatgtgagatttcttgaaaattgtagtggaatttcttcaaggtcgaataggattattaaagagatactataaaggagcaattggtgccgacaaaaaaaaataaaaataaaggagcagttggaatggtcagctagaatttcatactccctccgtctttttttacttgatgtttagcagaatacatacaaattaaaaaaaaaaaaaatttgtttatttctaaattaaaatatcatttattatttaatcaactacaatctaaaaaataaaaatcatcaaaatcaataaaaatataactaattctgcattaaaagtttaaaacatcatttattaaagaataaaaatataaagcttaaaacatcatttataaaagaatttagaaagtagtactaatataatcgttttttaaagtgagccaaaatagatgactttgacacaccaaccaaaagcctaaaaagtggaacatgtaggctttcaaggcaccgcggacaagatattgttaatcgcaacgtcattattattgatttcgattcgtccatctgtggaataatacgaatatcattattagagtatttactaatcaaatataaaattatgtagactataacgaatcatttttttcttcttccaaataggtaaatactctaagaaagatattcatattattccaaaatgaatgatagctatatttgatttctataataagattccacataaaaactgactccataaagatatagatcacgcagagtcgcagactatcgcgtgcgtcacactactcacacatctccataatcaattctttctttttcgctcgtcttgtaatggattagaatataggtaaagaatccatttatatgattataaaatggtaaggaatttgcgaaaacccaaaagaaaaaagcattgaaggaatatttcgtaatcccttattattttcacgatttctatcatcgaagaatccaattttttgatggagtctccaacttgtctgacatttctgaagttacttcgttttcaaccaataagcaaaatttctttttggaaaataacaaataaccaaattttataatttctctctttcttactggcataataaatgaaatccaataatggcctcatctcttgcattattcagtgatccaaaaagactttaaaaattgagtgacaaagacgaacgaagaccacgattagctcttcccatg

SEQ ID NO: 21996 - DNA, 3003 bp, Unknown
  misc_feature (1)..( 3003): 2750-1469P.txt file - cDNA_ID_2041497; gDNA_ID_1620819; Annot_ID_169396
tatataaattaactaaaacaacaatttcattttattttgttacaggaaaaagaattgaaaagcagtgattttctcatatattaggatttgatctgcagtagccgcatgataataattttgtgcatatacataaagtctttgacatttattttaaaattgtgcatattttacatattgaagtttgtatttaaaaatacttagttttataatcaagaaatcagtaatatcgctgataaatatgactaattggattaaatttgatatagtctatatatttgaagtgtgtaatttgtgaatatgaattttaagtaacatcataataactactgctctatataacattgtggaggttaaaatgtaagaaaggaaaatacagatagtataataactaaacaaaaagactaaacatcagaacaattggagatattttatagttctttttcaaagtattataatatttacataattatatagattattagaattattaattagttggactattatagatatcgttttttttttaattattgtgtgaaatttgatcattttaaactaccaacgatcccaaagatgatgcaagagaagagtctttgaccaaatgtaagagaaaaacgtgttttcgatgattgatggatatggagatcagaattaagaaaccctgatgaagcactcaaactcttcactataggatgaaggattccgtatagaacccaattacatatgtaacctttcttggagctctctcggcttacaactacatatgattagtgggtacctaaagcatggattgataaagtaaatatttataagattctctaatctctatagcaaatataataatatgttggcgtgatgataatcgtgagactaaagtaggaaacaaaaaccctagaacaaaagatgattcatgtgtgacgtattcgagaaggaaccttaaaaacgtttgtgatattcacattaaactggtgttatacatccaaatccggtaatataaatatagtgttgaattgttgtgtgaatcaaaagagagaaaatagggcacatgaaatagttgtgagtatatcctaataatccgaacaaaaaccaaaaacatatgacttcctacaataactcctccggcagtctcgccctggccgttgctcttctatttgccggcgccttatatatctacttctcatcacgttcagcttctgatcccatctccggtctcctacaaaatgtcaacactgtaagttgattcatataatatatatggaattctagagtacaaataaaggaagatttgaaatatattttgaaatggtacgtgacagagattgatacagtatccggtggacgagctagagacggtgctggacaaggcgtcgacagggaacaacaagacggtgataatagcaatggtgaacaaagcttacgtggaggaggatggaggagggaggacgatgctggatctgtttttggagagtttttgggaaggagaggggacacgcccgcttcttaaccatctgatggtggttgcagcggatcagacggcctacgatcgctgcctcttcaggaggctccattgctacaagatggatacggaaggggttgacttggagggagagaaagtatacatgtcaaaagatttcatagagatgatgtggaggaggactcgcttgctcctagacgtcctcagccgcggctaccatattattttcacggttaggtccgtcccttgattttgtaacatatataacaaaacacttaatttgttgctcaaacaagtagtgtatatacaatgttaggatacggacgtgatgtggctaaggagtcccttgtcccggctaaacgtgagcttggatatgcatataagcgtggacagaaataacgtgagaggacaattgatcaacacgggattctaccatgcccggtccaacaacaagaccatctccctcttccagaaatggtacgacatgaggctcaagtctttgggcatgaaggaacaagacgtcctcaagaatctcctagactctggcttctttaaccagcttggtctcaacgttggcttcctcagtacggccgaattcagcggtttctgccaagacagccctgacatgggggctgtcacaaccgtccacgccaactgttgcgtccacatccctgctaagatctctgatctcagtcttgctcttcgtgactggaaacgctacaaagcctcccgtgtcaacagcaggtggagcccccatgttgagtgcaggcgttcatggaaggacgttcattatgtccccaagctctgactttcttcgttcatataagcaaattaatgagattgctatatagtatacacaattacatcatttataagtgcatatcttcttttgattaatcctctagctagctagatgagcaattctcttttaacaagtaattacaaaacatcttatatgtgtgttacaagctatattctcgttttttattttttcttttaataatatagagattaatttactatgttagacaaatatgtttttgttacaatgattgtagaaaaaactacttggctaatctaattccgaaagagaggagggcaaaatggaaagaaattgagaatgatctcaattaaggtagaagagacatttatatcatttcttacctaatggcatatcatgtaagtaactaaaagttttgttaattttgatatgtagtaaatatatatgtacgtttattggattcatattaattcccttaggtaaacagaatgttacgtgaacgattgaaaatctcacagagtaaaaacacaaaaaccctaattacatgacgattcttatgtgatatattcgtgaaggaaggaaccttaaaaacgttagtggattttctatatacattattcacatatatccatcgtttatataaataaataaataggttaattgtttagtacaaaatcacgagagagagaaataaaaaaggcgtgagtctcctaactagctcctaataatgcgataaaccaaaaacatg

SEQ ID NO: 21997 - DNA, 3003 bp, Unknown
  misc_feature (1)..( 3003): 2750-1469P.txt file - cDNA_ID_2041505; gDNA_ID_1620819; Annot_ID_169394
ttaatgattgtacagtgaagagtggtatgttcttcttttcgtctgcattaagctccttatattttatcttgctgaaatgaaagggtattctatagttcttactttggtttagtactaaataaagatctgattttaagccacgttcttctttaactgagatcatctactatagaaaaaagtcaatgggggcattccgagaatcgaactcgggacctctcgcacccaaagcgagaatcataccactagaccaaatgccctgttgttgatttagttacattgaagcattgaagcattttattgtttgatcttgtggataagagaattcacactttactctatttttagggaaatctacttttggttgttctattcttgatgaagctagcaacatgcaataagttcaaaattttctatatttatattggaatctgacgttagaatgctgaatgttctcttgtttgaaaaatctgacgttttagatctagttctatcagttgactttcagggcttaatagtaaaggtggacactgtactttaatagatgaaatgttagctggttaaaacatttgttttacaaaaagtcaaaggggcattccgagaatcgaactcgggacctctcgcacccaaagcgagaatcataccactagaccaaatgccctgtttgtatatcttgttatgttaacgcattctacttgcattctgttttttccgtgacgagaatttatgctttcctttgcttttcattagatgattattaaatatttccgtgctgtttctgcggctcaatctttggcagcatacacagcgtgtttgtcttttctgtatgaattgtactggttaaaaagacatacattattggacgtgaaactgcattatgttctttttctttgcattatgcacttgatcatagaactttaaggagcttttttgtttttgcttttcacttgctaaattggaagaaaaatatatggtctgcagttggtttatatgtgaaagaataggactggttttctagggaagctagcattgagaacagatgatttacgaaaagtcattggggttttccgagaattgagctccgggcctctcgcaccctaagcaagaatcataccactagaccaaatgcccttcttttttgtattatgttttttagttagtactttctattagcattcttgcttttctttcagagatttgttgcttcgtttgcattttccgtagatacataatcaaaattcttttctgttgatgcagatcattcgttgttatctggatgctaacaaaacatgaaggtcttccctatgtgaagattactgattaatatctattgattggatgtgatagattggtatgttcttcttttcctttgcattataggtcatctaacatttcgagaatcgaactgggtcatcgacttaaaaaatttgattatgttaaaatctgtattcaaatatataagttaaagattggtatgttctgtttgaatataggtcatgtacttaaaaaaagaagtcaaaggggcattccgagaatcgaactcgggacctcttgcacccaaagcgagaatcataccactagaccaaatgctgtatttgaatgcccccactgaagcattgtgttgttgtgtaatcctgtggaaaagagaattcatgcttcactccgttattacaggaaattaagtcatgggggtttgtttaccttttgagggttctattcgtgatgaagctggcaacatgcagtaagttcaaactctttaacttatatagaatgcttttttgtttagataaagaaattatgtttaagatttagttctattagttgatggatttagttctttcagggcttaatatatttagaacttatgtatttaaaactatatatttagttctttcagggcttaatatattcagaacttatatatttgaaactatatatttagttctttcagggcttgatatatttagaacttatatatttaaaattatatattttgttctttcagggttctaacttatatatttagaacttatatatttagttctttcagggcttaatggattgtctgtaattgaaaattgatgaattgaccctagtcattcctataattgaactcgggacctcccgcaccctaagcaagaatcataccactagaccaaaagccctgttgtttatgcaatctggttcaaatatttttgtggtcttctagtttgttttttgaaaaagaggctgaattacgaaatgtttactagttgaagctaagctgcagaagggaggtgtacgtcatcgcctcatcgggcatgtaagcaaaggtatgtaaaagttctggaaaaatgtgatttgatcatagagctataccaaattcttggttattgactatttttgttaagatcatagaggatccccaatagaagtgccattgacaatttatttcttgttgcctaactgatataaatatgaatttacttccgtctctctataggtttggctttaccagccgaaatttatgtctagtactattagttgactttcatggctttatggtgaatgtgatttgtctgtaaattttaatatttgttgaaacataacacaaaaccacaaaaccttgaattgctgaatgtttatctataaaagatctaagaggcaaatatatgggaatatatggaaaattttgttacctgttattctgagataaataagtaaatattgaaaaaatcttttataagattctctttgggaaaatagaatatcgcatgataataatcgggagacattaaagtagaaatacaaatacgtagacacaaaaaccctagaacaaaagatgatgcttcgtgtgtaacgtattagagaaggaaccttaaaaacgtcagtgatattcacattaaattgggatgacttgagtttggtgttacatccaaatccggttatatataggttaaattgttgtgtgcgaatcaacagagagagagaaaagggcacataaaataggtgagtctcctaaacatg

SEQ ID NO: 21998 - DNA, 3000 bp, Unknown; identical to SEQ ID NO: 5819
  misc_feature (1)..( 3000): 2750-1469P.txt file - cDNA_ID_2041515; gDNA_ID_1620819; Annot_ID_169391

SEQ ID NO: 21999 - DNA, 3000 bp, Unknown
  misc_feature (1)..( 3000): 2750-1469P.txt file - cDNA_ID_2041539; gDNA_ID_2936554; Annot_ID_194183
tataaaaaatgcaaaataatcatactaagacaataagtaatatagctcttttccgttattgtcaagttttaaaatttgataaataatatatcaaattgaacctttcgagatgatgaattcaactatatctttaaaatttttaaaataaaatgtatgtgatcgtgaaaacgtttaaaatatatgtaaagttataaaaatggatatactgcgtattattcttgacttcatataattattttgcatttttttttatgtagagggtaaagtagcaaaattgggcgactttgagggttttttttgctcaaaaccctaatgtttatataggtagaagaggaatattatccaaattatgtatgtacatattttgacatcatcgtgaataagaaatattctatattcctatattctaagtgtaacattaatttctataatttatttttttatgccgggtatcatcagacagtaattttgtcggtagaatgaacgctatatcaaatatctttttagaataaaatgttgaatgattattcttaaataagactaattttacagttgtaccgatatttttttccatatttgcctaaattgtattaaccaataactttggattttttttttgttttaacaatttcgagtttcggattttcttaagttcaggaaacataaaccactttatataaatcgaatcaatatatatatatatatatactaaaatgtgaagttttagtatctattacaagcattgatgtgaagtttttactttttagtatcttctgcactgcacctaactacgctttcataacatggcttgcaatggatgacagattgactacatgtgaacgaatggagaagtgtaatactttaatgactacacttgtacatttttccaggaaccggttgagacaagacaataagcaccacctcttctttcaatgctcgttcacaagacaagtatgtgagaagctagctagtaaaagggctacgtcaagaaaagtaacacctcagtttgggatcaaatcactctactcctaacggatgcaacaatcgaaatgaaagctctactaattactattgcagtatatgttccaaaatacagtccacaccatattgagaaagagaaataatataagacatggtgaagaacctcaaacaacttcaagccttggggaaaacatcgataattgttcatattttggctttctactaggagataatttctaaactctatctagtagcgtatgttaaaaacaactcaaaaatcagttgcatttgatgtaataccggttttttgtgaatagattgaacattcattaaaaagaaggttttttacgtgatatagaggataaatagttaatgtgttaatcgtaattttgtatttagccttttctaatctctcttgtacattactcatctaataaagcaattcattctaaaatttaattattattttaaatttttgttgtagagtgaattgatttattagatgagcaatgtatacacaagatagatgagggcaaaggtaattacaataacatccttaacacattaatttatatactctataactggtataaaaaaattagtttgaatcattaaaattataattgaaacgaagattttatgcgagctcaaatagatttacagaaaataaggtatagaaagaaagatatatttcgagtttacaaaagctggaaacagtccattaacttaaagatgtgatttttgtctgattatcccatatctaagagtaaatgcgctatattttcttatatattttctccaatttaaaaagatctttgtcttatattcttcatcttacttagtagatacgcccaagactaaatactgactaaattgatgtgtaatcttttagcttccccgtagatatatattctttcgtaattttgatgaaataattaattgcttaagacaaacaaaaagttggtcaatattgtatgacatatataagtactaattaacaagttggaagatttgtttctatcttttattcctcgtttgtaatccacatgaaaacttttctagtttgtctacttcccatatttagtttttcttttctatttgtacaaattcaacatctatctgttcgctgcatttttccttcaaccttttaaacatagaaattacataattacttttcttaagttcttacgtttgaccaaatttttgtgtttcttttttttgttttttaaattagatattattccaaataaagggaaccaaaataattttaccccatccagccaattcacaaatcacaaccgtggacaacaagtggattagtaaaactaagaagaccgaaagatagtaatcttttattattaacaataaataaataaatatgaaatctattttcctttggtaagaatatttttcttaattatactattacaagtgatgagtacaacaatgacaaatcatatatgccttaccaataatgtaataaatatattgttacagcaaaacaaaaaaattggggttatcaagtaatttctaagttctttcttgaaataaaagcaaaattaaaatatctaaattatatttttatttcctccaatagaattgaagaaaagcacacaacatttttgttttaagcacaacttttcaaagaaaaaatcacggaaataaatgtggattcatgatatctctctccaggtggtttaaaatttaaatcattaaaaaaaaatgatagagatctttagaaagctaaaaacatggagtttgaaaattcctaaaatctcagaactttttttagcactacgccagaagagccgattttgtctcagatttactttcctttaatctctcctatttttaatgacttttatttctttctccttttgcaacatatttttctccaccacctttttttccttcaccattataaattgctctcaatcatttctcttttgtatattcataaactagacaccaagagacaaaaaaaacacacttaagtaatagagagaacacatcacaatg

SEQ ID NO: 22000 - DNA, 3000 bp, Unknown; identical to SEQ ID NO: 5820
  misc_feature (1)..( 3000): 2750-1469P.txt file - cDNA_ID_2041539; gDNA_ID_1620819; Annot_ID_169383

SEQ ID NO: 22001 - DNA, 3000 bp, Unknown
  misc_feature (1)..( 3000): 2750-1469P.txt file - cDNA_ID_2041603; gDNA_ID_1621124; Annot_ID_172212
ggaaaaacacaactcacaattttatgcaaacacaattttacagttttggcgggaaacacacaattccgcaattttatcgccaaatttgtgatttgttgtattggtggacaaacacaatttaggtttggcggaaaaacgtaattccgtaatttccggccaaaatcgtaaatttattgtactggcagaagacacaatttcggttttgacggaaaaatgcaataatccaattttatggttttggccgaaaagtgcaattctgtaattttccatcaaattcgtgattctgttgtattggggaaaaacacaatttcggttttttatgggaaaacacaattatttaatttacggttttagtagaaaacgtaattatccaattttacggttttggagggaacagaattccgcaattttccgccaaaatccaaatttaattgtatcggtggaaaaccaaatattttgtttttggcgaaaaattacaatttttcgatttcatagtttgggtagcaaaatgaatttctatagttttatcaccaaaatattgatagaattaattactcggatatcatagaaaagtatgtttattccaagaataatatacatctttttttaattacttatatattttgagcatttgtgtaattacaattaacatccatgattagtttttattaaataatattatttaattcgtttttcaattaagaaataaataaataaaacaatcattatccacgttactaatccacgtcatttaccctaattcacgttattatccgaatccacgttacacggaaccaaaaattcccttaaatctttcggttttcctttttttctcgacatttcacagttcatcctcgtaaaaaaaacggtcgctctcttttcttgttccgtcgacgaaaccctaatttcgtcgccgttctcggtttatctcgtctcttccggccgaaatccttcattggtgtcgaatttcaagtcatcataaatcaaaacccaaataaaagagatctatggaattctacatgattcgttaaaggtttgagttgaaatcaagaatatctactcttttactttgattttacatgtctctcgtttagtcttcctctttggagacatttatacttctatcaatattttgattcatacggtttagtctttctcctatgtatccctcaaacatattcttacgtttcttaatttgattgttgtcttcccccaaaaaaatttgctttccgatttgaattataaatcagtcgtaaagtgatgtaactcagctataacatgatgtaactcaaccgtaacatataatttacacaacctttcgtcttccttgaatgataactcagtcgtgacatgtaatttaccgaacctttcgtcttccttcaatcatataactcaaccgtaacatataatttacacccatctttcgtcttcctttgagcatatcacgcagctgtgacattttaattgaccgaacctttcgccttcccttaagcatataactcagccataatgtaattttaccgagccttacgtcttctttggaacatataactcagtcgtgacatgtaatttgaccaaacctttcttcttctcttaagcatataagccagctgtgacatgtaaatattctctgaaacaataagagacgcaacatttcgtctaactttatcatcgagcaccaacttcacaagtttgtcctacgttgtttccgcatcaatctgcacaactctacaccctatttcatcggtgttaaatacgtaacctgatcaaccatatcgggagaaggatgaaagaaatagaagaagaatgaggaagacgatgaggaattggaagttccggtggtattaaaaacgcaggtgaagaagacgagttgaaaaaatttggccctattttttggtccattgatgatgctgatatggaatattgcagccgacgtcgttttgaactgatgaggtggcaagtaagccaccaaacgaacatgtaaatttacctaaataattcagctatcaaacaaagctataagtcagttgcgacatcaatactattacagtaattaaaaaacaaaaaaacgccaagttaattcagccgtttaatgtcgtaactcaaccgataataaatatctctgtcgtatcgtttaataattcggtcgtaactgcatgctattatagtaattaatcttttgcaactgagtcggccattacaagactgagttattcagtaacccaactctttacggctgatttatgacactcgaaaataactcagccgtaacaacatctcataactaagccgtccttcataacccaaccagccgaaaaaagataactcagtcatgtcgaggtaataagtcagttgttttctaataactcagccataacgttgtctggattatgctcaaaaatctataactcagacaaaattcattaactcagccgtcatgtaggctggattatcgcataactcagacaaatcagccgtaattattggctgagttatactataattccgtcgttttcttataactcaaataaatttgtcttaagtcagccgcaacataccataactcagccgtaactaccgttgtatcgccttacggctgagatcattaatccacgtcagtgatttctgacatggcgacgtgggtttgctgacgtggcagtggcattctttgtaattatgtttttttctgtgacgtttagtagggcacgatgggtatacaaaaaaaaaaagaaaatatgaaagaaatataaaaaagttttgtatggttctcgtaaatacacttaatttctatgacatctgagtaaagttcctttaataaaattaatgaaattggttgtccaaggtcctcctatctagacgtgagctttattgggcatgggcattttttgagaccattgtccattatggactacacaaaatcagcccataaaaaatctatctgttcggacacgcccaatggtctataaacggaccatttgacagctctacataccgacgatg

SEQ ID NO: 22002 - DNA, 3000 bp, Unknown
  misc_feature (1)..( 3000): 2750-1469P.txt file - cDNA_ID_2041753; gDNA_ID_2214708; Annot_ID_189855
aattggatctagggttcaatagagcgaagcaagtggaagcttacgatgtttctcgatgtggtggcttccttgaagaagagaaccaacgcgagcttgggcttgggcagttccacgaatccgattacccacagtgtgaatcgctcgtcctagggttcccatttttctgatttttccgattacccaaagagagagacagagagggacagagagagcttgttttgaagaagagaaccaacgcgatcgctttattcagttcgttgattttgttgttgacctccaaaccatatcaaattgaaccaaaccgaaactttttaatctaagcttaaccaaataaatagggctggctgaaaataaccgaaatacatacagaacggttcgcttgtcggtttttttccttaaggttccgattgctaaaattgcataatagcataatgacataaattgtagaataaaaatttcgcagaatgaaaatttgcaaactaaaaaatcgtcgaatgaaactaattttaaaatatattaattggatatattttgcaaaatgacaaataaatatttcaagaagatcatgagactgccacaaaccgaagaacacataggacgacacgaggcaaatgaatggctggaagcaaacagttatactgaaggcacaagaggtagtcaaacaaacaagaatacggttcatgacagaggttctcaatggcgaccaccaccaagaggatgggtgaagtgtaattttgacagtggctttatgctgggacgatcctttacaaatacgggatggttgataagggacgatgaaggaaaggttttaattacaggctgttgaaaactaccatcgactaattcacctttacaggcggaagctaccgggttgttacatgtccttcaagtagtttgggcttgtggaataaaaaatgtttgttttgatggagacaaccaagaacttatagcaactatcaataatggtgatgatcattctctgataggggctcttctttacgatattcgtcattggatggccaaactatccaacgtatctctactccatgtcaatcgtgaacgaaatagtgctgcagataagatggctcaatacgttctgtctactactactctgtatcagttctttattgtccctcctcgtttcttactttcttatttgtatcaaccttatacaatttaataaagttgaagttgttaaaaaaaaaatattatattaacaatatatatgtagatatatatatatatatataaacttaataaaaaataatgtttaaaacaaattagtatatttgagtaattttcgatactaaaaatgtaagataattaaaatttattaaaaagttatgaaaatgtttttttgtattactaatgatataattttgtgtaaactatgatacttttttttttacaattgctaatatttgtatgcatagaataataagattatattatgcaaataaataattatatacacactttttggcataatgaatttttacttaaaacaaaaatacaaatcttacgtttttgcgttttctaatacaattatgcagattttttttattggcaaattttctgcattatgtgtgttaccaataagagcctaaattgttttcagattatcgtataagagttaagatcaatgtaaaaaataacacaaatcgatatattaattaaataataaatttttgaaaattttatgtaaatatatggtctcattaatatcataaattaataattgtaaaagtttttttaaatatatatatgttatacggaagaaaaatagtgaaatatgaatttgctaatatttttatttttatttatattaattcttggtaaagtttatttaatatctttttactacatcgaaaacgttcttttttttattttctaaagttaataatttattattatttgaggtttaacgttaccatcgtaaagttaaaaatataatgattataaagaagaagaaaaaattcagacataatatttttttttaaattacaaaattagtctaaaatctctacaaattaataattattaatttatcgataaattaatacttttataaattaatagaatttcatagttcaaacatttatatatgtgataaaattacaaaaatgaagtagcaatatttttgcatggccaaaacaaataataaaaaaagatagcacggccatgatcgaggagattaaaatacatcgaacgtaacgttggatgcatttacaagtgccatagcatgactttcttgggacgaggatcatggatgaataaatatacttgttgaacaacatatgttatgttgcacgagcaaattaatttcacatggtgacgttatcgactaatgatgacagtagtctgttgaagtgaatcaatgaggtactgaaaagtcatagaacgtggaaaatttacatttatcttgtctgctagaaacaattgtatagagttttccaaatttgaaaatcaacatgtgaagaaatttttgttgatcttcagtcttacaaatttttggatagctgctttccggctgcccaaagcatgctttcaagaaatagataaactgtgttcaagttctctgtggtcaagaccatcgatgaacccttgaaaggtaaaagtggcatggactgaggtctgcacaccaaagaatgaaggtggactagggctgcggtcgattgaagaagcaaacaaagtaagtgtattaaagttgatatggcgtatactgtcggctaaaggatctttgtgggttgaatgggtaaagaaatatttcataagaaaaggctccttctcggcagtaaaagacactacaacttgcggttcttggatatggaatatagagggatagcacaacagttctatagagtagaggtcaaaaatggagaaacgacctcattttggtttgatgaatggagtaatataggctgtctatatgaaaaacttgggataagaggatgtattgacttgggaatctgagttactgcaactgtgggggaggtaatg

SEQ ID NO: 22003 - DNA, 3000 bp, Unknown; identical to SEQ ID NO: 22002
  misc_feature (1)..( 3000): 2750-1469P.txt file - cDNA_ID_2041753; gDNA_ID_1621124; Annot_ID_172217

SEQ ID NO: 22004 - DNA, 3003 bp, Unknown; identical to SEQ ID NO: 20867
  misc_feature (1)..( 3003): 2750-1469P.txt file - cDNA_ID_2041837; gDNA_ID_2910741; Annot_ID_193675

SEQ ID NO: 22005 - DNA, 3003 bp, Unknown; identical to SEQ ID NO: 20867
  misc_feature (1)..( 3003): 2750-1469P.txt file - cDNA_ID_2041837; gDNA_ID_1620821; Annot_ID_169460

SEQ ID NO: 22006 - DNA, 3000 bp, Unknown
  misc_feature (1)..( 3000): 2750-1469P.txt file - cDNA_ID_2042017; gDNA_ID_2910741; Annot_ID_193683
ttattcttaacaccacctttttagttgtcatgaaattgaatgcattcgacaccacaaataatttacctacgatgaccttccacgacttttgccatgtttccatcatacgtaggaataaaagtgttgctggccacagataccatgaaatctagagcagccatttgagacgaatggttctgaaactgttgcagctctgctgactccaatagcatttccttctttacctataaccacaggtgagtaaaactgataagaaaaagtgcattgtaatgacgatgcagttgagcattctttgtagcaagaaaagggaaaccaggactggtagactcacaattctcgggaatgcttcccttaacacggatagtctatgctcgctcccataaatctcaccagctgcaatgtatatctgtgtatttttctcaaatcccaacgcttttaataccaaggccacctcctctggcgtcaaaggacacagcccttgcgccctcctctcctctgagactatctccttctctctccaccagggatatgtgtacctaaagaacacagaatggacctatgaattaacaactaaaaagacctataaccagagcaccaattcaggagaaatcttttgaagagaaacctcatcttttttagctcttccgcttcttcctcagtgcaaccatgagtgcagccagagaaagctaacatgtccatctcatatctcagatgcaaagccacaaatggccctctttgttgtagaatccgaactaacttagatcccaaagcctcaagctgtggagtgaactttagtccctgaaaattcacccggcacctgagccactggagagagagcggaagaccattgtttgccaggcgggtatcagtcctattgaagtgtacaactttatgcttgctgaagagaggcaatacctgaacaagaaattaaccaatcacatatgcaaatggttaggtaatatcttgtaacaaggatagtcaaaggaaccaaaacagcaaaactagtgataaacaagacaaacctgcttcaagtaatatttttcatcagaccagctcacaggaggcatttcgaacatttgatatccatactttctactaaaccgtttaggaagcctccttaagatccgaacttcatctcttaatgaatcaatgaaatgtctcacatcaaaaatatcctcaaaaccactgcaaacaaaaatgaggatactttagattgctaaaaaatgttaagcatataagacacatgagtgattctataaacaccaaagatagagtacctaggatcagcccagaaagatgttttgtcaagctctggaacaacgagagtgagattcaataaccgagcaacagtcaccatatcacatatctgaaacacaacataaaaatcagaatttggaaaaacatcaaatctgaaagaagaagaaaaagagaattaaagcaaagtcaccaaccgcggatcgcatttgattcaatccaccattacaggatacaagtagaataccattgcttgtataattccctgcacaaaatcaacaatctcgttaaactctctcaagcaccaacgaaccctaatgtcccctaaatagagagaaaactgactcggagggggtagaggaggtggcaatggaactggctcaacaggggctgagaatctagaaatctgattggttaaaccagtgaagatccgggaatgccaaagctcaccggcggcgaaaagctgaaccaaacacgtccaaaccaaaatgctggagcaaactctaacgaaccatacttgtacacgaggcttcggaactgccggcggaagcggaagcttatcgcttcgcgcctgagtaatattactctccgatctaacttccatctccctcctccgacgatcgtcgtcgccgcttcatgagaataaaattactataacctaaatttctccgatcttgtgagatgtcagaaattgaaattagatgacaaacgcgaaatgaaatgcttcttctctcctttgtgtcaaatggtttgaatctcgaggagtttttttttctttcgaaattcagaagaagaaaaaaaaatcacgagacggaaaaaaaaaaaaaagaggtggtaacggtgagagatgggaaaataagttaattaaccgtcaaagtgtcttcttcttcttctatttattgttttcccaagaaactcattctattgcttacacaatttatttcctaattcagaaagcttcaattttcctaacttgtttcattatatatatcattaaatgtcaaagattattctataaccaaaaaaaaaaaaaaataggtttcaaggataatgattgatcagaaaaacatatgataaataaagatttcaagaatattcaacattgaaaaacatataaagaaagatgacacattttgcctttttgatagtcgttgtcattcgtcaacggattcacctaattgttctcccgtactttttttattactgtcatctatttattgcactaatcacgattcaaaccactgtttatattcatctcctttattcagatattttcaagctgttgtaaaacaaaacaaaaactgaaacgaaatcatgacacgtacctcaatgttgcattattaacatcccttccaaggaaagattactattttattctttactaaaaactcgagtacaattgtcttttcaacaaaatttcccaattaagtttaaaattaacattaccaagtcatatgtagttatgcttgaattataaaatctggatgtgttatttgtttctttatttacttctaacttactttagtgtgatccactacaagtatataggtccaacattattaatgggccttaattttaaagcccaattccagagggtagtactccacgtgttttaacgaatgaaatactaacacgtggcaatgcacgtgttgactttcttttgtttccttccttccgtttaacaagaaaaatagctaaactttgaaatccgtcagatcgatttctctctatatcggagccgtcatg

SEQ ID NO: 22007 - DNA, 3000 bp, Unknown; identical to SEQ ID NO: 5834
  misc_feature (1)..( 3000): 2750-1469P.txt file - cDNA_ID_2042017; gDNA_ID_1620821; Annot_ID_169467

SEQ ID NO: 22008 - DNA, 3003 bp, Unknown
  misc_feature (1)..( 3003): 2750-1469P.txt file - cDNA_ID_2042065; gDNA_ID_1620823; Annot_ID_169597
gtttttgaatgagtaaaccccacaacgacgataaacacaataatacaaacagtgaccatggaagtaatcaaattcaaccaagaagtcctctttgttccagtcatggcaataccattagcaactaaaagcactgcaacagcaaccggatccaaaagatcaaaccctttagcaaaggaatcgactttaatccgaaaataatcagaatcattcttgaccaaactagctagatacgaagaccatgacctccctaatccagcagcaccaaccatagcctcaagaagaatattcccagcagcaataaaggcaataaaatcccccaattcaaccctaagataagagaaagaacctccagcgacaggaatctcaactccaaactcagcataacagagaactgagagcaatgcagagacaccagagatagcgtaggagagaacaacagcaggaccagctccaactcgagcctcctgacccgtgatcacgaacacacccgaaccaacaacagaaccaaagctaagccagagcaagtcccaccaagtgagacaacgacgcatagggttctcgctttcgcggcgggctgcatcgagctcgtacgcatcggaagagcgagagagaagacgatcggcgaggcgtggacaagtggcggagagagctgatttgtaggtagagaagctctgaaaagagaattccgggaaaaaatcctgcttcctccatctccagtagcttctccgttgacttaggtcatcggatctcgactccagctggtgagcttcctccattgaagcagggatcatctcaaatccacaaaaaatccgaaagagcgaataattggcaatttaaaaacttgagtgtctaaaatatgataataaaatagttatggatcgaaatgtaaatagtcgtctaattgtagttaaaattcgtgcagcgttcactgaaactgaaaggtggtgacagtacaaccctaaaaacgagggacccacctaaagtttttattgaaagtcgtctaataagagttataaaccaacggtcaggattggagatgtgagactcgatatcaccttttgagatgaatcgtacaaaatgcaggacccactttgtctgacatgttttgatcaaatagctaaacgccacgtgacgaatgtctattacgagatcatgccacgttcgtcgatgagcttgactgatttattcatcaacttgcttaccatttttttataaaaacaaattgttttaaaatcatatttctttttttttttgtcacattttaaaatcatatttctagtatttgttatttgtttgaaagaaaatgtattagatacagaacttgtgttttgccattcgtttttgatttgacaataacagattttgttatttagtaccttttctgatttttataattgctttcgatttttttttactgatattctacgtgacgttttataaataaagaaaaagtaaaattaattattagaagattcattattacatagtttcagatttcgtcaacagtcattttcatactttataaaacttacatgttcctgtccaaaggtatcaaggtaaaaatcccataataaaaatattactgttaatgtgacatattattttaggacaatgaaagactatttttatggagtatagaattcctttctggtattttgaataggaaaaaatcaactacatttaataattttatcaatttgcttacataattacgtgtgataaaataatagtattccggaatttattaaatgtctacctatattttggttattacccaaaatgagcttataaaattattattaataatctactttctatatttttggttaattattagtttatttaaaaacagcatcctgaaggacggagagagacagagtatgcgaggagtgtgaaaacgaagagcataaacaacacgggacgaggagagagaaactagtgtgttttagaaagaagaaagagagagatagacaaagagactgtttgtgtcttcttacccattcgaggaatcaaagcatctatttccgagctctcaagacgacgagaagctaaaagataaggctgaagaaatttagggttttttcttccttttgtattcagctcgttaattaaggtatgttcccaaattcttattcttaaagttcggctctttcctttttcttccgacttgtgtcttagttttttttttcaatcgtggtcaaaatttgttcttgagctactctgttataagggtttgtgggtactggaatctttgattcgagagcaatggagactttcaagcacctcagattttatggttagagaagtttttttttttgagctgctctgtagaataatgtgcttaggtctgtacggatttggggtaactagttggatcgcgagtgtttctcaccaggtccttggaaaaggatttgttttatacctgaaatttgggatttttcagactcatcttcaagtactttgctttgaatcggggatttagcagacttgggttcttcagtgagatgctttattcagttttgggggtttgttagatttgagagcttaagagataatttcttgttgcttttgttgaaaaactatgaatggagactagatttaattgggcttcccttggaaaccatcttgagctttattgaatctgtgtataatatgatggaataatgagagtataaactgaactcattctattggtatttgtaaatgcagggctatccatcttccgagttcttcagtagcttcacaagctggacctgaaaatagatcttggcgcatatcaggagtgtgattatggttatctgaattcatgtaatttgaagggattttcacgagctgtgatcgggtcatgaatgcgtgtctgaggacatgcttgaaccaaggggagcggacataccaatattgttcctggttttggttgtacttcctgtggtagcttacattttattaggaaaatggagtaacatttctgaaaaaagagtaagggctaacttgctggctcagatg

SEQ ID NO: 22009 - DNA, 3000 bp, Unknown; identical to SEQ ID NO: 5897
  misc_feature (1)..( 3000): 2750-1469P.txt file - cDNA_ID_2042114; gDNA_ID_1620823; Annot_ID_57828

SEQ ID NO: 22010 - DNA, 3000 bp, Unknown; identical to SEQ ID NO: 5892
  misc_feature (1)..( 3000): 2750-1469P.txt file - cDNA_ID_2042114; gDNA_ID_1620823; Annot_ID_169577

SEQ ID NO: 22011 - DNA, 3003 bp, Unknown
  misc_feature (1)..( 3003): 2750-1469P.txt file - cDNA_ID_2042203; gDNA_ID_1620831; Annot_ID_169674
gaggctgttctcttccgaaaagacgataaatcttggttttgagagacgcagagttcttatcgtcatccgaatcggaagaagaagaagaagagtcatcgtgaccatggatcttctcagagatcttctccatgatcgattcctcgtgcttgtgctcttccgccattgttaactttgaaacctccgcaaaaaccctaaacttgtttctggtttcagtaagcgatgagcgagaaacggagaagaaaacgaaaagtctctttcagtcatacctctctctaaataagagcgtttgatacagattcaatctcacccgtcgatttatttaactcaatcttggccgttgggaattaatagcttactttctaagaaaatcattaaataacagtaacatctttgagacggaagacagacgacgaattcttaattaacgtctccgttagtgtagcgttcaatggggtcagcacgtcgtcgtcgtcgagaaggtagatgcttgactacgacgtcgtatgaaatttaagggaaatttgtttatagggatcatagaatagacgatgctatgatgagattttatttgggccaataagaaacttgagggaaagcccaataggttaagtgaagttataaaaataacagcttttttttttttttttttttgacaaatatagatttaagtctaaaatataaaaataatatagatttagtattaattttgtcactagaacacaatatgttatttattttgtgatgctatatatttatgctttctgcctggcatactcatcatatttattgttagtcatgtaagacaaaatcatattctggttattggtctaatcacattggctggttgtttccttgatttttctataacccactgtgcatttaaatgtgtgttttcggaccataatccatatcatttgaaacgatattatatacacattcgaatttaactaaaaaagtatgtagctaccacctagccaaatcaaatctctagggcttactattgcgccatcatgccaaacaattagcccgacaagatcagattttcttagggtagtaatattcttctcgtgatcaataggataaagagaacatattgtataactatctgaaatgatttgggatcgacgtttagttaaaatatataattaacttaatcattgagtttgacggaaatagctaagctgcaaatgcaatgaagcgtttttcttttaccagtaaattataagatttgttaaattcgttggagtcaaaatatggatcactctcatccaaattcattttaaaacttatacattatgctattagtgtatcaatctcaaccaaaaacgtaatagcttctttatattttggaggaagtccactaaagctgaatttcggggaagcctatcaaacaacgagtgactagcttctttgacttgcttttgaaagtgctttgcccttttgaattttagataaagcgaattaatgaggagaaagaaagaaatttttgttttattttgacgagagtgtgtcccattcatttgtttaccaactcaagctctataaacttattttcagaaacactaatataagaattatacatgattgcagtatgaatccatgaattggattaagaaattaaatggaatagaaaaaaaggattaataaataaataaatggatcatacgaaatcacgtacacatgtacagtgtaaagggcccatcatctttactgattttgggaacttgatgaggcccattaaagaagggtgataatgggactttggggtctacatccattgaatctgacggcctgaaattttttggcaaataatgatgatgttaataatacgtctcggaactacaaactttacacatatattgtgcatattttttacaagtagtagtaatattaaacattatccagattctttcagaatcagtttagtttttttaaatgctttgtaggcgacaccatcaattttgtcgattcccatatgattaatatattactacttagtagtataatattatgtaacataatctcgtaaacataaaacaaaattgcactaatttgtgtttcaaatgcaagattttctttggttcaaagtagtgccaaaaagtatcactattatttatgtgtactatgtagaaaataaaagagtacgtatataaatactttaatgatctctgaccttttggtctgactgtctcagtctgaaagtcacgtgactcagctgctccctacgcttagcaacgcaacgcaacgcaactctttgccacgttttttcttatttgcctctgcttcttttgttaaaacatggcaaaacaaaatgaatttacaaatttataacaaaataaaatttgttttattgtgaataatttcaatttttaaatacatacaaaaacagtatccaaagcttttttttttctttttgtggttgtggtttattttctttcagccatagctttgtttgtaaaacgtaaacacaaaatttaaaattttgcctaaaattttagttttttttgtctgtcaactatatacgaaaccttttattgtatcaaatcaatattaaattctactgtattagttttattatggtttgttatatttttcttccttgtaaaaaccaatgtttcacaccaaacagtaaacataaaaatattgtcttgcaatgtaactaaaattactaattatagacttatgaactgtaacctatggttattaaagacagataaattagcatagtctttaagtacgttttcttttgtcataactatttcataccatttttatgaaaatggaactaaaagcaataaagaacattatatatatcaagaaaaaataaagtaataatttttatatatatagctttcactcttctcttacaagcactgttattaacccttctttttcatctaaaaggagaggagactttgaagaagaaagaaaacattcaaagctaaaaaacgcagcgttttaggaaaaaagaggtagagagtgattctggctttcccaacaatg

SEQ ID NO: 22012 - DNA, 3000 bp, Unknown; identical to SEQ ID NO: 5920
  misc_feature (1)..( 3000): 2750-1469P.txt file - cDNA_ID_2042217; gDNA_ID_1620831; Annot_ID_169678

SEQ ID NO: 22013 - DNA, 3003 bp, Unknown
  misc_feature (1)..( 3003): 2750-1469P.txt file - cDNA_ID_2042225; gDNA_ID_1620831; Annot_ID_169681
atgagagttacctaagcaactagtagatccttgtccacatatctccttggtgtcgttatctctctgtgtcctcaccgtttcatctaaaaggatcaatttcgtccttctcggagtgccattaccactactacttctagaaagttttcctcttttcctaggagactccgcactttctggactagcaatcggtgaataaccattttgaggctcagatgaattgtcaacccgaagtttagtaagcctatcatgtacaaagtcatgtgaatgcattaacttgcgccataacgatgaatcagacgctccactgctacttcctgctcctaaatcaagaacaagactaaatcaaaacccatccaaccaaacttgaaaaagtttgcaaatttaccaagaacaaaaacacaaatttggatctacaactataaactgtactcagtgtaaagaagaataatttcaaaatccccaaatgaaatttgaagtcaaagtgaagagaaattagctaacctttcttgttgattgaagcactactacaacgctcaattgaagaattaacaccaatcgagacacgagccttgtcacagttgttatctgctttattcgacgaaaccctaactccaccaccacacccttcagatcccataagcttagccggcaacgaaacatccacaggacaagaaatcttcaaaccatccatcacaaacccaaatcgaaaacatcgcagccgtgtaagctgcgatacgaactcatcatctccttttaaaccaaaacccagatagttcgatcgagctttagagaaagctaaatcttagaaatttctggagaatagtgagctacaagagtgagattgatttggtttttttttcctcgatgaagaaacgcaatggtgcggctgcgtgaatcgagggattttaatctagggcaagaaaatgaaagaggagaaaaaaaagatgagtatttatagttttcgggaaattaactttggccttgttttagataagccgtcgacggtgagattgttccggtgagctcgtctgtactggtaactctgacgtggctactacattattgcgaaacggagtgatttagaaccgttggatgttgactgatgacggggtttttatgatcttgttggttaatagagtgacacgtattcaagtgaagatttcacttggttcatgtggtttgatatgagtttccaaatatgccactggtggattctcaggtgtttgcttggagcggagggtgtttttgattttgacgaaattatcccttatctgaatgttaacgccgttagattgtgttggttccgttaacagatttttgatttaactatttcggttcaaggtcttcttgaacaagtcaatgaagttacattgacaaaaaagaataaaacatgaactttacaatattgaagggattgcttttgtatttaaagttagtttttacaggtagtgattgtttggatatgtgctctatttcttttgtttatttgtgttcgtttttgttgagattatggttgtgtaagcgtggtttagtatttgtttaaaactattgaggcaatctaatgttgggtcctcttggaagatcatctttgtaatctttctcaatacatcaaactgttttgtcaaagagttttcggctatgttgcttttgaatgtggtatttatatattccgtgtgctttaaggttcttctttctttatatccgctttttaatttttggttttagagtttttatgtatccgccagttttatttttagaaaaaaatttttttttattaaatataactatacatatcatagataaatcatttagacgagaaaaattaaaaagacgttaattttatgtacccgtcaattttatttttggaaaaaacaaattttcttattaaatataactatacctatcatggatgaatcatttagacgagaaaaattaaaaagacgtttaattttaaaagcataattagtttcagatcattttaaattatggaaatttaatagtaaagtttcttaaaaataatatgtattactcaaaataataaattttctaaaaactttctttatctaaaaaacatgtcttaccaacagttgatcctaaaccaaaacaattatgaatctaaacacttagaagtttttttgttaacaaaatggaataaaataacaataatccagttttgtcttaaacgtataaagccttattgttttatattggattagcaattgggcctgaaagaagaaaaacaatcatatgggccaataggacttggatctatattgcttcaacttattacaatattcatgcatgtgtggaatttggctatgtcatgtggatggataagcgttggcagagtcttcgttacgttttcataaattatctaaacaacttaattacacaatattctcaggtattggcaagaagaaaaaaagaagaagaagagaaaaatcataatataaatatacttctggacacgttgaagagacatatttgatgactagtctaagcaagattccacaaaaatgaagcatcgattttgatcaaattattcggacttcaaaatatgaaaatagtatagaaatattttctttatgtaatattcaagccgcattttgacaaaaataattaataaaaaaaatgtaagagtatccccatctttagtttttaaaataatagaaaaaataaatttggtcaaaagacaaagccgtcccttccggttcacacgagccgcacgtgtgctttccttttttctccttccccgttctctagccgattctctctgtctagggctcctccgtcttcttcttctcataccttcacataccacaaaacctctcttctctctctattgattctctacgaagaggaaagtgattttgaaccatcttgatcggaaacggcgtttcgaaactggaggtcgaagacgaaaaaaactcttatctcatcgctccggtgtaccgaattcgagaggtttttgttaggtttcgtagtgattgattgattttgatg

SEQ ID NO: 22014 - DNA, 3003 bp, Unknown
  misc_feature (1)..( 3003): 2750-1469P.txt file - cDNA_ID_2042285; gDNA_ID_1621170; Annot_ID_173951
aaaggtcgatgatcatccgcgccaatgtcatcggatccgtttgatcacacgattaaagatttcaccaccgttcttattttccgtctctgtttttgcgtttcacgatctttaccaaatcatggaccgacagtcggaggtggtgacgcaaaccatggatgatgcagcatatgcgtcgttatgacgagattcaggtttgttgcttctagcctaagtcctattttgatctcttggaaccttagatttataattttagcgcaacttgctgctgcataaagaaagtctctttaggttgtaggtcaatcaataattagttttctaaacgcaatttcataagaggaactagggtttgctcttgtagtcagttttacgaaattgacctaatttgcggttttcttgtctgttatcactttgtttcatttaggacaaattgacctttagttttcttcttgttattgtaggttcgtattcttgattcgccaaatcagtgggtgcatccgcaaaactgtttgtttggattcgtgatagacaacatattttgctatagcttggtaacgactttctatactctgtttcttattctttcttacaaaaaataataattgatttagttgtaaaatgtttttttttatttgatgattggattttttcaaaagctcttttttaatatatttattattattttaaaggttttataaatactaaattaatataacgttgtgaaatctaaccggattttggatcccgccatttaaccgtggtcattagcgattccacaaatccaacatgtttttcacatcttcatatgtatttagcatttgtatttttttttctttaaaggttttcaactctttttttatttttttaaagattttataaatactaaattaatatgactttgtgagatctaaccggattttggatcccgccatttaaccgtggtcattagcgattccacaaatccaacatgtttttcacatcttcatatgtatttagcatttgtatattttttttctttaaaggttttcaactcttttttttatttttttaaaggttttataaatactaaattaatatgacgttgtgaaatctaaccggattttggatctcgccatttaaccgtggtcattagcgattccacaaatccaacatgtttttcacatcttcatgtgtatttagcatttatgtttttattttattttctttaaaggttttcaactccttttttattttatttttattttttaaaggatttataaatactaaattaatatgacgttgtaaaatctaaccggattttggatcctgccatttaaccgtggtcattagcgattccacaaatccaacatgttttcacatcttcatgtgtatttagcatttatgtttttattttttttctttaaaggttttcaactcctcttttatttttttatttttgtaaaggttttataaatattaaattaatatgacgttgtgaaatctaaccggattttggatcccgccatttaaccgtggtcattagcgattgcacaaatccaacatatttttcacatgtatttagcatttgtgtttttttttctttaaaggttttcaactccttatttatttttttaaaggttttataaatactaaattaatatgacgttgtgaaatctaaccggattttggatcccgccatttaactgtggtcattagcaattccacaaatccaacatctttttcacatcttcatgtatatttaacatttatttttttaatttttttttcttaaaagattttcaactcttttttcgttttttaaaagttttataaatattaaattaatatgacgttatgaattctaaccgaattttggatcctgccatttaaccgtggtcattaaggattttataaatccaacatgtttttcacaaatcttcatgtgtatttagtattttttttttaaaaagtttttaactgtttctttttttcttttcttattttgattttttaaaaagtttttctatttcagggtggataaaattagcagaaacaaacaaatggaatagaatcaaatcaaaaatcaaacaaaaaccgaaaaccgaaaaaagaagagtaaattataaacataattaattaccattccccaaaaaccattcccaaaaaaactagctaccatattttcatgaaagttaaatacagaccaatcccaataataaaaaatctctcgaaagtgaagttttgcgcaaagaagtcggctcagatattatttgaagttttgaactatggtagatacttatttataaatcaattacatataaaattaccaaaagctaataaatcgtaagccacataattcacgtaagattcctgtccgtctctgaaagtgtggtcgttactcgttaccgacgaaccgttgattctatggaaacaagaaagtccagaaaaaaacaaaattgcatacacgtgaatcaacaatttatgggtcgacctgaaatatatttagaaaaataatttactaattctttttttgatagagaatttataacaaactttagtgacaagtcataatcaaaatcagatgactcatcattttccaattttcctaggacagtggatttttcatatggaccccttaaaaaataaatatattaataaatatctaaaagcttttgtaaccgttgattaattacttaaaaactcattagaagcttgattattagtggaagacagacaacctttgtacttaaataccttttatgagttttgtctgcctctaatttactctttgctacacgcttctagatccctcttccttcgtcaaaatctcatttttcttttttcttgttgatattgagaaatgacttaatcctatttcgtctccttcctcaattcaacgatgcttagggtttgccccaaaattatataaactcgtcgatacatacaaagcttgtgactagaattcgtttcttcaagagtaaagcttcctcctttcttctcctctgttttcatctctctgaaacaatg

SEQ ID NO: 22015 - DNA, 3003 bp, Unknown; identical to SEQ ID NO: 17531
  misc_feature (1)..( 3003): 2750-1469P.txt file - cDNA_ID_2042293; gDNA_ID_1621170; Annot_ID_173949

SEQ ID NO: 22016 - DNA, 3003 bp, Unknown
  misc_feature (1)..( 3003): 2750-1469P.txt file - cDNA_ID_2042315; gDNA_ID_1621170; Annot_ID_173943
gaaatcgttaatgaccatggttaaatggcgggatccaaaatccggttagatttcacaacgtcatattaatttagtatttataaaatcttttaaaaaaaagaaaaaggaaaaaaaaagagagttgaaaacatttttaaaaaaataaaataaaaataattaaatgctaaatatacatgaagatgtgaaaaacatgttggatttgtggaatcgctaatgaccacggttaaatggcgggatccaaaatctggttagatttcacaacgttatattaatttagtatttattaaaacttttaaaaaaatcaaaaaaaatttgaaaaacttttaagaaaagaaaacaaaaaataaatgctaaatatacatgaagatgtgaaaaatatgttggatttatggaatcgctaatgaccacggttaaatggcgggatcaaaaatccggttagatttcacaacgtcatattaatttagtatttataaaaaacctttaaaaaattatttatttaaatgttttagtgaaagttttagttttggttaaaataatttttaaagaaaagaagaaaaaaagttagaatgaagaaagtcctagtgtaacgaaggcctcatacagcaaagcccattccaaagtcctagtgtagctctgtcgtaacattatccaccaattttaggtcaattttgtaaaactaaactacaagatcattccatgggaagcttctctccgatatgcaagacaagacgccaaagaatggcaagatgcagaagagtacacccaccgtttatcatcaaaacctgacagagtaacgtcacaagaaccaacagctaatctctggacaacaccccctattggttggacgaaatgcaactatgacggcacttaccacagcaacgctccgagtaaagcgggttggctcttacgggatgatcgaggaacctttctaggtgcagctcatgctataggctctattactaccaatccgatggaaagtgaactccaagctttagtcatggccatgcaacattgttggagtaggggctataggaaaatttactttgaaggtgacaataaagaagtctcagagattgtcaatggtcggtcttcaaattttgcagtttttaattggataagagatataagcgcttggagatcaaaatttgaagaatgcaagtttacttggacaaggcgattttcaaacatggctgcagatgctctggcaaaacaacaacttcctttgaacactcagttttattgctataactatatcccgtttgtaataactgattttttacatcgcgactttgctacagcaaattattaataaagctgatgtttgaggaaaaaaaaaaaaactacaagatcaaaccctagttcctccgatgaaattgcggttagaaaactaaatattgattgacctaattcaaagagaccttttttgtgcagaaactaaatattaaaaatccaaggttccaagagatcaaataggaatttaagcgagaagcaacatacctgagtctcgtgacaacggcgcgtggtttgcgtcaatacttgggactctcggtgagatccgccatgatttgctagagagatcgtgaaacgcaagaaaacagagagacaaacggtggcgagatcattgatggtgtgatcaccgagttacagttccgacggttctgacggtggtgaaaatggatggtgatcatcgagctttgacgttctcgtgatcggtgagttctttttgtaagagaggaacagaaacaaacagaggctaaaaagacaaaagaagaagaagaaggtggattttttgttttcttctcgtaatccatgctttggaccttgtatcagccacttatgatcatttgctatattgatgctttccaattttagagtattgaaatgggtttctttgacaatcattttgagttagtcatcattccttgttctgaatcaagaattggcttttgttatgttgtctaggttctgcttgtaactagagtaatgctattgtagtctctgttgtttatttgtagaatcatagagagtcgtggaagcatgttttagttgttactctcgatttcttgtcgatgttgtggtgttataaattgagcgttttaaccaatacaagttaggagatggttagtatgtgactatgtgttagtggccatgtatgtagttcgatcagataatctgaatgatgtgctaaagagcttgcataggaagactgcctttgtgttagcttgcatagagacttgttgcaatatatgagactgaaaactattatgtgaaaactttaatttgtgtacaaatatttttaactcttaaaattaaactaacattgtaccaattagcacatgaaagaaacacagaattctgtgaacatatgatgaataactatataaacacattatggattcagttaaggagacagaaacaagaagatgaatttcagatatatagcaatagagtcacttataatcatatcagagcttatactttatacaaattatcactttagtccttaaattaaaaccgatttaatcgacaatcttgttattctttaaaacaatttgttcttattttcaatctttaaattttgcaacaatcgacagaacttatcgttattccgtgtttttattttcatatctttcttaaaatgtttcaaaataatatatgtttaatattttctgatttacaatagttattaagttatatgaaatataattattttaaattttattttatttttcagaaaactcttataagagagcttaccattagaatatgaaaaaaaattaaaactctcttataactttttaaaaattttaataataaaaaaatggagaaagcccgtgaaagagctcttacgaaccaaaaccattcagtccggttaagaattggttatcaagtttggttcctaaaagatatccaagttcaaaagcaaaaaaatatcttcttttctctctctctactctcttctcttcttctcttcttctcttcttctctggctgggcaaccatg

SEQ ID NO: 22017 - DNA, 3003 bp, Unknown
  misc_feature (1)..( 3003): 2750-1469P.txt file - cDNA_ID_2042340; gDNA_ID_1621170; Annot_ID_57237
aagatatgtcgtaaactggaataatggtaacgacgattgatcgtttagctcatttaatattttcgcgtaatcgtccaattcatcaaagaaagacacactcttttactgaacttgtaatttttggctgattaaacaaacactatatggctagactttcccggtttaatggttaatgacaaaaattagtcacagagtcgaataatgggttcttgctgtttttcacttaggagaggtcgtgaggaaaatgagaaaaaaacgatgagtaaaaaagaagtgattgggaccaatttgacccgcgagttttggcgtaaccaaacatttcgcaccaacaagatcttctctttattatagctttttgcacttttacaaaagtaaatttgagcaataaaagtgtaacaaaaaaagtttcaattattactagttacccgccaatccaacctcccccataatgcacacacatggtacacatcatatatgtaatatataggacaatattttcttacgcgtatatatatatatatatatatatatatattcagaaattaactaattactgggaaacataataattaaaaaaatatttaaataatagaagatgataatgaagagtgcattttgacaatagtgtatttaaatctaattatatatgttaagcgaaacctatacaaacttcggagtgatctaaatttttagctaatagatcattcgattttacaaaaaaaaaaaaaaaaaatattattttctatttactatagctttacaacattcttttaattacgacagtgatgtttctccaattgataataatgttccataataatcaaacggaaacgagtatgttaatgtcaccgtagttaaactaagacaaaaggttctgacttctgaaccgtttgatcgtatcatcaattgtagcatgacgttggatcatcattatgtacccaacaaaaacatatataacgttgtactcaatatgatcattcacttcaagtcttcgaaagtaagttagaaattgtcaactatttaacaattttttttaacaaaatccaaccactcttcagaagcttaaaaaggtaaaaacctaccagattattctttcacaaattacagtcgttagattacttttcaaataatattgtgtagaaattctttatagtcacattttgaatgatagtaaccgtctactctaaactattatgtttaatctcaataatccatattttatagttggagtgggttgagacttgggagacggtcaaaacgttacaataatattcttagtttaaagctcgatttggtagaaagtttgactttacatatttgtgtattttttggataggataggtccgataggatttgggatatgatatcatgggttcgtccaagttatagtaatgttgggattgggggtaaattggtaaaactataattaggcaaagcgtgaagaaaaaaaaaattgacattatgatgagaggagttcgggttgttgcatgggaacattatttgtgctcccataaaggtaaataaaaaccaaattataatcatgggatatttaactaagaaaacttgatatcacgaggaaaatcattataagttcagatttaaagccttttcaaatatagcgtacataactatattctatatgtagtcgatgtctcgatgaaatgcttgtttattaaggagacgaatccactagcaatttttatatccaactaatttatttattttagtttctttctcaaaatataaatttcgattgtagtttaattgataagaccaaattcattgagcatgcagtaccctagcaaccaactaatcgtgagaacagtttgaaaattctaattgggatagtcaagtcaacgacctcaacgcgtattctttaagttcttccgttttctttttttctttctaagccgtgattaccgcctcggaaaatcatggagttttcacggaaaataatttttagactatagttatatactctaataaatacaattgcaatacccgctaattcagcaggaaactatgacaactggtttccgtgtacggaatgactctcttgcccgcatcattcttgatgatgtgtcatacactacaaggcaagaaaaaatcaataaataaatcaaagttaatagtagtatagtatatagtataatctgttttgctcagtcatattcactcaccgtaaatgccaaagtgaaagcatcagtttgaagccagttagcttctgtttttttattatgtcatattcaaaatcattcaattattcatatgtcaataattactcggttacagggtgaaattttataatctgattcgtatgaaccaacgactcaaaagtttagctagctagtagctactcaaaaaaaaaaaaaaactacttgttaaaactacaagtttagatttagacatatgttcactagattttgacagctacgcattccttaaaatgtctgatgtttaattagcatgatttactaaaatagacttgtatttattatgttaaaacaaaatacgcagtttttgttcgctgaaaatgttccaaaacaataatattctttaagcgaaaaatagaaattcatataattatattacagttaagggaaacaaaaagaggaagaattcgttggcaacaattgacaaatacctaaagcgtgcgaggtcagtaaatcacacgcttgagcagttagtggcggttagaacggtaaataaaggagacggaattaacaagtaatcacgttaaaaaaagctaaacgaagaatcaaattgtgtaggagacgacgtcgtatagatacataacggccgtctgtcttaacggctctttttggtgtcgtcttcttttatttttattttggtctcccaccagattctataagaggaccaatatatctccaaactcgtacattcactgtctttaactctcactactctctctctctctctcctctgttctaattctctaggaacagagtaaaagactttggctcagcttctgcctctccaatg

SEQ ID NO: 22018 - DNA, 3003 bp, Unknown; identical to SEQ ID NO: 22017
  misc_feature (1)..( 3003): 2750-1469P.txt file - cDNA_ID_2042340; gDNA_ID_1621170; Annot_ID_173936

SEQ ID NO: 22019 - DNA, 3003 bp, Unknown; identical to SEQ ID NO: 17294
  misc_feature (1)..( 3003): 2750-1469P.txt file - cDNA_ID_2042410; gDNA_ID_1621201; Annot_ID_174924

SEQ ID NO: 22020 - DNA, 3000 bp, Unknown; identical to SEQ ID NO: 8235
  misc_feature (1)..( 3000): 2750-1469P.txt file - cDNA_ID_2042417; gDNA_ID_1621201; Annot_ID_174922

SEQ ID NO: 22021 - DNA, 3000 bp, Unknown; identical to SEQ ID NO: 6466
  misc_feature (1)..( 3000): 2750-1469P.txt file - cDNA_ID_2043719; gDNA_ID_1621094; Annot_ID_170883

SEQ ID NO: 22022 - DNA, 3000 bp, Unknown; identical to SEQ ID NO: 6457
  misc_feature (1)..( 3000): 2750-1469P.txt file - cDNA_ID_2043733; gDNA_ID_1621094; Annot_ID_55610

SEQ ID NO: 22023 - DNA, 3000 bp, Unknown; identical to SEQ ID NO: 6457
  misc_feature (1)..( 3000): 2750-1469P.txt file - cDNA_ID_2043733; gDNA_ID_1621094; Annot_ID_170876

SEQ ID NO: 22024 - DNA, 3000 bp, Unknown; identical to SEQ ID NO: 6457
  misc_feature (1)..( 3000): 2750-1469P.txt file - cDNA_ID_2043733; gDNA_ID_2926162; Annot_ID_139757

SEQ ID NO: 22025 - DNA, 3000 bp, Unknown; identical to SEQ ID NO: 6457
  misc_feature (1)..( 3000): 2750-1469P.txt file - cDNA_ID_2043733; gDNA_ID_2926162; Annot_ID_198830

SEQ ID NO: 22026 - DNA, 3003 bp, Unknown; identical to SEQ ID NO: 18255
  misc_feature (1)..( 3003): 2750-1469P.txt file - cDNA_ID_2044033; gDNA_ID_1621119; Annot_ID_172014

SEQ ID NO: 22027 - DNA, 3000 bp, Unknown; identical to SEQ ID NO: 6970
  misc_feature (1)..( 3000): 2750-1469P.txt file - cDNA_ID_2044045; gDNA_ID_1621119; Annot_ID_56268

SEQ ID NO: 22028 - DNA, 3000 bp, Unknown; identical to SEQ ID NO: 6970
  misc_feature (1)..( 3000): 2750-1469P.txt file - cDNA_ID_2044045; gDNA_ID_1621119; Annot_ID_172008

SEQ ID NO: 22029 - DNA, 3000 bp, Unknown; identical to SEQ ID NO: 6974
  misc_feature (1)..( 3000): 2750-1469P.txt file - cDNA_ID_2044057; gDNA_ID_1621119; Annot_ID_172003

SEQ ID NO: 22030 - DNA, 3003 bp, Unknown; identical to SEQ ID NO: 18261
  misc_feature (1)..( 3003): 2750-1469P.txt file - cDNA_ID_2044091; gDNA_ID_1621119; Annot_ID_171991

SEQ ID NO: 22031 - DNA, 3000 bp, Unknown; identical to SEQ ID NO: 6982
  misc_feature (1)..( 3000): 2750-1469P.txt file - cDNA_ID_2044102; gDNA_ID_1621119; Annot_ID_171983

SEQ ID NO: 22032 - DNA, 3003 bp, Unknown; identical to SEQ ID NO: 18337
  misc_feature (1)..( 3003): 2750-1469P.txt file - cDNA_ID_2044232; gDNA_ID_1621130; Annot_ID_172454

SEQ ID NO: 22033 - DNA, 3000 bp, Unknown; identical to SEQ ID NO: 7281
  misc_feature (1)..( 3000): 2750-1469P.txt file - cDNA_ID_2044319; gDNA_ID_1621137; Annot_ID_172700

SEQ ID NO: 22034 - DNA, 3003 bp, Unknown
  misc_feature (1)..( 3003): 2750-1469P.txt file - cDNA_ID_2044338; gDNA_ID_1621147; Annot_ID_173110
gagatgtgtggctccgattttacccggagaggttcttatcaatcgctaagattaggaaacgtgaaacatttgatcctctgtgtatgattttgtatacttgcgttgatggaagctcagagattgcttcagagctttgtagctgtcaagggctcaccatcatcgctgaaactctacggacttcctcttccggtaacactcttattcctgaagccaaaaatgccattttgatcttaaagtcgtgatttttatctgatttgagccaatcttgttataattgtttgtagttgggtctgtggaggattattggctcaagttactggtttcgagaatctgtgttgaagatggttacttcctcaagctcttctctaaattatacgaagatgctgaaaatgagatattttcatcagagcaagcctttcttgtgaggatggtgtctgatattgctaatgagcggataggaaaagtgtcaatccccaaggatacagcttgttcgattctcggattgtttaggcaatcagttgatgtttttgattttgtttcgggtgaaagatcggagcttccaacgggttcaactatagtagatgtgatgggctactctctggtgataataagggatgcttgtgctggaggacgtcttgaagaactcaaggaggacaacaaggattcaggtgatactgttgaattgctcttgtcctctggactaatagaacttctccttgatctgcttagtaaacttgatcctccaacaacaataaagaaggctttaaaccagagtcctagttcttcttcttcttcattaaagccgtgtccttacagaggattcaggagagatattgtgtcggtgattgggaactgcgcgtacagaagaaaagaggtacaagatgagatcagggagagagatgggctctttttaatgctgcagcagtgtgtgaccgatgatgagaacccgttcttgagagaatggggcttgtggtgtataagaaatttactggaagggaaccctgaaaaccaggaagtagtggctgagttggagattaaaggctctgtggatgtgcctcaactccgtgaaattggtctcagggttgaaattgatcctaaaacagccaggccaaagcttgtcaatgacacctgaagcttcatttgtctcagggaaaagaggagctatacaatacacaacaagaggtccttcttgaggcggtgaagatcataaagaagcacggtgtgtcgctaggtaccacctgggacaattctacattgtgagtgatcattttgtagagacaaggaatactgatccggaagctatctagctagatggatccaaaactctgtgtttttgggaaattacagaaaatcgtgatgacttcttaggtttcaagagaaaaatgtttcatattggccttgcttttatttgtttccttcttggtatttatagggttctaacaattcctatatacatgaaatgatcaattcaatatgttaagcagaaaatggctctcgtttgatgtggtttgcagtgcatgatcaattagttcagctcaacttttgtgaagcctttcatgtctgttggtttgtatttaagttccttgttgtaaaccttctaagcagttgttgtgtttcactttctctataatagaaaggcaagttcttctctatattgttctgttgacgatcaaaccaattgtgatacaaagtctgattctctttctctggtgttctgtttctagaaggagattcagtttctaacaaggttcactgcagtcacaatttaccgatatgcagtcttttctctgtttttagattgttatgtttgtttgagcagaatcatgttgaaggttttctcgagatgtcagcaaaaacttactttaccacggcttgcagacttgtacatgaaagttgatgatcaaaccaggactgattgattgattgattatacaaatgaaaccaaaagttccggaaaatactctgtgataagaatcttattgctccctgttaacatatggttcaatataactccagaaaaaaccagagtcgttggcattgagcattgttgtgtgtattcaggaattgtttgatagtctgatttgcgtaatttttcagtcaacattgagagatctaactagtttgtttgatgttgcagtaccaaacatgtctgattcagaatggcaaacacatgttctggaatagaaacagattccatttaataaaagataaaaccattatcttaacatagaggtatcataagataaaccagaaacatagatagaacaaaagataaccaaagttgcaagaacaaactgaaatgagacgttaatttagcatctaactggatgatgatgcttcaaagctttataatccgcttactcttccttggtttctcaagggcagattccacatcataaccccaaatcattttcaaccactcggaacttttctggtatagaggttccgaagaagacggatctttatcgtaaatcctctgttttttctttaatttcttcttcaaactcttcatcttctctatgaagtcttcgtcaataacagtgcttatgtattcatggacgacgaattcgtatgctccgtttatatcatcaacaggattcttacctgttacagatttgaaatccaacataccttgtagcacaaggacctcatctttcgaactccactttaacatttgagaattctccttttttgcatctttctttgattgtttggcactcacgttcttccgcttcttcccagttagcttagcttcaccggaaccaccacaaaccttggaccggttggtattggctttgtccattatcagacggttctctgagagaaaaagagttcgtttttagggagaaaaagagttcgtttttaggtttcggctgtttttagggttcggctatagttactatatatcattagtacgtttaacctaacgttttagtaaactctcatgccagggcctttacttgcggaaaccttcttgatggaccaaaagcttctccttcgatg

SEQ ID NO: 22035 - DNA, 3003 bp, Unknown
  misc_feature (1)..( 3003): 2750-1469P.txt file - cDNA_ID_2044344; gDNA_ID_2926128; Annot_ID_196745
tttgggcaaagttatgtctttatattaaatgtcgtgtctatgagtctatatttatgtgatatagaacaagcttatcttttgatttacacttttagtaatagtagtttgttaagaaaacatgcataaagcataattctatgtgtgtgtatttcacttcacatatagcatatatatgaaaacttctctctatttcctagttaaaatctctacagtcgtagttaattggctaggattaaggaagttaagcgatcatttagcacatatgtattgtgaagttttgttgaatgtttacaaggtttgtttccaagtgattgagatgacaaatcttcctctgttcgcaacaaccacgttgttttacacttattcccaagcatcatttttttttttggtttatcttttaattgcaatatacatatatagtacacacatacacgagatatatacaaacgtatgcaattgcattctataaattgatgttagtgaaggatatttccaatattacaagcaagcatttatttatatgttatgtacaatgtcttttgtgttataattagattgttttattcagcatatatttttctaaatcggtggtcttgattgatcaattactcctgtcgtgtttttttggcattattgaatcaacaacatttgctcgaattcggaaactcttccaattattaaagattgctgaaaatatcattttatctagattcttatcactctttcatatttgttggcattattatccatttcaatttcgttataaaaaaaacaggtggtaagtttgcaaactgagctttcatatctacaagcacacttagcaactctagagctgccacaacctcaaccaccacaggttccggtgtcatcttcaggatctctacaggctctttccataacggacctcccaacaatatcaccgtcggtgtacgacctctcctccatcttcgagccggtcatgtcctccacttgggccatgcagcaacaaccacgaccgtctgatcatctcttcggcgtcccgtcatcgtccaatatgggcggaggcggtgagctccaagcactggcgcgtgagtttattcacggtgggcaaatgccagctcagccatcgccgggaaccagtggttctgcctcgtcagtgataaaacgagaatgaagttatttttatcgtatgtttgtttatttggaccgtaagagatctatagttagccatatgtttctccttgtaatatatatacttggtcgaattcgtatttaaattgttgtctagaatgttaatataagaactatatgatttacattgattaaatggagtatcttataggccaatatgttgaagttgctttggtctcttggaccatcgaatatgttgttttaatcagcctagagtacaccggttctccacaacttgggtggaatcttgagcgtgaaggaggcttgattctggcgcgagacacgaaccaatgagtctcatttctcattttccctatcacttatattgggccttaaatgggttcaataaagtttttttttcttatatcaagcagcccaaaatattatttaaacccgactcaattgagtttgatactctggtttgctttgtagtccacactattttaacaacatcttcgaagcatgcatttgatttaacaatcttcctaatttactagagaatttgagccaattttgtcttttttttcaccatttttataaaagctggttttcaacttgtgttctcttagcatttcccgcctctacatcaactagaaggccctacacggaccttgaacatgatcttagcgatgtctaaggactaagctacataaaccaatgagtaaaatacatatggattggacaataatcaccaatcaaaaccccaacgtcgattgcatagccgataagtagtaccacaatggtgagaggaggatagtgccagcggctatgaagggtcgacgtaaaccaaaccttgatgagacactgtaaaacacgactattggttgaacaatcagttccaatcgaggctcacaaagtcaaagcatgcttgtaagatatttggagtaattgaaggtacggtgtaatcagagcgtttcttgaattgccgaaatgaagtttagccctatggctatagaagcaataagccatttttatattcataactttagaggtattaataagaaacatatataaatttttttataaatgtattgacaaaaaatcaagtaaaaataagcaagatgcaaaacataagcaacatttctaattaatattatataattttttataatgattttatacatgaaaaaatctctaattaatagatatgacacatgtgtgatcatgtgagttatcaattttgaataattttttaatactaaattgacatattgtttgatcagaaaatgtcattttttgaaactaagtgaatgaataaagggttgagctaagcaatatataattgttgatgatgaaataataacatgaatacaaattatatttatatgtgtgtatcaattagtgtaatatttaagagagaaccattggagtagagccttacaagacaatatatgatcaccattggaaaactttaaagctattactatggtaaaaactcaattgcttgaattcgaattcaagtaatcaaaatcttattattagctcaaatctcaagttcctattactactctatacatatacatgtgtattaatctatgttatcaccaaaatagaaacaattagatatagcaagtgaccactattttccttctaagacaccatacgaactaatttttatcaaaaacaaattatcaagctctattacaattccgcatgtgtgctatacattagattaattaaaagaaattaaatctgttttcactccatttatcaaaagtaacatctttaacgaatcaaacccataaggtactcttactctctattaatagaggagaatgtgtcatcttctcattactcaataagcatacttatcatatacacaataccacaatg

SEQ ID NO: 22036 - DNA, 3003 bp, Unknown; identical to SEQ ID NO: 22035
  misc_feature (1)..( 3003): 2750-1469P.txt file - cDNA_ID_2044344; gDNA_ID_1621147; Annot_ID_173108

SEQ ID NO: 22037 - DNA, 3000 bp, Unknown; identical to SEQ ID NO: 7473
  misc_feature (1)..( 3000): 2750-1469P.txt file - cDNA_ID_2044354; gDNA_ID_2926128; Annot_ID_196742

SEQ ID NO: 22038 - DNA, 3000 bp, Unknown; identical to SEQ ID NO: 7473
  misc_feature (1)..( 3000): 2750-1469P.txt file - cDNA_ID_2044354; gDNA_ID_1621147; Annot_ID_173105

SEQ ID NO: 22039 - DNA, 3000 bp, Unknown; identical to SEQ ID NO: 7500
  misc_feature (1)..( 3000): 2750-1469P.txt file - cDNA_ID_2044488; gDNA_ID_1621148; Annot_ID_173137

SEQ ID NO: 22040 - DNA, 3003 bp, Unknown; identical to SEQ ID NO: 18501
  misc_feature (1)..( 3003): 2750-1469P.txt file - cDNA_ID_2044504; gDNA_ID_1621148; Annot_ID_173134

SEQ ID NO: 22041 - DNA, 3003 bp, Unknown; identical to SEQ ID NO: 18503
  misc_feature (1)..( 3003): 2750-1469P.txt file - cDNA_ID_2044522; gDNA_ID_1621148; Annot_ID_173126

SEQ ID NO: 22042 - DNA, 973 bp, Unknown; identical to SEQ ID NO: 7483
  misc_feature (1)..( 973): 2750-1469P.txt file - cDNA_ID_2044534; gDNA_ID_1621148; Annot_ID_173120

SEQ ID NO: 22043 - DNA, 3003 bp, Unknown
  misc_feature (1)..( 3003): 2750-1469P.txt file - cDNA_ID_2044619; gDNA_ID_1620302; Annot_ID_152681
gtaaaacaacggtggctaaagtaatcaaacggtggtatgaaataggcggctaataagatatttttagccgcagatatttatgtgtctctgagattgacacgtgtccttatatagttggatattggagaacaagttagaaagttcacgttgagaatagttgtgagtccgcagagaataattgctctcatgcgcagcccacaagggcatcataggacccgattggatataggatccgacccggttcgtgtcaataccacgtgactcaaaaagaaactcccgctcttggcgacttttcgaaaccctaaagagactcgtatttcccccctaacgccgattttcccgccgctctcactcaattacaaaaatccgtagatccccaatctccaatcacatatctcccacaatctctttctcgctctctcgatcatcagattcttcaatctctttcaccaagcttaaccaaatcgttaccatgaaggatatctctaaatctccggcgagaagaagcgacggattccaccgctacttaaaaccaggagcgcttgctcagatccgaaactcgagaatcaacgctagatctactacatctctcgtatctcgctcctccctctcgcagctagtagatccgatttcaccatctgagaactcggttgatgaagcagcagcggcttcgcggaatctgacgatagatcaggtaccacatcttctaagaaagatctatggtccttacagttatcagaggaagaaattagccgctgctagatctgtctcgtcgatgatgatgatgaatatcaatcctcctataaactcagttcttgttgaacccagtagtgatgttattgctcattgagttaaactagtttctaccaaatctgtaatctgatgatacaattcgggtaaaatgtttaatactatcataagactcactatatgaatcattaaattatcaataaattgtgtgttttcaattgatgagtttatctttgttaatttaatgtttgtgttgatttgatatcttacgatttggatttgactatagattccttcactacatattaatgaacacttacatgagtatcattttgggattcttaatgatgtatatgtaactcttaagtgttgtaactgttttgaaagattagccaaacacttaaagattcgaagagtaatgatataagactacatatatttttctcaaatttgttatcatcttgttagattgtaattgacataggctatgttacctcagtcaattctctgctttgcttaatctaaacatctcaaatctataggttttgattatctctctgtttgttgtgatgggtaaaaatgtttgccttctgctattatcagacgctattgtctcagaccaaatggttacctatgtttgtcgatgggtgttaacagatttcatttgcttggtggtattaccgcatatggaacattggtcttggtttatttagtctcatcattcgatgttaataagttttatctatatgctttctttcatttgttctaatgggtaatgatggttatctatatgttgcctttagcaaacgtcgctgcccatatggttgaacttgaatcctgatccaactgaacctctttaccctctgattatgcaatcggttattaattgatgttgatatccccaagtacatatgtatgttatatgtaagagaccattcataactttcactttctacccttcaaagttttatttaactctcttcattgtcaaatccttcatctttactactttttcaatatctccccattatgtataaatttaatgcatcaagtactacaactattccacatgtgcattgataaatcaacctcaaaatagaggtaaaagagagagagaaccacttttttgaaaggagtggaattgttctcgtatcacgagattacataaacgtgagtcgtccaaactactagattcgaataaaccaaccaaatcacaaattgtttcttttaaaataatgaaacatgatgtgaaaacacaactcgtagcctatttgatattgttttcgttcatgttttgtcgacgtagacccatatatcttagtaggttttgaaataaaccaaactgagccccaactaaagctactaaaccacggtcgatagaaccaaaccgacgtaaattcaaagctataaactcaaaccgaattataaaatatgaagttatgtttgattttgatatttttctcactgaatcaaacctaaacttaaaccaaaatggcgaaatctgaaaacccaatgtaaatgcagactccctatggtcgattaattttgttgttgcagaattctttagaagtatgatgtgacatcaccttgactaatgctaatgtcatcacttaatgtaaagaacgtactaatatttagcaacgattttaaaaataataagcatctcaatacttaagattatctcaagtaaaactaataatccaaagccatgatgattcatatgaagcccactgcccaccaaggcaagccaaatgtcgatctctctcgctaccagcaaccaccgcacttgcctcgtccatgtcacttccacaaccataaatttttttggtgccactcgaaataaaataaaaatataaaatttatcaaaatcattaacgatttaaagcaaaattctaactttaataagataaagctacaatccggagatggtgaaaaaactttaatccatattcacattgtaagtttttctatggaaaatcacttcttctttttttccacgcggtttcaaaggttaatcataaaaagagtagaagttaaaggaacttttttgtatctattatagtttgtttttatatgtattgtgaccacaaacacatatatctacatatttattttatatataaagagatagataatctaactgagaaatccacttgaagctattcaacaatttttatagctttcttcctctccaaaaccacaccaaaaaaaaaaaaaaaaaatttgattttcagatccaatcaaccagagatg

SEQ ID NO: 22044 - DNA, 3000 bp, Unknown; identical to SEQ ID NO: 633
  misc_feature (1)..( 3000): 2750-1469P.txt file - cDNA_ID_2044638; gDNA_ID_1620302; Annot_ID_152673

SEQ ID NO: 22045 - DNA, 3000 bp, Unknown; identical to SEQ ID NO: 638
  misc_feature (1)..( 3000): 2750-1469P.txt file - cDNA_ID_2044667; gDNA_ID_1620302; Annot_ID_152663

SEQ ID NO: 22046 - DNA, 3003 bp, Unknown
  misc_feature (1)..( 3003): 2750-1469P.txt file - cDNA_ID_2044755; gDNA_ID_1620303; Annot_ID_152716
actcatttaataattcttatggatcctttataatatttactaatgaagttttctttgtcatcaatcaataaaactacaaaagaaattaagttattgataaaccataaaagagttttgctgactcagaagcaaatactaacgatgtttattttttgaaatttaagaaatggttatattgcttctatagaacgagcagaaaactgtacttctttgcatgtgttggggatagttttcactttcaagtgtttgtaaagaaatagatgaaattttttgagtgtttcgtacaaaccaaaaattagtcttgaatatactaaacgtctttttcactacaacaaggtttacttttcatgctcacatgttcatgaatatatatctagattcggatccctcttgctcttataaaacatatacggttggcatttatgtaaacttactagtattaaggaaacgaaacacatatatcccacttgagtattttttttatatatagataatttttgccgcttacaattttggagagttataaaaaatatacttaactgttgttaagatatcaatgacttttttttttctgaaaaaaacacattcatagattttttaatcttcgtattcttatagtagggattttaaatatctaaacgttttattactgaaaacatatttttatgtaaagtaagatttgattgaagagaatgcattttggttttaaaatgcgttgtttgggtttaaatgattgagaagacagtttattgccgaagtctctccgatctacaacggttcacactaagtggaggggcttcttcggcgatggtttgccacccacggccaccaccattcttaaatgctccgttttctattagaatcatcgtgtgagaattgagaagaatttgaaagaaatggttttattgcttctatagaacaagcagacagctgaaaattatacaatgcatgtaattaatgagcagatgataataccataagacgacaatttttgtttttgtgtgtgtaaattatatgtgatttatgtttatatatacatgttatactgtttggattatggctttgattcatatatcgtatcatccataagtcatgttcgaagctattatattgttatttttttgaagccgttagatgtcattataattgtattattcaaatataatcttaatgtcaatcaaccaatgcaaaatctatgaacaagtgatgttacatatatttaaatataaaagtataacaattccatgataattaattaatggttgtgaagtgtatgactatgtttgcgctggagaatattgtgcgacggtcatggattgatcattataggatgaatctacactttacacacgcaatgtgaattgaatcttcgaatattctggttgaaagattatttttcatgatatcatggtagataattcttccgataaaatgcagaacattgaagttaagccaaagtcagagtaaagtttaatctaaattatatggaaaattgtatgaagtatcttctctttttttattgaacgactttgtatgaaagatctatggatctaataatttatgaatggggggctttgtctccgactctccaaccaattaatacactgaacttgggatattctaataggcatttaataatataactaagaacatttgtattcttataatattgaagttttggatgataatgcaaaaagtcttgtgattaacacatctcactattatagtggtttagtaaaattgatgtatggtattgtttaagcactaaggttatgcaacagttcgtaaacaattaagcaatactacttcttcttgacacaattaattatgcaacattaaggttcgttattctcattaatgaacctggactgattacagactttgctaataatgtaaagctaattactggttaactccggtttacacaataccatatatcaattttactaaactactcttatactcactgctcagtctttcatgacttatttttgcactattctcttcctcttgtatatgtcccacttctcttacaatactttctttcattcgactacttatcttctttcgtagagttaacgtcggtagcctgcctataccaacttttgttaatgaaattcattttctcgacctttttcgtcccttctatatgtatgtgctacacaagctttgtcaaaagacatttttcattcaactaaattctgtgaaattatgacactttttcactaattaattactcataaactacaatttctaaactagaatatcatattaactcatccaaaattaccccaaaacaaaaataaaaaactcttgttttttttgtttgggttaattttggaccaattaagtagataataccgatttctcaattcaatattcctaattactttccaagtgttagaaataatattgaatggcaatgcctactattatgtggccgacactacaaagattaagaatgggctctctaagcccattagttgggtaataaagcctgtaatgggtttttggttcgttacttagatctaaccctctaatttatttagtgtctttgacacattaaaaagaaacaacacctcttcgctttggaacttgaatggatgaggcttattgacaaatacaaagaacgaggaaaatgccacaccacaatacaaacacacaaagccaaaaagtaccaagttacggtactgtcggaatattacagcatcccaaaatcccagatttccacgtgttaaaacaatagtacttttttatcaatctcatgctggtgacataattaatagtgatagtgatgtgactcaaacaaactgattgtagccattgaagaagaaaaaatcctttagacggaaacaaaaaagaaaccccacatgaaaagtagccaacgttcaaattacaggtgaaacaaattcaccagaaaatctgagaaattgttaagatttctgtattgaattaaagagaaaaaaggtggaaactttattgctttttggccataaaaagatg

SEQ ID NO: 22047 - DNA, 3000 bp, Unknown; identical to SEQ ID NO: 649
  misc_feature (1)..( 3000): 2750-1469P.txt file - cDNA_ID_2044774; gDNA_ID_1620303; Annot_ID_152710

SEQ ID NO: 22048 - DNA, 3000 bp, Unknown; identical to SEQ ID NO: 644
  misc_feature (1)..( 3000): 2750-1469P.txt file - cDNA_ID_2044782; gDNA_ID_1620303; Annot_ID_152708

SEQ ID NO: 22049 - DNA, 3003 bp, Unknown
  misc_feature (1)..( 3003): 2750-1469P.txt file - cDNA_ID_2044866; gDNA_ID_1620304; Annot_ID_152750
atgctgaaaacggcatgtcgttttgtttgtttgaaatgttggaggaaaataatcagcaaacgacgacgtatcccctcgtgttctgaagtatggaaacggcaggtcgttaactcttgcttcaaaaagaagtttccctctttcaatttttttttacttattcattgacttcgcttcttcctctttgtcgttaactcttagataattaacacggaaaaaccataagtaaaaagcaaaacaaatagataaagaaaaagagcatatacttcaaaacaatggaagagatgatgatggggtcaatacgatgtgaggaatcagaagaaagattccagcgactgcgtaccctaaaaggaaccagaaccaccgtccattaatggaagcgagaaacttgcttgcatcccaaagcactttcataaagtggcaaaagagaaggcaagggatcatagtttccatactcaccatcatccacatttactctaagaaatgttgcactcctgggggctgggacaggatgtccatattttgatgcttccgcactagtcttaggctccatcggttttggaaggaagttgaagaacatttagaacaatacactaaactgtaacgtcgtcattttgccaaagagaaaaaaaaatgggccactcgattattatttgtttagacccgttggtaatcgggcttaaacgggtgaaccctattaaattatttattttttaaatggattcgggtaaaaaaaacataacaaatagcccgtttagactcgcgggcttgaggcccattgtaacatcactagagagagaggtgtcttattttattttttttatgagtgtttaggaccaaaattagattatcgggctttcttcacaagccaattatcgtacaaccatgtttgagttccagtgaagaacctttttgacgacggcgtatactcgtatgcttaaatatgaaaacggcaggtcgttctttttcttcgaattgtttggagaaaagaaatttcgaagcgacgacgtatcgtcatgtcctggaatgtggaaacggcaggtctttgtttcataaaagcttagaattcttggaccatatttagttcatgaatttatcatacgtattaatatggttagtgattgttttaattagggtactagatgatttattatgacctaactgatatatccacctaaatagttttgatccgtagcttttcagttgattcacgagaccgaaaatttgaactaaaatggagaatttgtggattataaccaaattacaatatctatatgaaatataacagatactgaattagaatagaaaacatgttgttaaaaaatttaaaataaaaataaaaataaaaatgggcaaaacaacaaataccaaacgtaaacgaagatattagaaaaagaaattctaaaacagtggcgtttttctgtccaaatccaaaactattatgaagggacgtttctgatatatatataaaaaaacccgagattttatcggatgtgtcgtaatgaaaggggtaaaacacgtggcagtcaaccaggctgtcagttgttggtgaaagcagacaagcgcgtgattttaatataatctctctttacccgcgccaacaacactttaccaagacagatctctcatggcggtgctctgatgcttcagcctttgattttttccttttttgacctttttaatctctaattataataatcagtacaaaatcactgttgtttaccattaatttaaggaattaatcctaatctgattttaaggaattaatctctatttgccaaagaagaggcgcaaaggctccgtcttttttcttcttcttgtttctgtgttaccgatctggctctgtcttcttcttcttcttcttcttcttcttcttcttcttcttcttcttcgtttacgtctctgtgaaatgctcaagctgattagggtttatcaactttttctcaactttcttgttatctccttcgttatcctctctgtcttctcaggtgactaatcactcactctatcgttatccacttgattgttttgtttcctgtttgctttttgatttgagatctatttttgggttcagattgttgtcgacagctaaattctttgatgtatttggatcaaagtatccgtttttatttgatttgttccgtcttcttcgtgatcgtgtttgtgtctgtctctctcctagatttgggttttggggatttgggtatgcgttgttgtgatcagaagggacctttatcgtttagtgatctctttgatacagagagacactaaaaatggtgaaaaaatgacaaaacttcttattggatgagggaagaaacgttctaacgtgttccatcttctatcattttcttcttagatattttaagattgactgttttctgaacatttcatgctttaggaagtgttaagttgaaacctttttctcttagctctccaattgctaagtgttttttctgttgtctttcttaattatcttttgggattctcatgggatttgattgaggtagagggaagaagagagagagacaaaaagagctttaggctattgtctagacttgcttaatttggaatatatgtgtgctgagtctagtattttcctctgtgaaatccagctgatataatcatgatagtaacattcagtttcttttgtcctttcattgattgcagcttagcagctattgtgcatttgaagctgtactcggaagaaaagcccatagaagagtcaaatgtaagttctcttactgattcttgagctcccaatcaatgcatagaagctgcgataataacccattaattatgtagaaagtttatatgctcattggtcgaccatacactttattttggctgtttctgatgttctggcttaacatatctgttttctttgctgttcttgtgattagcatgaactaagtttctgactttgaaatcagcaaaaatgtgtcgtggttggtcatgctggaatctttagtgctaattatctctggctcatacagataacaaaaaatg

SEQ ID NO: 22050 - DNA, 3 bp, Unknown
  misc_feature (1)..( 3): 2750-1469P.txt file - cDNA_ID_2044895; gDNA_ID_1620304; Annot_ID_152738
gat

SEQ ID NO: 22051 - DNA, 3003 bp, Unknown
  misc_feature (1)..( 3003): 2750-1469P.txt file - cDNA_ID_2044906; gDNA_ID_1620320; Annot_ID_153306
gtgatgaagtaaagggtcaaccaaaagaaatgactgcactgcgtaatgcaagtgctaaatacatttgtcgtatgtgcaatgtggggtgccacagtccaattgtctttgaaactcatctaaggggtcagaagcacgctgccaatctgaatcaatcaaaggcatgtctcttacttttgcatatttgagagcatataaaaaactacagtgtggtagacatatgctttatgtaataccgtaggatcaggcactcattgattctaagaagcttcaagagaaaggtttcggagaaaaagaacaaccaagagaaacaattgtagagccacagttgcagtctcaaaacgctcaagagaatagcaagtgtttcgaaaagcatgttgtcatggtgaatcaatcagaggtcagtttcttaatattggtaatttggtattttaatttacaatttccagtgtagcaaaacatatgctgaatatgagagtcttaactgtggtaaaatatataaagaatgaagcttatatagttgcatcaggtactcatcaatgcgagtaagcttgaagagaaagatgcccaagaaaaagctcaaccaatagaatcaatagccgaacctcagtcgcagtctcaaaacactcaagagcataccaaattctttgagaagcaaaacgaagagttgagaaagatttgtggcactttagaaagcagtgtaaaagaacctcttccaagtactaaggactgggtggagactcttaacaaacagattccaaatggagaatttttctttggtgacctaagatctgattttgaagtacccagggaagcaaggtaatttttgctaacttggatttgcttgcttagtatgtcaaagatgcaattatctaaatgtattctccaacttttgtcatagtgaatgttttgatggcattgtcaagcctgtaaacctttccaaaggagaaactaagcattcatgggaggtaaagaagaagaaaatcgaggtgaccgtacgccatgcaagaccagctgcatctaaactttgtcatctttgcgtagtgatttgtgatagccggggtttgtcaacagttgtttgtgataacaaagctcattggccgaaccaaaaacatactactgtagtgacacttacttcatgttctacctctttatccttgatcaatatcaaacccttctgacttcttatttttgatgtaggccgcctttgtagccagcaatggttctcagtccagcgtttcaaccaatcctttgaaggaaccagagggtttgcagcccgtgtggtgccaagtctgccagatcagctgcaacagcaaggttgcatttgcaagtcacacatatgggaaaaaacaccgacagaacttggaatcacaatcagccaagaacgaaactatgtctactggaccaggcaagctttctaaagattatggagaaaaaacgaagaaagtatcatgcaaaaaccaaaccacatttgattctcaactgaagagtcagaaccattataccatggcgaaggagcttgtagaggtaaatcttactatttaggttttctttcgtgaacttggaatctgcttttagtaatgaatattacaaatcttagtaaaaataatatccttaggtttgattcctatcgaaagtgatgaagtatatattagaccttaactaaaatatcgatgtagaaggcatttgtctccgcatttgagcatgtctccgcattggagcagttcagtattgttgactcaaggacaatccgagaagacaccgaccaagaaaaagaagcaacaaaggagcagacacttgtaaagatggatggtaatgggtttcgaggggcaccagaagataaagtggaattgaaccaagaaaaacatagagaagcactggagcagttcagtattgactcaaggataatccgagaagaaaccgatcaagaaaaagaagcaacagaggagcagacacttgtaaagatggatgatcttgggtttcgaggggcaccagaagataaagtggaactgaaggagagacacaccgtatctgagaacttggtgcaccgtgtcttcactgaacagaatcgagagtctagaatacccaatgaaccgaggtaagagccaacattcatgggagtgtataatatggtctctctctctctctctttctcttgaatctcgatcaatatgtgtgtgtctaactggttgcttggattttgggttacagaggatgtttagatgtgattcctgagagagtaaaactgccaccaaacgtgaatgtggccaagaatttggaagatgagcagaagcataaacccgaaccaaaagcacaggaagccgaaaacaagtctggaggacgcaaggatcttcctggagaggctgccaaaagggaagagattaagggccaagctgataacttttggactcgcctttgggggaaaaaatattaaaataatgtgaattgttaattcatgtttaagttgtcaacaatggatgttttcttttgaatggcagattaacgttttattttggattggcttttgcttatttcttactgttgtttcttatatataaactttacctcttaaaaaagattcaagaacaatagaatttaggcattgtagtatataggttctctcaataaattgggaaataacgaccggtttttccaacagaattttcggcttagtctgtaatgtaatcatcaaaaattgcattatttgctttacgactacagctcaactgggccaccctgattacttatccgacccggcccgacccatccggatcttccttctcttgtttaaattaaagcagataaaaaggaaactggaaaattcagttcaagtattgtcgtcggaatattactcttcaccggccaggtaaagctttcctacgactatgcttgtgttcgtcggaatgtgtttttctttctttttcttatagtctctggtcgctaatgactcgtattcttggtccagttttcagctcttgtgtgtaaatttgttagtcttttttaatg

SEQ ID NO: 22052 - DNA, 3000 bp, Unknown; identical to SEQ ID NO: 779
  misc_feature (1)..( 3000): 2750-1469P.txt file - cDNA_ID_2044917; gDNA_ID_1620320; Annot_ID_153301

SEQ ID NO: 22053 - DNA, 3000 bp, Unknown; identical to SEQ ID NO: 786
  misc_feature (1)..( 3000): 2750-1469P.txt file - cDNA_ID_2044940; gDNA_ID_1620320; Annot_ID_153295

SEQ ID NO: 22054 - DNA, 3000 bp, Unknown; identical to SEQ ID NO: 787
  misc_feature (1)..( 3000): 2750-1469P.txt file - cDNA_ID_2044958; gDNA_ID_1620320; Annot_ID_153291

SEQ ID NO: 22055 - DNA, 3000 bp, Unknown; identical to SEQ ID NO: 798
  misc_feature (1)..( 3000): 2750-1469P.txt file - cDNA_ID_2044985; gDNA_ID_1620322; Annot_ID_153382

SEQ ID NO: 22056 - DNA, 3003 bp, Unknown
  misc_feature (1)..( 3003): 2750-1469P.txt file - cDNA_ID_2045020; gDNA_ID_1620322; Annot_ID_153371
ttgtcttaacatggatgttccaggttaaacgatttggagtaattcctccaagaatcatctcgtcaaggaaattggcagcttcacgaaacttactaatagcacagaacccactgattactttcccatataatccagcatcaggtttcaaaccctgaagattcattctatcaagaagttcaacggcttcttgaatcttctgctccttacagagaccagtgatcaaagtggtatacgttaccatgtttggcctgcagcctctagccatcatcatctcaaatagttccatggcttgcaaagaacgcccatctttgcaaagaccgtccatcaaagaactgtacgtgaaaacattcggctcaatgcctttacttttcatctcttctagatatctcatagcttcatcaacatttttcgatccacacaaaccgttaatcagagaagtataggtaacaacagttggtgcacagtctttctcaaccatctctgtaaacaacttcttcgcctcatctatccttccgaacctacacaaaccactaatcaaggttccatatgtgtaagaatccggatcacaccctctcttaggcatttcaagaaaaatcttaagaccagcatccacagttccgtcatttctgcaaagagctttaatcaaaacattgagagatgccacagtaggaggcaaaccaatctctctcatattcttgtaaaacttaaatgccaaatttaactgattctcttccacgagaatggcaagaacagtgacataagccttctggctaggatcacaatcaaaatccttcattttgtgaaaaacccttaaagaatcaaacggcctatgaacccgaccataccctcgacatatcgaaagcaatatatcttcactaacaacacaattctcaatcttcattctaacaatcagatcttcagctgctttgaacttattagcagagaccaacctcaagaccatataaccaaaagaactctgatcatgtacgtacccatttgcgtattccgccgttgcggaatcaaaaactgccatagacttctccacatctttttcagctcgcatcagtttgataacctgtgaaggcgtgatgttctttgaccacttgaacatcatcactttgctacccattactaaacaatgataccttccaacaatagcaaagaatacacctttttatagagaagaatctcagctacgcattacgtcgaacaggttgtgtgcataaacgatttcgataggctcaaaccaaatgaaagaaacacagaccagaaaaatcatttgatcttcaaaacatacgagttccaaaagtgaaggaagcaacaatgaaactcgttacgaactagaaggttaatcaaattgccggagaagaatcgctcaccagttttggctagggtttatgaaatgggagactttagctgcaaagagaagagtctctggacgatttagagggtgtctctctaacaggcaacaaagtacatattattacagtattaaccaaatttaaacgaattaagtgtcaacaaaagcttatataaaaaatttaaagtttaaaaattataaaatatgtcaacaatattttagtacttaaaattattatgcgaaatatttagatcaatggactactcatctaatatatttgcacctaattttaaagtataaattcaaccaataattagaaaatgatagcttatactcaaattcaacaaattatatataaatgtatagatactacaatatcattaacaaaagtcaccttaaataaatacacatatcttttatgttctctattgttttgcgtacgctaacacaatttctcatatgcaaaaggatgaatgagtaacaaattacctcataagaacaatcatctttgcttacatactaatacaataatcactcaatcaaccaataacatcaatcacataggtttacatacaataatcactcaatcaacttcataagaagaatcatgtttacttaattcatcaattatccccaaaaacactactattaagtataaactataacatatttgtagtgatgggtcaacatttttatcatatttaaactcgggtttcctcaaatcgagaaatagtgaacatgtaatattaattttaaatcgcaattacagaaattaattgaatttggtcaaatggacagaattttataaattgggtggaactagaaaaaaaaaaaaaaagagtatagggtgaattgagtacatgaaagtacatggtaatcctagttaaacgcataatacatgtgggttcatttgtatttttttgtaacttacgagtaaactggctacaacaaaaaaaaattagaagatttttttgttttgtagaaaaccctaattttagttatagttgtataactttgataaaattataaaattgtattacgaaaaaagtaataagatattcaaaaaagcctagaataacgtatatgactatgagcatgaaactgcaagtcaaatgctgacagacaaccataaacaaaagaaattaaatagagatacctttaaaataagtaaaatttcatttataaaaaatctactttcttgtgaatctgtcacgttcaataatttgaagaccactcaacatacaaggtaaataatgaaaaataaaatctaccaaaatttcaattattattatcttccaaaaaaacaaaattatacagatgatgatggtgatatggaacttcgattggctaatattcactgtgtctctaaaaaccatccacttatcaagataagatggaccctacactcatccaatctaaaccagtatctcaagattcttatctaattacatcattctctaccgttagatgaaattgaccattaaccctaccataactccatacaccgcgagatactggattaaccaaatcgagatcatcgtagccgtccgatcaacaagtaccatctcttgaaatactcgaaatcctcataagtccgtccctctttgctctcactatcaaaactctgaatttcgatttcaatg

SEQ ID NO: 22057 - DNA, 3003 bp, Unknown
  misc_feature (1)..( 3003): 2750-1469P.txt file - cDNA_ID_2045038; gDNA_ID_1620322; Annot_ID_153366
ataaaaatagttttgattctgctcctattaaatctttatgaaattgtaaatgttttatggattttgattattggaccaaaaatcttttgtctatgcaagaagtgttactcacttactcataaatcgagatgcaaccaaatttatcttgtcattcgtgttgatcacgacaaaatcattttcctaccttttaaatcgcatattttggtctctctcacaaaaataaacactaaatttgatttctccaaaaataatttctgtgtagtctccattgtagtctcatatgggtttattatgaaaaagtcagcgactcggcgctaattttaatttataattcattattagatattagggatttttaaatggaaatcatataaatttatatgatcaagaaaaaggatgtgtttcaaattttgatatagtttaagatatttatttgtaaaatttgtatttgaataaaaaggataaactttttggtagaccggttcgaaataaaaatttgtgtagaattaagggattaatgattcttctttaatgttttaaataggccaagcccgtttctattagcctcgttgtcttggcccatatccaaatctctccacacttcactcttttggtcacaaactcataattggcaacttttataacgttttttttttttttttttttttttgcttctacaatgtttctttgtggcatacgcaacgttactactgaagaacatcctatttcatgcagtttattttaataaagtgttagcgtgtatatataattctcattactattttctattcaaaacagttacatccaaaggcatatctaattatatattaatataagtgaaattaatatataaaagtcgactcagattaaatgaagcaaagtggattattctatacgtctaagattcctctaaatctttatatccatctcagttccttactctttattttatacgcaaaaaaataaaaacgtatccatatatataacatttatgtgtgtgtaagaatatatattataaatcaagacagacattttagcacagaagtagagaaacaaaggaagaagatggagatatttgtgaagaaagagtacttagatttggttcttgtcccatttggattaatcatagttttatcttaccatctatttcttctctatagaatcctttactttccttaccataccattatcggtttcatgaacatcgataaatccatttgggtcgaccgtatcatgcaggcaagttatcatctctctttacgacaatcttttcaaaattatcgatatcgatttctatttaatgttttgtccaacttattacaagataaaaaaaatgatgatttggtaatgccaacatttttctaattattacttttgctatatggatttagatataacggttagctcgaatgattacaggcaagaaaagacgaattgggtggtgctttaactgttctttcgagcagcatatcagcttcaacatttatggcatccattgctttaacattgagttcacttatcggcgcgtggatcggaagctcgccggttagtatgactgtttttaccggacattttatctatggagacacgagttcaatcacaatggtcatcaaatacacatcgctcctcatatgtttcctagttgcattctgctgttttattcaatccacgagatgttttctacatgcgaactatcttatcaccactccgggcgaagatattcccccggacatggtgaagagatttgtcttgagaggcgggaactattggtcgctaggtcttagggctctttatttggctcttgatctattgttgtggcttttcggaccggttccgatgtttattaactcggttttgatggtcatttgtttgtattttctcgactcaaactcggtggctcagcctctttatcaccggacttttgaggcggagcaaattgtcaagaagatgagaggagttttgcctgaacagttgacttttagatgtaattgaaaagaaaattatttgattcttaatcactttgccaacttgggattttccaacgaattatatttgattataataatctttggaaaattcgtaagaagttttagtttatcaattattgcatgagatttgtgaaagccgtacggagcatgttccgggagcgtctcgtcttatgttttataatcatccacacgataaagcattaacggatagagaaaaaaagatgagctgtttaattcatttcttggaagcaactacttagacatattctctaactttgaaaataatgattataaattgggttcactaatatagtattgtaaatctgtaatttaatttccacttgtgctacgaaaacagcatggtcacatcacattttttctcagcaagtatataaatgcatgtctgaatattgatcatgcattttcacgtaagttgacataatttgtttttagataatatgcaatgcaaatatttaaaagagaaggtgaattcaatggtatttttttttgtgtgtctattttcaaaaatagcacaaatacagatttttaaatcatagagcatttaatgtaaaatatttgcaaagttatataaggtttttataagattgtatatataaggttttataaagttcataaattttgataaaacagattataaaatggtattgctacttgctagcacactttgttagcatgacctttaactcaatgcaaactcatgctaccaatcaaagcctttcattagagaaaactggataacaaaataaataaatagaaaccacacatttaggcccataaaggcccataataccttttcttgggcctattattaaaaacttaacccctttaatcgctgttttctctctctcgcgacggatcttcttaggtctctctcttctcctccttttccccactttttcaaaatcagcaaattttggattttcagaatttgagtgaacttaaagtagaagacgaattgtctgaattcgaattttaagaaaaatttgcagagatg

SEQ ID NO: 22058 - DNA, 3003 bp, Unknown
  misc_feature (1)..( 3003): 2750-1469P.txt file - cDNA_ID_2045084; gDNA_ID_1620322; Annot_ID_153354
caaatctccagcttaattaatttgtacaaccatttatgaaaataagagaaattaagaattagaaaaattcatctaaaagtagataaatttcctgataataatttaagagtaggaattcaagtaaatggttgtacaatagttgaaaaattcatctaaaagtagaaaaattcatctaaaagtagatgtaaaaattcatctaaaagtaggagtatatgaatcgtagtatatatttttaaaaatttaaacactttgtacgtaattggttaaaatttcatgacttcagatacatttcctgataataatttaagagtaggaatttaagtaatccgaattaaaaggatacaaaacgaatgtaatgaatgattatgttcacatgataaaatgaaaattttgtgtctcttgaaaaatgcatacgatatgcaatttccctttctttcttttgttcttttctctctaattttacgttttataatttctattagttattaaatgtagtaaaacaaaaaaaaccaaagggtaggtaaagaggctaatatataacgtgagagtagatttgctattctctcattaccctatcaaccctaagtaatctctttagctctcgattatcatcattacaccatcatcatgtcctcctcaaacaaaaattggccaagcatgttcaaatccaaaccttgcaacaataatcatcatcatcaacatgaaatcgatactccatcttacatgcactactctaattgcaacctatcatcttccttttcctcaggtactcacaaaatttacattttcttctgttaaatttataaaaagtatattgttaattttacttgattatagaaacaagctatatgaacgatgttatgtatatatgttaagacatgcatgcatgatgatataaaccgctctatgaaacagatcggataccagatcctaaaccgagatggaatcctaaaccggagcagattaggatactcgaatcaatcttcaattccggtactattaacccacctagagaggagattcaaagaatccggatccggcttcaagaatatggtcaaatcggtgacgcaaacgtgttttactggtttcaaaaccggaaatctcgagcaaaacacaagcttcgtgttcatcacaaaagccctaaaatgtcaaagaaggacaagacggttattcctagtactgacgctgatcattgttttggttttgttaaccaagaaaccggattatatccggttcaaaacaatgagttggtggtaaccgaaccggccggttttctatttccggttcataatgatccgagcgctgctcaatcagcgtttggttttggcgattttgttgtaccggtggtaacggaagaagggatggcattctctaccgttaataacggcgttaatttggagactaacgaaaattttgataaaattccggcgatcaatttatacggcggagatggaaatggcggtggaaattgttttcctcctttgactgttccattaaccatcaatcaatctcaaggtaaattaatcatttcgaaatagtaatactgttcatatttttttcttttcgaaatagttttattacctcatttgctcaacatacatgaaaataaatattataattaatgcttaatttggtatatttcgtagatgtataattagtatactaaatttagtatatagcatatatatatcgaatctaatatcatatagttcttaccatatgcatgctggtgttatccaatgtcacatatacatagatatgtacgtacactcatttctcatatttcatatattagtgtgtatatatatatatatatatatgtatatgtatcttggtcataaaaaaaaaaaaggaatcttggtcatatatatatgaattataatacttagataggtcatagattatggtaaataaattattaaattattccatattttggaatgagtaacgcatgcatacgatattttgggaaaaagacgttttggtctttagatttgaccatttactgtgtatttttttgggtaaattagtattatttaattactttgactaacattaattaccaaaatgtgctctattgatcacaagaaaaacgagatgtaggattatccggtggtgaagacgtcggagataatgtttatccggtgagaatgacggtgtttattaacgagatgcctatcgaagtagtgtctggattattcaacgttaaggcagctttcggaaacgatgccgttttgatcaactcgtttggccagcctattcttacagatgaatttggtgttacttatcaacctctccaaaatggcgcaatctattatcttgtgagttttgtgtaatggtcttaaggtttttgtttttcttgtatgaattgctgaaagcttttgtgtttggttttgcagatttagaagatattgaaaagcaaatgttatggtgctatggataaatattaatataataataaaagatttctgcgatttatttagttattaattatataagaatttcatttcttatcttttaaatttatgaacaatttacaggacatttacattttcgagactttgaaaaataaagaatgaaattaagttacagctttatttaagtttgtttccaatgtaatatgttcatttgtgcatttctattttctttcttttctgaatatatagcttatctagtatgtcattaaaaaatgttaattcttttatatatgtattcataatatttttcattataaaaaaaaggaagatattcattcatgtgagaaaataaatgggccattgctcctagttttgggcttttgggctttttcttagtttcttaatgtgtttgggccattgctcctggttttgggccaatattgagatatcctgagcctaacttatttaggcccattaagaacccattctattttgtgcgtgtatgttacgctgtgttctctcgttcaatcattttcttctctcatttccaaaatctagaaaccctagagcaaaaagtgatctcatg

SEQ ID NO: 22059 - DNA, 3003 bp, Unknown
  misc_feature (1)..( 3003): 2750-1469P.txt file - cDNA_ID_2045174; gDNA_ID_1620343; Annot_ID_154047
gtgctgaagttacaaaggaattatcccctatgtgggtggttggccccttgatcatcgccctttatataaaaatgttccaaggactatgttccctttacgccttctgcttcaaccaaaccatcaaaatgataagaaacctaccatcgtattatcttgtagcataccaatacattgccgatggaaagctcaaagacgacgttaaagctctagtgtttaaaccagtggtggccatcaagaacacagactacaaagagctcacacgcacgaagctgaaacagttccaagaatggatcattgagaaatacctggattttgttgaatctgtatggccttattactgcagaactatcagattcctgaagagggctaacctgatttgaagatcttcaacatggaaccctcaaattctgacttctcagggcttctctatgatttctctctgtgctttgtttacctttttttttttttttcttaattttaggaaggcttttcatgttgtttgttcttatctctatgtatactgataccttttttgaggttttacaatgagttcttttaatattaagggttatcccttttctccatacttaaaaattatctatacacatataaatcgacaacaacagaagaaataagtgcttaaaggtctcttataaacctctttagctccggaaatttgatggtaatgtttcttcagtaaagtactcctttctgacggtctctgctgagcaaaacttgaccttcacataaagcaaagtataaaaatccatctagtccagtcctctgaataaccacactatgtagtatatagcaattagaatcgatgcataaaaacatagcaatatggtatggaagttaccagagaagcgtattgcttcaccaacggtttagtgaattgccaaattggctgaaatatgaatggagcatctacaaaaaggacttcatccaatcggcttggatagtaatagtaaaatacgtcaaactgcagaaacaaaacaatggaaaagacaacaataagatcaaagaccattcacctgtaagaagatacaaaaaccattcacctgtaaggagaaagaaataccaggaaagtcaagaacttaagatctgcgttctgagatccgaatccacggagatcaaatatcccaagtatcttgtgttgtcctgctggtaacttacttaaagccttttcaagtaagaacacacaaagcttttcatcttctattggatcaagcagctgcaaaacgtcagacatttcacaaatcctcagctatagtaaatctgcattgctgaaatttaacaagaaaactggtgtctaacttgccccggggatgtgctttgcaggagctacaataaccactggccgacctttaacatctagaaaaccatgtacataggcttttccagtgtcagtagctgctttaatagaatcttcagaaagctcatctaccttgaactcatgacgccatttctaagcttttaagtaaaggataacatggaaaccaaaccttatcaatattaccaaaacaaaaaacaacatgtgatttgattctacaggttctacataaaagtgaagtctctggcaactttctagattcattatagtgaagaattgatagaagataaagaaaacacaaggaagaggatacaatagctttagttagctttccaatggcttcatcaacagaaaatctgcgatctttcaaaaaccagaggatcatatcctcatcatctcttccatatttgccaagtgggagactagtacaatctttcgcaagccgttcttttacttccaaaactagctgcaccacatgttcacaaacccaaactttcattacacaatcccctcagaactcagaagacacattccatagtctaaacatccaattcaatgggtattgtggaactcaagaacccaattctgagaccacataagcaaaagactaagtttttattttatttcttaaacagagcttccaatgccaacaatggaagaaagaaacagaggaaaacttgctgcagatatcatcagaaaaaagcataaaaggcatatgcgaagaagaaagccattgcgtaagaaattaaaaaaagtaacgtcatcgtaacattcatccaatttccatgattctcgctttttggctaaaagagaaaaaacaaaaccttgtgcgcatgttgggattcagacacgcaacttcggacagagaatctgcagttccgagatcgattaatgttcaaattcttcgagcttttgaaattgactgaagcagcaacgatggttgagctgaaacgaatcgacattgactacaaggagtaaaaatttactctttagagtttgattctcagaaattagattgatgagaggaattcggaagtttcaaaagctgggctttgttcaccacagagcaagaagaattcagaatttggaattttgcgatttatagatacagaagcgaaacagaggcatatgtttttgtttcccctttttatagactcttgcttcttatacacacgggtacgggtctttttatctgggtttagatccggttcagggtctcggatccacgttcggatccggtttggtatttctacattattaccaaaatttatttgcttagccagaagtttgtattttgtaaagacatcatcatagtactacatatataactacacactcgcagtaaatctttttttctctctgtataattgaagttaaaaataacaacaaaaatggcagtttatatggaggatcacataaaaatagttaaaaataatttagtcctagtaattataggtcttctctaattttatttggaactaaatttcagaaaacaaaatatcgtatcaaattttgatgtaaattataaaataatagaaattagtgagatagcattctaaatgaggattgcatattttggtattagatatgtcggattttatctgatatggtagttttcagtgtatatatatatctctaaagctttttcaagccaaataagaagaaaaatg

SEQ ID NO: 22060 - DNA, 3003 bp, Unknown
  misc_feature (1)..( 3003): 2750-1469P.txt file - cDNA_ID_2045216; gDNA_ID_1620345; Annot_ID_154146
cccgaataaatcgttgttaagtgtttttaaaaaacactaaatgattgttcttttgtgttgtaggacttttgaggttagaacatgacgtgagttcttgcgagtatgaagacatacacataatgtggaatttgttacacaagaatgaagatcttacacgcgtaccaatccaacaacaacaacaacagaggaagaaaccttgttggaatcttcttggttcgtatctttgccaaagattctgatccgttttatgatataaaccaaaccattgttgtatttgagagagccttgacgggtcccttgcagtgtggtgtggttttattgacaaatttcgcaaataatgaatccgaggttgcagagttttaaattagctgttatatattccattgcatacctctatgtacttatcatcacatgagtgttgtatatatattacaaaatgctttacatagtttgatactacctatgttcatctacttggtttcattgatcttgccttttcacataagaaaacagaacaaatcttaacttaaaactcccaagttgctaaaaaatggattttgtaatagaaggaaaaactttcttgagaatccaatgataaatttatcaaattttaaaatcaaagcctttttccaaggaaaaggaataatatagtggtatctttatttaataggtctctttagaaagaaaaaagacatccctattccataaaaaagattagacttccaagttccaaattagtggccattattaaaagaaattaaattagcaaccaatgagaaagatgaaacgtcagaatcaattggttagatactgatgtccaaacaagtgtgtgtgtgtttgcttcatatatgtgtgtcggctgcttctaggcttattaaaaggccggtctttaaaagagtattcaacaagtattgtgtgatgatgtgattgctttttctcttttttggttagacatttcacctaacgactctttgatttcattatatgtaactaacgcatgttgatatctatatactctttgcctcttttttttttcccaatgtcaaacttacatattcttttcgtgtgaatcttttatctttatacttgtctcaatcttttttgtcaatcacatcatcacacaataatttgagttttttttttgttaatgaaaatttcacatgccttcatcttctttccaccaagttcttcatttgtcatgacatctaagttcttgtcatttgtcatgccttcatattcaacagctccaaaggtggggatcgcgtcgttgaacactttaatcgcatgtatctcgctggaatgcaaaacggcatcatactgatcggttatggagttataccgatcggttctctatttggtctcatacttatcggttgttgtaagtaaaccgatcagtatcaatctccgtttccagcttcttctcattctcgaatgtgatggtattgacatgctacttagactttgagtaagaaacgatatcagagactcgcttcaaacttcacatatctcttcatcttctgttggatttaataattcacatatgacttatcatatgaagaaaagaaactttgattatgtctctcgtttcgattattttcctactaaaaataattctcattttacaaaagtttctttcactcaaaccaacataaataggtatactcctattttccccaccaatacatgtaacaactctcaacgtgatattgaacatgttaagcatgccttagaccatccttattacatgtctcatactataaatcttaggtataatataatcaaaataacatgtgaatagtttagaagtgtttcttagctaagagataaaagaaggtttaagagcttcaaaccattacaaaaattcttagctataatgtttttcaataaaacaattcatcataatagttaagagacaaaattaagagtctaccattaaagttgctcttagactcgtccaacagtttgaatcctatatttcatcgtccaaattcttttaacgcaaagtgcaaaatcttgaaccctacacctcttaatatcgtgtttccacaccaagattctattgatcgtcaacatttagacatgaattccttgttatcaaagcacaatctgtgttttccaaggtggtcgatctttgatgaaagtgtccaaaccagccaatctttttgaataatctatttattatattgattctgaagaagatgagaaaaatgataaggatcaatatgatgttcgtacgcatagtctaccatatgaaaaatacggtccatatacatgttctaaatgtaaaggtgtgtttaatacttctcaaagttttgctgcacatatgttatctcattacaatcatgagacgaccaaagaaagagaacatagacttactgcaagaaacaagaaaagatatcgtaattacatggaaaatctcaaaagatcacaacagaaggtgggatccatattagtgacataagtgacaatgaaacttttcaaaatcttgtatcataaaagaagagtttgtttatgatttatttatttcatatctcttattcaacttattttatttaaataaataatgcaaacttgtcttctatttatagtatttcataatatttgttattaccaggaatggatatgcatatttgcacagaaaattgtaatctttatttgctctttatattttaaggtttggttttgagttttttttataaaataatttcttaaatttcaataaataatacgcatacacaattacgcatgttaagccatattaattaataaaggaaagagacgacagttataccctcacaaaacttaaacgtaattatctccccaccttccccactctattctcaagttcgccggagatttatactaacactgcaaaattcactcacatttctactaaaatcaaaaccctagtctcgccgggaatctctcaaatccgtaaaaatcttctctattcaatctctccttgctcacattcaataacgaggcaatgttgatttctcaatg

SEQ ID NO: 22061 - DNA, 3000 bp, Unknown; identical to SEQ ID NO: 996
  misc_feature (1)..( 3000): 2750-1469P.txt file - cDNA_ID_2045228; gDNA_ID_1620345; Annot_ID_154142

SEQ ID NO: 22062 - DNA, 3000 bp, Unknown; identical to SEQ ID NO: 991
  misc_feature (1)..( 3000): 2750-1469P.txt file - cDNA_ID_2045289; gDNA_ID_1620345; Annot_ID_154123

SEQ ID NO: 22063 - DNA, 3003 bp, Unknown
  misc_feature (1)..( 3003): 2750-1469P.txt file - cDNA_ID_2045296; gDNA_ID_1620348; Annot_ID_154235
ctccttcaactaaaccgaaacctacacctgcaaaggatatagaggtggataagccaagtgttgtcttagaggcaagcaaagagaagaaagaagaaaagaactatggtagattctttttctgtttcagaaatcaacgtcttttcatttgtattctcaattttgactttcttcctttctcattttccaagcttctaacttggaagctgatttacttttggatgcagcctttgaagacatttcacccgaggaaaccacaaaagaaagcccatttagcaactatgcagaagtctctgaaactaattcccccaaagaaactcgcttgtttgaggatgtaagtttcgttttcttttgtatttccacagcacaccaagtggtgatttaaaaacgtgacatagttttgctaaccttctatgctctcttattgatctctgggtgaaggtcttgcaaaatggagctggtccggcaaatggtgccactgcttcagaggtttttcaatctttgggtgagttattgaatttcagttttcatcactatcagcgcactgtgcatgattcatgattaaggctacggatttcaattttattttatagcatatgccaacaattataaacaaaggaagatatgaaattggtgataaagaggaatgagttggcttcaaaaggatctactccgttacttttgtccttctgctagtcgttgatctgtattggtataaccatataagacttgcaggatattaccttggcaatctgtttcatatctcatgtgttatgattcttttttcttatatgctcacgttattgtctctcttttccttattctaaatttaaaactgaatcctgagtctgtctattgtttacacaggtggtgggaaaggagggccgggtttatctgtagaagctttagagaaaatgatggaagatccaacagtccagaagatggtttacccgtaactcatcttccctagcacattgtctttaaatgcatccattaagtttatctttaaaactggttgcttagtggacatttggtaacattgcatgtataaatgcagatacttgcctgaggagatgaggaacccagaaactttcaaatgtaagtcttttaatatttaatcctgctatcattcttttattagtcctcatttttacatatttctaaagactaaaggttacatgactagcttttgaatgatgtaattcgtttataggttgatccaatggttatctaaatttaaaatacagtttggtacttattgtctccgcttggaattttgtagggatgcttaaaaatcctcagtaccgtcaacaactacaggacatgttgtaagagctccattttacgaacaatttagttgtttccattgcttttaagaatgtctaaactatgtaattaagaaatactcttgtttgtttcttttcatgaatttaggaataatatgagtgggagtggtgaatgggacaagcgaatgacagatacattgaagaattttgacctgaatagtcctgaagtgaagcaacaattcagtaagacaaatctcagtttgtaccaagttaatagtacgttaaataggtctgatactcaatgattgaatctgtatttgtcagatcaaataggactaactccagaagaagtcatatctaagatcatggagaaccctgatgttgccatggcattccagaatcctagagtccaagcagcgttaatggaagtacgttttcttttaacctgaataagagaattgcttaattttaccccacttctttcttcatacaaaacagaaaccaattacattcttgttgttgttgcagtgctcagagaacccaatgaacatcatgaagtaccaaaacgacaaagaggtaataatactgccacttctccattgcccaaaaaggcgattacttttttaagaaatttgaggttattatacattgattgcaggtaatggatgtgttcaacaagatatcgcagctcttcccaggaatgacgggttgaaaaagctcacgtctttggttctatcaaaaatgtcacattgtctttagctttttgtagggagaaaaaaatgtttttttttttgcaaagagtcttcagttttggtcagatcagagaattgtgtaccatgttaatcttaaacgcggtcgggaattggagtcgtgtgaaaacgccgctgctgttgtttggtatgaatattatacaatagaatttgttgtcttaccaaaaaaagtctatgaagacactgaagagcaaattattatttttaagggaaaatttccaaaataaacttcatgtattcaaaatttgcttgaaaaaacctcaattttttttgtttgagattgtgtgaataaatctgccaatattttgttttagcaatttaaaaaattgaagtttttttctcgcaaattttaaatagttgtgatttattttggaattttaccttatttttaatatccaaaaggagaagtgacgtggcgatatcgaagcggtttaatgaagtgatggccccatcttaaagaaatcaatgacccttatcgttccacttctatcggagtcggagtttttttttgttgttgttgtattccgtacgtcggtcgttgtcgggagaattggcgcgtgaaatccttggctccgtcgaatacgtctgcctccgacggctgtgagtcgcatgattgagtcgtgggtaagtatccttgtgacttcaaatttgtatttccgttctttataatcccctgactcttgagaaaatcgaggagaaaaaaccatccttgcttggtattcatttgaagagtgttttagttataaaatcgtaatgtttgacggtatgtgatattctgtgagcatgattattcagaaagcttttgtctttttagtaaatattgtctctttcttagtcttaggtaatgtaacctcaagaactctatgcgagaacattacacattatctttggaattggatattatattgttaaagtttaatcattgatgaaagttgcaaagagttatgatg

SEQ ID NO: 22064 - DNA, 3000 bp, Unknown; identical to SEQ ID NO: 1018
  misc_feature (1)..( 3000): 2750-1469P.txt file - cDNA_ID_2045304; gDNA_ID_1620348; Annot_ID_154233

SEQ ID NO: 22065 - DNA, 3003 bp, Unknown
  misc_feature (1)..( 3003): 2750-1469P.txt file - cDNA_ID_2045313; gDNA_ID_1620348; Annot_ID_154230
ttaaaaacgtgcttaaactagtaagccttgtgatggtgaataatccgttgaatattgaacttttgccatcaaaaatataatgaagaattaagtcatggtatattgttgacaagtcttctgaaactttgtagattagctaagtgatagtgatgaccttgtacgagaatgactgaatgagattcatatgcctataattagacctagagagataaccgacaaaatcagtcaaagcatcatattttcatattgaattaattaacatccaaaacattttataactttaggcttcacataactctatgtttctcgttgttgtagcatttattttggaatttaatgaagcaccatattataattgtagctatttgtatttttgtcagcagaaaacttagtatttgaaattacaattgctactaaatgctaaaaaagaaagaaaaacaactctgtattttttgtgtgtaaatttcgaattttttgtttctaaagctgtgagttcttttttaaatgcataaaatatcatatatttattaaaaatgacgttatttaatattaaatatgaatgtgttacgttttgatcagttgttaatcaggtggcataaatcattttacaccgagtcatggacacagcattttttctcttgttctatctagctcatatccatgtgggttcacatgcacttgtatatgttaagagtatttattttattttattgttatcaaatgtgcccaagacaatgccacatagcttatctaccctgtcaaatccatataaaactattgaagcctttacaacttgtgattcattttcctaaagtcttaaattttaacctttgccagctcataatttattccttatattgtttagtgcaaagtttgtttgaagatggttgccgaatatcataataatcttttaattttatcgtatgtgacaatcataactataatttattaaaaaataaaagcttatataaataacatattctaaaaattatgcatgctaattagacatgagctggaaaatgaattaattgaggtaccatcaaatgttcggtcacgaaaaaaagataaacacataatccaaatagaaatttagttctatcagaatatgataaaactaattatattagtttattgcatcaacatataaataagatgcatacttatgtggacataaatagttatacatactcgtgatgtttgagattcataaattatactccagaagtttgtttgggaccgatagggatatagaacatggccaccgcatcaaggcagtattggacgcggtttctcctccagtgccaatgattatgccaacaatacaaagtgaataaatatttttgacaaccacaaaaaggagtagaagaaacaatatggcaaagtaaattgcctaattggtatttttttcatatgtctaagaaattactgatcaaaacacatacatcttttcgggccacgaatcaaattagagtccatttgcaacgttttaacttttaactcaaaatctggcctgactcttacgaaatctgcttatgttcgatcgattgagctaccaactcatgaatttatatttaacgatctctactaatttagttccttaatttaccttaaatttccatgttacattaattggtttacgttgtacaagttgaaattttcttgacattgttgttgttgttgttgtcagaattatttatctctttccatatcgtttttgtcttaccttgagttggacctttgttgtattcgtttataccgatccatttaaaagaaaaacaaagcaacataatcatcttggagtttacccaagaaaacaaaattcttggagtttgaaataggttaagattcaggcgtgtccaactacatattaaatttatttatgggccattttgtaatgttggccttttgttcttaaactgggccattttactgataatagaccaaagttggtgcaatggctcgagcttacccatttgtttttcgtatgaggacatcctattggattagattttttcccactgaccaaataataaatttatagtattttgttgtatataaatccaaattaatagagaatatttagtctcccagcgaatatcgaagtgataaaaatacacaaaatatcaaattattaaataaactttaccatatcgaaataatgacaaaggtgggattatatattgggaacacgtaccactatggtgacgtcatgggtaccgtaggtttgtgttggcaccaccaacaataacaacaaacaaacaatacaaaacccaccacttagtgctaactaaaacccgccaatcacattatacttaattacaaaagtaaaatacgatttgtttcttctggtttgataaaaactaaacagaactctctttttttttttaaattatgagattcgagttttgagacataagcgaagaagacaacattggctgatgaggtgtttttgtctaaggaaaaagaactttaggcgtgatcacactcgcttacacgtatttgtttttaactccaataatttgactaaaatgttgcaagattttttttgttttacatcaaattaaatgtgatatagaaattggacgatttattaaaagaattatatatatacacatttcatacacagtttcatcatctgctttttttcttcagtttaatggtttttttaattagtatgttatgtagaattgtagatattccgatggtccgtaaaacgacatacatgatctaaatgtcgataaatatcacttatgaccatatgtaaaaatatggattaaaaggttggatagatttataattaatagaaggaagatacgagaagaaatgtaggtccaaccacaaacatggttttgacatctctctcactctctatatataggttgttgtgtagcctctttagtcttggaaatacaacatattataagtatattaggtaacatatatgatcatatctctatatataaagtaggtatatatatatttagcgagagagggagagagatg

SEQ ID NO: 22066 - DNA, 3000 bp, Unknown; identical to SEQ ID NO: 1017
  misc_feature (1)..( 3000): 2750-1469P.txt file - cDNA_ID_2045322; gDNA_ID_1620348; Annot_ID_154227

SEQ ID NO: 22067 - DNA, 3003 bp, Unknown
  misc_feature (1)..( 3003): 2750-1469P.txt file - cDNA_ID_2045332; gDNA_ID_1620351; Annot_ID_154334
taggtgaaaattagatacgttactttttatatataaaaaatatttgatctctttttggttaaaagatatttttccgtattttgaagacttagattaaatgtttacagtaagtcaaatctcatattttttatagagatcaagtcagtaagacagtaactatgtgatgtaatgacattccctacatgcccccaataatactgcaatgttttctatccacataagttgtcctctgaaatttcatttaatatattgttttttttttggggtcaaacaatttgatttaatttcttcttcgttatttggtaaaattacaggtcgctattaatatccttctaataaaagccatatggatcacatgatgttatgatatattgaaacttatcataaatacatagatgagtgaatgaatgcttcaaacattgtcaattattttcttgtaaagttacaaaatgtccttttggctaagtttgatcttttgctttttcacatttgcttcctcatctccaccggatgatcctgtcaactgtgaattcggaaacacaatgtgcacggtgacgaactcgtacggcgcctttcctgaccgctctatatgcaaagcagcaaaggtggagtacccaaggacggaggctgagctggtctctatagtggctgcagccactagagccggccaaaaaatgcgggtcgtgactaggtactctcacagcttccccaagctggtttgtactgatggtaaagacgggactctcataagcaccaagtttctaaaccatgtggtgaccaccaacccggaggccaagactttgacggttgagagcggcgtgactctaaggcaactgatcgaagaagcagctaagtttgatctggctttgccatacgcaccgtattggtggggacttacggttggaggaatgatggggacaggtgctcacggaagttctttatggggtaaaggaagtgcggttcatgattacgtgaccgagataagattggtgagtcccggtttggcttctgatgggtatgtaaaggttcaggttcttagcgagactatagatccggaggaatttcgcgcagccaaagtttctctaggtgttcttggtgttatctctcaagtaactttcgaattgcaaccaatgttcaaaagatcgttaaattatgttatgagaaacgattcggatttcggagatcaagcagtgagttttggcgaaagacacgagtttgcggatttcttatggttaccgagccaaggaaaagtggtgtatcgcatggatggccgagttccgcttaatacttcgggagatggcttgttcgaatttttcccattccgttcacaactctctttagtgttagccatagatagatccttaggtaaatctttatttctcaagataattaataccaatatttttgatttgcatagctataatgtttcttatatatatacttttgcttcatgtcatgcagaggagagtgaagagtcacttgaagatgcaaacatgaagtgtgtgagggcaaagctagtatcgtcgtctatgtttttaatgtcatacggtgtgactaataacggtatttcttttacttgcttatacatttgttgattgtttcgatataagattatacaaaactttcactagtaatttccatggacaggcctaatattcacaggctatccggtcatcggaatgcaaaaccatatgatgtcgtcaggttcatgtctagacagtcgtcaagacggactaatcacggcttgtccatgggatccacggataaaaggccaattctttcaccaaacaacattcagtgtttctctcacaaatgtcaaaagtttcatcaacgacatcaaagcacttgtgaagatcgaaccgaaatctttatgcgtacttgaaggcagcaacggtattctcatccgctatgtcacatcctctctagcatttctcggaaaagaagaaaaagctttagattttgacctaacttactacagaagcaaaaatgatccattggcaccgcgtctatacgaggattacattgaagaaatcgagcaaatggcgatattcaaatacaatgcgttaccacattgggggaagaataggaacctagcgtttgatggtgccattagaaaatacaagaacgcaaacgcgtttttaaaagtaaaagagaaatttgattctttaggattgttttccactgaatggactgatcagattctaggtttaaaaggaaacgtgacgattgtgaaacaaggatgtgcattggagggactatgtatttgttcagaggattctcattgtgctcctaccaaaggttatttatgtagaccaggtaaagtttatagagaagctagagtttgtactcgtgtaagttcctaaatcctaatcaaagttttggtcctcagttctgttatatatcaaaaacctcattcctctctctgctttaagagaacagagcagtctctgttcataattgacaagcgaaaacgacgttgtattgaattcgtgacacgtgtcaaacaatgagtagttaatcaaagtgtcactcgcacgtgaagagagtagagtaggtgggtttagggtttaagtgttccagattcttccaaattcagttgatccaacggctcagacttaacctgaaacctttgaagacgcgatcctcgaacttcaccagtccgtttgcactatgcaaccaaacacactttgtatcgaataaattaaacaaaaatcataactttacaatcgcataaatcgactttcatcttcttcacaagaaaacctctctcagtcgctaaaacccttgaaccatctcttgatcgctagcttctaagtaagtgtatagttgaatcatttcgatcaaagtttaggtaaaaagttgtttgctttcagatacccttgttttgatttgtgtcgatgattacaaagttttactttgatttgtgtctttagggtttattagattcattcaagctataaagttttgattttgatctgtttttgcagagagtgaaaaaccatg

SEQ ID NO: 22068 - DNA, 3003 bp, Unknown
  misc_feature (1)..( 3003): 2750-1469P.txt file - cDNA_ID_2045336; gDNA_ID_1620351; Annot_ID_154333
ctatggatcaacataccgtccttaactgatttatttttcatttgctaatgtgaactggtgatgagctgagaaatttatggtacaaatgtttaaatcagttttagaatattttaggctttgtagccaaaggagaatgcagaacccttcttatttgttgtagccataaaaccccacataattggatagaggtctacaaaaggctctaatcgagttagatgaggtatcagaatatgttattatgtattaaccaatagaaaccagaataattaatagaggtctacaaaaggatcaaaattatcaaaaaaaaaaaaaaaaaaaatgttgtttaaggcttagatgaaatatttatggtaagtcaaattcatatcattttctaaagagaaaaccttaataatgtagctagctaggtccagtgtacacataagttgttccctgaattccttttaatgatttgatctcttttgtatttgtaaaattattttgagaatgtgatgttatataacatataccacataagatcaaattatttactttttcaacatgtacatataaaatgaagaggagcatgaggagtcatctggcgaagcaaacaagaagtgtgtgagagcaaagcgatcgactagcatcttttttgtttggaatctcatacggtgtgaccaataatggtatttcttgaatgtttccatgtaacatttttttcagttatatcactgtaacagtgtaattcctactgcaggcgttatattcacaggctatccggtaatcggaagccaagaccgtataatgtcgtctggtgcgtgtctagacagtcatcagaacggattgattacatcttgtccttgggatccacgcattaaaggcgagttcttttaccaaacagcattaagtgttcctctcacacatgtcaaagatttcatcaacgacattaaagcacttgtgaagattgaaccaaaatctctctgtggccttgaactcaactatggtgttctagtccgttatgtcacatcctctccggcttatctaaggaaagaagaaaaagctttagactttgacctaacttactacagaagcaaagatgatccttggacaccacgtctctacgaggattacatggaagagattgagcaaatggcgatattaaagtacaacgcgttgcctcattggggaaaaaataggaacctagcttttgatggtgccattaaaaagtacaagaacgcaaacacgtttttgaaagtcaaggagagattagatccgtgggggttgttttctacagaatggaccgatcagattctagggttaaaaggaaacgtgacgattgtgaagcaaggatgtgcaccggaagggctgtgtatttgttcggatgattctcattgtgctccgaacaaaggttatatgtgtcgaccaggtaaagtttacaaagaagctagggtttgtactcttgtaaccgcttaagatttatgagtgattctaaactgatgaaataaaaatcctacgaaattaattggtgccaatagcttcacgatgctactgcatcaaatacgattgatctaatttgaagtatatatacctaataataatttgtaacatgcagatatttttctccattaatattttaaaatctaatttaattggccaaatacgtgtttttgaaaacttatcgtagcaatattgaatttgaattattgatactactataagccatacaaactaggcaaagtaccaatcaacaataagatagaaaatagggggcggtcttcaatttttttttgttttaggcgtaattcaaattacttcatgtagacaacttagtcatgatgtctcaatgtctaatcatgccaccgggaactaggtaacctgcgaaaaaatcacaaacatatgaaatgtataatctataagataccacaacctaataactttaaacttatatactaatgaaatgaatgtattaaatttgcaaaccaaattacattgaccgaaaaaaaaaacaagagaattgggacttacttccgcattgtgagccaggagcaagtggacggccacaagcagccgcgacattgactagcttttgcatatcaatggcggcttcgatttccttattgatgacttcgcatacacattccatcccgatgattcggacaagagtgcaacaaccttgggatggtcttggcggagttggcagctccttgtcgatagaatctggacatcccctcagaacttcgatgcctgaatcattacatctctccccctgaatttgagatgatgacaacaacatcattacgactaaaaactgacaaaatatctgttctttcatttttctttatttttattcttctattgtcttctttcttttacgcattatatgtataaaagattgtacggtatattaagtacagaattgagaacacgatcacattttgcttattatggcagtagatcaatctagaatcctttgatataacatagtaagtagtaacaatattgactatatatatactgtatcagtatgagtgaaaattagataacgttattctttttttggtcaacaacaatataggtgaaaattagatacgttactttttatatataaaaaatatttgatctctttttggttaaaagatatttttccgtattttgaagacttagattaaatgtttacagtaagtcaaatctcatattttttatagagatcaagtcagtaagacagtaactatgtgatgtaatgacattccctacatgcccccaataatactgcaatgttttctatccacataagttgtcctctgaaatttcatttaatatattgttttttttttggggtcaaacaatttgatttaatttcttcttcgttatttggtaaaattacaggtcgctattaatatccttctaataaaagccatatggatcacatgatgttatgatatattgaaacttatcataaatacatagatgagtgaatgaatgcttcaaacattgtcaattattttcttgtaaagttacaaaatg

SEQ ID NO: 22069 - DNA, 3003 bp, Unknown
  misc_feature (1)..( 3003): 2750-1469P.txt file - cDNA_ID_2045344; gDNA_ID_1620351; Annot_ID_154331
gatcaaagactttaaatttggatgtttctctcaaattcaaaatgtccattaatttaattgttttttttaggttgatatttggactaatctgatcaattcttgcttgccgccctgaaacgaaacattctatgcactcaacaagtcaacatgacgtcaattggttgaaacataatattatctttatctaggaaattctaagcttttgttcattattttcagtattattactattataacattgaccgttgacaatgcaagctgtaattctttctaaaagactcaatgttttatcataactcataatattataactttgttctcatagctaagtttagtagagttcaccgcctcaccggctaaggaaggggtcgaacaaatgagattgacagattgttaataattgaaaatatttgaaatgttttcttgatacatattctttggctggtattatgcaaaatccacggaaaatcttcatctttttaatccttaatatacgagaaaataaaccgtaagatgcaagttaagtttttcttcttacccggcaagaatgtcctttcttggtctacaattaacaaatctaaaatgatataattttttaaaagtaattggatatatacatcttttgtttattttctaattctagttttttttatatatcatggtatttttaaaataaacttatagctgaatttctttttatgctcaatcagtttatacatatatggatgggtatttggtcctctctttttttttggacaaagatttttagtcctaagtggcgttccgtgattcaaatgtaaagacatagtttcttttaccaaaagagtgtaagacagatattgtttagcaatatcttaaggagacttcttagtgagggaaaaaaatagaaaggataaaagaacaagtgggtgtggaatgatctatagcaacaactttacatcaacgaatcagagaaccttttttacttctctaacgtctaacctaaagaatttagaaatttgctattagtcgggaagaaaacaaacaacaaattttaagcttatttaacccaaaaactgagaaaagaaaaaggagaagaaatttcaagcctaacacctggagaatgagataaaaagggatccaagaaacaaactagtgggtgttgaattatatctcttgttgaagcaactttctaccacttattattacccgcacacgtttgatttattgtattcacacacattttaatttcgtgcatttgaatgagtaaacttaaatacaataatattactatatctgaataaaaaagaacctcctaacttcagcttcacttgttcaaaatattcaatcatattgtcttctttttttgacagcacatacaatcatactaacaataacatacaaaaattaagaaatactaaagagtaaatgtgcgtgatgactgatgacataaggaatacataaataagtcggactttaagtggaacattaatcttgaagattcttctgcgttttgtaatgttaggtatggtttttataggatatttacatataattatatccaagttgatgctcattgatccactaattttccgattctacggggtaatatatttttttttttgatgaacattgtttgtataaatcattataaccatacatacatgactaagatgaataaacattcataaatacgacaaataattataaaatttattatgacaaaaaatttcttataaaattttcaaaatatatatttttcctcacgtataagatttatacaataactaggtttccaaacttacatatttacaaaaataataattaatatacctctacttagagaaagaggaataattaaaaaaaaatttggaaagcctaatgcataaaaagtcttgctttaataatggattggatcctttttattctttgtttaaggaaaaataggttcgtcgacagctctacttgtgagtaatgactaatgagcacatccgtttttggagaaattagccgatataaaatattgagccactttctgagattatgcactaacatagtatcgattaaaatgaaatgtgaatgacgccaataatgagagaaatgtgaacacacaattttatcgataacaaaaaacaaacagaaaaagagcaataagaaagaattgagaaaggcaaaggcgcacgcttagacaaaaagaaagcaatcgagaaaaaggaaaaataaaaatagaaataacaagaaaaataaagagacttgtggtctgaaaatgcgtttcatacatgcgcactattaagcagaaaacaccaaaaaaacaaatcccaaaaatgaaaataaaaacaactttttttgggtagagagaatggttcttggtttaatttggatttgaattttgcatggttcaatatttcaattattaagttaatcaaattatattaaattttttttttatatacaataaccattcgactaccaaaatgaattgaccaatcgaaagggattagaattcggtttaaagcaatcggaaactaaaccagagagaattgtaacaagaccggaccggaccaaaacaaaacagaccagagtggactgatgtcttaatcgtttttgttctttattttctctgagaaagagtctctgttctgatttgtcagtggaaaaagagaaagagaagtgggacccatctccgccatagccaaagacctctttctctcccacctcatacctctctactctctgcccatcattgcccccgacgaaactctctctctctcgctctctctctaaaaagagaaacaaacatttctttagtgtctctctctttcatcatctctttaccttttgcttcttcgaaaaaaaaagagaaataaattctaagaagagaaattgagagcttggtttttctttattggcatgaatttgtaacttaccagagataataaagttagggttcttttttttcgttcttataaatatagtaatctttctatttttaagtgtgtgtgtgagtgttgtttgggaataatg

SEQ ID NO: 22070 - DNA, 3000 bp, Unknown
  misc_feature (1)..( 3000): 2750-1469P.txt file - cDNA_ID_2045366; gDNA_ID_1620351; Annot_ID_154326
caatgattacgagcagagtaaatcgggtagctacagagaaaaaaaatcatataaatgtttgaatccccttctttgaaatcattaaagattttctatccaaaattctaataaaatcatcacagaaaaattatctttaaaaaaagatgtttgcaaattatccaaaaaatcttgatatattaattagagagattttacaaaacttgatgggaaatgtttcttaaatatttactaatacagtatttgtaggtgcatgatttttccctatttattataatggtaaacttattattacttctagcttaattagttcttatttcttaacaaatgtgcataaagtacattaaaatgcaaatatataaaatctatatataattatataaaagatctaaataaaaatattgcttgagttttgtcccttttttacaagatttacccgatcacacatagagttttcattaatactgttttaccaataaagatgtgaaactagctatataacaaaactagggtttcgacccattcagaggagcgttcttggcagtaacagatactgtatataacaaaaaggttagtacgaactttctctttgcactttattttttctaggtcatcgtaatatcaaggcgaaacctgatatatatgattacggttctttgctttttcttcttctgatatcaatgtctatgtcattttgaggttctcctaggttttctatgtcttccaaattccaatagaagaaccaaaggttgtttcaacatgagaaatatcagtgatttgcctaacgatttgctggtgaagattttgtcattaattccgataaaagttgctgcgtctacaagtcttttgtccaaacgatggggttctgtttggaaattgattccgacgcttgactatgacggtacatatagtgctgcagctttagagtttttcggaaagtttcacacccttgtggctttacgctttatgaaattgaccattgaggatgttcattcgacaacttgtttccggtccgtcaagaatttatctcttctagatgtaaagttctcaagcgataaaaccgttgagaggcttttgtcttgtttccctattcttgaaacattggttgtgcaccgatggggcgctgacaatgtgaagactttcgcaatttgtgtgccatcgttgcagagcttaaacatccgctacacagtagggggttatcacaatccaaaaactgatcatggatttgtgatcaatgctccttctttaaagcatttagatattgttgatcattttagtgggttttgctcattagtgaatatgcccgagcaattggatgcagaaatccaccttagacatattgattctgagaagcttctggaaagtcttacctcgtctaaaaaactttccttgtgtttaaaaccacaaacggtaaagtctctatgtttctcgtgtttaagattcttttgcgtttattatatttagtttcggctgatgatgctgtcacttttgcagggttcatatccgggaggagactttgaccagctcgtgtgtctagagctatgtgttatgtgctccttagattggttgaatcttatcctcagacgttcacctaaactccgatctctcaaactctaccaatcagtaagttttgatccaaaactagatgatgttgttgcatcttcagtatattaaattgcaactctttgtcatgaactgtttgatctcagagagagagaaactggagctgcaggaattccaaacatgtccgtactaaatgggagcaacccaattctgttcctgaatgcttacttgtgagtctcgaaactgttaagtggattttgtacaaagggacacaagaagagaaggatgtggtgaagtatttgttaaagaatggaaacttcataaagactatgagtattcgattctcatcagtagtcacgttggaagagagaatccacataccaatggagtttgagttcatgggaaggattaattccagcagatgtcagctttcattctcaaagctataagattgtaatgttttgattttatttgaacatgttttttccctcttttaagtttccagtcttgtttcttctgttttgtctcaaagcttatagttttacccaaattattgacattgagagccaagatttgagtagcataagtagttactgtttgataaaaaaattatattcgtttcttctcatattaaattgccaatcttatgataacttctcttctctcttaaagttttttttacattggatgtgatctaagggtaaatagtggtgtttttgttattaaataagggtaaatgtgaatcaatctatttcataacaaaaatcaaactgatttattatttcaataaccaaattaaaccaaaaataccaaaattttaattacaatgtataataaatgatttattcctaaattctaacaactctacatttttaaaatctagtaatcttgctctctctctctctctttttttgttggataaattttggtttgatttcttgcttcaaaaatattgttccaaaatcaaaccggcttttagttgaaccgaaaccaaacataattaaacacctctgcataaccgaattctctttacttcttcgctcacaacttcacagagagagagatatagcgaaaacctacaaatttcgtcacggaagcaacaatttggctataaaaatcgtaagtttcttctaatttcttcatgggtttttcaatcaatctttttattcgccaaaaatttcccctattctatgaattcttaacgtctagctaggtaaattgattaaaacccaaaagcgaacggaaccagtttctttgtgattctaagtctaatctgttctaaaatcgttcctttctctgttcttgaacttgtatacgctgtatcacatggctaatttttgtgggtttcttcttcctgcagatccaatgtttgcttatggttattttcatttattttgcaggaatcagaaccatttgtgaaagaattgtgtaacctaaatg

SEQ ID NO: 22071 - DNA, 3000 bp, Unknown; identical to SEQ ID NO: 1063
  misc_feature (1)..( 3000): 2750-1469P.txt file - cDNA_ID_2045428; gDNA_ID_1620354; Annot_ID_154430

SEQ ID NO: 22072 - DNA, 3000 bp, Unknown; identical to SEQ ID NO: 1062
  misc_feature (1)..( 3000): 2750-1469P.txt file - cDNA_ID_2045461; gDNA_ID_1620354; Annot_ID_154422

SEQ ID NO: 22073 - DNA, 3003 bp, Unknown
  misc_feature (1)..( 3003): 2750-1469P.txt file - cDNA_ID_2045517; gDNA_ID_1620354; Annot_ID_154406
ctatcgagacgacaccgaagaatcaaaacgagaaaaagaatcaaagagataccaaaaaccaacaacatggaggttcttcagctccatcgaaacgacctaaaccttccaatttcctcgatgcggttcgttcgttatctctctctttctatcgagtacatttgattgaagtttatggagattttgatcaattcatacgaaaaatcgcagcttagagagagattatctggtgggcaatttaggatgctcaatgagaaactctacacttgctcgtaagttctaatttcattctttccgatgatcttccttcagttttcacagtgcttaattcaaaaatctctgctttctcagtggaaaagaagctttagactactttaaagaagatccacaaatgtttgatatggtaaacatacattaactcgagaacaagaacttatgttgttgattcttttagttgaattgtaaaattgattctgttttgttattagtatcatacagggtatcaacaacaaatgtcaaattggcctgagcttcctgttaactccattattaattggctattgtctaatagctcttctttagttgtggctgattttggctgtggtgagaatttcttatcctgtattgctatatcttactttttgcctgctgaaattgtatcactctatcgacactaatattgtctcaggtgatgcaaggattgctaaaagtgtgaagaacaaagttttctcctttgatcttgtctcaaagaacccctctgttattgcctgcgatatgtcaaatgtacgttgaatctttactccattcatgttaatttcatgatttctttgttccctcagacttaactggtatttttggggtttactttgtagacttcacttgagtcttcatcagtggatgttgcagttttctgtctttcattaatgggaacaaactattctagttatatcaaagaagcacatcgagttcttcgtccaaggtacagctttgtttacttgccaatctcttcttgttcatgggattttgtcatgattctgaataatacttcctatggttttattgtattccacagtggtatgcttcttatagcggaagtaaagagcaggtttgatccaaacaatggaggagcagacccaaaagactttgtgaaagccgtttgtgatcttggatttacttcggttttaaaggtgcaatcttttcttcttctttttttcatttccactataagaaagaaactcatttggttctttgagcaggacttctccaataagatgttcatcttattccatttcaagaaaaaggttagtgaaacatacttcctttcaggtttgttattagtctcgtagcttagatctacactttgtttagcaataatccttcttttaatcgtgtggttatataggagcagatgaattcaaatcagaagataataaagtggcctgagttaaaagcttgtttatacaaacgtcgatgatgagtttacaatggaagattactcagaatactatttttgttctccactgttgtatcatttaggcacattgattgtcctcaaaatctcataaatttgcaccctataaacttttgtaagagaaaagcaatcacaaagatttttcaagtgtttagatacagattttcagatttttgtcaacatagtgttcaggtaaagtgagatttaggccgtgaatcatgaatggtgtggtgacgcattcccctaccctctgcaactgcattttttaagttttaactagtcattcaagtttctaccaaaatttaagttcaaagtgtaaagtaattataacaagtatagcctaattcgaattacaaagatcacaacacaccctcatttgtaaccatgaatcccttacggctttacctttcactattctaaaagatcgctcgtaatcatcttgttgttacacaatacaacattcagtctctcactttctattctggcctctgggaaaccaaaaccacattgattgaaaatctctaaacttttgcaaaacacttctttcatttatggagagatgcataagcaaaaaaatcccttacctctacaaagttagaccaaatgttaagttagaccaaatgtttttcttgttttgttacagatgatatgatctcacttcacttataaaagtacaaaaaggactgatcttgtagtaaaaaggttcacctttctcaccccaccgacattattaatttcttttgtttttgttttctggtccacgatctttaaattcatgcacatttttttgtccttttgtcaattaataaaaacagtgttgttcgttaaagattgataaaagattttgtttccttcttcctactatcgtcttgtttattaaaaaaaaaaagacaaatatttttgtttcactgctcctatcttcacattccaggagacttcctttcaaaattttcttaattataattattcacaagtttgactttttctgttcaaatttggtttaagtcggaattgtaaatcgatttacagttctataaattttgccgaccaaaaaaggcaaaacaaaacagagaaagagaaggataaagagacatgagatttcctgtcactttacttacgcggacatagcaaacatctttttgatcattcagagttttttttgtcctattaccacttcaaatccaaaaacaaaagtttataaatttatttccctcaaagtaccacttaatcatcgactttttgaccatttctccatctgggttttattatcttcagttctttgtgtcacaactccagtttctttttgtattttgttgtttttttcacaaattgagattgttgtttcctataaggttttgttttattctatttatggaagtctcttgatttcgcttttataacctcaaaaagcatctttcttgatagcaccaagtatgatttgatcatcaaaagggtttggatttgacaggtctctattttaggtttgtttttggttagaagttaaaaccaaaataaaatcttaacttttggaaatg

SEQ ID NO: 22074 - DNA, 3003 bp, Unknown
  misc_feature (1)..( 3003): 2750-1469P.txt file - cDNA_ID_2045549; gDNA_ID_1620356; Annot_ID_154513
aattaatttttaaaatccttgtaaatatttatttgcggcaaatagatttacaagggattttaaaagggttttaaaagatttacaagagattttaaaaaggtttaaaaagatttataaaagcttttaaaagagttaacttaaaatctattttggcgggaaatatttttttgaaattttttgccgggaaatttttggcgggaaatttattttggaatattttatgcaaaaaaatattaatatttcattttgttaacttaaaacaatttccaaataagggtaaaatggtcattaaaaatttaaagagcgtaaaaataaaaatggataaaacaaaagggtagagttgaaaaggggcatcatgaaaagggcattagaaagaatttttcttattggttaaaacatatactctaaaccgtttattatactttttatcattcaaacatttgtactgtaccacttatttttcattgactacacatatttctcatactgcgttttttcttaacaaatcgcactatactactaaatccatttgatctgcattgccaaatccattcctcccattggaagtctatatttacaataaagatacacgataaatgagaccaccattaatggttctacatccatacgtgctcactaatcactttgtgtgtgctctatttcctgaatttgttacgtgtgattagactaccggaaggaacagaagattgcattagtcgaaagaattttgctcttcttattttatcgcttagtagcatgtttcactttgtggatatcaaacttctgacttttattgaagctagctaccactactttcaataaactggttaatctcaattaaacaattattggtgacggttgcagtttcttggaagctgccactctcaataaactaatagaaattgttgtcttgacttttaattttttgatacagtaccattaaaacttaagaaacttaaaaaagactcacatataccaagaatccgaatccaacccgaacccaaaaatattttgggtatttttggttattttttcatttttactaaaataaccgaaccgacccgaacccgaaccgaaaccgaaccgaatttttagaatacccgaatggttctcaacctcctacccgaatagacccgatacccgaaaaaaaagaaccgaacccgaatgggtacccgaatgcccacgcctaactcaaactaacaaaagcaccaatcgctcatttccaaaacccattaaaacaagtgtagtatcacaagtcaatgaaatgtctaagttgaataagcaaagagaccaaaactcatttataactcagttagtctaaacttgaaaccagtaattgttaccttaatatcacaaaacctgtttctagtccagtatttgaagcttgcaacttctcagaaagcaaccatgtcaatccctgcaacaaaagaaagatggaaccgattcaagtcttagtgttttgcaaagggtttcatttcttaaacccaataaataaacacttctttcgtcaagaacaagctaaccaaactataaatcagaaagtacaaaaaccttctagcaacaattcaaaattcaaagacctcaattcaaaattcgaagagaagagcacaaagtaaaccaaattcttagaaccacttcaattttagctaagctaacggaaacccagaaacataaggatcgaaatacaagagaagagtccagagaagataacagaaacccagaaacataaggatcgaaatagaagagaaagtccagagaagaaaacaaacctaaagacgtcgataaacagtgaagcttgatgaacagaggagcttgacgaacagaggaagctagatgaacagaggaaggtgttgaacagaggaagctcgtcgggcaaatcgccgagagatcggagaaggagaacaaagtcgagagaagaagctgcgtcaaacgcaagtgttttagggttatgtttttttgtgattttcaaaaatattcaggacattctgatcattttctatgtcgatcgcaatttaacgctgaattaaaatagcgtcaacaccctaagtatatttcttttttttctgaccaacaaagtcttctgatctattttactgatttcaacatcaaaaaattatttgaaaacactccgcccccacccacccaattctacctttaccggagtatttttaacgtacggttgaaaaagaaaagaaacaaaaaaacccggcccatctgtatacactcaatagacccatgattcttacaaccttcaacaaaatctaagcccaattcacggcccatctcaaagcttccgctttcatctttcacaacttcgatcatctctctcagagaacacatccgatgcttctccgatcgccattcacagagccaattgcagagaacaaggatccacgtttgatgtgtttcttctgattcacgacaacaaagatctgattctcaattgagttttgaaatcaagctctcatcactctaccacatcggctcgagccttcaccattgtctcttacactaagagcttattcttcgttcaccatttctctattactgttgtctctcatagtagaagctgagcaaaatttggatctctttcgatcccgatctcttctacaaaactccgccatttttgtagtacctctctcgtgatctgcagcaaggtacactgaacttgtctcgatccacttcctcttacgctttccgttttcaaaatctccctctagaactgtgattagctcttaagttttcgtggtttttgctattcctctaatgaacttagttagatctgaatttgtgttacttaagtttagttttagtcactgaaaattctgaaccatggatgttacatagatcgtataagttactgtatatatccgaatttggtgaaatgaaaaagtaagaggaatctctaatctgaatcctgttattgaaaaagctttgactatttgcagcttgcatgcttggagtgtgttcttgtgattgagccaagaagttggggcgagtatg

SEQ ID NO: 22075 - DNA, 3000 bp, Unknown; identical to SEQ ID NO: 1085
  misc_feature (1)..( 3000): 2750-1469P.txt file - cDNA_ID_2045603; gDNA_ID_1620356; Annot_ID_154497

SEQ ID NO: 22076 - DNA, 3003 bp, Unknown
  misc_feature (1)..( 3003): 2750-1469P.txt file - cDNA_ID_2045650; gDNA_ID_1620366; Annot_ID_154851
ttgtctttggtagcaaatcccagtcacttggaagcagtagatcctgttgtgataggtaaaaccagagcgaaacaatattacacgaaagacgagaacagaacaaagaacatgggtattttgatccatggggatggtagctttgccggacaaggagtggtgtatgaaactctccatcttagtgcacttcctaactactgtaccggtggaacagtgcacattgtggtgaataatcaagtggctttcacaaccgatcccagggaaggaaggtcttcacagtattgcactgatgttgcaaaggctttgagcgccccaattttccatgtcaatgcagatgacattgaagcagtagtgcatgcttgtgagcttgctgctgagtggcgccagacgttccattctgatgttgttgttgatttagtatgctaccgtcgctttgggcataacgagatagacgaaccgtcattcacacaaccaaaaatgtacaaggtctggctattatatcatccatctctgtgaaataatctaataaccaattcaagtttccatttcatacttttcttgtactttttttttgtttaaaaacggatgttacttgttggtgataggtgatacgcagtcatccctcgtcacttcaaatctaccaggagaagctcttgcaatctggacaggtaacccaagaagatattgataagattcaaaagaaagtaagctctatcctcaatgaagaatatgaggcaagtaaagattatattccacaaaaacgtgactggctggcaagtcactggactggattcaagtctccggagcagatttctaggattcgaaacaccgggtaaaaaacatttttatttcatttagtttgtcaatgccttttggccttttttcttttctttttcaatgtaacattttgctggaaaactattcccttgttcttttgcagagtgaagccagagattttgaagaatgtgggaaaggcaatctcaaccttccctgagaactttaagccacacagaggagttaaaagagtttatgaacaacgtgctcaaatgattgaatcgggagaaggcattgactggggacttggagaagcacttgcttttgctacactggttgtggaagggaaccatgttcggctaagtggtcaagatgttgaaagaggaactttcagtcatagacactcagtgcttcatgatcaagaaaccggggaggaatattgtcccctcgatcacctaatcaaaaaccaagaccctgaaatgttcactgtcagcaacaggtatgcatttttttttaatctctagagatgataaccactcttcaattgtttttacatgatctttacgttgtttgtgtatgcagctccctttcagaatttggtgttctcggtttcgaactgggttattcgatggaaaatcccaattctctggtgatatgggaagctcagtttggagactttgctaatggcgcacaagttatgtttgatcagttcataagcagtggggaagccaaatggctccgtcaaactggtctagtagttttacttcctcatggatatgatggtcagggtcctgaacattccagtggaagattggaacgtttccttcaggtatattatatgaccgatacttaccgttaagattctctccactttttgtatttgtttccctctcatttgaaaattttaactgcagatgagtgatgacaatccttacgttatccctgagatggacccaactcttcgaaagcagattcaagaatgtaattggcaagttgttaatgttactacacctgccaactatttccatgttctgcgtcggcaggtaaaatatctatttatcccaagttcgtaaaatgttgttacttaattttcgtattcttcacactcacatgcttgatatcatccatttgcagatacacagggactttcgcaagcctcttatagtgatggcccccaaaaacttgcttcgtcacaaacagtgtgtatctaatctctcggaattcgatgatgttaaaggacatcctggatttgacaagcaaggaactcgatttaaacggttgatcaaagatcaaagtggccactctgatcttgaagaaggtatcagacgtctagtcctctgctctgggaaggtataaaaaaaaagatccactttttccgtcattaactaacaaagttcccacattctgaaatttaatactttaaatgtcaatgaatcaggtctactatgagcttgacgaagagcgaaagaagtctgaaacaaaggatgtagccatttgcagagtagagcagctttgcccatttccatatgatctcatccaaagagaactaaagcgatatccaagtaggcgtcgaaaactcaagtttgtgttcaatagttttggttgattatggaattctttgaaacttttgttcttgtgtttaacagatgcagagatcgtgtggtgtcaagaagagccgatgaacatgggaggataccaatacatagccctaaggctttgcaccgcgatgaaagcactgcaaagaggaaacttcaacgacatcaaatacgttggtcgtcttccctcagctgctacagccacaggattttaccagcttcatgttaaggagcagactgatcttgtgaagaaagctcttcaacctgaccccatcacccccgtcatcccttaaaaaaacacagcttgagaggcttgagcctgtataaaaaagacacaacacaaaaataaaagattcatgagagaatctttggttaccaaagagtgtcactggaaaataaacagatgtttgctagacttacaaatttaagtttattcgatttgtttggtttgttataggatttaatcgagataaaaggaaaaaagatttaaaccgtttggtttagtatgataattcattaatttggttcaactttggattgattttggttcggtttggttttatcagtgactgtatcagcttgaggcagttgcaatcttgtaactggagagaaaaagctatcaaagttaaaagttatg

SEQ ID NO: 22077 - DNA, 3003 bp, Unknown
  misc_feature (1)..( 3003): 2750-1469P.txt file - cDNA_ID_2045654; gDNA_ID_1620366; Annot_ID_154850
ctaaaatttgcaaccccaaaaaaattcaccttagttagttttttgcttagtaaatttgtttaaattatagcattcaaatacttttgaggtcttaaacatagagtcatagattggttaagccaccgacagtactattacagctggagagaaaggatgtatccatggagaaaaaggcaaacaatagcattcaaatactctttttcaaaattactaagtaaaagagttattgcttgaaactccacattgattgtgattgatagatcagctttggggaattgagtggccacaaaagaaaaaaacaaggtacattcacatctcttatttgaaagctacatgagtcttatcttaaacgtacagaagaaaaatagtaaaaaggaacttttgtcctcacttactactactactcattactgtactaactcttctctttgtatcacgtttcattacaacattcagatatcagctaattaggatgatggtttgtctaactctatttgttgctggttttgactgcaactgggtctgaacaataagggcagttcccaaacagaacatcaaatgacctgcaagaaattggatcataattgagctttagagcacaaggattgtgtgtgtttggatatgagagcgtgagagattaaggtttccacttactgtcttgttgttgtgatagaccttaaccagtctgtgaggcagaggctatggaaagacttgttgcaactgatgttttcacatgtgtaatctgttcgtgtcccacttctagctccgagctcctcatcttagattaaagtaaatgagaagttagcgaaccatcaaagcaaattactattctgaagcattgctttttcggtttaagaaatcaccggtgggtagaaactgcgcatagcaaatcccacattcaacttgttgttgatcgtcttccacttggagacctagaggctttggaagctcagtacctagaatacattcaaggttctcaggaaatgatctttcatttgacctgtatgattatcattaacccgtcattcctgctttcaacaatccatataactccatgctatataaccaacctctcgaaagagatttaaaatgggagagtagagacaaaataattttaccatcttttgcaatttcttctccataacatatgcaagttgttcatatgcgtagctgaaggcacaggaccaataaaccgggacctgtctaagcacttataactattaaaaaatgtcgacaagtaggttattgagagtgtgtgtttgtctagaaacatactctggtagggatttagggtctttgaagtcgatatgaacaatgatgatacaatcattccctgagaaaaaaatgaaccaagtagagatagataaaagtgaatttcgtcaagacagaaataaaagagtatggagacaaatggaattgaggtaaaggtattaaaccagcatcaatccggcgaatagcagaggcacgagctggttgcttgacatcaacaacacatagagatttatcgatattgtccaagacagaccaaaattcttgaagatagtccaaatgctgttaacaacaaaaacaagctgattagtgattacaaagagagaatgtagcaaagtcttagatctaccttttggaattggtgcattacatccttcaatcttgaacttgttgaccattctagtgtaaacatatatggcacatcctacatcgaagcaaaagttaattcgctacggagaatgaaaaaagcttaaggatttgacattaacaaaccgcagaaacagaaggtggtgaattaggatagtctctgttcagttgaatttctaagttgtgagctcttcccttcttatctctgtacataatcatgatgatggcacaaagctaacatgtcacatgaagatggagctacataggttgcaaagtactaatcacattaagtaagattttgaagacaaccctaaaattatggaacttacagaatgtgaaagctaaaaaacgttaaatctccacctaatctccttattggttcccatccaatttcttctatctaagaaaccaatacaacaatggttcgttgaatatgtgagagcactcgatttcagaagaagggaagggatcgatggttaaccaaacctccgagtaaactttccggtaaaacgaagaagacttggctaattcctcgcatctttcacggcctacacattctccagaaacattcatcatctacgcagatcatcttcaacctctgaaactttctgcatctcgagtaatccgagtgctatgttttgggccgataagcccaatatttgatgaatcttattatggcgcagttaataattaggaacaagtatttgagtgaggacttcgagtgttacgttgggcctaaaagcccaatatttaatgaatcttattgaggcccagtttatataagtattaaaataacaggtatatagttatccttgtagccaaacatggatttttcaaggcggtgcactttcttacttttctttccttctttctctgtctcctagaagccacttcactgggatcgtctccatctttgatccaggttcgtcttcttcgtgaatcttcctgcttaattttttttttcagttactacttttttttggttattgttaattttctctgatggaaattctccgaaattgaaagttgttaaagccaaaatatttgggaattcaaaaacatttcgatgatctgaatgaggtcagatcgctgagaaaatatgggattataggttattttcgttttaaattttctatgttttgtatgtttgcatgatatatatatatatatatatatatatatatatatatataactaagtcgttacttgattagccatttttgacttatctactttctttttatgttgttgagtattttattgtgttgtttaatggatcattttcaggttcagagattaaacaatttgaaaaatcggagactctgggattgtatggttcgttgttactgatagattacttaagctatg

SEQ ID NO: 22078 - DNA, 3000 bp, Unknown; identical to SEQ ID NO: 4036
  misc_feature (1)..( 3000): 2750-1469P.txt file - cDNA_ID_2045654; gDNA_ID_1620680; Annot_ID_164404

SEQ ID NO: 22079 - DNA, 3000 bp, Unknown; identical to SEQ ID NO: 1164
  misc_feature (1)..( 3000): 2750-1469P.txt file - cDNA_ID_2045658; gDNA_ID_1620366; Annot_ID_154848

SEQ ID NO: 22080 - DNA, 3003 bp, Unknown
  misc_feature (1)..( 3003): 2750-1469P.txt file - cDNA_ID_2045658; gDNA_ID_1620680; Annot_ID_164405
ttagccgaacatggttcccttccacaaccagtgtagcaaaagcaagtgcttctccaagtccccagtcaatgccttctcccgattcaatcatttgagcacgttgttcataaactcttttaactcctctgtgtggcttaaagttctcagggaaggttgagattgcctttcccacattcttcaaaatctctggcttcactctgcaaaagaacaagggaatagttttccagcaaaatgttacattgaaaaagaaaagaaaaaaggccaaaaggcattgacaaactaaatgaaataaaaatgttttttacccggtgtttcgaatcctagaaatctgctccggagacttgaatccagtccagtgacttgccagccagtcacgtttttgtggaatataatctttacttgcctcatattcttcattgaggatagagcttactttcttttgaatcttatcaatatcttcttgggttacctgtccagattgcaagagcttctcctggtagatttgaagtgacgagggatgactgcgtatcacctatcaccaacaagtaacatccgtttttaaacaaaaaaaaagtacaagaaaagtatgaaatggaaacttgaattggttattagattatttcacagagatggatgatataatagccagaccttgtacatttttggttgtgtgaatgacggttcgtctatctcgttatgcccaaagcgacggtagcatactaaatcaacaacaacatcagaatggaacgtctggcgccactcagcagcaagctcacaagcatgcactactgcttcaatgtcatctgcattgacatggaaaattggggcgctcaaagcctttgcaacatcagtgcaatactgtgaagaccttccttccctgggatcggttgtgaaagccacttgattattcaccacaatgtgcactgttccaccggtacagtagttaggaagtgcactaagatggagagtttcatacaccactccttgtccggcaaagctaccatccccatggatcaaaatacccatgttctttgttctgttctcgtctttcgtgtaatattgtttcgctctggttttacctatcacaacaggatctactgcttccaagtgactgggatttgctaccaaagacaagtggagatgtttgcctcctctagttggacgatcataagatgtacccaagtggtatttcacatcacctgttccggtgtaaagcccaacttcatctactggcctagtaccaccgctaaactcgctgaatatttggcgtagaggttttctaacaacattacccaaaacattaagtcgacccctatggggcataccgataactatgttctctaccccgagatctgcagacctatcgaacatctccttcatgccaggaatcaaagattcagcaccttccagtccaaaccttttagccgtggtccacttagtagccaagaaattctcaaactgtgtgctccaggtaagcctatcataaataaccatccgacgctcactattgtactgtcgaggagttggggtctcgatcttgtctctcaaccagttacatttatccctatcagcaatgtgcatgtactcataccctatagtcccacagtaagcttgctcaagcctcgacagtatcgacctcagtgtttgaaccgggcggttctcagagagaaaacccgacatcctccatacacccagaaagaattcccgatcaagatcagcctcagtaaacccataaagacctggcgtgagatcctctggaatctctctcttctctagacctaaaggatcaagcttggccttcatgtggccattaacctggtaagctctaactagcaacaacaaacgcatgctttcttgaatggtttgccccgagataccaggcgatgtagaagcctgacccacaaaattcctaaaaaagttatcccacgactcatcaacactgttgggatcagcctcccaagctctttgtaactcctctagatacacactgcttgttccatctaagaagctatcagttagcttagaaagtgggacaggacgtggaacaggtgcagcagactctgcctttgatttgagtattgtagagtgaaaacatctggtttgacaaggcaaaacccttgttctagtggcatatgaaccacaacgagactgagacagtgtccttcttatggcaagctttgccacagaagaaccgattctaaaccaaaccatagcttaagtaatctatcagtaacaacgaaccatacaatcccagagtctccgatttttcaaattgtttaatctctgaacctgaaaatgatccattaaacaacacaataaaatactcaacaacataaaaagaaagtagataagtcaaaaatggctaatcaagtaacgacttagttatatatatatatatatatatatatatatatatatatatcatgcaaacatacaaaacatagaaaatttaaaacgaaaataacctataatcccatattttctcagcgatctgacctcattcagatcatcgaaatgtttttgaattcccaaatattttggctttaacaactttcaatttcggagaatttccatcagagaaaattaacaataaccaaaaaaaagtagtaactgaaaaaaaaaattaagcaggaagattcacgaagaagacgaacctggatcaaagatggagacgatcccagtgaagtggcttctaggagacagagaaagaaggaaagaaaagtaagaaagtgcaccgccttgaaaaatccatgtttggctacaaggataactatatacctgttattttaatacttatataaactgggcctcaataagattcattaaatattgggcttttaggcccaacgtaacactcgaagtcctcactcaaatacttgttcctaattattaactgcgccataataagattcatcaaatattgggcttatcggcccaaaacatagcactcggattactcgagatgcagaaagtttcagaggttgaagatgatctgcgtagatg

SEQ ID NO: 22081 - DNA, 3003 bp, Unknown
  misc_feature (1)..( 3003): 2750-1469P.txt file - cDNA_ID_2045662; gDNA_ID_1620366; Annot_ID_154845
tctcatgttcaaagtgggtttcttctaatccaatttgaattttagttcttatattattcccctctaaccctaatcatatgtttctcaaacttttgatttttattcaagattcctcctaatcagttatttcttctttgtatgtagatgtagttgcaacttcagagcttttctcatctgtggtgtcgtagcgtgagagagacggatttgcagtcattgaaactctttggacattacaaagcccaataaagatggacaaatgacaagcccatttttaaattttgtctgactctcgcctatcctacatgaattctacagagacaatgcatcatcccattcggctaggtcaattttcatccctatcttgtttataatctataatcttatagataggttacttacaaaaaaggtctttaatactacttttgatttttcaaaacataatatatttctcaaagtttttgatttttaaaggtttttaactctctttatttttctatttttttcttctataaatattaaattaatatgacgttgtgaaatctaaccggattttggatcctgccatgtaaccatggtcattagcgattccacaaatccaacatgttttttcacatcttcatgtatatttagcattttttttttttttttttttttttaaaaagttttcaactcttttgttttttttaaaggttctataaatactaaattcatatgagattcaatatttagaatataaatactaaactaatacatgtggatacccaatacaaatataaacctaacagtattagttatatactaaactaatatatatatatatatttgtaatacctcaagaacctaaaattaaaataataaatccgaatatacagcggcggatccacgttatgggtgatgggggcaactgccaccagtaaaatataaataatttacgttttttaataatacagagtaagtaaagtaacagaatggtatgaaatgctcccactaaaagcaagaagtatcgggttcaaacccatttaaagacattttgcccccattaaatatttctgctgagtccgcccctgcgaatatactagattttgttttttagtaattcatataaattggatatatttgggataaaagtagccaatgttatagttttcttttaggtaatttgagtattttggttatatttgggtaaagagtagtaaccaatgtatttttgggtaatcggatatttcgattagatttagtatatatggtactctttccgtttcacaatataagttgttttagctaaaagcacgcagattaagaatatttatttttaaaaagtttaaccaatcataaaagacactgcataatagaaataattataaaacattaaaataatatataatagaaatttgaaaacaacttatattgtgaaacaaaaaatttggtccaaaataacttatattatgaaacggaagaagtatattatattctctcatccattttaaaaataaaatttgaggattttaaacaaacttgttccccctttttatggagtacttcttataatagtggctaattataagagtctaaaaacgaatttttatatgaatttagaaaaattaggatggggtttttgggaaagataaaatgttgcctataacagtacatatttaatcagacagaagtgtcttcacggcgacgaagagtgtcttccggcaattgcatactccaacgcaaacaaaaaatgaaaataaagcaaatgtcattcccgttaaataatacgtgaatgtcattcccgttgaatgctaattaaagtagagaagcctcaaaatccgatgagtcatacgtgaatgtggttctagtgtctccccaaatggcttccttccatttaattccgaagttaacttttacacttgccatcaaactttagtaatgaagaaaacattgatacaacaaaactgcgagtgtaaaaagtctcatttcactgttaaattattaattttaagagtagacattaactgcgcctaactgatgactaaagaagagttgatcaaacaaagtctacacattacctaacattctctgttctaactaaatacatccatttaagagacacttaccaacctcctactcaaagctactctaactgttgttcaattaaccatcaacataactgcaggagtaattgattaaacaacaatgaactctgacttcatcaaaaacatcgaaagactctgaagtcaagcatgttgtttttatatgtcaaccgcaaacctatgcattaaacaaccaatagaagccaaaaaaacgtacagaatctaggagaatgcaactatgattatgaaaattcacgcacactaataccactagcttacaattagagagtgaaacgttacaatacgtccacgcaaaatacgtcttattattatgataacgtacattaatattcatgttttctgtttgtgctctgcattttgcttatctgtgctaggtgaaaacaaaaaaaagaagagatttggacattttaacacacgctttgctcgcacttcacttttttcacaatcatactgttattttccttcctcttataatgaaaacttaccgataagcaaatttgtaccaaacgtatgaacgaatgatctttctagattagtcgattttaccatacattaattaaattattaggttcatctacccaactacaaaaaaagggagataacgttggcgttttcaaaaaagagtgaacactaataaaagttttctagattccttttctcaacttttctttaagctaaaagactccaaacaaacacttaagaaagaaactgtcactcaaacttaaacctacttcccatgtgaatcaaaagaaagcaaaaaaaaccagcaaatccgtccatctttaaataacaatctcaaactctttaaacgttactcaacttttttcttcttttcaaaaacccattctatgaacacaatctcacctccttcatcgtgtttcatacctctcttcccaacacgatg

SEQ ID NO: 22082 - DNA, 3000 bp, Unknown; identical to SEQ ID NO: 1230
  misc_feature (1)..( 3000): 2750-1469P.txt file - cDNA_ID_2045731; gDNA_ID_1620374; Annot_ID_155107

SEQ ID NO: 22083 - DNA, 3003 bp, Unknown
  misc_feature (1)..( 3003): 2750-1469P.txt file - cDNA_ID_2045741; gDNA_ID_1620374; Annot_ID_155104
aacatctgtggaggggttgatcaagacaccagcatcgatactacatagcctcgcaagtgtatcagtcttcctgaaatgcctaaccatttttttgttagagagatttttgttgtttttgttgttatggttagtacttttactccgttttatagatggatcgggttaaatttgttcaatacataatgaaatgtctatctatgttggtaatttctttccactaaaatatttgaatttctttttacatgtatttattttcaactattaccattaatttctttattagaaaagtcatattcaacatgttttatcaaaactttctgtcaaaagatgatattagaactaaattcggacaatattttagataattcctcgtttgcgacgtaatacatgatgtcaaaactatgttacatttagtagtacttatcttgaattaaataaaattaagaaaaaaatatgaatggggtgttactatggcatatatctattacctctggatttcattctatatacaaaaatattattttaaaatgataatttacacgcgccaaatatgcgtaccagccacgaggcaaaaattactatataactttttttgaaaataaaaactaattttttgttttttcaaaataagatacaaattatacgtaattccttagtaaagcctgaaaaacatcaaactttattttggctaaaggacatcataaaacctactatgtaattgtcattaacgtttgtttaactaaccaaaataaattactgaatcttgaactataaattcgaatatagagaaaatatgaaattttgtaagtgttattagacatccaaattttaaaaccgcgtaaactacactacaatttaaaatcggagtatgtaacctacatagagcctaaccacctcctaagccgtatttaataacattgttatattatgtaaagatatgatatatatcgttaagtaatattatgtagtgaaaatccgtcacaaatcataataacttgtagtgatcaaacttcttgtatataatctactttgttctcgcgagcaccttaatcaatcatcccatttaaaaaatttctttttgctattaacatcttaaatgttaaatctatcattgagcaatgtaacagttctgtgtgaagaaacaaggaatcacttacttctacattgtctctttacaaaggaaatttggcacatgataatgcttcggtttgggcaatctccttatatctttgcagacttgtctattaccataggtaatcatataaaagttattatatatgaacaatgttcctatggtaatagaaattcacattttattaaaaaaactgatacgaataattcaaagaaataaaataacttttatatgattgtccataagatatagtcaaaacgcaaaagactttgctctaagaaatattaaaaagaaaaacaacaagacgaggattatttcttttcaataattaaaacattagtataaatacaatcacatgcttaatgtaataatgtgacagtttggccgagtggtctaaggcgccagatttaggctctggtccgaaagggcgtgggttcaaatcccacagctgtcaatttgtttttttctttgactcctttgttcatctttattttaaaatcaatataaacccttttcggacattctaaatattttgacccaacctaatgatattcattatttgtctaacgggtcaactttcaagtcttcaagtaaacatgatatggaattatatgggtcaactccaagtaagaacagtgcatgcatcttgaagacaaaattgatttttttttttgtttttaattaatggaaattttgaaatactaatgggtcaagatgaggttgtccaaatcaactgatatcatatatgaccagattcctcaatagtcattagtcaatacaaaatccataatcttttttaaaaatataatctttttattttaaatcgcctatttttttccattcatttgtccaatgtgaaaagccataaatcatatattaagaagttgtgaattgtgatcataggagtaatatttctatctgaacaaaaattgaattttgttttgctttttgttgaaagataaataaaatgtttggcagattgtttgtacagaacacaacttgttgataaaacaaattccatcaagacagctaatgagcttttgatagtcagagctttgaagacgtgttaatgaattaaactgattagacctaaaaccaaatatttagaaagaaaaaaatatgataattgttatgttatttaatcaatagtcaaatactatgttgagtaccaatcatttcagtttcaacgattgctactcttttgaccaataacaaaaaggtttttatttttcatttctcaaactccatttttgtttgtttttagcataaaaacagctagaatgtgagtttcatatgtattatatactataagaaatcatataaattaacgactagaacatattgttttcattctagtggtatatctgagtttgactagaacgtttggaggcagattaaagtgatttcgccttgtcaaaactactttgtatatgttatcaatcaatcgctcaaaactaaatcggaaaaaaactacataaataagatatggaaaatgatactaacacaaactagtaagtaagtagtcactacatattctggtcccatgaatatggcttacatagtacatacattgtgagattaaatgaatatgatatataatacaagcatataagcatgtgcatgactatgaagtgggaatacatttagtgcctttatatgcaacttgacagaattaccaattatgtgaatagtgaaacttatattgcgtcttggccttttcacatccgtgacatgatccctcaaatctatatcttcttgcggcatatgcttatatataaacatatgacttcgtctatagatttatatccagataattaattctctcataatatcttctccacaatttcaactcttctaaagtctaaaccatg

SEQ ID NO: 22084 - DNA, 3000 bp, Unknown; identical to SEQ ID NO: 1233
  misc_feature (1)..( 3000): 2750-1469P.txt file - cDNA_ID_2045772; gDNA_ID_1620374; Annot_ID_155094

SEQ ID NO: 22085 - DNA, 3003 bp, Unknown
  misc_feature (1)..( 3003): 2750-1469P.txt file - cDNA_ID_2045798; gDNA_ID_1620383; Annot_ID_155377
tcgagtctcttgttttaggttttatccgattctgatttgtatacctgtcaacttcatttgttaatctgtgtgctgatttagcttcctaactctgttgatcgatttggggaattagctctttttcttttcgtggtgaatactaatgatgcaaagctttgaatctgatccatgtatttttttatatgctgcagaaacagatagctaatataattgagtttggatactcgcaagtgaaaatatgtcggtcacagcgggagtgagtgaatctgcaattgctgtaagggagaaactaaaaggtggtattggacagactaaagtgcgaaggtattggccaggaaaagctccggagtgggctgaggaagctgaagaagatgatgatgttaggatgcagaaggtttctgttttggatagagcttttccaaagaatgatgatttgggtgttgctaggaaggatgatccaaggctgcgccgtttagctaagactaaagttgaaaaccgtgacgaagttagagctgatcatcggcggataagacaggctgagattatttatacggaagaagaagaatcgaggaatcaagagaatagagacgaggacgatgatgaagatgccttggaagagagaagaagaagaattagagagaaaaatcttagaagagcgcaagaggaggctgctttacttcctttagaagaagaagatgagatacaagaggaagaagaggaggaggaggagtctgagtacgagactgattcggaagatgatatgcctggtattgccatgattaagcctgtttttgtaccgaaagctgagagagatacaattgcagagcgagagaggcttgaggctgaagaagaagctcttgaagaattagcaaagagaaaattggagcaaagaaaattagagacaaagcaaatagtggttgaggaagttaggaaagatgaagagatacggaagaacattctattggaggaagcaaatattggagatgtggaaactgatgatgaactcaatgaagctgaggagtatgaagtttggaagacaagagagattggtaggatcaagagagaaagagatgcaagggaagctatgctgagagagagggaagaaatagagaagttgaggaatatgacagagcaggagaggagagattgggagaggaagaatccgaaacctttgtcagctcaaccgaaaaagaaatggaactttatgcagaaatattaccacaagggtgccttcttccaggcagatcctgatgatgaggcaggttctgctggaaccgatggtatatttcagcgcgacttctctgctccaactggagaagataggttggacaaatcgattctccccaaagttatgcaagtcaagcactttggtcgtagtggaagaactaaatggactcaccttgtcaatgaggacacaacagattggagtaacccgtaagttttctgatttcagcgtttcttttcttgcgttttgttaggcacagactcgtttaggtctctgaaatatgattaatagcttatgagtagaaacattaagatgagaactgaaataaatcagtgcatgcaaatgtgaacccgggtagtgttgggagattcttgcatctgtttttctcgtttcatgagagctgcagattttgatatttttacttaacataaaatgaatgattgtgcaggtggacttccaatgatcctctacgtgaaaaatacaacaagaaaatggcaggcatggatgctcctatcgcaaaaccaaaagggagcaagaagatgaaagattgggagtcttaaaccgcaccaacatttagtttgctttttaaaaaaaatccaaaacgatacagaagtgttatgtggtagtaaaaaacatcgtaacatcttactcagttatgtcttgagtcctctaaatcgtagtaattaaaaatattgctttgtggaagacatctagtcttttgtatcgggatcaattatgcatcaatcaaagctgtctgcttgtattacgaaagcatagttagttacatatttccatggcaggaggtggttgatgggattttttttggcagaactgatttgagtttcaatagacaattctatggctagaatcgcttattatataacattctgaatacagtgatgcttgccaatctagattagtatttgtaagaatggaatctatattttataagactgcaaaagactgttaaactaacactatcttttacacttcgatatcattattaactggaatttaaatttaaattctggagaagtttgcaccaaaaaaaaaaaaaaaaatctggtgaagctaatttggttagataacaaatttcagaaaatacaaacaaaagtaaaagtggcaataatatgcaaaattagaatgaatttaaataattctgccgaaagtaaaatggtacaacagatacgaaagctgtaaagaagccgacaacaacatacacattagcccactctgcttcttcttcttcttcgctcgccatctttttttttgattagtcaaccattttcttctctctccaatttcaacctctgtaaggtacgtctccgactttccatggcttccccacgtctcgtcgtcccctctcttaattttgcgtttcatttcgttttggttgatcttttttttgaatttgattttatatctccgtgatctgattgctcctacctggttagtgacttcacaaaacatagatttttgtttattgttttggtttcattcgatttctggatttgatccttgatctgatttcaaaattattcactttctggcctcgttgagccttagatccaattctttctattatatcggagacaacatttaatccttgatatcttaatattgtgttgcgatcttaagtttttgattttgaattgaattagactcatcttgttgtttttctcaaatcttaaatacgataaaaactaacttcatcatttgattctgatttttcgtaattcttaatacagagacgacctggaaaaatataaaaagagatg

SEQ ID NO: 22086 - DNA, 3003 bp, Unknown
  misc_feature (1)..( 3003): 2750-1469P.txt file - cDNA_ID_2045805; gDNA_ID_1620383; Annot_ID_155375
actttgaaatccgtgaattctttgagggcttacacatgaagattgaggaagaatttcctgtttatttggtggagaaaaatgctctgaataaagctgagaaggaagagaagattgtgagtacatttcccaaactaaaacttcctgatttctctatctctctctctcactctcttcgtatgtctcaggacaaacagggggatcagtgtctgatggtagtcagaggtatttgcctatctgaagagcagattgtcacaagtgtaagacattaactaagatcaaaatgatacttaaaaagattgaaaatagaatggattttaactctattccacgtatacaggtctcacaaggagtaaggaggatgttgaataagcagatactagatacggttacagagtctcaaagggttgttcgcaagtgcgaggtcactgcaattctcatcttatatgggcttcctaggtactctacctcatcatcttctttctaaatactctcttgcgccaactggctcaatcaaatctatgttcacacaggttactcacaggatatatcttggcccatgagatgatgcatgcttatcttagactcaatggtatgtaagagtcaaatatgtaatactccatttgtacccccatttgaggagagttctcaaagtcctttggtttgatcacaggttacaggaatcttaacatggttcttgaagaaggattatgccaagtgttaggctacatgtggttggagtgtcagacatacgtttttgatactgccacaatagcttcttcttcttcttcttcccgcactcctctatctacaaccacatcaaagaaagttgacccatctgattttgagaagaggctggtaaatttctgcaagcatcagatagaaacagatgagtcaccattcttcggtgacgggttcaggaaagttaacaaaatgatggcctcaaataatcacagccttaaggataccctgaaagagatcatcagcatttccaagactccacaatattcaaagttatgatagccagccatatgttataccagtaatgcacgttttcattctttggtgtgaacacagtttcttcttgctctattgctcttgttctcatgttttaagagtttctccttcgttttgcagccatagaaactttaaacaatcttgcctgttgtacaaatgtatttttcgctggaatgaattcttgctgtgataaaactgaaggattccttagctcttgatccacttctagcgtcgtatcacaaaagcacattaggtattattgttatttgaatgtatcattgttggaggtatatagagtggctcaagtctcccaaatataacgaagctaaaatgtttgttatagtgcttttagtattggaatatctttatctctgttcaacatttacactatacagttatcaccgataataatatttgactgtttcaatcgcattgattctacacttcaaattcactgtttttcatagcttccacttccacccttccaccatttgtgctatatagaggcctgggggttcggttatatcggtttaatcgggttttcggttttttcggatttttaaaattttgccgaattggatcgaacaaaaattattcggttcggttctcggttttttcggttcggttatggactaaaaattgtgttccaaattgaactgaataattgttatttttcggtttattaggttaaccgaaaataattttcatattatagctatacataacaaacaatccaagacaatttacaagccaccatcattgtcggagctctaccatcatcgtcaacgcacaaccaccatcgcataatcttctcgtcgaaaaaaataaaataaaagaaataaataaatcgctgacataaaagaaaaataattcaaatgagaagatcaagtgatcgaggaagaagcattcacctaagacctggagtaaataaatcaagagtgtatacaatgatatagagagaagccactagatccaaaattcttaagaaaagaggtggaagaagaagaaaaaacaaatgggaacagatttaaatttagggtttttctttttatactgtataaaataattgtgggctgtaacatatattgggccaaacgaaaataattagtattatgggccaacaaacaaaagtttaaatgaaagcccatatataataaaatcaattagggtttttaatcttaaacatggcggccgaccttcttcttcttccttaagacaatacataatgacagaagcaaactggggaagatgaagatggagtggtgaagaacaaaaccgaataaccgttcggttcagaggtgccgaaccgaaccgacccgtaaaccgaaatcttcgaaagaaattgccgatcggtttgctactgttccaaacctcggtgccgaaaaccgaaacagtcggttttttcggttcggttttctcggtttattccgaatgatataccaatcctggtttaaattgaagggctgaataaaccaaatatttcataggcccatgaaagcccaatagaaattactgtgacatgtttatgagattttcgcgtggcttattgttgagttataacgtttcggcttcccgacctcaaccgtcttctgctcctccgccccgccacagtttcttagggttcttccgcattgtttctccgaattgcaatcccctcattctccacaatgtaagtttcgtttattttgtcttcaatttcttctggattttgtcaatttatgtttcctttgttctctctttcagaatcatcgagtctcttgttttaggttttatccgattctgatttgtatacctgtcaacttcatttgttaatctgtgtgctgatttagcttcctaactctgttgatcgatttggggaattagctctttttcttttcgtggtgaatactaatgatgcaaagctttgaatctgatccatgtatttttttatatgctgcagaaacagatagctaatataattgagtttggatactcgcaagtgaaaatatg

SEQ ID NO: 22087 - DNA, 3000 bp, Unknown; identical to SEQ ID NO: 1357
  misc_feature (1)..( 3000): 2750-1469P.txt file - cDNA_ID_2045869; gDNA_ID_1620391; Annot_ID_155622

SEQ ID NO: 22088 - DNA, 3000 bp, Unknown; identical to SEQ ID NO: 1359
  misc_feature (1)..( 3000): 2750-1469P.txt file - cDNA_ID_2045887; gDNA_ID_1620391; Annot_ID_155615

SEQ ID NO: 22089 - DNA, 3003 bp, Unknown
  misc_feature (1)..( 3003): 2750-1469P.txt file - cDNA_ID_2045893; gDNA_ID_1620391; Annot_ID_155612
gacgtaaatgactcttcgtacaaatgcatttagtcggctttgtgtgatgcggacaatggtttgtttgccataattacttaggatagcgagccgcgttttgcatagctagggaattaagccattggtgcctaggttttagcatttatccgcagaaccaaatatttttcaaaattttggttacaaattctaccgcaacatgtccacatgtagacaatcggataatcatctcccaacaacatatactccaattaaatagttgattccaatttcttatatttaaaatcaaatgatataaaaaatgatcattgaatattggtggctagtgccgggttgccgaaataaaatataaacgagtggactgaagaaagttttgacttggaagactacaaaatagacaatattttccgttaaagatagataataaaaagacaatgcttttgtttgtacctaaaagcactaatcaaaatcgaaaggtaataatggaggtgaagaagacatcattctcacataatcatctccgcatcctcagcttttgctattaatattatatttaatataatttgttacgtaaatcatataaattgttcaaaattatttactaatgtgcaattaaaaataaagaaaatagtggaacaaagaacgtgttcattggcaatcttaacaatcgacgagtatgaaaggatgaaagatccacctagtcctagaaaaacaaaagtgttcttaaaatgttatagatgtatctagtccttgattaataatttttttaaaaaaatactttcataatttttagaagatatatattttatcatgcttagtttaacttgtggaatcacacgaatttgttttgttaaatggcagtgagtagttggaactttagttagcataagagaaaaatatttaaataatttgcaatcctcgggagcggtgaggttaacgttaaggttaatgaaatacttagttatatatgaatgtgttaatatgcggtgcagcatagacgtgctccatattttagttttaatgcttattctattttaattaagattaattttgtggacattgggtttccataatttctttgatattttaattaagatttgataaatttgttttgagattttataaacgaggtttacagaactttttaagagtatactctagttctttgttcttagtagtatatagcctatcaatatattctcaaccagtttaaatagatttatttgactttttcaagaatttcaaaactaaaccaataattttgctatttatacttatttctttaatgggatcagttgcctatctttataagtattctatacgtcaatgcatgtatttgcaacgatttattaaggcatgtgaatgtgaatgaagtatgaagaacgtgtgattagggccctacttgattcaagcaataacactaatcgacatcacacaccaagacgtacaaccccaacccaacaaagaacaaactctaaaaattaaaaaataaaaactctgaaattgtctgatttagaataaatatatcgttactatagagggacgattggctttgatagtaatactttttttttgttttcaaaatattaaatttatgaatcaataatttacgatcattaatgagagattgatgactttaaaattatgtttaaaagatttaaataatggatgaatcattatggaaatctttagtcttgaagagtactaagtataggttttttttttttttcttttcggttttgtattccaatgttctttttcaacataagaggcaaatcaactagtttgtcttagaactgcgtttaattgaatttgacaataattgtatttttgattttttttatcatgatattcatattcaaatcaactagttatgcacccttgaaattcactaacatcatatgaggttggatatctcttggtaagttcagaaccgaaccaccacatgtccatatctcctcccgtaaaatcagctatgctatcaatcatattgttttcttcttgtttgagagatagggaggaatatttgggccggaggacagtttattcctcccggaagtcatttcgaatgttaatttgtttttgaaaaacgatgccatggcataatccgagggaaagagtctctcaccttgactaacaacaaacaatctaacttggtccgcgggcaagtggtcgaatcacctaacatatgctcaacagcaatacaacacaaccgatgttccccataacaattgtgaccctatgatggaaaccaaaaattagtcccaacatatataccataaaaatatgtaaattgataaagcagaacctagtgtttggaaaggggctctattctttctaccccaaagacaaaataataaagataataaaaaatgatgacaagagagacaaaagtaaacaaaaaaaaggattttagaaatgtaatagatttccaatatcaacgctcctttttgttcccgctttaacttttcccactcgcaaatcattttacctttggattcaagcctcatgatactttttctttttctcacactttttacactattctctgttttgttgttactcatctcttatcaaacattttaaacttgtcgactttcactcttcactagctaccattgttaacttttggttcttaattcatattttctgctccaactttgtagagaatcttttgttatcccaaagaaaaaggtgcctaaattcacgtttgacaatgttgcttgaaaaaggtttgatcttgaaatttcaaaagagggaaaaaagtaaaggagaaaaatttggagagacaagaagtgagtcaagggacccaacaacaaagacaaagacaaaaactttggattttgccaaatactatgattaatgctcattcaacactactattaccatttccatcatcatcatctctctctctctctctggttttggaaaactgcctgagaaaaaacctagccataaccatcttcttcttctttctcttgttcttgaacataattctgcttcatg

SEQ ID NO: 22090 - DNA, 3003 bp, Unknown
  misc_feature (1)..( 3003): 2750-1469P.txt file - cDNA_ID_2045924; gDNA_ID_1620391; Annot_ID_155601
tgtgttttatcgagtagttttgataacaaaggcgagttgctggattcttcttggaaattctaatctctggaaagctgacaagagcggatggtaaatcaaattcttgattagcatccagaggatattattattaatacaagataactacgatcagatatttactctttcatggtatatacatttcatttccatgatctcgaaaaccctttaattgaacataaactttattcgactttgcaagaacatcttttcatgataacatttctccctaaatgagaaccaatagattagctttgctaagtgcattggttaagttcttctgacaagtataaacttgaaacatatatgaccatcaaacgtagctcaaagctcgaccccaaaaggtcttgcgttcatacttgctaacgggtcaaatccgcccgccccattgttccgtgactccaacctccaacgacaccgagtaataagatagttccaactaattgacctgaatcttggaacatgttcatgaattctcgacaccaaaaatgttacaaaaagtatccattaaaaagaggaaacgtgttacttctattgaaacaaagaaccaacaaaacaaaaaaaaaactttatgcctactttttgaatctttataagtcaagctaaaataaaaggttgtgaggcacaagcaaagctgagatttgttgtattcgtataggaaacaccaatggaccaaattttataccttgagttttgataacaaaggtaagttgctggcttcttcttggaaatctaatcttgtatgacgattcgggaagctaatcagagcggactgatagaattctatatgactaaataacatagatataagcatatagaataatttccaaaaagcactacaaacttttgatttctaggaaagagtttgtccacatgaaccttgtttgagcttgctcatcttcttctccacctacctttgatgacaagattggcctagtatctgatggtttttggttgatatctaatctttgagctatatactgatgcagcttgatatgaaagatagagatgaaattaatgtattgttgggtcactgtagaggattgtattcgtaatagtattgttaccatgatctatgatgcttttacttctttcaacaactagtttgatgtgcatcttttgttaattaacttagaaaattgtggccatatatcgctagagttggcctgaagaccaaatgtgacgctaatctaaaatacatatattgctaagaaattcgctcaagttcttgggatgatatttgaccaaaacaaactgtgatagatttgggccacaattacaatttttagcctacactaattattggaccaatcataagattggtttggcatttgttaaacataatgtacaaatctaatcaaaatatcctaaaatatcacttaaatcactccaaatctaaatagtaaattccatcaaatctttcaaaatatcaactcccacagtttataaaagaactattaaaattttcatatattgtaattttagctacataactttatataatgagaaatacaatccaaagatatagaactgaaccaaaaaaaacataataaattttagctaaataactttttatttagtaaaagattttttttttttttgggttcagttctatacaataaattaaaataaagaaagaagagttatgttctaccaactatataataaatggtgaatgaagaatcattaaatagaataggtttggtgtccacataacataaaaaaaatccaatacaggatagtatattcttattttatggtttaaaaaataatatttcaaactctctaatatataaaaagaagttttacattgaaaaatccgcaaataagcttaaaacgtgagcctattgacttttacttttttaaaataggcgttatattttgttgtttttatttaaaacatcatgaaactttaacgttttcaattatcgttcaacgaaacgtatattttatttattgtgcgttaagtttttttttgtcaacatatgaatcatatacacaagtaaactaattttgtcactacttaataaagaaaaaaaagttacaaaactaatttgaataaaataagttcattcctttatcagttacaataaaatcaacaaaatttgaataaaattagtcttcacaaaataatactaaatttgatggatttaactatattagccaaaattcaaaaaactctcatagaattttaactactcatatgattaggttggaaatgaagtataatttataacaaatactcatttctaaatgtcttggaaagataagtcaaaatcattatgacattatcagtgactactgactatgaaaatttgatttatcttgctttatgaattcaacgatacagtagacagagtcaatttacacgaattaagtgatagttactgaaatgaaatctaaaagcgaataatgttatatccaaaaataaacagattacattaaaaagaaagtgatgattgattagtaatattaattgcaacaattaagtaaagaaaatcgcgagaaaagaggaacccacgacacattgaaacttgcaaaaaaaaaaaaaactagaaagcgtgcttcgcaatggtcttttctttttcttcttcttctcaatatacactaataaaataaaaataaaaagcttctcttgcaattctctcttccctcataaatagagatgcagtaagactataaatattgaccagtgtcctagagagagaaactcgccgcttttaacactttttttttttctggtttttttttttggttaagcagtaagcactaagcacatatctcgagcacacacacaaggtcagtcaaaaactgcttctttttctgattcatatatatatattgctttgtgggtctttggagcgtgcatgttttttgttcttattgttgatttgtgtgtgttttcattttctgggcaacggctagttattcccacaagttgtagacgacagaagaagatcgatg

SEQ ID NO: 22091 - DNA, 3000 bp, Unknown; identical to SEQ ID NO: 1445
  misc_feature (1)..( 3000): 2750-1469P.txt file - cDNA_ID_2045954; gDNA_ID_1620403; Annot_ID_156031

SEQ ID NO: 22092 - DNA, 3000 bp, Unknown; identical to SEQ ID NO: 1446
  misc_feature (1)..( 3000): 2750-1469P.txt file - cDNA_ID_2045968; gDNA_ID_1620403; Annot_ID_156027

SEQ ID NO: 22093 - DNA, 3003 bp, Unknown
  misc_feature (1)..( 3003): 2750-1469P.txt file - cDNA_ID_2045994; gDNA_ID_1620403; Annot_ID_156021
aattcacataattctcatcgattagagacatttaggtattttttgtatgaaacttgatcataggtttaattatacataggccaatacaaatgtctcttaggtaatgacgataatggaattaaggattagaacataatttgactgattctaaaattcaggaaggtgttgagtgggagcacaagagcaaaatcgctggtaaaatgcatgcttgcggacatgatggtcatgttactatgcttcttggggctgcaaagatacttcatgaacatcgccaccatttgcaggtctatgcatttttcccttttgaactactttcatcagtaacatttggcctaacacattttgttttgttttgtttagggaactgtggtgcttatctttcaaccagctgaggaaggtttgagtggagcaaagaagatgagagaagaaggagcgttgaagaacgtcgaagctattttcgggatacatctttctgcccggattccctttgggaaagccgcttcacgtgcaggttcatttttggctggagctggagtcttcgaggctgtaatcactgggaaaggaggtcatgctgccatccctcagcatactatagatcctgttgttgcagcctcaagcatcgtcctcagtcttcaacaattggtttcacgtgaaactgaccctttggattcaaaggtttcgttttttactctttgatgatcttcacacctggtctatacattatagaacagaactcattgaggtttcttctgcaggtggtcacagtttctaaggttaatggaggcaatgcttttaatgtcatccctgattcaatcaccataggaggaactcttcgagcctttaccggatttactcagcttcaacagagagtcaaagaggtgatgcgacccaagattgcgcctataatatttcccggtattgttgctttacccatagaaccaatctccggtttcaacttttgattctaggtgattaccaagcaagcagccgttcaccgatgcaatgcgtccgttaatctaacaccaaacggtagagaaccaatgccaccaacagtgaacaacaaggacttgtacaagcaattcaagaaggtggttagagatttgttgggtcaagaagcttttgtggaagcagcacctgtaatgggatccgaagacttctcatactttgcagaaacaatcccgggccatttctctctactgggaatgcaagatgagaccaacgggtatgcatcgtctcattcaccactctatagaatcaacgaggatgtgcttccgtacggtgctgcaatccatgcatcgatggcagtacagtacctcaaagagaaggcttctaaaggttctgtctcaggctttcatgaagaactctaaaccttggttgtagacaggttgttcatcggttattggttcagattcagaagcacaaacctaacactccattgaattaatcaagtgttatcgtacaagatccttgcaagtgttatagaatgatgaaaatgtatttaatagctaattttcaattggcaaattatcaacttttaatagtctgtgtaaaagtattgacagaaacttagaacacgaattatgatcattggtcttgttgtaatgtattggcaaaaatcatatcttatgtttaattgaccaaaatcataagtgaaaaaacagtatttcatagcatagaatcaaaacataatagttcggtgccaaagaaaacaaaaagttacaaatgaccttgagaagtttcacgacaacatctttctctctaacttcttctatttctcagaagagttgggtcctctcttctttccgaaaccaacaactgcacaaatcaatgaaccattactaaccaataatagatacgcaacgtaataagcatttgagtcaaaaccaaatgataaattcagaagctctagtctaaaacatcgaaccacaagtgttccaatataacacatttctcgagtattcacaattcttattcaaattcacaatattattaaccacattcaacaatgcagtagtatcgctttataaaaatcgaattcaacaatgaacactaacacactgtaaaggaatcaacaaagaaactagatcggaaaaattacctgcggtgacaaaacgacggttgtgctgcagacgcttgtgagcacgacctctgggcttctttttcttatcttgcttcgcaacctttggagtttgtcctctaaccttaccggcacgagccaaagatccgtgaacctttcctgaaatcgttaaaacacacttaacgtcaacagatccacatcagaagaaaaatcaaaagctaatctataaatttcaagaagtttccaaggattttacccatgattgattagcttctctgctttttgttcctccgttccgccggctgcaagaagctgaaatgagttcgtgcgaaatctcagaattagggttttcgagatgatgatacgtatttaaacccgataccgaaatatattgggctttatgggcccatactaactacttaattactattgggctttattagctcgaatatggacatctgtaaaactggacctataagcaacacaagtttgacaatataggaatacaaaataattcgaattcagagaaaaattatctctactttaataggtctataacgtttgcataatctaaaacccaagatattttggaaacatatttctattttaataccattttccactaatacttttcaataacagtagttgtttccataaataacgtctccactaattgaataaaatgaaatatttaacgaattattaattgcgataattagatacgaatcaaaaagattccaccggcttcgttggaaactttaagatatttccgattttaccccatataaagggaagatccaacggttattcttacatctctcaatacgcagccaaatacactctctctgaaacctctcctcttttagggtttaatatcaacgcctccaaaatttccgtgcttttgttttcgtagataacgaacaatg

SEQ ID NO: 22094 - DNA, 3003 bp, Unknown
  misc_feature (1)..( 3003): 2750-1469P.txt file - cDNA_ID_2046001; gDNA_ID_1620403; Annot_ID_156019
tatttacagtatattctccttcaaattttggagtattgtggattttgaacatgtgtaaattgtaataaattggttgtctttttacgttttttttctttttcttttgattatgttcgtaactaattgactaactaactttagagccaagtggagaagacaattcgtgtgagtttccacggcccatgctttcgacttttgagtgaaaacaaatatttttgcattgttaaaagacaactcaaaaatatctcgttgttattagtttgttacaaatactacaatggcataacagttttcgtaatataagttttccttcgacatcattttcttatttcctttaaattatgatggaagaagattacgacatcaaaagctagagaaaaacattatgagatgatgaagtttgttgcaacggctaaaaacagaacattacaacttaggcctttcataaaacatatgggcttttatggcccattaaaaatcgggcttagtggacttatttcagtctcatatatatattttgagtggcgcatcagtctcatcttcctccatggctctaaacaactttttgactttccaactactccttcttctacttcgtgtttcatcggaatctccatggatcgtcgccggagatgtgtctcgaatcccgatcaatttcctcgaattagcaaagagcccggaggttttcgattcaatggtgagaatcagaaggaaaatccacgagaatcctgagctgggatacgaggaattcgaaactagtaagttcattaggtcggagcttgaccttatcggagttaagtataggtttccggtagctatcaccggtattatcggatatatcggtaccggagaaccaccattcgtcgctctaagagcagatatggatgctttgcctattcaggtctagtaccaattcacagaactctcatcgattagttacatttaggtctatggttcagaaatttggattaaggattagaacataatttgatttgataattgaattcaggaagctgttgagtgggagcacaagagcaaaaatcctggaaaaatgcatgcttgtggacatgatggtcatgttgctatgcttcttggtgctgctaagatacttcaacaacatcgccaacatttgcaggtctatgcatatttcccttttatactactttcatcagtaacattggtctaacacatttttttgtttttgtttagggaactgtggtgcttatctttcagccagctgaggaaggtttgagtggagcaaagatgatgagagaagaaggagcgttgaagaacgttgaagctatttttggtatacatctttccccccggactccctttgggaaagctgcttcacttgcaggttcatttatggctggagctggagctttcgaggctgtaatcactgggaaaggaggtcatgctgccatccctcagcatacaatagatcctgttgttgcagcttcaagcattgtcctcagtcttcaacacttggtttcacgtgaaactgacccttcggattcaaaggtttcattttttactctttgatgatttctctcctggtctatgcttaatttgtagtataacttattaaggtttcttctgtaggtggtcacagttactaaggttaatggaggcaacgcgttcaatgtcatccctgattcaatcaccataggaggaactcttcgagcctttaccgggtttactcagcttcaggagagaatcaaagaggtgatctgatcctttttgatttttttctctgtatgttattttaccatagaatcaacaaaccctggtttcaacttttgattctagattattacaaagcaagcagccgttcaccgatgcaatgcgtccgtgaatctagcacccaatggtaaccaaccgatgccaccaactgtgaacaacatggacttatacaagaaattcaagaaggtggttagggatttgttgggtcaagaagcttttgtggaagcagtgcctgaaatgggatccgaggacttctcatactttgcagaaacaatcccgggccatttctccctcttgggaatgcaagatgagacccaaggttatgcgtcgtctcattcaccacactatagaatcaacgaggatgttcttccttacggagctgctatccatgcaacgatggcagtacagtacctcaaagataaggcttctaaaggttctgtctcaggctttcatgacgaactctaatccctgtcaaccttggtacagtttcctcatcggtcattggttcgaattcagaagtaccaaatttacactccattgttgatagaattccatttaaatgatgaaaagccttaattcgtagaacaatttcaattgggaaattctcaacttttatgatatgtttgtgtaactgtaacatactggcataatcttagaacatgaattataattaataggctagtcttgttgtaatgcattggcaaaaccacaccttttatgtttatattgatcagaatcggagattttaagcatcaatttacattctttggaaggaaagaaactcaagattgcataatgcttcatcaagaccagcctctgctttaatactttaaatcatgaacttcattcggtgtcgccttgacccgctatcgagagaccaacgaattgtgcctccaaacgtctcctatctagctacttagtttggagtgttccaaccttaatgtgttctagttgtattctccttttgttgttgttgttatagttgtcctttgacgtcgtcatttgcttgtttcctttaatcttgatggaagaagattacgacatcaaagctagagaaacaaaaaaaaactcaaaagaaaacaaaacattatgtgatgatgaagtttgttgcaacggctaaacagagcatatactgtttagacctttcatcaacaatatgggctttttggcccattaaaaatcgggctttgtggacttgtttcagtctcatatatatatatgagttaaatcagaaattggttgtcatcttcctccatg

SEQ ID NO: 22095 - DNA, 3003 bp, Unknown
  misc_feature (1)..( 3003): 2750-1469P.txt file - cDNA_ID_2046005; gDNA_ID_1620403; Annot_ID_156018
tttagagaaataaattacttaaaaacatgaagccatttgagattctccttgtcttcctcgttcataaggtgagtgtaagctccagccttgtgcaatgctacaatacattaatgttaattcatcaatcaaattatgttactaattaagtgtttagttagttaatagttttattgtgcttacgataaaaggaatggtatcggatgatgaatagtcccggggatggtaaggtgcttccattctccttggccacctatttaaccatataataatcgttttgtgaatcatgtaatcataattaatgattatagttgataaactatagaaaggaattaaagaatttaccagatacatgtagtcatcatgtccccatgacataagaacattttcaagtccacagccttcagaataaattccagctttggtattgtacttagggttgttaaaatcagggttttccataaaatactacaatcatggttgaaaaggaaaaaaatatattatagaaatcacttgtttggtaaatattaatcaactaggttctaactatcaatattttgaggatgtcaaaaaaagaactatcaatactttgagtaactagcaaaatatattgagttatatgtaccttgtggtgtacgttagattcatcaaatgcacacccaacaggaaatgtgtcacctaaacggatagagaattcataaatcacttacttaaaattgataagtttactacttagtaaatcaggattaattaatgaaagaaatcaaagattaaacttaccaacaacagcccattgaggaagccctccaaactgtggtagggtaagaaccttcccaagatctggaagttcagtcatttttagtatttttaggattcttataatatgataattttgattcttataagcatgagtttttgtcataaataacaattaattaccatggataagcgcagtgagatgaagccaatcttcgttaggataatctttacggattgcttccgcagattgaagcaaatgttgaatttgtggttcgtcgaggtcgggatcactctcgtccaccacttcttttgaaagttcacaacattcccaaatgttcatcaccatcttgtccaattttccatactcacttctcattttctgtacctgcaaacgtatcataagttagtaacaatatattttataacagatgagaaacaacaatatgtatcgtatgttcatttcggctaacatcgttaggaaagatttttattttcattagtaattcataaatcacgtccatgcaaaaataataggactcaactataatgttgatcacacaatctaataaaccctaaaccatataagatatataagagatcttacaaagtctaaagtttggttagtgtgttgtgttgcatagaaatgttcgacgctcttttgcctctcgctgtttgtatccgtgtagtctctgcaataatttacatcaataaaatcttaaatgttttggaaaacattttagaaatcgtctaaattatttcttgagaaaaaaggaacctgaattgacgaccaaatgcgttcatctcaggagccaaaaacacttcatcatcggatgatatcttcgacattggtatgtcgctgtccaatcgtaactctccggtcttctgcgttgtcgagtcctcatgtacttaaacaaaacaaaaaagaaacaaaaaaacttctatttttacgaaatctcaagataaaatttatagaagaaaaaaaactacaaagaaaagaataacaaaggaagatagatagatgttttaccaaaaacagggttttcgacggagatattcatcttccaaaaaaaaacaaagtaaaaaagaagatgagttatgaaaactaaagatcgagagagaatgtctacgaaaagatgtaatttgatggagacacaaaaagggtatttgtagtggtgatggtttaggagacgataggtactttcctctatatttagagagaaatccaaatcttttgaccacgaaaaataaactttgtccaagaaaataaaaactgtggcatgataaagatctcttaacatttatatacaagagttaatttttttgttttcgttttttttagtttatttactctactgcgtttgtttatgttttgaaatataccaaacatcctaaatccttaaatttactctcttcttgattggtcaactttttggcatattttcttccttttaagatttaggaagacatgtgtcatgttctaaaatagatatagtagactattaacatctatgtgatattcttatgaattatcatagacacatatgtccaagagagttaattatacttagattctccattttcttattcaaaaaaaaaaagattctccattttcttacctttttatcagtgtttttcactttccccccatttttcatatttataacattcacacttattagtttctcccccatttatgctatttacagtatattctccttcaaattttggagtattgtggattttgaacatgtgtaaattgtaataaattggttgtctttttacgttttttttctttttcttttgattatgttcgtaactaattgactaactaactttagagccaagtggagaagacaattcgtgtgagtttccacggcccatgctttcgacttttgagtgaaaacaaatatttttgcattgttaaaagacaactcaaaaatatctcgttgttattagtttgttacaaatactacaatggcataacagttttcgtaatataagttttccttcgacatcattttcttatttcctttaaattatgatggaagaagattacgacatcaaaagctagagaaaaacattatgagatgatgaagtttgttgcaacggctaaaaacagaacattacaacttaggcctttcataaaacatatgggcttttatggcccattaaaaatcgggcttagtggacttatttcagtctcatatatatattttgagtggcgcatcagtctcatcttcctccatg

SEQ ID NO: 22096 - DNA, 3003 bp, Unknown
  misc_feature (1)..( 3003): 2750-1469P.txt file - cDNA_ID_2046013; gDNA_ID_1620403; Annot_ID_156016
gacaatacgagatctaccaaaattaataaaaggtaaaagaatgaaattgataagatgagttgatgtcattaatatgcatatatgcgtgataaaagaacacatagacaatttcaaaacatgacaataataaagaagaagtacaaacaaatatcaagattaccagatctgcgtgagatcgattggatagggaaaatgtaagaggaagaagaatttgataaagacgggagtgatctcaatatatatagtagagaaaaataataacttgtgatttatgctttttaagtattataattattgttattaatatctctctttgtttccagaagagacacagaaacacatgtagatacgactttaagtactgaaaaatctatgtcaagtagataaagaaatgaagaagaaatgaggaagacgaagagtaaaggaaataaaaggagttgagactgaaaaggttaaaaaccctaattttactctctcttgtcttgtgcgactcatcttcagtctatcgaccaaaccttttatttatttcctttttgttttatctatctattttatttattattattagtgtattcgtattctaaggtggtatgtattaatattataataggctttgtacatacaaaattagtattactcagctaaatgagacatatcagaccatgtcaactttttttgagcaatataaggaaattacgaattgtgagatatttataagttttagttggagtcaagctgtaaaaaatgtaaggctttctttttatcaaaaagataaaaatctaattttaaagattttatttaataatcttgtgctttaattaactgttgaatctcgctcttttgtttgaaataaatatttgtttgtacatccattttaatagtataaaacctggtaccttctctgaccttctgaatgtttttgaacataattacggattaatttaggagaagattatcaatatttttaaaataaagaacgcaggaaaagaacataggaaacaaagcatttaaggataatctctttggattatagggcaaacacatgtttttaagaatctttttcttttttgctttctttcacattatttgaaatatgtaacatattcttgtgggatttgaacccaatggtcctacactggtgtgggtccaatgatgatgtcgggagatggggcctagccgcagatttgtttgaacaacagatcaaacggtcatcatttatttgatctaaatgattatattaggttttgcattttttcttctcctttgaaaagatgaaaaacgaaaaaaggtcagaaatctactggagataagagtaccgtctgagactagaataaacatagatatcagctgaaaaaattgataagagtatgataatgtgcttattcagttttattattaaaaaaataaaaaaattagtctgctacgaaaacacaagtatacatactatagttgataagagcattatccatggtgtgtagtaagtaagtaaacaaaccattatatttggattaatcgagtattcagcaaatattcatattgtcttgttaatgattaagagcctagaagtctttaaaatatccatcaagattcaaacattatgactcaaactagtgtggtgttgtccattatactcgaaacgaaatggtattttttcaacttttgcttgtaaaacttagccagtgcatggcctttattaaatcaactattgggtcactgcatgacccatttatcaacctgtaactgaatattgggctttggcaaagatccaattagcttcattcgtatttcagaaatttgattttatatccgactgagtaggtacgtatatgcaatacgttatgtcctattagccttatgggactcacgggtacttatgcaggagatggattaatttcatatccatctgcaaactaaatacatttattttcttatggcaaaaagccaaaaactatgtaacgtttaatttacgaaaaaaaaaatatttaatatttgggttatatggatttttttttattttttttttttttttcgggacattagcgagagtcatagtattaaagaaacagtaaaaacaacgaccagatttaatgcaactttattactactttaattcagattcgagaattgacaggcaaatacgcattattttagtacattatgaagaatcatacagttacatatttcacatatatattgttttaaagatgtaaaacgactaagcaagtatgtcatctgatagcattatgaactaataactttttgtcaactctgattttcatttttaaaattattatatcttgttacctctttgtaaccagcaatagtttcttgacaacaaaagaatcggcaaatcaatgaaaacttattaaactaacacacaaaacataaaaaatagtgattagccgacacaacaaaattggatttgtctttctctctttaaaagattttcacccgaatattcctaaagatctgaaatactgaaaatatcacacaaaaaaatccaaaaagaaaaaaaatcattttaaaatttagaacttgtttttcaaggcccaaaattaatcgttgtcaataattggaaacttaaaaataaagtcttgttctagaagaatgtgaatcatcttctccaagtttcaaacgttggtttttttccccactgtgatcgtcagctttatatattatatacacgagaatcttgtacccaattaacatatacatacatgtaaatgtgtgtatgtatataatataaaattattctccttttcactaatttttcttcaaatactttaatgcccaccacctgttcgatcaaattccccatctcgaaaagctagaactttcttcgtctctattggtctctcactctctctcttacctcttctcatttgttctttctccttctaaattgggttatcaagtatattggatcaacgggtttgattcacgatttgtcatttcatcttcgtggagagagtttgatctgatttgttgatcgtcagcgttatg

SEQ ID NO: 22097 - DNA, 3003 bp, Unknown
  misc_feature (1)..( 3003): 2750-1469P.txt file - cDNA_ID_2046032; gDNA_ID_1620403; Annot_ID_156011
tggattttgaaactctgtctcatgatctcgttgttcttcagtttgcaaactatgaattcacaggcactgtaaccgaaatctgaaagaaatgtagcaatagcaagaaaaagcaaaatttgttcctgaatagtttggtctagaaattgtgacaccgtctaacgattttgtctttcttcctgcagtggaatcgttgtacagacattctatctgaaaacttgtctgatatcaattgtgtaaccacagtcttgtgatcttaatcatcctcactataatacacaaaaatctcaatctgcataaccaataatgaactctaaagctatggtaccacactgccattcattaaatatttcaactcgacacaaatgtagacaatactatattgttttagaaataatcatacaaccccaagatccatcacaaggtaggtaatacacagtcggattatcgaatagtttttctctcacgacacaactagaagattacataaagcaatatgaatatagtagcagcttaagtttcagagccccgattcaatcaggtactcaccgagattctccacaaccatattgcattgtccaggagtcattggttcatcatagataccaaataccaaagctaaggtggtcttcttgatggtaacaccaccagctccctacaatggaagcaaaatcaacaacagttcatcaaaaatcaaacaatattcaaacagtctagttaccttctttcctcgaatgacggcattaggctctccttggattaccatgtacttgttaccaccaaggaacaatcctgttggggcaagtgttccaggtgtagtaaaatcgtctttgatgccctgaatttcctcaggcttcacctaaaacaacaacaatacaaaaactataagagaaacaaattcagtctctcttaaacatctcatgaaagcaacttaataacttatgaacaacataaccagtacaaagaacttgtctatttccaaaggtcaaaactttcttcttaaaagagctttaaacttgtgattcgaacttcttctaatgcatcttttgcactctataacctcaagaacatatgaatcagaaaatcaaaaccaaacattgaaaattgctgaattttggtggtttagtagctaaacaaaaccaaaggttgcagatttcaacatagaaccaaaccagaaacagcaagatgataagaattgagtagtcggtatagaaataaaccctaacctgaggaaaattgttgctctgagcccagacgctaccgtcttggccgagaattgcggcggcggtgaggcggttgcctgcaacatcgcacattaagtgatcgtcgacgtaagtctgccacgacatgtttgttttcttcttcttctttacttttgctctgcttcttctttgtggtttatcggaatgttctagagatagcgtcgaaactacgagtgagtgagtgtgtggcaatggcatttacgcaaatatattgttttatacatgattgacacgtgccagacacagctctttttaatagtttctaaagaggaaaattgtattagaaaatcaaccagttataatgaaaagggaggaaataaataaaaaaatagaaaacttatttaaggaaaaccaaaacatttaattaaatatggtcttttcctaaaaaaaaacaaatgtttcgattttcattataattgatttttgttatgaataaagatggatgtccattataaggccctcatctaaacccatcatctagatgtttttagggttttatcttttttttgtactcctatataaagaaccatttatctcaatggaataacacactcatttcttttatctctttctctggttataacacgttatcagcacgttctaaaaggtagatatagagattcttacattttttttaagaaccatgtttacttatcgactcatggttcatagtacttattttctattattgaaacaaaacaatatgagccgatcgatgattatagtatagatcggtaaaagcatgttttcaatgattcaataaagaagagaataatgcttatcatttgtttctataattactatcgcatgattcaatgattctacaaagaaaatcgttaaagaagagaatcatgcttgttaattgttaatttttgtgatttactattacaatattgaatatataaattaccaattttataattatataactaactttgtaactattcataacccggtggtgggtgatgcaagcatgtattaatgttttagcattccagttttgaatagttgcatctatattcaatatcattttataaatattatattgtctaaaatccatttatgattgatatgatatcccttatttaactcctttgattaaaacgttatacatatcttatcacttttagatattgacttttccatattaaatatttgattttcatatatttgattgtgttattattatttttactaaaaacatttcaagataatttttctttttataagattccatatatctaaatctttgtgttattattatctaaatctttttataagatttccatatatttgattgtgttattattatttttactaaaaacgttgcaagataatttttctttttataagattcttttctctaaatctttgtggtatctaaaaaaaaattgttcatggttttgtcgtaattttgcacgaaatcattttacccaaatcttgcacgaattcatattaccctaaataaaagttttgtcaagatatatgtaaaatccagattttgcacaaagtagttttattctgattggttttacaatattgcattaaaattatattaatatataatatttgattattttatgaaataaattgattgataaataacttaatttaaaggtataatcacttatagaaatttttatgaatgactattttaatgtatcttaaaaagatatcatatttttgatggtcaaagttttttcaagaacttaaattatcaccagaaattgagaaaataaatatg

SEQ ID NO: 22098 - DNA, 3003 bp, Unknown
  misc_feature (1)..( 3003): 2750-1469P.txt file - cDNA_ID_2046035; gDNA_ID_1620403; Annot_ID_156009
gtttttgagtttaattcatgaaaacagagctgttcatgtttgagtttaattcatgaaaaaaattactctcatatgttattctccttatcttttgatttggccttaatgaaatgtcatagtttgggagaaataagttttttaacttgactaagtctatttaatcacataaaccaaaaccttgtacattacataaaaaaggaagaacacaatgaaaaataaaatctcattcaacttttatagtcaagtaatagtctttagagacacattacacaatatcatgtatcttatcatatcatataccaaatgcaaatgcagaagaagagggcttacttatctaaggtagttaacaggtggttccagagtgccaacaagtatcccgagatcgatatccttgtcctcaaacttttttatgaatggatgactctgagaacatgaacaaacaaatcttagaatgtttcatcagagatactaataaccaagactgaaagagggtggtgagtaggaattacttaccaagaggtccaaagatgatgctcttgctggaggatctttttgtatgctgttatgaatgtaaagaagaatcatttaaccattagttttaattctttgtgtgccaatgccaagtatatgaagatgaaaataatgagttgccacttaccaggctgatacaaaggagcagaattcaggtgagaattgatcagaaggagcagttggtggtggattctctactattgctgccaagagttcataaaagcttggcgggttttgctgatcttcagattctaaataaggaaatcttcctattgcacattctaacactgacatccccaaactccaaatgtcactgctgtagtcatatgtgcttccactaatcctctcaggctgtgaagtgaaaaaagagacaagtcatgattatgtatgtatacaatacagaaacatcaagaaatttgtaatgtagatgatttttggaatgctttcgtaccgacatatagttgtaggttccaacaaatgtgtccctctgtcccatggagctagcaagacttgcacttacaccaaaatctgagattttcacttcccctttatggtttacaagaaggtttgatggcttaatgtctctgtgtatgacatgtctttcgttgtgtaggtacacaagacctagcaaaacctgttcacaaggaataatataagtaagagtgaccgataaatcataagaatgctttgaataagctggtggtgtatttgacctgtttacagacaacagcaaggtaaggttcaagaatagtcttgacttgtctaatcacatccgcaagagatccacggtccatgtattcaagcacaagcgaaaaggctccattgtgatagaaagaatggtagcaaactactacatgtggacattgtgatgatgcttggtttattttaagctcctgaacaatttgcttacggatttcttcttgtatattcatctgtatgacctgtgattcataacataagcaaactcaaaccccaagtctactcaaaggccttagtcactagcataaaatcaaaagaaagaaaaacaagtagtttaccttcatagcaaagaatttgccaacccatttatgacgaactaattgaacaacaccaccactgccttttccgatgactttgacagtctctaagtcttcagcagtaatttcgaaatcaagctccttgctatcagattgctataaatggaagataaaacacatacacaagaaatctcctttaattctctggaacattgaggtctctcataaaacaagatttagggttgaaaaatttacccttgattgcttctcatctgacgtcaaccttagccccttttgattcagaagaaaatctccatcgtgaaatgttccactcgcagtcctgttttcaaattcaatgaaatttcacagaatcaattcaaacccagaaacaatggatcaaatctaatcgattcttgtttacaatctcgccaaacaaaacagatccaagtaaagaaaggagaaatcgcgaaacttacaggaaggaagagattggggattcttgagctggaacggagagcttaagctgcttcaagttcgatttgatcttcaccattttttttctttggtttcttccttgggattatcgctctctttctagggtttctatctaaataagcaatttcaagaaagtgttaggaagtggagagaagacgacgaagcaatcaataacggactaatttattttgaacgcgtaagaccgggaaaagaaaaaattatacattaagaaaaacaagaattaaatcatttgggctgtaagatttaaatgggcttgaattgataaatataagatggtacggcccattgcttatctctggtatatttgacagctggcgctaagaaaagtcttaattgattttctctttttttggtatcggaaaacgttttgtgtaaattggataaacgaattatattacttttttttttcgatttgtcggtttgaaattaatatttttcccacactttaaatgtataagcaaattaatgtatttgatatcgaatttattaagagcgtataaagctcacaaattcaattcaatgggaccagtttaatttaaattatattggggtagttttcgagaataggcataaataacgggggagtaatgaaaaagttggaaatggtcacaaagcttagcggaatccagacaagtctatcaaatcgaatttattgtactgcctgaggcccggtttgtttccgaccagtgttcaacttctgacaagaaaaaaacaatagccaagaaaaaaaaactaaattagtttcccactctcgctgtagagagagagagagagagctttaacgaagcttttgttttttgtagagagagaaaaagcttcaaacttttttcactaaaagagagaattaactcgaagaagaagaagagctgccagaagataataaagcttccttctttcgagtaaaggaagcaaaagcaaagtgtgtagttactcagcaatg

SEQ ID NO: 22099 - DNA, 3000 bp, Unknown; identical to SEQ ID NO: 1441
  misc_feature (1)..( 3000): 2750-1469P.txt file - cDNA_ID_2046039; gDNA_ID_1620403; Annot_ID_156008

SEQ ID NO: 22100 - DNA, 3000 bp, Unknown; identical to SEQ ID NO: 1463
  misc_feature (1)..( 3000): 2750-1469P.txt file - cDNA_ID_2046125; gDNA_ID_1620405; Annot_ID_156072

SEQ ID NO: 22101 - DNA, 3003 bp, Unknown
  misc_feature (1)..( 3003): 2750-1469P.txt file - cDNA_ID_2046128; gDNA_ID_1620405; Annot_ID_156071
acatggatacatcaataaacaaaacaaatctatgtatgatatataatagtttacggtccatctattggtcccattgactaattcacaacttatttgattcatattttatatatacatgtcacaacccatatcacaaaagattccagaaacacaaatatttttaattcttataaataatattatctaaattaccacttcctaactggataatgcatatctaataataatgatttctaaatggataatatatagttgcatacaaatatatattttcaagcactcttggcaggggaaataaataccagtatgtgcaagcttaattataccaaaatagtaggttattccttagtggattggtaaaactaaaacaacatgacatttattaacatatagctaggttagtccatatttaaccaaaaattcatagatgacaaaatatattagatttaaatattatgatgtgaacaagatatgtaatatattgatttgcaccagtttggtgagttatcatctaggttcaaactcgtataatacgaactttttgacccaaaaaaaaaaaactcgtataatacattttgatgaccaaagaaaataatctatatggcatataaaaatattttaggaaaatagtatgatagtatagacgtgtgatctctaaaacaaaagtgggataattaacaaagacttagaagagagtgacatacatttttatttttcaacattcaaatctatgatcttttcttttaaaaagggaataggagatttaagaaaatatagaaagaaggtcataaaagaaaattaaaatataactaaattatagtaaaatggacgtatctgttagaaaaatagacaaaatagtctttcatataatgtcaaatggaagttatgaaccaatggtttatataagaagagggatataaatgacacagaaataataaactagtaaaagaatggtttggacattattggatatgaacaagaagaacaaataaactaagagaaaataggcaaaaaaaaaacatcgaattttttgtctgtcattcaaataggtttaactacgacaacaagtgaatattttttgggtgggtctagtcgaatattctaaccactacatagattgggaaagctaaactaagaagcctaagaccaagcagaaccggttacagagtagctaaaccgcaaggactgaaaccggttaatgaagccgagccacattggtatggtacagctttcgttttcgctgacttcacaaaactaatcattatacctaactcatcacagtttatttatttataagaaaagagaaaccgaaattaagaatggaccaatggatttctgttgggataatggctttaaccgggaaccggaaaacccggtgagctcaccaccacccacagtaacagtaaccaagaaaaacaattgtcttcccaatgcacctgccacgtgtatagagacagtacagaagtgtcaccacgtttcgactttctgttgtttaaatgacttgaataccctccgttatgacactattttactgtttgaaggaaacgcaagattgatgaaacggcgttttaatgggttggcagcgtttggttgaaccacctaacaaccaccactttccttcacacttatagttcctttttttttatttttttattttattttctgttgggaatctattttttctttatttttttattaagcatttggtcttaaacaattataaaaataaagctgattggtacaagtattaaaaaggaaaaaaggctgactgataatggagttgattagctacagctatagattaataatagctgaaaccttttatttaatatttgtttactggaaaatagtggttgtaaatttcaaacaaataaaatgtacatctttttaaatttagaacaaatataacaaaagtaaacattagtttgttagaaatttttaaaaatataaaaatatttaatttttgattagactattcactttttctttaaataagatatattttaatatgattggattatactttgcttaaaatcttgggatgtttatgaaatgacttaaaaattcttaaaatagatcatgaccgcaccaatcgcagcaaaacggtaggagcgttcattagacacctaattggctaattgatatggcttgtgaagaatttgggaaccttcccgatattcaccaatatttaattataatttgttgttttctttagaattttaattaggaacggcttttgtgttaaaattacggtggccactaaagcatacacgttttggagtataaaactataaattatacattcataacaattttttccggttttccaagtttcttcctctctcggtcctcttttagcatctctacagtttctctctcctctaccgccggaaaaaaaaaacgatttctccggccggttttggtttctccgttccgttaatagccttcgttttctcgtccttggaatcgtcctctggttgatttctgaatgttcgtttgactcggctacgcggcgattcggatctccgtgtttgactcggtccctggctcgttacgcggcgttttcgtagaatgtggtttactttgtttgcatgccaggctttgtattgaattcgtggggcgagatcgtgatctagggtttcgtctctgttcttttggttcgttgcttgttgtggtcgctttttgtttcttaatccggctgaagaaaacgaaagtctacagagataatagattacggaatgatatggtgagatgatttcccctctctgattttagtcaattttgttgtttaacgattttggaattctcgtgaatttttgttgttaacgattttgttggatcagatctctaacattgctcgatttttttagagtttctgctattttttttcttgaattggttactcttttttttactctgcttcgttgtttgatccttctctatggagaatctcacgttttgttgctatttttgtgaacttgagatttgagctctgttgaaatg

SEQ ID NO: 22102 - DNA, 52 bp, Unknown; identical to SEQ ID NO: 1457
  misc_feature (1)..( 52): 2750-1469P.txt file - cDNA_ID_2046139; gDNA_ID_1620405; Annot_ID_156066

SEQ ID NO: 22103 - DNA, 3003 bp, Unknown
  misc_feature (1)..( 3003): 2750-1469P.txt file - cDNA_ID_2046231; gDNA_ID_1620412; Annot_ID_156283
gctaaattatatttacatgcgaaatgataagcatgaagattttgtttaggtgacatatttgctaacatctctttaaaatgtatattaaaaaaaacataaaatattttgggcataaaacttaatgtggaattttattagttgtctcatttaatatgtttatttaatatatctgtatttgtggtattataatgaataagacattaaatatgaataaaaattccaaaataatatttgcacgtttatgatagaaataataaaagtctatttaataacttgaaaagaaatgacatgtagaaactgatttcaaatgttaaatacttatatggatactggatacatcatccaaaacatttttcaactaattttaataaataatataaaaatacttttaccatttccttacataccaacttaataattttcagacaattaatcatgacgaacacattgaccgttacatcatatgaatgataaaacaaaaatagtggtttctgttttggttttcctattactaattgttggaaaccacttcaattatacgcgttacgtagtttgatacattgaatatatggtacaatatacattaaatttattttcgaaaaatatgaatgtgatacatacctacaaagtttggcaaatacaaaaatggtccccaacgttactctcccccacctcaaagctgttcatatcgcccttcaaagattgtgaaaatcaaacccttatcctcttaaaacccttaaaatgttttcttctaaagaaaaagttgctttcttatttttatttttattttgaattctggttttggcgcatacatattagcgaaaattagagaaaaaattcctgtatatgcaaaaaaattaacgtttttttcctacaaaatttagtataaaaatcaataaatatattaaaattatcacacaagaattaactttgaatttcttttccagattagcttttaatatattttgctttgtaataaagaacatactgtattgaaatatgttctactattaactaatatgaagattaccggtaaagaattactaatgtttcatctacattaatttttgtgtgcccataatttcaaaattttgcctagagtgggatcaataattttggtgaagattgaagaaaaaaactaaaatttggggacaacattacaaaagagcattcagtatttggaaagcttaggaccatggtgatttagaagcgccacgggcgtgatgcatactgcatcttcggcggacatcaaggcttttgaaacctttttctaattttgttatctatataattcacatcaaatagaattagtgaactaatgtttacaaaattaggtaaaacataaattatatgtatgaattaacaaactattagtttaaaagtaacatatagtcttatttttttgaaacaaaaagatttactttaataatatatttttttttttttgtgtgtggatccagaagaattgtgaagaaaaaaaattcttctaaactgcatactagtcacaccctttactttcgcgtaaattcagatagttcggctgaaaaaaattggttaaccctcaaaaaccgtcatgttaattaggtttgcacaatccattaacattaggggatgccaagtagtatcacattagtacttcaagtcctcgatgaagtgttgataggcttttgctttgtttccttaatcgtaacataaatgtcttcatgtccttaggatatatacaaacctatccttgcccaattgattattcatctgcattccaaactaaacacaatgcttcttcatgtaccattcatatcagttgggtcacactccaaacatttaattttctttcatttccatataaaaatacataatccgtgaatagttgaacttctctatatttgacttgagaagttaaatagagaaattaacaactataccagttagtacagttggtaattaccaatagatattcaaaaattagggagagaattcaatgatttgggttagtaaggtggaataatcaatatatgtctacgtctagataaggtaacatatgttttattaataataactcgagatctatataattaaaacgcccctaaatcctaatccatcattaatgtcaaatatttgaagattgaaccaaattctcaaaaagtgttaaaaactatttgcaacaagagagagcagttgggttgtgttgtgttgtgttgtgttgggttgtgttgtggtctctttgtaattttacacatcaaaagcaacgcaaagctttacactttcctttctcctttctctttcactgcaaatttctcctacccttaaaaatcgaaacttcaagagaagaaattgaggaatcaaaaattccctagattcgagggttcttctctcacttgttctatcttcctgcttcatcggaatcgtttgatttgtgttctttacattttctccgactcaacttatggtctgaattttacctagtaagtacatttgtctactttctgtttattctttcgaaatcgatgctttatctggaattgatcatgttattgagtttggcttgggttaactaatcatggggaattctcaaaatttgttttttttttggattatgtgtttgattttgggaatatactgttagggtttggctagtgtgatgaagtttctgaaactggtgatagtaaaggtgtaaactttatgctcattttaggttaaattctctgtatcaataaggcactaggcatttagtttaacaattcaatgctcagaattttgatttgagtattttgttagagttcaagtgtttagtttagcttatcgtagtctcttttggtatttgaggtcactattggctcatatatgttatcttgttgtaggtgcaaggcattagagaaattggtacagtcgtgtgacatgtgaagattgttgttgtacatatagctgaaggaactctttgctgatttttacataaaagagtgtatcttgatatttggtttgcgatcgagttaagtggaagcgatg

SEQ ID NO: 22104 - DNA, 3003 bp, Unknown
  misc_feature (1)..( 3003): 2750-1469P.txt file - cDNA_ID_2046235; gDNA_ID_1620412; Annot_ID_156282
agtcaataaattttttattatataaagcttggtttttaaagtttagtaatttataagattgtgtcacatgtcaactttagtgatctcatataattttgacattgataaaccaaaatatctttctattaattttaaaaatataaaacataattataaaaatttataattttaaacaatttaaaaatgtaaacaaatatttacaaggaaactatacttatatatcatacgtaaaacaatttaaaaaatgtaaaatggataattataaagaaacaatctgtattttattatataaaaacagaaattattatatcatttacttattctgacttaagtttaaaaagattactttttccttcaaaattaaaaagagatttaagaaattatacaattaattaataaaatactactataattaaggtaattatacagtaaagtattaatcttagaaaaatggtgaggtagctgagtatctttcgcaacagttcttctaagtagttagcaatttttttaccacaaacaaaactagttgtgcctaaaaaacatttttttctcctccgttagatcttcagtccgatctctgccatacctgtacctagctcaagatgtgagagcccatttatttacaggctttaacccatttgtttaacacaattgccgaatcaaataactattgttttgttttgaggtcgactaaaacaaagtaattagtgagttacaaaaataacagaactgcactaaacgaccataattttaaatggattaagtatatgaactttttagtttacagtatacactaaatgacataaatttagaaaggacccatgacttgtagtggtgagtctatgtaacacaacttgaaattaaattggtatataacatactgttcacagaatttttttgaaggctattcaaactctaacaacaacgacattaaagatgatattgttatgttatattaaactatatatatttcatcttggattccatttaacaaaagacatgagtttagaagaaataatatgaatttcgaaggaagaacatcatatatcttaatacaagtttatagccattatgttcatgaagggtggatgagtgaaactccatggaatttacaaaaataaaaatttcatcattctacccttaaaagaaaatcttgtggatctaccactttgagaaagttaaactgaaattataggtatgttttggtagtcgtctaaaaaacttgtccataatatgttgtggtcaatcaaaaggtggccattaaaatctaccaaacatatcatttatggactagttcttgggggtttagctttgatggacaaattttagtgaacaagtggtaatataccaaaacatattatggacaaatttttgatgaattaactaaaaaataccaattttagtactattttgtagaaatggcaggtccataaaattttaaaagagaagatagaatgagtaaaatatccttagaaaatctaagtctaacaacaacaaaagtttcttaaacaacatcaaagaaaatttagtacaaaagtttcttaaacaacatcaaagaaaatttagagcccatgttctagtggtgattgagaattgaagaaaggttgaaaggaactaatccatgtttggtccaccctcgaaacaaaaaaaattatatttgtgtgagatgtctgggtttgagccaaatacctaaacatcttatctggtagtcactaatatatgatctggtcgaaaaatagtccaaattcagaacaaacagtgtagtggcccttttgaaaaaaatgtactttaaagcacttcttttttatctgtgttaatcggaccagctaataagattaattttaaaaaaaaacacaaattatcatacgaatttattcgtgtgttttgcaatatatattttcgaaaacttgaggatacttggatcatatatagaagcatgacgacgaaaataacacaatatgtacaatttgatacaagaaaatgataataaaatttacaaaacaatttgccaaataacatgttagttagagtatagcacccatccaattaaatagcttttgcaaatgacataagtttctaaaatatccacttaattaattttcttttcttacgttttttacatcctaactaacactagtatactcaattaatttttcgtaacattggttacatacctaactaactagctctagaaaatatattaaaatcgggacaagtcaaccattagacatgtgtaagctgaaccaaatcgagtcatttattttcccagtaacccactctcaccaagaccagaaaaaaagcgtagatccagaggcgacaatattcaaacacacaaaaagtcatcaatatatataaataaataaaagaaaatacaattcctcttcatataattcatattttcatgttacgaaaacaaaaaagatcaccgacacataaaactaaaccaaatatttcaatgaaaaattaattaacgactttgacgctttatttctctttctctcttcactctctcattatatctctttcgctgccgcttttgttactttttgttcgttcgaatcccaatatagaccaacgaagaagaagacgaagaagcagtctctcaaacttcttctccagatccgaatctcactctcatttctccgatctctctatttgaatgacctacaatttcgcatctcttttgatcttgatctctgtttctctccttctactggtaagtgatttccttaatccgtttctctgattttcttattccttcctttaaccttgtatctgaagcttcctccggaactaggtttacgatttgtttaattttggaattcgatatcgatattttgttgtgcgttaattgtgtgtttttatcgtagctttgtttctctgtttatcagatccattgataagaagctttttagattgttaatggcataagcacgatatgtttgtttgttttgtagaatctcttgttttgagtaatcactaatatacacaacggcggcgatg

SEQ ID NO: 22105 - DNA, 3003 bp, Unknown
  misc_feature (1)..( 3003): 2750-1469P.txt file - cDNA_ID_2046241; gDNA_ID_1620414; Annot_ID_156379
tgatgtttataataggaattagggtttctggtttgtgtttgccattttagctactggtgagattttgttctggagttagagtttcataagttccaccaatacgttaatgcttcattaacattactatgaattagttttattttgtgattcttgagatgccaaaattgctaatacgagaacaccttcaaacgtttggtattgatgaatgaatactgatagagttgatgcacatagatgtcatcattgtgaatatccatggttgccatttctctgtagctttgatggtaatgattatactacaattgcatgattaaaaatatgctttagaattagtttttttgagaaccttgagatgccaaagttttaacatgagaaaactgccaaacattttgttggttgaattgagtgttagctttgtgaagaaccgtagcagcattttctatgtagctttaaacgtataggatactgacattggcattgactgttagatttgatctctctttttctacaggcgaagtcttttcatgactctctggatagaaggatctctactcttgaaagcttgagacaaagtgaagctcctcagcttgctgagacaactgaatagtaatctgtctcgacattgaacactctctgcttggcaatgatgttttgagttgagatgctcttttttcggttttatgaataacttggaagttcttgtatgactctactgttataaaacaatgaagtttaaggtagtcgacaatggattgaaacttgctgtaacacttgccatgaacttgtgttcgatcaattattttggatctaacattagtagaatcttgttcttcagaaagatgaacttttgtctagaccatcttcaaagctagggatctagatacatctttctgaacagaagatgcaacagttatggtgaagataagcaaatgccattgactgtaccaagaacaatttgatatctcatgattaggtctaggccggcccaaggagcccagtgtcctaatatgggcttcttggtgggttggaagttcaatatctctaagactctcacgggtctggaattttatggttttgcatgtaaaattacaacttcaaaaataattgcaaaagatcaagatatatagtcatgctagtatcttactattgcaccatttagattcaatgtatgttattgacaagagaaattggcaaacaaacgaaaaaaacctagctattggcaaatgtaacaacaataacatgtttttcttgcaatgtcatttctcaattgaaaagatcttagagttaatatatctaccattcccgttatcactttaagaagaaaaataatctagtttcacataattaaagaaacacaataaatggggaaaagaaagaaggaatcataatggaaagacatgtcgagagcacatggtgtttgtatggggacagattccaatgtaagaaagaaaattaaataaagtggaaacaataatatgaagaaaaaaagagagtgatgcatttgtctccttggcggtggtatggtggcttcactatcacccgacacctcctcaaatttggaatacacctaatcaatcatgattatattacacacacatttcgttatgtagatacgacactcaatcacggatcattttgttgttccatcattttcctctttattagtataaacatcaaaaaacattttcgaaaacgtaaatgttggatgagactttgtgatcgcatccaaaccacttaattatttaaaattgtaacgatttttgttattttctacatatgagatttttttactatagatagataggttagtgtcacaaaggtagcaattggtttgatggatatttttacttctatagtttttgtcagactccaatgaacttactcatatgtcacttttaattggatgtgaaagaagatagagcatcaatattgaaatggcaatagactgagaagtcagaataattttttgaaaataaaggacaataagagagtgtccacatcaacttttaccatcttattttgtctggtggcttctgcttctttggatttaaaccttgagacaaatagaaagacgttcttcacttggctacctaacaacttcactttctgtgctcttgtcacaatcttaacccatttttccttacatctaacgtatatcattgattccttttgagaatttccatgttcaagacaatgagagaatatatttacgcaatttgatccaaacggtttaatttgtttattagtttgttacactttgtgtaaactatgatattaaggtaaggatgttggccttggatcagttcatgatgttttttagattaccaaaaacgttttagacttttgaccataactcttttgtaagacagaccatccctagtacactaatcaaccttgatttggccatgggatctacgagtcggtttgcggttaatatgtcaacaacgacaaaaacaactgatggatatgagatatgacggtttggtcatagctaggccggtccttggaaggctctttagggactgagccatgtcctgatttttactattacatagtaacattgccatattaaactctacatcaatccacaaactagattcatagaaaacatcccccaccgttagatcgttacatcccctaagtgatatgatattgatctacaagatgggtctgtcttttaaggattgatccaaatgtcggaagcatggaagcatagtataggacaatcttggcggcaacccatcactactccatatcctttgtatccacccaaatctctctccctctctctctatatatgttacattagtatgatatgaaagtaaaggcaagcaacgttttactcattatcttctcaccaaatttatagcccacaacggatcttttactttctttcttttgaaataagtcacatgttcttcagtctcttctcatgataatataaagggcaaaagaaaaatctcacaatctttacaagagtttttaaaatctctaaccttcatg

SEQ ID NO: 22106 - DNA, 3003 bp, Unknown
  misc_feature (1)..( 3003): 2750-1469P.txt file - cDNA_ID_2046255; gDNA_ID_1620414; Annot_ID_156375
tcttgattattcattaaattctattagattttgtgtcaatggtgatactattatttgaggaattgttatggaaaagttattgaattgtttgtttttatcatatcatttatcaaacgaaaacttgaggaaaacttaggaatgtttgtcacatcatttagttattaatattttttaaaaaattcaatgttgttatcattgttatgtttttagtaaattatgaatactttagtctattgtaaatataattaaattttcattagtttaattttaaactagttatgttgaaaatcaaaaagattaagtagaacctctgagcgtgtttattcatttttggaagtctttagagatctactgtatgtatcttattgaacaaatatcaaaataaatgactagtaaattataaggaaatgtagaaaaatatagttaatagattttaaaatataactaattctattacagatagcatattatagatatgtgtagtgtttccatatatagcaagttagcatgatataggaaaagatcttaccaaaatttcaaagctactagataagatcatattagctaaaataaaataagaaatatagcataatttatttaatggaatgatttataaagagtgatgtgtaagtgttttattgatttattacatatcttataattccatctccttagatctcttcccaaagaaacaaaagcatatagagttatgacacttggtctactcagccttgtttttggagaaatctttttgcatattatattatatatacttaagaagtttcataagaaactacaccaaaaaacaaaagtattcttgatagctatctagatctcatatacaatgtctttacaatttttgacgctcatctttctcctttctgctgctgtgatctatcacatccccgtcgtgacttgcgaaccatggtgctcggcgatgccttcttccacacctgagcagttacaagccaacattcagcttgcttgcagtcgtgtggattgtacaccgatccaacccggtggattttgctattaccctaatactttactagaccatgcttcgtttgtcatgaactcttactacaagagtcaaggtcgcacttatgctgcttgtagcttcggcaatactggttaccttatttattccgacccaagtactggcacatgtgaattttaaatttaatcgaaaaaaacatagaaatcttcagcatacttatacatttttattttgttttaataatgggtttctgtttcggactcttgtatttccaaactaaaataaatgaaatagacgttatttaataatttattctgaagtttcaatgttcttagtgatgacgtcttttactttctagtactattgttgtggttcaagatcaggttgttttttgactcgttatagtattcaaaattggagacttcaaaaacttagatttgttacaaatagtgccttatatatgtaagtcttgtcaccaattataattacttacaaaaagcctttggagttaatcgttactaaggtgtagagtgcttgtgttaatattatcttacacctgacttgttaataatttcaaaataaacttccaactgattcacgaagctatatatggagatgagtttttttttttttcttatgtatctacacaaatcatcatttatctagtaaattcaactcatcatgtaaactcttttagatgtaacgtaggagatgttgtttaatggtttgtacgtactttagtggattcgggttacaaacaaattttctgacaaaggaaagtacacgcatgagatgtattcaaagaggggatgatcaaaagatatataagtgatggttgaagaaaaagatagtataacgaaatgaaccaactgcctagatttgtaaccgcatgcaaaaaaaaaaagagtcattgatttgtatgtttacatacacaaacatagaaaatgatcagagttcttaattattcattaaattctattagatttcgtgtctaaatggggatacttaacttgaggaattgctcccacaaaaaaaacaaaaaaacttgaggaattgttgaggaaatcttaagatattattttttgtcatatcatttaccaaatgaaaacttcagaaatattagccacatcatttagttattaatatttttaatttttttaaatggtattattattgttatgtttttagtaaattacgaatacttgaatattgtaaatcaaaattttcattaaattttttattagtttgggagatatatacttataaaacctttggccttatcaacataaacttttgaccaaataaaagtttaaaatattccagttcaattaactttgcccaaaaataagtttaaatgatctaagagttggaaaaaaattggaagtaaaaaacttattaatggtttgctaaaatagtttttaccaaagcgagattaaaaggttaaactcgatctcctacgtttgctaaaactcagcccaataggcccgtacactaattcggtttgggtccaatgataaaatcaatatttcttaaaccataaattgatctaatttggtttaatttagacttaaacaaatctttaacaaatcaaaccgaaactaaacccaaaccgaaactaaacccaaaccgaaactaaacccaaaccggattaaatgggtcaaagaaaactcagcccaataggcccaacagaacctgaaacgtcatcttcactctcacgagtaaagaaatttgctaaactgattgattctgtaatttcagcgagtcgtctcgtctagctctcacttttgttcgtctcttctgcgtcaaacatttccaccattttcgtttcttaaacctttcttcagctcttctcttcgtcaatcgtgggttctttcatcatctctgtaaattttctgggttacaatactttagggttttttcttgactcacatttccgataaaccctagttttttttttcagtgcgatagtggaattgaagtctcttcggtgagtttctttactaatg

SEQ ID NO: 22107 - DNA, 3000 bp, Unknown; identical to SEQ ID NO: 1539
  misc_feature (1)..( 3000): 2750-1469P.txt file - cDNA_ID_2046272; gDNA_ID_1620414; Annot_ID_156369

SEQ ID NO: 22108 - DNA, 3003 bp, Unknown
  misc_feature (1)..( 3003): 2750-1469P.txt file - cDNA_ID_2046276; gDNA_ID_1620414; Annot_ID_156367
atctctcacaatgctaatatcaatataaatacgatagaaaatgaaaatgacatgttttattcttcaataactggtgtgtaaaaaagtatcgtatgaaaataactgaaagtgccattttataccaaatcatagttgcttggtgcgtatcgtttggcataaagtgaactataatttagatgtgaaggtccaatattcccaagaggcgaagacaaaaattgggtagacttaaaagagtcaattgatcaaacatgaactgaacttgggtaagatcatactttcaatcattagaaaggatccaccgagaggtctagctatgaagataggcatggtcaagctgagaaggttaggacgtaattagtaaatcttggttatagatagatagtcatatggttgatcttgctttctcacacttaacaccatcagttgaatccaatgttaaaaataggtaattctcagatgcagtacctcataaatgttgtaaaaaagtcataaataattattcaaaggaatgcatggaagaagtgaattacatatttttaaaaaaaatataggaaaagaaaagtaaagttcgtacaaaagagagtagtattattctctttttcttctccatagggcctcgtaatatctacttagcatacgaggacacattaatattcgatcatgtatatatatgcctacgactacgagacattcgaaagttattgtctagtggtttgtattcacacaatttccgtgttaacagttttagttccatttccttcatatagagatctaaatgatactactacatatcatttagtttaaggaaggacgatgtaagaaaataaaaatctaatatacgagagaattgtaacacgttcacttcataactagctagctagtggtacttaccagttactaccccaactctagtcaacactacattaaatactataatgtgaacaaaattattttgaaccaacggctgttacagtagtttattcaactttatcaaccaatgcattaaattgaacatatttctggccgattgaaataggttgggaacgatcttataaaattcagtcttaaacaagtcttggttttcaaaaatgcaaattcattcgtatgttcttggcaaaaaatggtttaattggtttgatctgatcttatcctatcacgcaggattggtgtaatataacgcaccaaattcggccaggaaacgtccgaatataatagtccaattctacttatgaatttgacgtgttgacgtaaagaatcaaaagtcgaacttattgaataatttattcgactttaattttcttttggggttttggtatgtttgtgaccacatggtatggagttgacatttaccattttcttgattgactacctaagaaaattttaattattattcacattatggagagttatgtttccatattttggctttaatattaatcatgtggtcaataaaataaagaggatagttatggcataagattgtccataatgtcatcatcttgtttagtaaaagacagtcacatgaaccggaatctcggtttaccaaacttttcactttttcagtttcacatgaatgtcaccagattcattgagttaaacatgtattttaatactataaaaggttaattagttatgatatcatatttatgacttttaaaagacttttgatattgtaatctgtaactagttataagttaaccatctcttataattagaacaaaaaaaaacttaattatggatgaactgattttaatggaaaaaatatttagaaatagaaatacattcataatttatatctaagtctaaccaaaacacaaatctaaagttacgaataaatcatttcaagtgtaattttactaactatttgactcctaatcttatttcatcacctaaactcctaattgttatatatttatgagagataatgacatttgttcctctacatactaatctaatggttgaatagtcatgtgtttgacaaacttataaagtttgatttttcgtatgtgacatttagttatacatccataaattatataactttcttagtgagatatatgaaggttatatatgtggagtatattcttaataattaattgttaccctactttttttcttttcggtgacgtaacttttataaagtttaaccccttaatgattattgtactacataaaccccaaaactcttttctcttttcttttttctttgtgtagtactgatatcaagtcaacgtgcggtacataagaacccaagatcccataaataaattcttcttggttttaagctttcttcttcatctctacttctctatataactttgagtagtctcaccaaagtccatttttaaaaaatcaactataccatttttagctattctttggtcttcgtttcgtgtaagcattcaatgttttttttcttttatctctttgggaaacgggagtgtggtcttcgtgtgtgtgtccctgtttcattaaccagttacgtttcattctcttcttttcttacgtttactacagatttcagaaagaaaaaaaagtgtttgaagcaaaagagattaatggcagattcttgagtcattaacttttttctaattcttttaattagatctctgaacataagagataacttgcgtcattattctatggttataaagattatgcacttgattaaaataatctctagttttcctttttctcatttgctaagcaactgtttctttttcttcttcttcttcttcttcagataattatgcttgggagtggaaagcaagaaaaattctaaactttatataaaattcccagaatcaattgatccaaaaagaggtaccatttttttcctctcgtcattttccataaaagtaagcttttgattgatatttaattattaaaagaatctgtcttttgggtttttgttttgacaaatttttgttttttcagtattgtcaaaaaagataatcaagaagaagaaactctgtttttttgttctgttcttggaaaaaaatg

SEQ ID NO: 22109 - DNA, 3000 bp, Unknown; identical to SEQ ID NO: 1541
  misc_feature (1)..( 3000): 2750-1469P.txt file - cDNA_ID_2046312; gDNA_ID_1620414; Annot_ID_156359

SEQ ID NO: 22110 - DNA, 1179 bp, Unknown; identical to SEQ ID NO: 1544
  misc_feature (1)..( 1179): 2750-1469P.txt file - cDNA_ID_2046338; gDNA_ID_1620415; Annot_ID_156417

SEQ ID NO: 22111 - DNA, 3003 bp, Unknown
  misc_feature (1)..( 3003): 2750-1469P.txt file - cDNA_ID_2046379; gDNA_ID_1620415; Annot_ID_156405
atgaaaaatactcctctctccattttcaattaaaactataattttaatatattaaatgacaattttgtccaacttttaaaaagctgtattttaataaattaatattaaatacgaaattacacattaatttaaaattttgaaggaaaaaaaaagaataaactaaattcaaaatcttaattattaattttgactatttatgagataaataaaaattatttattttatatattaaaatctaacatgatattatcaaaaaaatattttaaagattatcacttcatatttgttaagatatataaagaaattaataattaataacttttttaatatcgataaaacataaaaatcaaatagatttttggattttaaatataaatatttaaaaatgattactaaatttcagtgaggacattttcttaatttgtatcccttttatatattaaaaaatagattatatattagaaaaaagaataaggtatttttcaaacaaaatctcaaaaaggggtaattttccaaatttttaatcttaagcgaccaacacctaaaactattcatcaactcaaatattaagaaaatctgtcacattgtaacagatttgttgtcaaaaaattaattactagaatgacgtctaacgataaccaattttttttaatgttataacagacttgttttatgttataagagatttttataattttacacaatatctgttgtttgatggcagatttgttttctaaaatattatattttatgttatgatagagctattttatgttgtcacagataaatttatattaccataaatctgtcatttgatggcaggttcaataaagaagaaaataaattgttggaatgaccttaaagatatttgatgttacgacagatttgtaatttgaaatccttataatgaccgatttatagtttcctttttccatgattttttgtaatagaataatactaacaattgtaacagtttttttatttagaaaatcatattatgacagatttgattttttttgtcaatttggttttagaaattcttttaaataccactaaaataagttttttccaaaaaaaaactattatgaattttatttttcaaaaatactacaaatctaaaactaaatcttaatattcaaaacgaatttctaaatcctaacactaaaccccacacctaaaaactataccgtaaatatacatagtcaatccaaatatataaaaaaaattacaacttcaaaaatcaatttttttttatgtttatggtattttaggaataaacttttgtggtttttttggaagaaaaaaacaaattgttgtattttcgaaaaacaaaaattgaaaatgtggtatatgagagaatttctcgttttttatctttatttttttgaagaaaatattcttttaagaaatatattaagtaatttattttgttggtaacggcagatttaatatatgtgtgacagttttttatgatacttgtcatattgatcgtcaaaaccattaaataaatagagtattaagcaatggttttttggacttttaacacaaaatttatgtcaatctagtaatgagtaaaatagagtgttaaactagttatttttagcttaatttgggttaaatgggataaatttcagttattatatatatatatatatatatatatatatatatatatatgtttttttccatttgtaatatactgacaaattagaacactaatttgcaaaatgattagcggggacccggaaatagtcacttgcgtgccatgaggcatcttctgtagggtttggtcgtcattgtaattaaaaataaaaatgatacggatgactcgttaatttgttcttaaaaatcaacgacctgtaatttagagtacatttttcttgttggcaaaacatttagagtagattagaattatttttgtttattttgacgatggaaccatatagaagatgtctactctaaatcattattattttaatctactctaaattgttttaaatggataccgatggctttattttaatctactctggattctcaacttctattaataccgatggctttattgcatctactctaaattatttttatttttatttttgattattttcttagttctatataagccataagttctaatatttatacagattttcgcaaattgtaatagttatattttagatcgatttggactgagtttttgtacgtaaacattcactagatctcccactacataaaccttaatgaaaaaaaagaaaaaaaaaagagaaattttataaacttataagaaactttaatttttagatcaggtatttagaattttcttaaacgtagtaaagcttatcgtgcatgcatatggatatttcatggagatgtttataaacattcagaaaaacttaatttatttttagaaagaaaaaattattaactttatcagtagaagaaatatgtacgtatataaatattgtgtaatatctactgctcagactatgaaagactctttaaatgcaaaacactgagtggattacgaaaataaagcataaatctaaaagatgtgttgattatttttacaaaatatataaatatttatcattatacgagtcatagtaataaactaataattatcattataaaattttaattttaagtctatgtatgtgctaaatctaaaaaataaagtactttttcgtgaaaaaatatggaaaaagttatatatgtgtaatttttcatatttcaatacatcaattcgaagattatccattagaaagacttggtaaaaatttcaagcaaatattaagtaactcgtggtggctactttcaaaataaaacaaaagcatgtgacttattttatgatttcaaaaagttgataggttcggacgagttcacaaataatggaactaatagatccctataaatacaaagcattattcttcgtttatcttacaaaactttaaacacattgctttctattttaagatctttctatctctctctctctccatg

SEQ ID NO: 22112 - DNA, 895 bp, Unknown; identical to SEQ ID NO: 1542
  misc_feature (1)..( 895): 2750-1469P.txt file - cDNA_ID_2046438; gDNA_ID_1620415; Annot_ID_156391

SEQ ID NO: 22113 - DNA, 3003 bp, Unknown
  misc_feature (1)..( 3003): 2750-1469P.txt file - cDNA_ID_2046448; gDNA_ID_1620418; Annot_ID_156512
ccctaaatttcctttatttttttagttttgtattcttttctccattctccatcatcaaatccatttcattatctgcaacctccatcaatgaacgactgtgaccaacaaaaaaagtaacatcatcgatttctccttttcgagacgaagaagaaggagatccttactctctgctaccgaactccctcttcccttaatcttcctctttttctggttccatgctcttctctcttgtcttacttacggtttctggtttcgttgtttttttttggtaaaaggtttctttggttttgaatcataaaggccaatggtacatgtgattcgttgattctagcttaggctttaaattgtaaatctttaaacttttttttttgttatgggttctagattttatgattttatccttcaatttaaatttatttttgttagatctgttgaatttattgccttgtttttgaattgaaaaatgtttggatgtcatttgcgtagacgaaaagtgattggacgcataaggctgggtatgtggtggttatgcaagaagattggttgatgtttatgagctttttttgaaactttggtccatgaggctgcggtggccgccgtgagctccagtgtcttgtctggcaactccatacttatgtcgactcatggatgtcaagaaaagtttacgagaaaacacgaaatgtatatccatttgttcggcgctaggtggatacaccttcatttgttgcactatatccatttggtcgatgtttcatggatacaactctacttctaaaaatcatagatgaacacgtacttgccgattgtcagctataggaatccgtccattactcttcgaagatatgttatccaactaatgaaatattcttttatttgattttggtgaacaatgtttacatttggtgaacaatgtttagatttggtgttattcatctttcgtatatttgtttgtgcagataaaacattttaatgtaaaaactgtaaaatataggatcattcctatggtaatattcgtatgattatattcaaaaatggttcatacgagtgtgtaaaccctctacccttaacgctttacactaaatcctaatttacttaccctaaaattaaacccaaaccctcccatgatccttctccactaaatctaaaaccataaaacaaaactctgaaccatacaaaaaatgataattttaccaaccaataaaacacatttgaagcaaatcaaagacatagttgtccattgatgactatccaagcggtttagtccatgtggtaatctagtgactcatgaggtcgtttcatttcaatacacaagtttatacatgaatgataatcaccaattcaaacacccattcaaagtacatcgtctatttttctttaaccatttattcacttgtgtatggaaactcccaacattataaccaaaattgtctactaatcctagatataacaagaaacagatttacttatatagtgtataaaaggagcataatatcgatgtttgcgtctgaatggacagattcccttggatgacattaacaagcaggcgtccagctgaccatatatgtttgtactatcatctatggtcaccaatcatttgaatcaagttgaattcatggatgcacagtacgtcagtttgtgatgtaaattaatgtaatgcaaataatcatctgcaaaattgaatcaaagagaatataagatcaacacaaaagcaagtgtttggggaatcggatgcatcataacaagcgaatatctactcaaacaagtttaaactcaattcaccataacattcacacccaataaaaaaaaactcaatatgaataaatcagtgtggaaagaacctgatacaaagctgctccatcaatggaaaatcttcaaacactccacaagaagcaaaagcatccactaatcaagttttttttatctctctctctcaagctaaaatcttaaaccaccaatatagaataaatgagaaatcgtttactctaaggaaataaaaactaattgaaaattgagaaaagtgctatataagagaacacaactttgattaaataagcccaaaattttctctcgccgctgtgattatcagagaagtgggagaaccacgactgatgatttgccaccaaaaaccagagaaacgagatcgcggcttctactgctacacgagatccttcactcggtcgctcgttcacttattctttcttttcttttgttctccatattttatggtatctgaaattctaagatctagcaagtgaagaactggaagaaaaaaactgcaaactttaaggttttggagcaattgaatgaactttaggtagaacgcatgaaactacaataacatgaataaacacatagacaacaaaattatcagggtacagatttttaaaccaagttgtaattctagcaaacccatcaaccatcatcttccgctggattttgtgttttctaaagaaaaaaaagagatagaaaaaggaaagagacaagagattgtaaccgatgtaattaaagggtaaataagtcaaattgtccatacaaagtgcctattccttgaaaagtgtttaatcacgtaaatatttttaaaaaagtgctctacactgtaatattctcattaatttatccaataactaaatacgacgtcgtttagttacgaaaggtaatttggttcggcgtcgttacaaagactaaagattcacatgaatgtaactgttttttatccatatcaattttcaaaccaaaccaagaactgaactcgaaccattttttatccaaatccaaaccaaaccgaaatttaattggacctacaagcccattatatattcaaattttacaaaattggcataatataataatacaatgtttaataaataattaaactaaactgagtaaaagagggaaaatctacgatcctctctatctccttatccaacaacaacaaaaaacgaattctcgaagagaaagacactgaaatcgaaaaatctatagagagctcactcactagcaatg

SEQ ID NO: 22114 - DNA, 3000 bp, Unknown
  misc_feature (1)..( 3000): 2750-1469P.txt file - cDNA_ID_2046529; gDNA_ID_1620430; Annot_ID_156842
tttcttcgagtttatcggttaaagaatattactaaccaattgaaactaaagaactgttttaataatatttgagaaattttatttttattcaaatttttgttttgaataaatcaatatcaaaccaagaatttagtttaactcaaaaacgtagttgttatatatacttatatacctgattgattgcaaaaaaagctttaaaattttggcctcccaccacagaggtgttcgcaaaaccggctccaagaaagagtctcctatcaatttgaacgaaacccttacattttatattgtaacatccgctttcgaatgtatcttgctgcaaaaaacgatttggggttaaagaagagaaaaaaaaaatctactttcttgtgatagggacagacgataattggtgacattgttactcacactccagtatgcagtaagtcgtgtacggctatcgccatatagtgcaggaatcaccttaatatatttcatacgtagtaaaaaaaaaaagttatcagtaaaacttttaaccatgatatttattcaaatgaactaattatacatatgctaaatgatggttgcattaagtgggtttaattttgatctagtatatcacgatttaaaaaaacaaaacaaaaaattaaattcttacagcccaaccaaagtgggcactggtgcgttcgccttcatactcagtattgagccaaatgaaagccatgctgaattgctctttatttgtcaatttaggttggtaaatacttatccatgctgatgctccacgccacggggtggcatcgattttcttcattaccgcagcctgtatatatatacacatcagttttttcaaaaaaaaaatacacatcaaatggtttggatcatatatagtaaaggtataaaattttagtcacttcacatgttgaccaacagttccaaatccattaataggctgaaaatgtttctcggtgtggttgaaattatttcttggtttatggattggtacttgtccttgaggacatccttcttctggtatatcaaactcagcaaccatttcatcgtttgataagttttctgatgatgtatctcctgagagcatggctaaggcttcatcgctcggtctcatctatgtgatgcatcaaaaaatatatcaatcaaatagggataagtatatgatcatgataaacattaggtgcaggaaatcgacaaacaaatgtaaatatatagaaatatacttggattcggtgattttggagtttagggtgttgtagcgaaggttgtttgtagatatcaacgcattcgtattcaggttcttgaggctacaagatatgagaattttttttaactttatttgtattatatatttaagtttatatcaaagtgcttacaaaatggtgacagaccttagtattttgagaccttccatggaagcaaagtaatgaaagagagaatatgatgatcaacaaccaaggagaagccatttgcttagtttgcatattttctatgttcagccgttgaggcggagccaatgtatatatagggaaggtggtcatctgaaaattcttaattataaggtaatttacttaataatattaattcttaaatgtttttgtataaaaattttcatgttgatgccatatgatcatttcctacctttgaccccattcataatattcttttgagaaaagaacttattgacccaatatattaaattagtaatatttttaattagtaaactaattcataaaatataaagttaattgagttattttcatacctaaaataccttatattgttttgttaggcttataacagcttcaacaattccggatgagcttgggctgaacaagaactccacggcccatcttcaaacatagaaacccaatcagctccaaaccagctcaatccttaaaccaaattggaatcctgaaccacacatacgttatacgttaaccgaccgattaagctgatcgaacgtctgaccagccaaactgatcttcatttttcaccaaccacacttaaaacaaaaacgttttctcttaaagaaaatttaaagagacaaaacaaacaaacaaaacttcagtctctgcaaagctccatcctttgtggttgtgtcgtagatagccattcgagtggttaaaagttaaaaacttttatgtccacttgaatccttttttgtttctttttggattttatctgatcactcgttttgtgtctctgaatctctatcccgtggattcgcatctggatttgtttttttttcatttttattcgagcggctaacctttctcggatccatctgatatcgattggattctctctaatcaatcgttggtaagctaatatttaatcacttttgattgaattttccttctgggtttttgatctgatttcacctcattgtcttatgaatccaccatttgagttctagggattaaaagattcaaactttctcagagacaactgaggaaaaatgacatgtttttagagtttgagtttggttacattttcaggttttgttaagatttctctcattgtcttctgaatcctttgatttggtaatgattggaaatgatcataagattcctactttcttggaagcaaaataaaaatatccactttttatgagaaaaactctttgaaacgtctttgttatattcaaacttggtttgtttatacgttttgattggctaagtggttcaggtcacaagtgacaaaagtactgattttggatgatgatatagttggtttaagtggttaggttataagttaatcttgactcttgaaggattattcattaacaaaaagtagtgagtttggttggtttatgaaacatttggttagttaaagtggtttaggtcacaagttaaatgacaagtattcattaacaaaggttttgattttggtttgttctgagaaaattgtttcaagtggtgtaaaacttattcttaattaacaaaaacttttgatttttttggttgattctgagaaatttgattgatttattgtttcttagaaatg

SEQ ID NO: 22115 - DNA, 3000 bp, Unknown; identical to SEQ ID NO: 1647
  misc_feature (1)..( 3000): 2750-1469P.txt file - cDNA_ID_2046551; gDNA_ID_1620430; Annot_ID_156835

SEQ ID NO: 22116 - DNA, 3000 bp, Unknown; identical to SEQ ID NO: 1646
  misc_feature (1)..( 3000): 2750-1469P.txt file - cDNA_ID_2046555; gDNA_ID_1620430; Annot_ID_156834

SEQ ID NO: 22117 - DNA, 3000 bp, Unknown; identical to SEQ ID NO: 1703
  misc_feature (1)..( 3000): 2750-1469P.txt file - cDNA_ID_2046681; gDNA_ID_1620437; Annot_ID_157045

SEQ ID NO: 22118 - DNA, 3003 bp, Unknown
  misc_feature (1)..( 3003): 2750-1469P.txt file - cDNA_ID_2046770; gDNA_ID_1620449; Annot_ID_157412
ttgtatttggttccactccaatagatatcagtttggttcactttcgattattttatccaaaatacccaaaaaaacaaaacatcaaaatatccgagacttttttgacaaaattgtaatgactcaaaatatttgaaaattaacaaaatttattgggttagaggttgggaaaaaatgtattgggtttagatgtagttttgtataggaattgaccaaataattttggttccattcgggtacttatggatattctgttcggttataaccaatattcaatggataatgtgactgagatccatttagggtatttagtattctctagtgtgactgagatccatttggtttcattattgattttcaggtctaataagtataatcaaatatatttttgtaatttaatacatagatacaaatatttgttgaaaattagtttttttcgcgatatcgtcatatcctagtaataatattaataataataataatattattattaataataataataataataataataataataataataataataatatttcatgtatgcatgtatatataaatatttattgtgactatgggaatccttgaaagtgcagaatattaattactaaaaatgtagtaaatgaaacatatacaattggtaagtgtatgttgaaaatagtgaaaaaagagaattaactctctttttcttagcaaaaaaaacaaaaaaaaactaactaagtttaatcaaaaaataagtatgatttttctttttggaaactaaaatacatttaagtctaaaacctatgaaaaatactttttgttggggtaacagagataggcatattccgctgtaacaaataacggttttgccctcgatcatcttcttctttccttcttcatcgtttctttctcttcttaatattaccaggaattttggtttcaatttttttttttatcacaaacacccaataataacaatatatataccctaaagaatagtacaagaggaacccaaataaaataattaaacccaatgtatccaattaaattcgttttgatgagtgaaatctaaacccttatgagagtatagggaacccaaatgcttcaatcatagacacatatcgaatcaattatgaattttaattaataatttaaattattttgagaactttggatagggagttacttgtataaacttgatccatggagtagggtgtaaacgatgttgcaactagtggaataagtaaagaaataaaagggaaaataaaaatattttttgaaagctgtcaagggtgaaaccgtaaaattatataacgtaaaagtacctaaatttgtgagtactgtactgtgatgttcctatatcgacaaaagcacacactttaatgtgccgatctcgtaattgatccaactaaagtaggcttggtaaaaaaaaccaatgacggacaacacatgaaatattgctctctctcgctctctcttaattctttttaactctctcaatctctctcctcaaattggatatgagtttttcggtgagcgatctctttcttcctcatggatctggttaactttccagaacagatggtgaatccgtcggaaaatcttgcacaaaactaactgtatatcaaaaatgaggagtggagcccatattttcaatgtcaggatagctactggcttctatgcttttgatgaaaactttaatatcatccatgatgcagatattcatgaaagatggatgttagtgagaatgactgtcagaacccctgctattccgggtgttgcttttgcccaatacgatccaactaggttttaggtcacaatacatttacagctcagttcacgagcattctctcttgcttctttacaaattaagtaatagtaatgtttcatgtggttcatacaaccacggcgaataagatttgcacaacctaataattattgtagctttgttttttatattttcagagttcaaaattgaaccataatttaactagctacataaaaaacaatttcattacaataaaatgagcatatgaagttgtggtacaattgtaattaatagaggtttttcatatgcatttgcatatatctaaaggtcgaatatgacgatgtggagagctttttaatggtgattttttttacagaattctagaagatgacgaactaaacgaaatcatattcttggtgagtgcttctaaccttatagaaaatcttttaaatcttgtcttctaatgatatgcaaacttgtcatgttttctttgttgaggaaatgaatcaagccttgtaaattcattatcagttagtgacgatacaaagtggatgttgaaacttcatggctacagagatacttagttctcatatatcaaaaatttgcatatattcatatgttttcttccaacgattaaatgctttgagatacgactatattgtacatctttcagttattgttaattttcttaaaactagattcggaccgcatgttcgtgctggattatgtgtgtagatgtatttgtttggtatagtattcattaatccaaaccagggggaaaaacaatgctttataggagggtcaactgaccccataactttttaaaacttctatgttattagtagcctaaaacaatttttttgaccctaatacaaagattaatgttagaacatgaaacaaaaaaatagttcaaatacttgaaatttagtttcatagcatgcattaatgaaacaaagggaataataaattattaaacatgattaaggtgttcttagttttacacgtgggggttgtcaaagttgaccaaagcgttctcactgtttctttaatgagaaacaaatcaaataacatgggaacgtcagagtaaaactcgtgtcgttttgataatttaacaactaacgttgcgctgttttttagttacttagacacggtgagaaacacaaaaactatagacgacgaaacgattcctcaaacgcagaagtcttctccttctctcgacggattaagcttttacacagaagaggagagatatg

SEQ ID NO: 22119 - DNA, 150 bp, Unknown; identical to SEQ ID NO: 1817
  misc_feature (1)..( 150): 2750-1469P.txt file - cDNA_ID_2046800; gDNA_ID_1620452; Annot_ID_157532

SEQ ID NO: 22120 - DNA, 3003 bp, Unknown
  misc_feature (1)..( 3003): 2750-1469P.txt file - cDNA_ID_2046812; gDNA_ID_1620452; Annot_ID_157529
cgcatcgttggacatgaagagaatgcagaggtttaggctggcgatggtttttgacattctcaatgtattgcaatccatcaggctgcttggtacgagaggacactacacgattgatattgcggttggagttggcgctgggattctctttgactcattggccgggaagtacgaagagatgagcaagagacatttacggaatactcgttgtagtttgatttcaaaagactctctagtcacttaaatctattttttttttccggcaaaataattgtatattacactaaatctatttcttcttaaaacgtttagaaacacatttagttgaagtttaatgattttaatttagtttctattaaatggttctaattgaataccattcgttgaacctaattactaaatgtgtacgtgattgtgaagctgcctcattgagttttttaaatggtatatgtgtatattaggtcttcgtataactaatttatgcaaagttcttggttgaaaagttctccaatatagtagtctttatattaatttgttagttcaactaataaatagatcaacaagtgaacatttataatattgggtggctaaaaacccccagataatttaattgtgaagctcttatctaacacatttattgtattcaaatactgatattaacatatgtgtatatatatttacataaataaaaattagttctattcatcagaatcggataactcgaggggacaagagccatcatcaacattagcatatgggttgaaatgttctgaatttgtatccatgcatccaggaactagatccaagttgcatctatctccctgaaatttgttcatacattttaaaatttagtgtattcaaattttataggacatagtttggcgagaacttactccttcgaccgtcaagttggcgatcatcgtgcaacgagttggaacaacgttcgagtcaggaaatattgctctttcgcaggctccatcttggctcaactcgttcgctagaccctttttgcaccaattgataaatgataagttttgcatattgcatatatagatgataagtagttgtgaaaatttgaaaagaaattcattacatacctcattgaagaactcaataggtttgttttgccatcgcttggggacttgaaactgaagtctgtatggaccgtcccaatcgacaccattagtgaatgagaatatcaaattcacagctgataatgattcataggaaagataaaagtgtcaaattaatacaaataactatttggtcacaaaccatgatttgatttttgattataaaagaaaacgaaccatgcttaggaatgcaaatctgcatagtgtatatcggagaatcggctttgcctcgatctttcttaagcattgctcttggctccccaccacacatgattggttggttaaatcctcctgcaccatttagtaaccaattgaatattttcattttttttgttgttataagtactccataagactggtctatgtagctttctactaatttaatttggaaatgaaaatatatcacttgcaagccacacttagaaataattacttgactaaaccccacgattagactgctaactataagtacttgtacgaaaacaattatacagtatgtggtagccccattaaacagccgccctaaccgcgccaactcgttgggacaactcggaatacaagttaatttaattagatgttttatgagaaactcaccgttgaaagcaaccccatagtcttcgttaagagtgagtttgcttgcagctggattatagaaaagtttcaacttttcaccctaatccaaaaaagttttgtaagaagttaattgagttaaagagcctcaacacttgaaaatagctagagaaacttactgaggttggtggaagaccattcatggttttccagtacacaggagcagtacccatctcgaacatggcccatgaaggaagcttgtatctatcaaaataatcaatcatgaactatgtttattattatattcatatagttatatcgaccaaagcaacacgatgaactaaaataaagacagactctttgatctcttcgagaggtgcaagagtcgtggcaacagctttaacttggagatcaagtttcttcctcggaaatctccttagtattggaccaatccttgaactgtacactgtatcattcattagctttagttttaactcgttatatagctagtattatagattgacataaatgaatcaagaatttgagtgaaaatacttacaaaaactacgtttcgaggataaaggctgcgacggagaggcgaaaacggcggaggtattagcggcagcagccatcgataccgatctaatgagaaaccttttttggggatgaaagaaggagaaaaatatgtaagtaattgatatatggcttcaagataaggatttttcacaccacaaatacaaatatctactatagaatttttttcttacacatacaaacaaagacttaagtatcatagagacaaatatcaaatttgaaatgtaaggtctatggaacatgtccctttcactcttgggatttttcctttaatgaataagaaagaatgggctcaaaaccaaaataagcccattcaagagatcaatgagcccaattgtttgaaagcaaatattggggtgatttgttaactttccaagaaaaacacgggcttttcagcaaaacaactcgaaaaattgaagagaagatccgggttttagataactgccccaaattggcaatccaaatccctaaaaccatcttatcctctctttccaaatctagccgcaatgtagtcccgtgaaccacaaaaaagatgagatcttgcacgtctctgtcatcacaactagtactactaattgtgaagcatacaaaaaagaccgacccttatttatacacgcacacatattaacatatttatactactagtatataagttaagggtttaagcctcttctcttccttctttctcttagccatcacatcgataatg

SEQ ID NO: 22121 - DNA, 3000 bp, Unknown; identical to SEQ ID NO: 1816
  misc_feature (1)..( 3000): 2750-1469P.txt file - cDNA_ID_2046828; gDNA_ID_1620452; Annot_ID_157525

SEQ ID NO: 22122 - DNA, 3003 bp, Unknown
  misc_feature (1)..( 3003): 2750-1469P.txt file - cDNA_ID_2046832; gDNA_ID_1620452; Annot_ID_157524
tgttcattggttctgcaattagtccatatgttatgttgaatagcttgggtgatgattcctttataacatagaaggataggctggaaatagaaaaaactgcactcatgactgatactaagtgaaatgaatactcttgttttctttttctctttgtaaaggtcttgtgggagctgtgacaagggttcaagaccgcgtaaagattttcctcgcagtgttcttttggatgtttctcttcttctgggttacagtcacagatgggacgggtaaaggcaaaggcaagaagggttcacgtttcaagtagtttccatatatgaagaggctttggtgattatctactactctatactgtatatatatcaagacttcaaagagatcaaattacctgtataaacttcaccaagtaagcatcttccttgtacatcacttattcagatgataataggaaacaataagatcgtgttatcttcttggttaatgctagtgatatatagtactcaattcctgattctttcccagtctccatctgatcatgcttaaaaaacggcgtcgttgagcaataggactcaagacatgaatgggcctaatttatgggctttaaagagtttaaaccacagtaacgttctgttttaccggactccaaagcaatactccattagagtttttttcccccaaaatggagaaaagtcgttaactatttggcacgtgtattgcatgagcaccaagtaagtctaaatctgcattaaatgcgaacatccgagtcgacttaacaccttttgatcaaggctttaacgtgtcgttgttaccatagaatatagatgatagagcgcattttatatcactggatatagacacgtggttaaacttaattgggttgttagttaagttgttgtgctacctccaagtgactttatcatatactctgtgtgtttctggtagtaaaaaaaggtctaaaaccatagtgttaagcaaaagagaaaaagaagagcagagcaaaatccctaaaattttaaactctgttttgctttccgacaatcaaaccctaggttgtctgttgcttcattcgtgtaaattgttaaattttttgtttttgttttcttggcattttgtggttgatctttctaatttgttttcaggggttgctaaagggaaaggagagagatgggtggtgaagaggaagttgtttctgttgagctaccagcaccttcttcatggaagaaattggtttgttttctttgtttcatacaaagacttagaatttgttgtatatgtgtagtgctgcaattaccaaatctttttctttgaagactctgaatatggtagcttttggtggcgaaatgttagtataagtgtaaataactttatgttgattaggtgattcaaaggttatagacttagaaaaagccacatttgattgtgtttgatctactatttctacttctttgttcttgacttaatgcctcattttgactatgtttgatttacttcttacttttcccgattcttatggattttaagccacttgtaaacattgtttaagctacattaaggtcttctttagaatttaatctttcagcgttttgaacctcaaattttcatattttcagaggtttacattaactgacttgtttttgcagttttaccccaacaaagtgggttcagtgaagaaaacagaggttgtgtttgtggctccaacgggtgaggagattagtaacagaaagcagctggagcagtatctcaaatcgcaccctggaaaccccgcgatcgcagagtttgattggacgactagtgggacacctaggagatctgcaagaatcagtgagaagactaaggctacgccgtcaccagataaagagccacccaagaagcgaggtagaaccaaatctccagtgtcaaagaaagatgcagaaggtgagaaatcagagggaggaggagaggaaaactctcatgtgaaagatactgaaatgaatcctccagagggaatcgccgagaatgaaaatgtgaccgataagaatggctccggtgaaactgagagggtgaatgatgcaaaagaaaacattgttgctgaggaaactccaaatgcggctccagttcaagaagagggtgagtcgatgaaggagaaagctctggattctgttgatgataagagtaaggagactgacaaagaaaaagatactggctcaatcgaaaagaactcggtagatgtagagaagaagaccgttgaagctagtgatgagaagaagaattctgaagctgagaccagaaaccatgaagaaaatggtctgaccacagaagctgaggggaaagagaaaacagcagaaggagaagctaccggatagccctgttctgctctgcttctgttagctcatgaaactgtaagtcagttgtttctatcaatctattgaagtatatggtttcctttttgcttcctactcggagcattatcgcggtgaaaggtgttgttaggctgagatatgtattatgagatatgtgcaagttctgtttggttgtaaggttatgtagaggatatattattgactcttctctaaaaccattgcaatcactaggtttgatgttttatctttctgctacaatctttagtcattttcgtatggatggacaatcaagttatgaacaagtcagattaaagatccacacatagattaatcttctagatttctttttatcattggttcaatcttcatttgaacgccataaaatgggaaacccaaataaaaaaatggaagaaagcagaagaagacaagaggaaaaaggtaaaagttttgctttgagagtaaagtaagaatctaatgcaaagaaagacttacaatgttagttttcttatttccttgattccatccttttgcatggtcccagggacgagggtttagaatctttctattaaggaacaacttcatagtataaactcttattgttcccattttaggattaaaaaaaaaacttgctctgttttcaaaaacatcattcgagacagtatctcaaatg

SEQ ID NO: 22123 - DNA, 3003 bp, Unknown
  misc_feature (1)..( 3003): 2750-1469P.txt file - cDNA_ID_2046855; gDNA_ID_1620452; Annot_ID_157519
ttggacacagtccaccatgatgacttccatcaacctaacttcactggtgctgctatcactaaaggtggtccaagggagccttggcatgacattcactcccgtcttgaaggtccaattgcttgggatgtcatgtacaacttcgagcagagatggagcaagcagggtggtaaagacattctggttaagttgagagatcttagtgatattattatcaccccttctcctgttatgttccaagaggaccacgatgtgtggaatgtccaattgtttaggtccattgatggaggagctgctgctgggtttcccgagtcgcctgaagctgctgcggaagccgggcttgtaagtgggaaagataacatcattgataggagtatccaagatgcttacattcatgcaatcagacgtgctaaggatttcatctacgttgaaaaccagtacttccttgggagttcttttgcttgggcagccgatggtattactcctgaggacatcaatgccctgcacttaatcccaaaagagttgtcgctgaagatagttagcaagattgagaaaggagagaagttcagggtctatgttgtggttccaatgtggccagaaggtctcccagagagtggatcagtgcaagctatattagactggcagaggaggaccatggagatgatgtacaaggatgtgattcaggctctcagggcccagggtcttgaggaagatccaagaaactatctgacattcttctgtcttggaaaccgtgaggtcaagaaagatggagagtatgagcctgctgagaaaccagaccccgacactgattacatgagggcgcaagaagcacgccgtttcatgatttacgtccacaccaaaatgatgatcggtaagttcacatttcaacggaaaaaaacttgagaagtatacataaatgttgtgcctgattcatttgatgaaatccattttgcagttgacgatgaatacattatcattgggtctgctaacatcaaccagaggtcaatggacggtgcaagagactctgagatagcaatgggaggttatcaaccacatcacttgtcccatagacaaccagctcgtggccagatccatgggtttcgtatgtcactctggtacgaacacctgggaatgctcgatgaaaccttcctcgatccatcaagcttggaatgcattgagaaagttaaccgcatttctgacaagtattgggacttttactcaagtgagtcactcgaacatgaccttcctggtcacttgctccgctacccgatcggtgtagccagcgaaggcgacatcactgagcttccaggatttgaattcttcccggacacaaaggcccgtatcctcggcaccaaatcagactacctgcctccaatccttacaacctaatctcactaagcatgtcaagtaatgatctctctctccctctctgctttgctgctgttgtagctttgaataaaacttgagtgtctacctttagaattaagaagtcaaatggttgttatgatgatgcacttctttacccctttggtttttatattcgtacaatgacgtggtgagagaatgtagctttgtgatcttgttttgttgttgttatgtacctttggacttatgaatcttatatctgatccttttctttttatttagtgtgtttcacatcaaagtttaaacaaaaatagcaatgaactaggtaaaacatacttcattagaaaagtgaaagtgacaatctagagataaagcatgaaactagggttcatatagcacaaaactaatacaaaaggggttttaaagttttaagccggaaacagggcacgacacaccggacaaatcccactgttcctaagccattcctctccacaagtacgatgaaacacatgcgaacacggcattcgacccgcttccacatctgacccaactcggatattatccatgcatatcacacaatagccttcattctcaacaacaagcgtctccaagtgcatctccaccgcctcatcgttcgctggagcaaccgcaagttgcacttgcacatctacgtgatcatcttcaccgggaaacctcgagacagtaacacctatctttacttgtaccctctccacgtctttcgcaccatctttcttcaaatccttaatctcatcagcaagagtgttaacaatagcagaataaggagggacttggagcgaatctagaatgtgatagacgatggctagtgaatgatcaccgtctccaccaaacaaccaatctcgatcaaactcgtgtgtttgctcaagggttagagtttgaagattgtcaaaatcgggaaaatcttcttcttcttcaacgtcatcatcttcttcttcggcacgagtgtaatgcactttgaaatcgaaaaacaatttttggctctttcgtagttctccgtcgtagtcgttgtagatccgcttgacatcgatcacgttgtctacgttatcgtttacatagaaagccatgattttgttggaagaagatgggtttgattatttgctgtgggtttagggttctaatatagagagattagagaaagatgaggcaattttgagttaacggcaaaaacctgaaaaaaggaaagtttgcttttgcttttatcttgctgagaggaagagagatcagatgatcaaagaaggagatcgctaaagtttcgtaacaaggctgagccaaacactcgtgttatatatcccactcctcaatttccgtttaacttgggaaattttccttttaataaaaaataccgaatattatttataatatgaaagtaaataaagtattaaccaataatattttttgaggatatttaataataactactttccttatttccctattttacaaaaatactcaggtggattccgaatcaaggtcccgatatctcagatctttttgtaaatatcatttcgtagaagttgtggccatcgacgatcctcattgttcttctttactctcgagatcttctttgctcaaaccttttatcgtggacgtctagaactgatg

SEQ ID NO: 22124 - DNA, 3003 bp, Unknown
  misc_feature (1)..( 3003): 2750-1469P.txt file - cDNA_ID_2046859; gDNA_ID_1620452; Annot_ID_157517
atgtgtcttcatgttttttggttccattttttaaagatgttttttggttccatttcccttaacttcgtttgattttcaaggaaatgtcaaatatctgcaattatataacataggtaaaaaaagagaggttataatcagctgtacattaaacacatagtgtatatgccgcgatttatatgatagtctccgtccactcaacaaaaacttaaatctacaaaataatctgaattgatattttgaatgcatattaaaaaggtgttatttgagatatcatttttgaatcctacttgagagaagtggtccacggatttgattacatgatactcgagtgtgacatgttcaatcctagcaaaaagatatcatgctaaatttgtcttcttttgacaaaagtttattggttttcagtcctagaaacttgtaaattatgtaagcgagtgacaaagtttattggttttcagacctagagagcagtgaatgacaaagtttattggtttgcagacctagaacttgtgaacgggcagcgaataaagtagctcatatcattacgctttcccgattctagttccttggttttatatgacgacggttatctgttgtgattgataaaccggatcgtataactaattagtaattcctttcaaacttttagtttgaagaagatgttgagccaaaaaacatttatataatctatccgaagaaacttgtgtttgcttcttaggccatcttcaacggtaaaattaggtggattatcttaaaatattgttttttaattattatcatataatattattatttacttaaataattattctgaaaataataatttaacctattaaaatgtaacctattatttacttttctctctctcctactttattattattttatattttttagttagtgaaaaaccatactagagactactgatggagatgttcttatcttttctgtctatttttgactttcatgattcgcttttagtttcttttcttcggcttcgcttttgggttttctattttagcttttttctttttgcttataagaaaaaaaaaaaaactaattatgtacttattgtagtttaattatagtaatattcttttgattttttttcttttttttcctactaaacagttaaagattcacgtactacttatcaaattcagttcagacagtcggacaatatcaataggtgcacctaaatttcattccaagttttaccctaccacaaaaaaaaaaaatcattccaagatacaggcctaaatacgtgtacagaatgttaaatcaccaggcccaattatggcccatattcaaatatcaatagcacctaaatttctagtttctacgtcccttcttcattttttccttgggtcaactaaaattcaaaagtcctattttctaaaataagctaatatagaagcaaaacaaaggaattgggttattttaagtccagatttttcagacaagtcaccggtgagcggtggctgcgtatcagaaaccttgccgtgagcattgctaaataataaacatagataggggaataagctccaaaataagctcccttgtatcctaccattgtgttacaatttagcattacgccgagttgccaatactgtcttaattttccctttgatccccatatatgagacacctctgatctgttcttcaccgcatttttatgattgacggttttgctgatggttagtacattagaacttattagataccagagaatgcaaatacattgtataatccccatgtggccacgttccgtttatgaggagtaatattttatacaactatcacattcttctttacccaaaaaaaacgaaaaaaaaaactacccaatcttatagcgaagatgtgtgagatccaatgatgaagcaattaaattattgctagtgaattcatgtcattatgcgaacacgtactacttgagaaaagtacaccatatagttttcttgtgatggacggtgaggattcagcttgggaaacgatgtcgtaacgtttggatgcagaacgtcgggcgcacgatttggatatctcttttttttttttgtctcccctatcctcaagtcagggattttattacaactttgaatatttatttcctttttttatgtcggccttcttaaaacttttcaagattttcaattagtcactaaactttccattttatctttttcactctattatataattttagatgtaacgtaaaatattactattaggatgtgagataacataatccaaccacaattatatcgttatctagtaacattaactatatattataagttataaattgaaaggaatctcttgagagtaactatttagggcctaattgtgaaactaaaaacgtgtagggctgaaactaataacaattcgtacgttgggtcactattaaatcatcaaagatctgtagaaaataatgaaaaagtggccccacacgctccaattaaattacagcagctccacaaagtagctcttaaagagcttccatcacggaccagatcccgaattcttcttctgaccaccgaacgattgagtttctccgatcagatctcagtttctgggaataattcgaagttagtatttctctacttcatctctatgaatctcattcattttatctttatgtttctctttacttgttttgcgattaaaactcgtttgatcatttaggtggttctttgttttgtgagataagtggaactcgctgacttttttttttttctttttggataatcaacgatcgggttcatttgctattgtcctctagtgttacactgatacgatctttagttttgagttagatcagtgactttagtttcactattcaactagtgttccttgtttttaggacaatactgcgaaaatttagctgctctaaaattttgataccagatctttgagattcgtagatctcgcttttctttttttttagttttttcagaaactaatattgtgttctggtcaattcttattgctaaaggtgaaaaaatg

SEQ ID NO: 22125 - DNA, 3003 bp, Unknown
  misc_feature (1)..( 3003): 2750-1469P.txt file - cDNA_ID_2046880; gDNA_ID_1620452; Annot_ID_157512
taactgaatgatgagcttccttggtgttgaagcgtataataatcaactaataaaatatagttatgaattacattagagatagagggtcgaaaaaggtacgagtcaaaggacttttgtgtagagctagaggttaacaagatctctttcttttagttgtatgtgggctcctaagttgttttgttagcttcttattatgactcttaatttgcttaacattacactatgctttgacccaaaattctaaccaaagtactttaaatttacaactgttatacaaaaacaaagaagtgatcaagaagataaaaagaacgactggtgacaaaaaacaaaacatgtcgagtaaaaatcaagttgtggcatcaactgttgagtctatctttgactatatataattttgcataaaggaagattaatttgaaaaacctatcaaaacatccgtgtttcaacaacatgcattacgcatgtttcattcatgtggtaaattttatatccatatctagtataacatatttctaattttaaatttttttaattcttgaatatgaagtagtagtccatgtatttgtgagtaagagtaacatcataatacaacaaaagctatggccaaagtaattatctatgttataaattaaattaaacaaatatatatatatatcataatacaagaagtactctaagctatggccaaaaatattataggcttgggaatctcagccggaattttcacttagtttattttaaatattctcgttttttttgttgctcttcttttgcgaaagtttacaatattgtggtgaagaaaacgaaaaagtaattattattattttttttctttattttttttcaaacgagccaccagttgttcttgtgtgttctatttaagcccatcctcttcgcatcactctttcaaagcctcgtgtcttgatttctttcaccaaactcatataatcacatatctctccaagttcatcaaggtcagtctctaatttatattattttgtaactatttgattattttaggtatattttcagaaatatatagccacaagaaattgacaaataattaatacaagtaagaaaaaattgatcttcaaaactagactaagtgcatatatccagtactatacatatttaaatttgttaaccacacacatcgtgtttttgtccaaagttttaacgtaaacaatagtaagattttttgtttttcttagaaatatttctattaatttctgttaatctttttaatggaaatatctaatagaaagattcaaatttctatgcatgatgttacagaaaataatataaacacacacatacaagaactgaagaatgagcagacccggagattggaactgcaggtcatgcagccatctcaacttccagcgccgtgactcttgccagcgatgcggtgactctcgttccggccccggtggagttggtggcttagactttggtaatttcggtggcagagccatgtctgctttcggattcaccaccggctccgacgttcgtcccggtgattggtactgcaccgtgggaaactgcgggacacacaacttcgccagtcgctccacctgcttcaaatgcggcactttcaaggacgagaccggcgctggaggcggaggtggtggcatcggcggtccggccatgtttgacgccgacattatgcggtctagagtccccggtaacggtggtcgctctagctggaaatccggcgactggatttgcactaggtaccaaaatgaatatacttggttgatataactcgatttatgactataatatatagtttttatacgtacctatctaaaattttgattgataaagattataattgaacttgaaaacaggattggttgcaatgagcataactttgcaagcagaatggaatgcttcaggtgcaatgcaccaagggacttcagcaacagaacctctttctaagttatacaaactgcttttgaagtagccttgtctccaatttcttaggtaattcaactttcaaatatttatatatatttcgttacacaaatactatttctgcctatgattaaaaatctttatataattatactgatatgtttgaatatgcttgatttttaggcaccgtttcgatcaatggaaaggagaagcaggagcaaaagagagaattaaaagatgataattttgttagatgttgcaatgagagccaatattgtaactttagctgtcgtgcttttggatgtattatccatttttattaagatttcttttcattttctccttaattcgtaatttttcttttgcagtttctttttaagagttttattattctaatcattgtacgctgcatgtctttcttaaaagaagattctcttctcaatttcatcgctttatacatgagttgctactttctttttgtttttgtttctttgttgtccagccttttcaccgtatattcttatagctagactgtaatatacttactatcactttttagtagacataattctatcaacctagtgaccagtgactgcaataataatcaaattttttacaaacacacccccaaaattgtctaacttccaaactatctgaattttaaaatgcttaggagataataatatggagattcttaatcaacctaagaaataaaaaataatatttgatgttcttgtctgtatttccaaatgaatatgatcaataatgcaaaaacaattctcttttaaagaaaaattggagctgagagtaagggccaataatgggcttatatgggctataaaggcccaaatgaaacaaaagttgaagtttcgtgcttcgctgtacaaagacaccactctggttgtatcgaacgagcgaaacccaaccaacgacgagcgttcacctcaaatattttgatttgatcaaatcatctccacactcgccaaatcgttgtgtcctcgttcatatcgttatcgtatcagctcaaaaatctcaatctctcttccttacattcttctgtttctcgaatccttgtctccctccatg

SEQ ID NO: 22126 - DNA, 3000 bp, Unknown
  misc_feature (1)..( 3000): 2750-1469P.txt file - cDNA_ID_2046922; gDNA_ID_1620464; Annot_ID_157861
ttgagtttgtgaggagccacgtgtcgatgcactccacatggaatgcatggctgcattttggtaagagccggagctcgtcttcggctgtgaactctctgagacaaacggcgcaatcagagaggtcgtgtcgaagaccaatcatggtcttgtaatgtaacaagggcaatgcatcaatgaatgattggtcaatttctgcgtcatggagattaaaccgtgtttgataccgaccttgcagagcagtagaactctctgtaatgccatcataggcgtcgtcaagtcgagtttggggtctatgtaagaatttgaccagaaggtgaatcaaagcagctacaaagaagatgatggagaggagagtgatgtagagaagtacgatgggactaatcatgcatatcagatcaaagtctttgtctgttgaagaagaatatgaaaatgaaatcgatgaaacagagagaaatgaatcacttttctgatccatggttttcttgagaaagattcaagaggaaggagatggggaaataagtgaaagaagataaaaaaagtgaataataggaagactctgttattgtaaccaaaaaaagtaaagaaacaaaacgttgacgtttcagtgcaaagtgagttgtggttttcctaaatatagaagtcaagtattcatagatttcccaatacagatgtattgttgttcaaaagcaacgtggtttctttgacattagactaacagagcagtaacggattaacaaacagaggagaaaaaattaaaaggattcgtttttttcttcgttaatcaagacaattgggaataacaaaacaagcatcaaagatattgttatatgaacgtaatgatcttacgaacgaaagacagacactttaacagaatctgttatagatttgtcaacgagatgaagaaaaaaagtagcctgacaaaattacaagcatgcgtatttgcagagggctataccaagaacaacataaaaagactcaagggaagctggaacagtaggtgcaaaatgaggatgatgcagtatgtcagagacatgaaccatatgaagttccctaaagcttggaaattcaagtttaaatttagcttagaggagatcaaaatgacaaaaaacaagttctgttgtgaggtggaattcgagaaagctgcagtgcatgttgtttgagaacttgaagaaacttttgggacataggcttatgcaagatgtttctcgcgaaattgaagcagtgcatgggaaggaatgagaattaatgttcaaaagtctggatctggcttgtcaaagcagactatgaagccaaactatgagtgtgtgttaatgtctatggagttggccattcaacaaaggatatcagaaagtcaaaattgagctggttatactctagacttttcaggaacttcactttccattgcagctattttgaaaatgtgtacagaaggtgaggatatatggttacatttggaggacgacttgatgagacattctagactacttcacatctctctcttacaaaacactaggacagtgagggtgttgtgtttgtggttccaacatgtgcacatgcacctacttgattgtgtgatgtggactcgagagaacatagatgtggaatagtggacatgtttcagactgaattacacaactcatttttggtgtggagaagttccacataaagcacaagtggagatttaagcttgtacatccagtttgggagttggagtttagtttggatagtgttaactctggacaaagaaactctgctacaagttccaaagtacaagacaaattgtcaactaaagaattttctgtcaatttacagcaactggccacagttttgcacaattgtgagacacaaattagtgattctacagaaagtgagattgaagatagcttgggtcatctttaaaatcaagtaatatttgttgagagtttttttgataaatatatttgctgagagttggcatgatcattctgatttgctaatgttaaaatttgaagtcattaatgttataggtttgctaatgcaaatgcaattataagcatgacgtgacacgacccacatgctcctccacatttcattattatacacttgtttttccactaatgtcatgttacttttggagacttgctaattgaatcattatttgttggcacaaaaagaacctatatttattcaattacgcagtatagtaagattatttatttaattatatgtaataaaggagaaagctttcttatggtgtgatgaagaatgtcttttttttttcattgttagagaatctttataatcattaagattttggttaaaacaaaaaaacgcgcgaattccggctattggtttatcgaaacctctggctacaacgttggctttgtcatattttttttttgttcaaataattaaaagtcaattaattagtgtcaccatcacaaaatattaagagatcctccacacacaataaaaaatttagaacaattcttttccatttttggtttaaaaataaagtaatcaccaatttgttattattgtttgttattttccttaatcaattgaccaaaaaaaaaatcccacaacttaatttcaccattctttttgatgttctctgtattacaattgtcagagaagttttctggatgatctttcctctaaagtttaaagctttttttggtcaattcttttaaagttttgatttttttttggttaattctttaaagtttctttctttcttaaagagggatcattatgatgatgatgatgatgatctgatctgtacataagagaattaaagaacaccaacaacaacaaaaacagaggaagaaaataaaaaccaaatttttcttgttgcaatcatttgaaattaaattcaattcttcgattcttccgagctggttctcgaattgggtttgctgcaaattgtgaatccaataaaatttgttcgtgttgttgtgttgatggtgatttgttagggttgatccgatcaaaatttcaattttgtatcgtaaaacgatg

SEQ ID NO: 22127 - DNA, 3003 bp, Unknown
  misc_feature (1)..( 3003): 2750-1469P.txt file - cDNA_ID_2046935; gDNA_ID_1620464; Annot_ID_157856
aaaagtagatttattttgtattataatcaacgcttaccaaaaagtaactagtcttccctacttaaaaataaaattaaaaactatacctaagtactactaattaacttaataacgtaagaaaaaaaaactataccttaccaaaaagttagcttagctcagtttgaaattttgaatacgattgtttgattttagtgaatctgaatagtgaatacttatacgattattcctgtttatttttgtcaactatgtatacgactttaggcgttgcacaattaaaaaaaacgtataccactttagggctaataatatagaagctcacatctaaaaactaaaacccgcttattatgatcttatgatcacatatctgataaaatctttaggccacgtttcgaaagtacacacgatttactcctaattagagagattataatatcaaactatagatttcgtggaaaaccaaagaagtaaaatcattggtccgcttgattatgtatatctattttcgaagttttaagaaaaagatgaatagaaaagttaataacaaagcaaataataaaacatggaaatagagtatatgtaatagactaatagtagttttaacctttaagccttttctcgtgctaaaatcatgtaagaattcttttgacattttaacaaaaaaaatgtaagaacataaataatgagagtcacgacagcttttgctttagttaagcacacgagaaatcatcgattgcaagttcatagttactatctcgcatcctaactaaaatgatacaaatgcattgagcctatatctctttttttctttgccataaagttattttttatatacatattgcaagagtaaattctaaggttgaaagtgctgtgcctgttatacgtaattaattcagtttttttttttttttttcttccgtaattaattcagtttcagttttcctttttttacatactttcaaacaaagtaaaggtagtcaacgtttagttgaaaattttaaagtgtgattgatagccagtataaagcaagatttttatcttttaatagtactaagttaaaattttaaatgactcaaagtaaacgcagatattatcacgtttactttaaaacgcgtattgactttgaatgacttgagtttttctattttagcaactagcaagcataactttgtatattagtttagtttagttttgttttgttttatctccttacaaaatcgtattacttttttttttgtcggacaaaatatagtattacgtactagttcctgctggagatccaaaacttctattatctacgcttttagtttatagtccaagttttgaattgtttttgtcctattaattaaatctttaatgttttcatataatcgaaagattttcaaaacatatatagaccatcataatttttctaaccctattaaatcatatcagcttccatttaaaacgttgatataatattcatctacttccacctactacttgttcttaaagtgtgtaactatatatcacgtgaactgaattttgccatgaacatctcatgaacgaggtacctaaaaatacatgttcctgttattcacttttgaattttgtttctaatatatatcacggagaaaatgttgaattctgaaaagttgacatttaacaagaaatgttggttaaagacttaaagccatgcttcgagatgcgacttcaaatttttttcgtatcacatatttgtgttaatgacattttttgttatcactcgtttacaagttatctatatcaacaaaggcaacaaaaaaaacaaaatagaaaaaaaaaaaaatcaccttatatacatgaatggtggatttagatgaaaaaatggttgtgaaaggaagtcgagaatctaaactaatctaatggaaaatttaaataaaatgttaagtttgtcttataaatgcatctcatagtatatgttgcataccactctcaattagaataatggttcgaataaagaaaaaaaccaaattatttgctttaaaatttatgtaaaagaatattaattattttctaaacaacaatatataagcaaaaagtataatttttggtgcctttaaagatgtgattgtcatattaaaaagaaaatttccctaaagaattaatggtctaattatttagctagcttgtactccagaccaaacctgttcttctgatggctcaaacttaaaaaaacttaggtgataaatgcaacgaaccaacagaaaaaaatcaatttaactcacatccacaattttttttggttcataattaccacatccacaattattattattacttttattatactcccacaatatttttttgccgtatgtatgaaacataccaatttttatagagaggcagagatacgcgtacagcttttataattgaaaagggcaaaagtaaagtagtacttattattcacttcttcttcaccttttctctttgaattttcttcttcactctgcaacttctcttccccacctttctatatttactattttctatcttcaatttgttggatccgaaagttccttccttttttgtttttattattctttattcaaaagccagtttttgtgatccatttgaaatcccaatttgtctacttctcccaataataactctttttatatctctttttttcttcctttacttcagaaaacaagtctaccttcttctcttcttctaccttcttctcttataaaacctatctaaagccttttcatttttttggccggtgggatattgtttgaatgagttcaaccaaaaatcttatatattcttatccttttttttcccgatcagaactcagttcataaaacttgtctgaataatttaagaacccaactcaaaagattcaatttttcgtttttccattttccttcaaagtcttagcctaataaaagattcgatttttatacaattatttaatacccacatataattgaagaaagagagacagagagataacacaaaagtggaagtaaacgaagaacgatg

SEQ ID NO: 22128 - DNA, 3000 bp, Unknown; identical to SEQ ID NO: 1900
  misc_feature (1)..( 3000): 2750-1469P.txt file - cDNA_ID_2046950; gDNA_ID_1620464; Annot_ID_157850

SEQ ID NO: 22129 - DNA, 3000 bp, Unknown; identical to SEQ ID NO: 1914
  misc_feature (1)..( 3000): 2750-1469P.txt file - cDNA_ID_2047023; gDNA_ID_1620467; Annot_ID_157936

SEQ ID NO: 22130 - DNA, 3000 bp, Unknown; identical to SEQ ID NO: 1919
  misc_feature (1)..( 3000): 2750-1469P.txt file - cDNA_ID_2047053; gDNA_ID_1620467; Annot_ID_157926

SEQ ID NO: 22131 - DNA, 3000 bp, Unknown
  misc_feature (1)..( 3000): 2750-1469P.txt file - cDNA_ID_2047075; gDNA_ID_1620467; Annot_ID_157921
ctcttcttcaattgcaatttgtcttggacagtttggtcttcaattgctctgagatgtcaacttcaacctttgcgttcttggtctgcaactgtcactcagatgcaagccattcaaggtccgaaagataagagaagactctctcttctagcttggcaatgctcgatgtacttcctctggggagaaaggaacaatcggcttcatcgcaacaccttcagatctgctgactctctgcttcgcctaattgattctaccgtccgaaacagaatctcgaccttcagagaccagaatccgcgtttatcatcgtcgatgctacagctatggttctcttcctcttgatcttctccaggtgaactctcactattccatcggctaccttcacctacagtctaggttcaaccctaagatctatgtttcaatgtgtgtttctaattgttattggggtatgctctttctctattggtttcgaccaaacaaacactaaagtcgggctgggcttttgtaatttttatttccttatgcatttcaatagaaagcctttttcaaaaaaaaaatatataacttgctatgattaaaacacaactatacgtttatatatttgcttgttaaggtaatggaagtttattttgggatctaatatttatggattcaattaatgcatgctgtatatataataactgggagtagaaaaccaatccgagccgcaaattcgaagaagggtttatgcatgcctgattattgattgcgggttacagtagtcagtagatatattctttagcttaaggtactagttttaattttacattagtagttacacacgaatttggtggttgttacatatgagtttaaagacaatttaattatagataaattatgatacacatgaatgaagttatattattttattaaccattactatatttttctggcgacacatcacacataatttaaaggaaatgtattggaaaaaaatacacataaattaaatgttaataattttctgtttatttttaaaaatgaattgccaagtagaccaataaaatattttttatatataattggttttatgaagagtattgaatcttctatataaatgaggtagcttgtaactatttactatatccaactttgctctttatgcagattgtctgcagcgtcgtcaaatttggccttatagattcttcttaaatatatcccatcttctctagctctccaatcccataagccagaatttttaaatgctctaaagctctgactgtgactaaatccaggtccttgttttaaggtacacataaaacgcgtcgtaccaaataaattatgaaagaaataatctgtaaattgtcctccatttggtattattgttggaccaagtacgtcatttttggaataacacctcatccaaagggttttcttatttttgagttcgttcacgattctgattccggcgccggatacatgaccaagcatgcaaagactaaaaacaaatagaaaaattgtgaaatatttcattttttgtagagatattttgatcttcttttgtcgtgttgacttgttttttgtgtgtgtgtatttataacaacatctatgttgctatttttgaatttacagtttcttgtttctctgttaacataaattttctattaaattttgtccaaaaaaaagttttctattaatagttgttaaaacaaatcattggagactttcaatatatgttggacagaaataagtgtatgaacttctaagtaccagcctagcataggttatctcatccatttgcattatatcttttgtggcgaacaatatgttcaccaaaataaaatctcagataagttgctaatattaaccttcattatctattacttataatgtacattatattagtataaacaaaaaatgcaaatgtcggaattaatcgatcaactatatcttaataaactatttcttttacaagtacttcaaaacaatcctatagattttagagtccactttttgtatactagatctttttttggtcaaaatttgtatacaacatctatctacttattgtgacatctactacaaattatgaaataaagtagtagttttttttgtcttttattatttccaataaaacttatagtaactaggcaacaaagcgttatgaaaatagattccatcatccctaaataaccaattatacgatgatctatctttaacgaacaaagcttgcgcttgatatgcagtaaaacctataaaatgcttatcactagatcttttatatatatcgctccaaaatcatgtggttctacaaacatttgtcttgaagcttaatgacataacttctccaattttgatatattttataccaatattattgttttttatttacaatgcaattgatgattttcttgcttttgcgactaaattcgttcttgaccgtaaacatagattttttccgtatacatcaccaatatgcaaagaccaattagaaatagaaagattgagaggtctcaattattgttataaaattcttttggtaaatttatttataggtaacttagagagtcttctcattgaagtgttatttatacacacatgctagtattttagcatttacatttctctcttttcttgtaaattttttattaataattgaggtagcaactcaatacaaaactaatgattgatagttgacaaaggatctatgtattggattttttttgtaattaataatagatataagtcattttcgcttaaaataaaaatgttattgtttgtacttactttcttatcgttttatgtattttgagtaatatgtttttgtaaaataaaattattgttaagaatgcacttccaaggctactcctttttaattttaccccttccattttcattatacagcctgaattaattaaattcataaatatttcacaaacaccttcatatatttgccagtcaaggtaataatagtttaattttggaatctaatatttttagattcaattaatgcatgctgtagacatg

SEQ ID NO: 22132 - DNA, 3003 bp, Unknown
  misc_feature (1)..( 3003): 2750-1469P.txt file - cDNA_ID_2047091; gDNA_ID_1620477; Annot_ID_158210
attaaggaaggaagaccatggaattaaaatatattaaagcgactaacacaaatttaaatcataaactaacaaaagaaatatgtctgtcattttgttaagtttttataataaagaaaatatattgacgtatatgtaattttaaaatgggccatgcagcatgatatgcattactaagcgaagaaacaaaaatagaggccgaaacgcggaaaagagctgacaaatcgtaaagagtgtcttccacatgggattaggtcaatttcaccataattttcatggcacttcagagcctattgcatgtggtggatacatataagaaaaataagtttatagttttaaaactaaaattgatttagtcaaaaacgcttaataaaaatttcttgtcaacacataaaaaataaatgctataatagattgtgtttttggatagtatggaaaatccaacaaaacaaaatttagatgatatacgattgttttttatatctgttggcaataaattgagatgtataattgaaggattaggtacctttttctgaagaattcgccataatatatacatgcataatgtcataaaacatggagaaaaatgcccataaaaatgtagattgatgatttatgctatttcagtccgcgttttagtccatatttgggccttgcgagtaatttctgcttttattttcgagaactctgtctctgtgtatagactatagagccaagatgggctttataataaaaagtagatatgtagagggactttttggagtaatcgataattatgaattataattacaaattaacaaaccagaaagtagcttgcatatgcttcacattttagatttccttcagttatcatggtaaatacttaagatgctacttgtccattccataaatgttccatgtcctcgtccatatcttacttagcaaagagtccaaaatgtgggatttttctgtcctttaaaaacttaactctgttttttatataccagaagtgggagaccaaggcaacaattggtaactaagtttcaacttttttgagtttttctctcctgactgaatggctttttaaactttataaactcgttctaatttgtcttttccgtttaaggctttttcgtacgttttgcaaatagctaaacttttgaaaggaaaaagtaacctcgcgtttttctcatttatattgcacagaatatagatacaagttgcagctattactgataaaacgtagctacttttttggttgggtttatttgagccaaataacttcattaaaagctgtagtaccaagtttgggtctatcatttacactgctattgtctttgctatatgactcgaatctgatacattcgatttctaaagattatatctaatttttaagcgaattaaacttttgcaagcttggttttgatctctactattctattgactagagaagatgtcatagttgggtgtagaataaggtattgaactgacttgcttttattgattcattaactatggtatttatacacaatgatctctatcaagagataaacataaatccctaaaatataggttagaaactctatcatcaaagatattgtactaatcctaatcggattacacatatctccaatagagttgatatctattaacggcaaaaggagctaagctgccatgatgacccatgaagtatatgcctgcatgctaatacgcagaaaaacattgaatgtgaaagtggcaattattcgaacactcaaatttttttatcttcctaaaatcgtgctcgtgaagatttttcaaaacaaccgatataaccattggtgtttagttgtttacctttctttttattgcatacgatagcccattcttaggaattaaaccatgggggcaactggcaagcatttataatcattgatgttactttaattttcatttaatatgaatattaaacgtagtagctatatcattgggttggaattaatgactgagaaagaatgaatgaaagagagaaacgtgtactcgcagtagaccatataaccattggtgaacaattttatttggaatcgtatccataaatatcatttttatactagtacgcttgcttttacgactactataccttgtgtgggcggaccaacaatttaagaagggggtgtgggtgtaactggcccggtaaaccataattttgttttggccatgtacaaaatgagtttttggcatacggtgttttgttgtatttgaagatcccactcaatatcatttttttttccccaatttgattaatcatttgctttcttgaaagattattttccttataaggataagaataaacagtttcctttttcatggaacaaatttttcatgtttcaaagatattttcattttgtctgaagtatcaaaacagttttacattattatttgtctttttctgttcaaaaaatttaagcaaattagtatataataaataaacagatttgtgtatagtattgaaacctatatccatgagcaaatgtgtggtatataaattagataacaattcttttttgacatcatataaattaaataacattgaatttgaaattaatcacatttttaaaatgtgattgtacgttatttattctttaaaattatgaatactaattaaccaatatatgtcatcgaaataactcaaaatattgtaaagaaaactatttgcattttacatatagatatcttgtaaagttaattacgatatccatagaaatgttatacaatctttgactaaaaacgaaagaaagaattctaataattaataacctttggtgtttttaatgagagacgtggactctctcggtagaaataatacaatgattaacatacaaatttgtaactatcattagccgtcactcgccaccctcgataggacctatatacacttatacacaacactagccacacacatcctcaagcgataacaccacaaacaaaacaacaaaccaaaaaaaaaaaaaagagagagagagagagcaaatctccatcatcatcatg

SEQ ID NO: 22133 - DNA, 3000 bp, Unknown; identical to SEQ ID NO: 2007
  misc_feature (1)..( 3000): 2750-1469P.txt file - cDNA_ID_2047113; gDNA_ID_1620477; Annot_ID_158205

SEQ ID NO: 22134 - DNA, 3000 bp, Unknown; identical to SEQ ID NO: 2010
  misc_feature (1)..( 3000): 2750-1469P.txt file - cDNA_ID_2047125; gDNA_ID_1620477; Annot_ID_158201

SEQ ID NO: 22135 - DNA, 3000 bp, Unknown; identical to SEQ ID NO: 2008
  misc_feature (1)..( 3000): 2750-1469P.txt file - cDNA_ID_2047149; gDNA_ID_1620477; Annot_ID_158194

SEQ ID NO: 22136 - DNA, 3000 bp, Unknown; identical to SEQ ID NO: 2073
  misc_feature (1)..( 3000): 2750-1469P.txt file - cDNA_ID_2047218; gDNA_ID_1620484; Annot_ID_158418

SEQ ID NO: 22137 - DNA, 3003 bp, Unknown
  misc_feature (1)..( 3003): 2750-1469P.txt file - cDNA_ID_2047224; gDNA_ID_1620484; Annot_ID_158416
cggttgagtatctctggcgtatgggctcatgatgtcgcttggagtctggcgagtgcagctgaagtgacaaggatgccaactgtgacatcaactctccttgaggccataaaagaaagcaggtttaagggtctgagtggtaactttcagttggatgatatgaagttgttatcagacaagtttgagattgtgaatatgataggatcaggtgagagaagggtaggattctggaattctaatggtagtttcagcaatagaagacaattatcttctactcatgacaatctggagaccataatttggcccggtgggtctgctcaaagtccgaaagggagaagtctaagagagagcggtagaaaaaagcttagggttcttgttacatctagcaatagattcccaagactgatgaaagtggagactgatccaataacacatgagataacaattgtcgaagggttctgtatagaagtctttcaggcatccattgcacctttcaactatgaagtggagtacatacgttggctcaatggaactaactacaccaagcttgcatatgcacttcatagccaggtactaagcatggctcgattttacaattgcaagtacttttaaaatttgcgtagactgtgtgtgggaactgacttaattccattgataatttttgttgcatcccttagaaagacaaatatgatgctgctgtgggagatattacaattacttccgatagatcgatgtatgttgattttacgttgccatacactgaaatgggtcttggaattgtagcagcaaaggagagaagtatgtgggtgttcttccaacctctaacaccaaacctttggataacaagtgcagctttctttgtcttgacgggtattatagtttggttgatagaaagagctgagaacaaagagttccaaggatcttggcctcaacagattggagttgtgatttggtttggcttctctacccttgtttatgctcatcgtaagtaccttttcacattcttatataccaatttggccataagagaagagattgtagtgatgcttaccttttgttgcttactctgtgtgacaggggagaagctacaacacaacttatcaagatttgtagttacagtttgggtatttgcggtgctcatattggttacaagttacactgcaacattgacatcaatgatgacggtgcaacaaatacgattcaacgccaatgaagattatgtgggtcacctctcgggatccctcatcgcaaatgcggccctcaccaattccagcctcagagcaatgagattattgggtctcaatacttcagaagattatgctcaagctttgatgaataaaagtgtctcatatattgttagtgagttgccatacctgaaaatcctccttggcgagaatcctggacattttctcatggtcaagacacaatctaccaccaatggttttggcttcgtatgtatccttcttctgcatcatcagttgctttactcttgattttacttgttgaaaaagaaatgtttggtttgttatactatgttccagatgttccagaaggggtccgagttggcgcctaatgtgtcccgggagattgcgaagctgaggacaagcgagaggctaaacgagatggagagaagatggtttgataaacagcttccatacacaaccgatgatacatcaaatcctataaccctatatagattccgtggtttgtttatgatcaccggagtttcattcgctttcgctcttgcagtacttctcattctttggctccgagaaagatgggaaatccttgtgaattcggtcaatatatacttctcacaacgacttagacatttcaggatcctcttcacaagaactatccatcctagtcccctcggcctcgataaccccattggcgagaatgcggttcaaatggctcaacgtaacagacgataggaaatgagtaacatagagagaaaacaattgttgtgatgtggtacgtctctgactctgaccttggagcagcaaagaagatcctccagtgatccactagctcctgatccaagccggcttacgtctgaaagtataaatgattgttataccaattttgtaaattatagtgtgatcatattcgcaaccacttttgtaaatagcaaaaaggtattggtaatatattgagttaaaatttaacacatttagtttgagtattttttggagaatatgatacttttgcaaagaaaaaaatactttaattcttcattttataaaccttaaaaaatgtaccaaactttaatcagtatgtaaaagactcgtgcatttcgtttgttggtatttgtgtttaatttcttccatcaatttatttgagatgagacgactttcaccatttttctctgcttctagatttatatctttgactgtctaaattgtcaaatcccttacactaagtacttttgttgatttgttcttgtcaacacaagttaatacaaccccaacaaatatggagtttttaaccaaaaaaaaaacaaatatggagttctacgtgtaaaaatttcagattaaaacacatttgttcctacgaccgttgacaaatgtttttttttttttaagacaaatgatttttttcttttgctaaaattggttagttgacaaaattttatcctatagaatccttttcgaatttattccgtatttttacctttttactttcttcaccaaacattttgatagatttagtcagattctcttaaataatgaaatgatttgagagacaaaagagtagccaaactcgatagcccataccgaattttacgttgactaatgtaatttttcttaaaatcatgatgtcatcatcttaaactttgaatttttcttcaaatatagtacgtatgttaatttttaaaattggaataattagacagatgaaaaacaaaacacggcatgggtttatataacaacaaaataaaataatgactaaaagcagcaaacgtggggtttctcctttctctctagttggaaagtttttttaatg

SEQ ID NO: 22138 - DNA, 3000 bp, Unknown; identical to SEQ ID NO: 2067
  misc_feature (1)..( 3000): 2750-1469P.txt file - cDNA_ID_2047242; gDNA_ID_1620484; Annot_ID_158411

SEQ ID NO: 22139 - DNA, 3000 bp, Unknown; identical to SEQ ID NO: 2078
  misc_feature (1)..( 3000): 2750-1469P.txt file - cDNA_ID_2047274; gDNA_ID_1620485; Annot_ID_158464

SEQ ID NO: 22140 - DNA, 3003 bp, Unknown
  misc_feature (1)..( 3003): 2750-1469P.txt file - cDNA_ID_2047282; gDNA_ID_1620485; Annot_ID_158462
cctggttattgtttcagcgatttttttgagtttgactacagacccttactccttctcaacgtcattatgtcttgtgacaatgaccaattttccacttctcggatcgaccgaagttgtgtctccgatttaccttcttctcgtatgtggcattgtgttctacaacttttgtctccgagttagcatggttttatcatcggactattgtatttttatctttattgcttttatttttgttgtactaaagtctgagaatgatattttcttaagctttgtactaagtttgagtgattgaacgaaaacaaagtttattgacaaaaaaagaaaaggaaaacggatagctttcttggctgaactatagcaaatgcaatttgcaatgttttaagtcgttaaggtactaactactaatctcaaaagatgaaaaagattatataagtgaataaaatatcaccgcaaagtgtttatatgcatactttatctttcaaacataccagtttccgataaatatacaacaaaccttgtgtttacgatgtaatggtgttctcaattaaaaaagaaaagagagcacttttctatataacaaatacaagttgagaaaaaagccaaaattgactggaccgaagctgtaggagaatgggggcgataggaccaagggagagttacaattttatcacaagcttgtgtgtgtatgttttgtttcttttctttaaatttggatgttgacagctttaattttttcctaaaaatatacactagaaaattagagaatatttagaaggtgagaccagcgaatgtcatgccacaaatcatgttcataatgttataccaaataatcataatgtccccatgtgacgctttacttttctatattatctcgtaaccccactcatacgttttagaagaattttcacacaactaagataagttgatttttgaggcaaaatattgtttattttttctatcaataaatcttcgtaagactttccaataagagaacatttttcttattcctctcgtgacagaagcaaatcatcccatccacacaaagtcacaatccaagacacaagcccaccaatagagactccatctcctcactaaattcatctacaatagtaattcattattgctattatgttactataattgctttaaaattgtttcctatgaataattgaatatcataagcaatatgaacaaagaatgatgttcaaatcaaaattcgaagataaggatataaagttataatcgtgttgagtcatacacttcgagctaaagtttttctttaaacaattgatttagctaccacttaatctagttggtactgaacaagtaacaacataagtagaagataaagagaagagaatatcttactttgggactattagccatgatgtccacgaccaaatcggcctcctcaaaatcaatttttgtctaattttgtaatgtgagactttataacttttccataatatatagcggacgttattattttactcaaaattgtatgtggcttccatttgactactaaatgaacaatattatgaaacaaataaaatgaacaaaaaagttgaacaaaaaaaattatttgaatattttatttagaaaaaatctgttcaataatatgcaaaccaaaatatctccggcatgtgtaaactaaattgactatactaatttaacaaattatcaccgcaattacgccgcgttgaatttgtttttccttagatttggcgtgggtcatcgaatgtttaattaaattaacataaaaccaagataggccattgaccaaaatacaataatattttcataaaaccttatattattttctgaagagcaaaaacattatctgagaatctggagataaaattgacgtgacattaagaaccttaatcgaatttgattaacaaaatatttctttgttgcccgtttcaattttagtggattattttggtgtaacttgacattttagataattctattaataatagattaggggaaatgtcaatgtaataggtggcctcgaatttgtgttggtgcactccagctgtcttccttcgctttggagcaagtagaatcccaactattttctccacacttaaaaaaccttaaattactcattctcaatcttatattttctataaacgcaaatattttatgaaattttatactattaataatctaattccctaaatatatatatattttgcattttttacatcatatctttttttgcctaaaattttatacgagaaattttatactattaagaatcttattgcctaaaattaaccacttctttttttggtgttctatttcatgcaccgatattaaaaatcgtaggaatatcgatggccaaaataaaataaaatggaagaggatctaaactttgtattttatactggtcctagtcctagaaaatcgaattattcagtgttttcattaaatgcatagttcaacatattatttggcatgatagattgtctgcaaatgacacatcacttttcctttctgcaaaaataaaagactctataaagtaactttagaatttattcagttcctcaactcgatctagtccctttaattaagcaaacataattatttaaacaactcttttgagaaaacattttttctctttggtcaaataacaaaacaaattaattcttatttctacattcaattaaaaacataccaaaacatctattaacttcttaaatattttttctcaaatttgtagtccaaaaaaaacacgacgcgtatgttttttttgttgttgttgtgtaataagaagagaaagaacgtaaaagaattgacgcggacgaatcgtgttagacccaaaaagaacagctttcaattccattgtccaaattccttatcaaaaaaaaactctactctcggtggcaccagatcactcctcctctctcttctcctacctttttcacattctcttcttcttcttctcgtgagaaaaagaaagagagattctttattcattagatcgaagcaaaaatg

SEQ ID NO: 22141 - DNA, 3000 bp, Unknown
  misc_feature (1)..( 3000): 2750-1469P.txt file - cDNA_ID_2047293; gDNA_ID_1620485; Annot_ID_158458
attggggagaaacgtaattacctctttttacagtttgaaaagaatcacaagtaactcttttctaattaaatgttgaagaaactttaaaggaaggagtgaagtaagagggaggacatctttttaaatgtagaaatgggttagatctgttgcagtagtctgtggtagttgaattggcaccattctaatttagctactcttgatttatctattttaccagttctatatccacccacttatattcttatttttatcaacctaaacatgaagctgccatattaaaaatagagattcggacaacaaatcttgagtttattctgatatatcctaaattttattttcattaatttcaatatatattattctgtggtctctcataaacaattaaattttataattgtcattgaatttctagcagttagttatttatttctaatacaactataaagttattactaattaatttgtgtgctaataggtggaactatttaaaattttaaatataaatagatctatggttgagtatatccagttaaacttaatggattcataggtcgaatttcgattatattttaatctcaatttaatagaaacagttacgataaaaaaaaaatgtagattgcaaatgcaacatatatatcttgtattgtgcatgtggctaaatatatattaggtgttttttacgcccggtatatttaccaatttagttaattacgttgttttaactatactatacatggttaaaatgaaataatgttgtatctaaaagaaaacaaaatttaaggagagatttgttttttctaaaacaataaaaaaattaaaaattattcgctgatgaagattcatgtttagggattactttcactttcaattgaggaagtagacagaactgaagttacatgaaggacatagatatgcaaccggtaaaaatgttagtagatcgagatttggtaataaaaaagatgaagctaatgataatttctacgatgttcagtaactcatacctcaaacattggtattacgaatgtactccaaagttttagttacttccctatcccaaacattagcctcaagttcagcctctctatctgatatctcggagcaaaggcagcatactgatacaaaccaaaactgaagatgagtgggctttagtggggctttgatttaggcttagtgttaagcccaatttccttttattgtcttctacttaaacttttcttcttcttatcaaattttggtcaatatcggtcaacaccggttaatactgggtaatgccggattctggtcaaagtaggatgtcgtgtatgttcgtatgtgatgtcaatatttcgtgtagctaacgagacatttttaaagtctgcatgtgtggcgatgtgttggcttgtactccgtgtagctgataaacattttttctatcgaaaacgatcaacaacaatatcaatctaaatttctctcttatctctcttcttcttcaccgtaaaggtgcaatacttctctccctccatttctttctgttcttttcatcttagataagcttccggagcttatcacgtaccttcggatgatagattggaggacatagtttccatagcagtcatccatcaagcttccaaaacacaagagagcttacgcaatacgaatgaggcagtagaaccagctccatattcaacaacaggtcttacgagaaaatttgcatacttgtgtgtggcgaaatggggaaaaaaaccggaaatctcttggaccaacattggcgcaacatctggtttgtgagaggctattagaatctgaagcaaatggcaactacaaaaagaagagaatattcactataatgtcaaagaattgaatgaaacaataacgtatactccctctgcttcacaatgggtaaatgggagataagagcgatcaataactgaggacttgcaagctttaagaggatcttcacattgttcaatccattactgtgactcgtaagagagatgagttgttgtagtatgatcgacaataatggctcaaactgatcaaaagaaaactcatgaaagattacaaaacaaatgatgtagttgaccaccgacaaagataaaactaagtaaagttcgtataaaataaagttattaatttgaaatttctgaactagaaagagataaaaaaataaagaaaataattaattatgtgtagtatgcatatgtgtctgaatggatcagtaacatttggctacctcaatcaaatcatcaaatcaattgtattattatagaaaatctgaagtattaaagtatatttttaaattctaatcaaataaactgttcaaatttaataaatcaacgtattttttctaatttaaataacaaacaatcatgaatagtttatttgcttcaaaatttgatttattaaatttgaatttcgttttcctatatgtttgatttatttatatataacactaatggccaagtttttaaatagtctactaaaaattagataattatttaaatagactaaaaatttctccaaaaatgatacatcaacatgataattttgttttaaaaaagataatgaaattttaagaatacttctcatttaatctataaggtattttacggccgtagctataattttttattttaaaaaagttagttaagagtgaaatgagaaatataattgtaatttgtaatagtgattatatgattaggttaatcaatgaaataatggggcaaccaaagcttagctgggtttaggaagacgccaggaaagtaaaaaaacataaaaagtcaggtaggggtaaattagtcttttcaaataccatgaagaaagaagagacgccaaagaaaagactagtgacgaaagaggaagacgcggaggtactctcattctctaatctatttcttcgatagtgttgattctccgcaaaatcctctcgagagaatctttcccaaaagagattagatttggtggaagaaaagagttcttcgtcttcttgttgttgttgaggattgaagaagaagagaaatg

SEQ ID NO: 22142 - DNA, 3003 bp, Unknown
  misc_feature (1)..( 3003): 2750-1469P.txt file - cDNA_ID_2047299; gDNA_ID_1620485; Annot_ID_158456
accttacacccatcgttacccacctcctcggcgatgaacaactccagtttctccttctcgtgtcggcgagaacatcggccttggaaccttattcaacgtcatctcgtctcttgacagtgaccaatttgttgtccattgattcgttcgtggaagatccttcgactacccgtgacctcacatgtgccatcatgccttatagtttgtggctcaaagctctcatgaattttatgtcgtttcacattatctatcatatcttggttttggggaatgcctcttttaattatgttttaaactttgtgatctttgaatcactccttcttatatttgttttgatttgaataaatgaaaacaaatctttgcaaaaaaaaaaaaaaaagattatatcgacaatgatattgtttaaatatatcagtctacatttatcatcttctctgttagactcgtcgttaaatttctatttttttaatagtttacacagatgttttcatattctaactatttctttatataataaatttgtatatctagtagacggatcttcaaaaaaaaaaacaagttctccccacatattaatatcaaaaaaattcttaaataccttatcagcattttagatttaattatgagcaaaataaatgtttagagatatgaaacttaaataattgtatcttattctcaacaattaacgaataaccaatttggagacaaatctataaactaataaatcttgcttctctatagggtgcgcttttgtccctgttacgtatgaagtgacgtataatcgtctactaaactattttatccgtacgacatcagtttcctataatatttgtgtgacactataataaaaatgaaaaatcatgttcgtcgtatacctgaattaagcaacgtataatgaataaactttccataaatacaaaaatactcgattagtggagtgtgcatcgccaacaaaaaagattctacgcaacgtgtcgaatcagtacttgttcctgagttcctccgtcactaaccagtgcggaccatgtcagtatccaagcacccacacgctcgtcgtctcttgaaaacatctcacacaaatacacaacggctcggactaataacttgccatctaagaaaagctaattgacctaaggctttgtggcacctgcatgtaaaaagcaaacacgaatttgccacgttattacaaagcataccacgtcaccgtctcactgttacactatctcttgttctcctttatttcgctatggacaacaaaaattataaggtggggaagagatgtctcaaaatacttttttatcgtcctctcaatttatgtaactgataataatcgaaatagataaatttaattgtaggttgacaaagcgctaattttaataaaaacatatattagtttggaaaattttgtcgtagtaagtaattaaacctatcaatcttgactaataatttcaagtatcccataaaaatcaaaattgtccttaggttttgaaattgtactactgatagtacgtaattaaacaaacaaaagctatagcttgtggattatagctaatcccatttggcgatgagagtaatatatatattgttcaaataaagttgtaattaagattcgattgaaaaggtaaattatagtttaagaaaaacaaagagaggagacaacaattaaaaaaatgaaaagtggagaactgtactctcgcctatacgaggaggtcattatctccaaggctctcaaggattaaggaccatgctttgattctataaatgttgttttattcaaactatttatattattatatcatacgtaatatgtggttagcatttgacccacgtccccttaattaagtctagattaatcccattaatctatccaattaataattaggaaaattttatataagattgctattggatttctcggtggtggtttaaactataaaatagtaatgcctttgatgcgtgtgattttttattggaacttattggttttaattcttaacctagcaattatatttgtagtagtttatgttaatcattgtttaataatactcctataataactcttgcaagtagcaacacttgtgtggctatttattccagagtccatggatatgtatgtataagaaaataggagtgcttttgcagattgaagagtttgtctataaaatcatgtttacttggcatttagtgttattgtttgcaattttttattttaaattagtcggatattttaagttaaaatctgaatacacagcatgttccttctaacgttttttaacataattgtaaactaaagaaaaattataatataataaattaaattataccctctctattcattgtagaagatttgtttgtttcaccaaatgtgttttttttttataagttgctctcactcttgagagttttggagtattttgaagaggacgaggttcttttgtgaaaaagtgaaagaaacaaatcatgtcaagaattagaaagaaatcatgacaaataattttgtttgtgcagaaattacaaatgaatcatagatatccttctaattcgggatcggaaaccagttgaaaaatcgatggactaagctttctatattgggactagcttacccttagaattagtcaagcagcttaaatcatctatgacttaaaattataattaagaaaaaacaatgcctaaatatgcatatatttcaaatgtatcacataacttgtgacataagaaaatataaacaaaacaaaaagggcaaaaaagacctgaaagcttagaggcacacctgcataggtcccacagttcactcgtgacaccgtaaaaggcaaaacacgaacccgccacgttatcacaaaaagcaagccacgtcaatatagtctcactgtcaactacacttaacttactattttcacatctcattttcctatctttatataaaccctccaggctcctctttaatttctttaccaccaccaacaacaaacatataaaccataaggaaaacagagaaagagagagatg

SEQ ID NO: 22143 - DNA, 3000 bp, Unknown; identical to SEQ ID NO: 2079
  misc_feature (1)..( 3000): 2750-1469P.txt file - cDNA_ID_2047315; gDNA_ID_1620485; Annot_ID_158451

SEQ ID NO: 22144 - DNA, 2400 bp, Unknown; identical to SEQ ID NO: 2076
  misc_feature (1)..( 2400): 2750-1469P.txt file - cDNA_ID_2047330; gDNA_ID_1620485; Annot_ID_158445

SEQ ID NO: 22145 - DNA, 3003 bp, Unknown
  misc_feature (1)..( 3003): 2750-1469P.txt file - cDNA_ID_2047358; gDNA_ID_1620491; Annot_ID_158622
cattactatgaacaatctctcggcttggcaaatctaagttcccgaagatagagtcccatattcgaatacggttgtcctgacacgtcgtgaggattttcgtgcctgatgatggagagaagtaagcagagttgactactcgtttgtgtgcaagatcatgaagagaagctttaggttgtagtttacgcatatcccagattcgcgcctgaaaccataaccaggaaaatctattaaacaagttctgaaagaattcagataaacatctaaacgaatccaaagtgacagcatgatcttggttttgtttgatagacttacaaaatgatcgttcccacaactgagaagaagctcaggctggacagggttgcagtcgaggccacaaactttgcttccttgcttgtgtatcagaataggctcacccgtactgttattggtacgatgatcgatccttttacaaaagcaatcacgagaaaatcagtttggcactcatttaaaacagtaacaaagaggctagtctataaacagttcaaggggatgaaatcacttacatgtgaagaaacccaaaattatcagcagcaagcactacacctttctccgagtttatatccataccgtacagcattttccaactgtttgcgccctataaaccgatgatatgtcgtaataagttaaatgaatcagagaagacaaattagagaaacgagacgatggtgtgacctgccatccatcagggttgagattcagcaaagttgatgaagttccagtttccaggtcagtataaccaattgttccatcagaggatgcagaataaaccatgtcatcatttgtgggactaaacctgcaataccaacaaaagaagataaatttgataaaacaaaagacatgagcttttgtttccagatactataatgcagaaagtaaaaccacaacatatactgtaagattgaaagccagatttaaaaacttaccgcatattattaacttgaacagaatgtatgtttccatacacattcttctcatacacttttccaaaatcccagactccaatttgccctttcttcagagcattaaccataagaccaacaacagaatcgaataaaaacaatgagaaaataaacgcagaaaattagttacgtatgacttttgtttcattgtaaaaccttatctccagagagaagaatgttgttctttgttggatggaactccaaacatgtaacacgtctgctgtggtatctaataactgcacaatgaacttgatccgggatcacatattttggtttaatctgtccagcaaaggaaaaagagaaaagatccagtcaaaaaatctcatcaggtatcaaaaaatgtttggcgcttgaacacgtaaggacttacaggaggaattctcggttggagttggcgcttgaacacaaagtcaatagggttctttgtattcctatgagaagttgggagtattccgtggtcagtaaccactctatgaggacaggacattgtggtgtggccttcaagtgatgcagtagaaagcgaaaacattgagtaaattaacattttctccactcaccatcatcaaaaagctcacatgtaagcaagaatcgataagaaatagcaggagctttaccaggcattttacacaagaagcaaggcttcataggacaatcgatatacgttgctcctttaaatccagcttcatggccaggctgtttacaaacctataaaaccaccatgaaacaacaacagatacgaaacaatcaaagccaaacaccaaaatcctctgtctctgcatccaagtgaagaatactaataaacaataaagtgaatttcaggcaccattataatgggaaccaatacagtgaatacttctaatatgttcgaaatcaaaatcaaaagtcattacttattccacataagcctactcagaacttgaaatcataagccaagtaagaaaactcattagaaaagttagggtttttagaatagcgttactttgcaaactttcttaataagcttaacggtaatgggtgctttccctttggctttattcttctccaattcaattttccctccatttttaaccgcttcatcttcctcctccgactccgagaaagggtaattatcttcctcttcttcttcttcttctgacgaacttaactcggaatctgtatctctagcgatgacgatttctgggtccctttttcttctgctcctcgttgaactcattttcggtaaaaatctcacgacccgacaaaaggaagagagtacgaatcaaacagttttgtttctttttgggtttgatacgacgcagcggacacaaactaaagccggttaggtcgatgaccggtttaattatttacgcggataaaaacacttttactcccatttagatttaccattataccccctccagatcttgtaatatgttcctgtaataatgtgagggtatattggtatataactaactatctcgtggcgggagaggttaagacgtggcgaattaccggccggaagcaccattcacgtggctctcacgagcaatactagtattgggcctttttattcagataagtaatgggctatggcccaattttcatttatcccatatttaaatttgacttacaaacaacattaattgaggttctttgctggtatgttgacaaacaacattagttgaagttctaggaggaggttttaatgcatttattttctttaagaaaaggaaaattaggagacgtggacgaataggaactcgtataaaccacacaaaaaagaaataaaaagacaggagcttggaatttcttaacgataaagtttgtttgtggcgctcaatttcgaaaaaaacatgtcaacatcatcttcttccacaccgacaaaacacgtcgtcgttttcaaacacttaccagaaccatctgtggaggaaagaaagttccaaccttctctgcttataatacaatacttcccctatgctatcaaacctatcacaaagcctagagtaaaatcgattctcttaagatg

SEQ ID NO: 22146 - DNA, 3000 bp, Unknown; identical to SEQ ID NO: 2123
  misc_feature (1)..( 3000): 2750-1469P.txt file - cDNA_ID_2047385; gDNA_ID_1620491; Annot_ID_158612

SEQ ID NO: 22147 - DNA, 3000 bp, Unknown; identical to SEQ ID NO: 2131
  misc_feature (1)..( 3000): 2750-1469P.txt file - cDNA_ID_2047393; gDNA_ID_1620491; Annot_ID_158610

SEQ ID NO: 22148 - DNA, 3003 bp, Unknown
  misc_feature (1)..( 3003): 2750-1469P.txt file - cDNA_ID_2047397; gDNA_ID_1620491; Annot_ID_158609
atctgattcatgcttgaggtcattgcttccttgtagtcagatacatgaacatcctaattaacattgtcataagtttcagtgtcttcaataagcaaatcactgcaattagacagtttgagattttatttcataaaaacatcatctctgtgactgttgtttgcactgattatatctcaaggcttattcctgctgcaatgtctatacatgtatatgattttcagttcccattgactattgatttttataggattcattatagctgcaaggtgaataggattttagagatgtgtggtcgatcaactttgttgattggggatgattcttagatgctagaaaacctgaaaggcctgactttggttcttatatatgattatgaatgctaaatgacatgacttctttggatactgttttgaacttctccgcaaaaggcataagtaactctagctttctttatcagtgtgactggtgttcatcccaatttttttaatttgtaggggaactgcagtcaccatgaagaagatgttagagacggcttttcccggtttagatgtgattctcgcaaattacccaccaccagcaccaaaacgccttctagctaaggttgtgccggttgttcagatgggagttattggtatgatagttgcaggtgatcgtatccttcccatgattggaattacgaacccacctgcttggttccactccttgagggccaacagatttggatccatggcttccacttggcttatcggaaactttctgcagtcttaccttcaaagctcaggcgcctttgaagttcactgcaacggcgaaccggttagtaattaatggtttaagattatttccagatatgtaagatcagtttgtactaaatcctgtgtttctatttcaggtgttctctaaattgaaagaaggtagattcccaggagagatcgagctgagagatctcatcagtaaaactctaacacgaccgagcatactcacaggcagcagctactgaagtagtagtatcagaagatagaaacgctggaacctttccgtgaagttctcacaagtatttttaatacgagatggtggtacaatctcatgtgccaaaagtgtcttctatgtttcagttaatctgttgatgtagcataccttggtttacctagagtgaactcttttgattcaatcattttgcatagacacaaattggaaaataaggtacaaagtcattgccataagaaaaaaataaatgaagttgtatggagattacgagaaaatatctatatagacagattagagaaagctatatgaactgagatttaatctcagacaaactgaaaatgtaaacaagaagagttctttccttctgcgttaactaaaacattacgtcagcctctgccgacgacacgttggccggttgctgacggaggaacgccggggtcgtgcttaggatttgcagatgggtcaccgtagtcctcaacgttcaccatcaacaaactcctttggaatccagaattctcaaacccacctaatccaaacgaaatcattcagacatagagaaaaacatgaacgaatcgaaggaaggaaacaagaagatgagattcgaacctgaaacggaaacagggttgcgggctagagaagatgtaattgtaagcgtcaataagagacacacaagaagacgaactacaaaagtcatatctctctgtctgatataattaaaagaatcttaaaaatgcatcggttacagattcgtgtccgtcttatttataaagaaacgacaacaagtgtgtgtttatccaaactgattttacttgtctcaaatctcaatcaaatatatatacgtttcttataatgcggagatgatgaaaacaggtcagaagagtaagaccatgtagatgacgacacgtgtcagctaagaaggcgggagtgggaggtgacgtgtgcaacgcgtggtgccacgtatgtcacatcaaggccaagcaagtggaagtgtggaggcacacaagacagtgattgtcattttgtgcaaatcgtcaacgcttattaccaaattttaagatcattttaccaatttctcccactcccaaacttttttgttgacttttttctttctctttatggggtttcctcgaacttctcgccagaaaataataatttatagctcactctcctcactgttctttctaaacgaggacaaaacatgtttactacatttccaaaagtcaaaatatgttcatgagacagttttaaccaaagtaagtgaaattcgtaatgagattggtacttcaccgattatgccttaccatgcattgtactgccctccagtaattgtatttagaaaaatcttttatttttaatgtagttgtataatttgctacaaagattttccgtgggttctattgggctccttaaaacctcatattggatccgactaatggtgattggtgatacgcatcaaacatgctctcgtcaaattgatagatttttggtttctgttggatgaattcaaaatatataagaagaagtagacaagattatttacaatataatacagtacatatttactctacatctgcttatataatttcgttgtatagcagtatcggtataattacgaataagttcttttaattttcatttaaaaaccaaaaaatgttttgattaatttagaaaaatattgaaactttacgagagatgggccgacaagtaagattaaatggtacacgtacccacatcgcatgcaacttggtctcttcgtttatacagaatctatgccttatttgtgttacagacataaatccgtgacaagtgacatcaattcattagggaatattatattataaggaggtgttgatctatagatatatatattatggaaaatttatcattttttggaacgtaatcctttgtaactaaatgcacctatagatacacatcaaacacttcatttgttttaagtaatttaatagactttttaaaggataaaatcgaaagagatctcaagagaaatagggagagatg

SEQ ID NO: 22149 - DNA, 3003 bp, Unknown
  misc_feature (1)..( 3003): 2750-1469P.txt file - cDNA_ID_2047406; gDNA_ID_1620491; Annot_ID_158606
tatcggagcaacaaccacacctcctttgagtcctaacggtgtatcctctccaataggtggaggaaaaacgtggatgaactggcctaacataacccctcctgcattgcagcttccagggagcagattgaaatctgcattgaatgcaagagaaatcgatttctctgaagagatgcaaagtcttacttctccaactacatggaacaacacgccaatgtcatctccattctccggaaagggcatgaacaggcttgcaggaggagcaatgagcccggtgaatagtctcagtgatatgtttgggacagaggataatacatcgggtttgcagatccgacgcagcgtcattaacccgcagctgcattccaacagtctttcttcatcacctgtgggagccaattctctgttttcgatggattcctccgcagtcttggcttcaagagcggctgaatttgctaaacagcgaagccaaagcttcatagaacgcaacaacggactgaatcaccatcccgcaatctcttccatgactacaacttgtttaaacgattggggctcattggatgggaagcttgactggagcgtccaaggagacgagctacagaagctcagaaaatccacttctttccgtctcagagccggtggcatggaatcaagactgcctaacgaagggactgggctcgaagagccagatgtctcatgggtggagccgctggtgaaagagccacaggagacaagactagctccggtttggatggagcaatcatacatggagacagaacagaccgtggcttgaatcaaaagttttgaactttcattaaccgttccacaagaagcaaagtcagaaagattccgagaggtcgatgctaatctatttcattttatttgtttaatgctttgttatttttctttagaataaaaagaaaaaattcttaggggacaaaagagagttcgtttgtctctctctctgtctccaaagaaaaacagaggtgaaaaaaggtttcaaaacctaagaaaccttgaattacctcacctcacttccttgattctttactattcacaatgagtaatcgatttttttttttcttggtaacactctcacgctgaatatatatgttttttagtaataatataattggaatacagaaatgtatttacacttgtgaagttagggaaagtgttgtaattgtttcttctaagagttgatctaagatgtttgagactatatcttcgcttatgattccttctatatcttcgagctttaaagcttttccgttaaaccaatctgaaccttcaaggtcagatacagtgagtttgcagatcatgagccacatctcttggtagccatgaagtcggatttcttggtcttttgatctacttgtcaatgtgatgtgatcttgttcaatcgtttcattgagcttactagattcaagttctgaagacaaccgtcttcttgaaatgtttcctgttacaaggaaacaagtatgctttaataacacaagaaaggacatttcaattttcaatactgaagaattaccaacctggtgatggagttactcgaacaccagcataccggtcataatcaagaaccgagacagggctcgaatcatcgcagcttccacactcttcttcttcttttgttgatctcacttcacaatttactaaatcttcttctttggaccaacaaccattactttggacccaattctccttctcgatgttctgtctcaacttagtttcttttcgttttcttctgctcttacgtttctcctttctacgctgcatcagttctccaatctcaagcctctcacgtcctggtgaaacgttcatggcattgatgttgttctctttaccctctaggtgtgtttgatcctctgttttgctctggttctctctagtatctctcctcttcttacaatttctagttcccagctccttatcatttttatccttctcgaaactgagaatgaagaaatcatcatcttcaagctcaacatactcaagagtggacttaactcttctatgctttccctgaatctcatcgtcgtccctcttcaaatgattcactgaatggctccttgagagaaatctggttttgtcgatcacgggaattgagtccaaacccatgagcctcgccacagctcctggcccatctcctctgcctctgagtggctcggggatgaaatcacgagacttgaaactgggttcagtaattagatcagatgggtaggtagaagaggtgccggaacagagaaatctttgaagaatgatagagatacagccgaatgaccgagtcttcgagccgagtgagagagaactagccggagaaggcgatgacttcatcttcatggtctatagtgtcagtgtttcgaaactaacggagaagtaacgcataaggaaaataacttttgtctttacttttttttttcggttgagtgatgatggagagcaaaacaaaaagtgtgaacaaactcagagcgggatctagaatttgaactaacattctcagtcaaaaacaaaatgtaaatcagctttttttgttgtactttttgtgattgagaaagcaatagacaacagttgagacgctgtgcactgcacgcgttttgacaagtcaattcccggagaaattcatgtcgtccggtgccgcttttttataacaaacctctgtcacttttgttctttttagttcttgaaccgagtcaacaagaaaaaatagttgcggatcaaatatttgggccgttttgatacttttcagtgggctttatgttacttctattcattcaagcgggggtgtaagtgcaataaaatataaatacaggggtatttaagcaaatatttcaaaatataagacgtcaacaacaatgagcaggataataatattccagcatccaaacaagtcttattgaactctctcgttccgtcttctccgattcgctttacactacttcttccctcgtctctctctctcgcgcttcactgtgaattaatcgagagatctaaatatccgccatg

SEQ ID NO: 22150 - DNA, 3003 bp, Unknown
  misc_feature (1)..( 3003): 2750-1469P.txt file - cDNA_ID_2047440; gDNA_ID_1620491; Annot_ID_158594
aacgcgtactctacaaaggttaaagctttatcaaggtcagtgacagaagcagccaagcgagcctcacattcagacttcagatcatcgcaacagaatttgctggctaattgaagcagctcaaatacagtttccacacgaaacagatcaactcttttgattctactatatatgttgagtgccaacattgcctcaatagagatgccattttccgagaaatcaatctcagaagttgttgattccacgaaagaaccatacaacatggcctcaaaaggacgcgaaagcgctgcgattctcgacctaacacacttagccttctctgaacctacgcagaaggaaatatcgctaacctcatctagacccgaaaactcatcagccttagagattttaacgtcatcactaccaaattcatcctcacataccgtagaacattcacaaccctcgtcgtctacattcaaatcacaaccatgagtcaaactagtcttcggacattcagaagcaagcccattacaatccatagattcaactcccacaagttcatgttctctcctaaaaaatctcaaccaagcagagaaaacaaccttacaagggacatcaatggcgtgcctcctagcgttgagaaggcacctacgcaagagcttggcatcaccgagactgcggagaacagcgtactgctcaaggtagagcatcgatgcctcggattccgaactggactcgattctccgatatagatttgataatgactccaccaaatcgataggtttgaggtaagagtccaagggaggctcgaggaggtctgtggtgggaaagccatgagggagaagtgaacgagatttggatttgggatgcccaaggaacttcatcattcgagggctaccattgctgcttgtagagggagagtcttgtgtagtaaaggcgtggacttgagtgcttttaaatctctcaaagagtttgagattgcgcattttgctatatcacagaaatctgagaaaagggtttgattttgaagtaaagagagagtgagggagacggagagagcaagagagagagagagagagagagagagagagagagagagagagagagagagttgaaaacacaagctctgtctccggtgacaacacacagtgcagagacaaaaaggagagagagagagagaggaagaagaagacgatgaagtgtgattgagaatataaattatttttataaaaaggtcaataatttggggagaaaaaagagtaatggcgtcgatttttgcaaacccaaaaaacatttatatggaaaaaaaatggtcgaatctcatatctgtttttctttcttttatgcatttttttgtggaacagtttacgaacttcaacagttggtggttcttattgggtgcgatacgaaccagaccactttcctttctctttcctttttgtgtaaagaccactttccttttttaaaacaatattttgtttctgtttttttggtgaggaaatattttgtttctttgttaaattgttatttttttccatatttgaagatattggtatggcttttaatttgtgaaaatttgggtttattacagagttatatgatgattaaatatagtttagagaattatagatggttggttcgtttcgggtataattaaaataagcctctctgactatccaacgtcattgattcatgtgatgccaagataggtaggttaactagttatgtggtttcttatcggttatctcctatctaaacaattgagcttaacattaaactttgaagatattaacttatctctctaatgaacgaaaaaaattcagttttattggttgattggttatgatttcaatgactaacaaagaaatggtctttaatttatgtacagcatgaatttactcaatttattacatacaacatgatttcaaaaaattgcttaaaattttgcaaaacatttctttactgtgatcacactaatcatttgttaatctggtgtctacttttttactcgctaacgtgagcgtgtatatttatattttctgagatcttcatagttttaggtttttagcttgtagttagttttttttgttctcgatattggaccaacaactatcaggaaacgcataatttattatatatataaaaaactctcataaaacgtactgtattaaaacaataacaaataaaaagtggagagaactatatccagaaccaattctgatgttcttttgcccgcacacctggaaaacacatgcaagtgtactctttaaagataaacatatataccatttgcgaaataattgaggattttttttcttttgccaacagataaataatataagattgtttcagaaaaaaaataaagatggataattgaggattaggttggcattatttgatgcaaaaaatactaaagaaaatctcacattgaaatcaattaaaataattttcttatggtatatacaagttgatgcaaaattgataaaagattaaacaaggcaagagacgtgtggtcatgtgtctcggcaacccatgtgagggaatctgaatcactttttttttttttttttttatgtttctcgaatctgagtagcacaataattgaattgtgtttcgtaactaaattagggatttattaatcatgaaaaattatttgatgaaatcaaattgtggtccgtctagttgacttataccagcccaaattatttagcgaatataaagcccaaactaggcccacaataacaaattatgcgtttcctcaaacgaacaccaccatgtcatgaaccattctagccgaatccaaatagaacgaaactaaaattgctttaatccatatgtgaccagataaagtaaaacactccttttggggaaataaatatccacttttcaccatctttttggtaaacaataaaacaaaccaaattttgtgtgcttgagcaacaacaactaccaaccagttactgtcaaaaaaaataaatgaaaacgtaatcgaagaaaaggtcgtgttttctagtgttgcagaaaatg

SEQ ID NO: 22151 - DNA, 3000 bp, Unknown; identical to SEQ ID NO: 2120
  misc_feature (1)..( 3000): 2750-1469P.txt file - cDNA_ID_2047453; gDNA_ID_1620491; Annot_ID_158592

SEQ ID NO: 22152 - DNA, 3003 bp, Unknown
  misc_feature (1)..( 3003): 2750-1469P.txt file - cDNA_ID_2047614; gDNA_ID_1620500; Annot_ID_158836
aattttatagggaagacagtgacaaattcttgttatttataaaaaaaccaaatttgaaaatcgaagagccaaattgcaaaataaatttaacatttttttatcggatgttacaaaaataaattagatatccacataacatgtgcgaatgttattgataattttgtattaatcaacaaaaaatacatgtcgggaaagaaaaaaaagtgtttcatttattgttatgaaccctttataagttatgtattaccaaaatagcactcattgttttaaaattacaaattagtccgttcttttattcccgtactcgttccttcttcttcttcttcctctcatcgtcattttctcgattctcactcttccggtcaccgactaattctggttagctcacattccttatgctcattcatccacagttccctaattaacgctacgaattttgtttctcctcttatttcttctttcctcttgtagaataaggtttatcaaaagaataagaataaggtttatctcttaaatctccgataattagcagagttttttcaggattgagtttgatttgctgttttggaatcataaattttgcgttttagtggataaaaagctagctttgaaagagttattgcagagaaaaaaaatgggatcgagagggattatcaacgataagtggtcaatgaggattctatggggttgtgctatcggaagtgctattggtatgattgatccatctttcccacattttcatcttagagactatggtttttgttactcaaattcatgagctttttgtttgtatgggacactttctttaacccataattgtttaggtttatacatggttgctgtagagagacaaactcagaacagggctcgtgctatggctgagagtttgagagctgctgaatcacaaggtgatggtgataatgtctaatatctaccaagtagtgctcagttgaatactctcagttgagtttttttttttggtgtttgtttttgttataatgacttcttctgccaagatggtgttgatgtagtttcttttttgcaaataatcgtaataaggtttcgaaacttggagagttgaagttgctgaacatacgatttgtgttatcgcaaaaaaagttatttcttatgcctgtcatgctatgtttgtgaattcgatttttaatgcgtattttcagcaaggcgtcttgcgtttaggggatgtgttttctattaagtaaaagtcttccttcctataaaagcatgagggatcattttatcaggaatgtacagcaggatcaacttattacatagaaataatggctcagggacaccaaggcttatgctttgggtttatcttcttactatgcttcttcagctctacttttgcactcaggattcttaaggacctccctatgatggagccaagaaagctagatctgaaccatgaaatgatgcctgggatggttatgctacagccagatcatgaggtccaacctgagcacacggtcaagcctggccatacactccagtccatgtccggtgtatcagaacatccagagcacacggttaagcctggccatacactccagtccatgtccggtgcattagaacatcctgagcacaaggaaaagcctgaccataaactccagtctatgttgggagaacatcctgagcacaaggaaaagcctgaccataaactccagtctatgttgggagaacatcctgagcacaaggaaaagcctgaccataaactccagtctatgttgggagaacatcctgagcacaaggaaaagcctgaccataaactccagtccatgtctggtgaatcaaaacatcctgagcacaaagtcaagcctgatcagataatgcagaccatggcgagtgaactggaagaggaagatcctgaccacacaagtaagcctatggggtatggtgtaggtaggggctatggaagtggtgggtctggtgttggctatggcgttggaattggctctagtggaggcagtggctttggagaaggtattggctctagtggaggcaacggctttggagaaggaattggctctagtggaggcagcggctttggagaaggaattggctctagtggaggcagcggctttggtgaaggaattggttctggtggtggtacaggtattggcattggagaaggaataggatccgggtctgcccaacccaattgcggccctgtcacgggagctccaggtagcggattcggtgaaggcataggacaaggtagtggtccaggggaagggattggtatcggtataggacagggtggacctagtgtagtagtcccaggcacaagaatccctccgatagtggttccaggcgcacagattcccggttttgtgattccaggtatcacagttcctggctacggtactggatgccaaacaggtggctgcaatccgaacccaccacactactatatcccaccaagctgtccccattgtccacctttcacatcaggacaagacaaacacatgtcagacaaaggagccatgaccgaagctcttgcacccacttcaccggagatacatgtttaagctttaagagtccatgaaacaccagtctaataaatcactcataatgaaatctattttggtttataaaagcttcacagaaagttgaataatacaactttcttgctcaagtaaaaagatatataagggaaatgcatataagaataagtgagaagtactcagagacagaaaaagattgattaagaattaggcagctggtaattgcatttccatggctgtgtatctgtatgactgacaaatgagtttaaatagaccggtccacaaatcaagttaagctctctactttaatggaaaatacgaactttagcttatataatttcttaatttgaaatgacataaaaagaggtgaatttttcttaaagcattaaactttccgaaaggagagtggtggcactgtaataacgacggagaagaacgaacgaacgcgagagatcgagagagagagaaatatttaatg

SEQ ID NO: 22153 - DNA, 3000 bp, Unknown; identical to SEQ ID NO: 2205
  misc_feature (1)..( 3000): 2750-1469P.txt file - cDNA_ID_2047662; gDNA_ID_1620502; Annot_ID_158933

SEQ ID NO: 22154 - DNA, 3000 bp, Unknown; identical to SEQ ID NO: 2202
  misc_feature (1)..( 3000): 2750-1469P.txt file - cDNA_ID_2047725; gDNA_ID_1620502; Annot_ID_158938

SEQ ID NO: 22155 - DNA, 3003 bp, Unknown
  misc_feature (1)..( 3003): 2750-1469P.txt file - cDNA_ID_2047729; gDNA_ID_1620502; Annot_ID_158942
tttttttaattattaaatttaagctgatgatattcagaaaatatttacttcttggaaaggacaaaaataaaactaaatttactttttttttttctttctctgccttatgtggatgataaattttcggataataacctacaaaatgtgaataaaatttatgagaattgaacaaattgattcatcttttttttttcctttccctggtacagagtttgttgtataagttatataattcggacggtacaaatgagaaaacaaacaatcaaagattacctcaaagactgatgatgagaaactacattttctcggacatcatcatctctctgtattagtattaccttgtgacaccaacggtattgattcagcatctcctggagtttctgtggtaacaactttggatgcttccttcttcagcttatggttgttataagccgctacaccggcaatagctgtgtgtgaacacagagcacactgtatgagaagcaaatttttttcttgttagccaatttgtatgtgagaagttttgtcttaccgatggcgtaaccgaaaagattgatgattgtgagtttcgtgtcggcaaagagaagagctgacaccaagacaaccacccaatccttgacaacgccagcaactcggatagtgagagcactcgtgtgagaaatcaccaagaaaaccgacaagttgagggcaaatgtacagagggaattaagggtcaacactacaaagtggaagttccatgggccattgccatctatcttcgatttctctagaaagatccacggcacaaacaagcagatagcactgcaaaggaggtacaaaaagataaaagtaacccttaggcttaaataatgagagaaatgagatggcttcctcttcttcgattttacttacctgcatgggctcacgtagtacataagagagattgggtttaacttgatgcccttcctcttgacaagaagttccatgaagattagcctcagggcttctccaacaacaccacccatttggtaaaccactccaatccagttgatgtttaattccccataagaagctactaaaacaccaaaacttatgatagacattatcaaaagcatcctgcagctcatcatttcaagtccagcagctactccaagaataaacacagcaacaggcactgcaagtatggttgaagaatactgtacattgttagtcagatataagaagtaaacataagacttatgaggaaccaagagcatgaacagtttcttacttatagccttcaacatctgcgcaaatgcaactgatatgtagaggtaggcagtgtttcccaaccagagggtcattgcaaacattgcacctattggaataactgacgtaacatatctgagtacataaagtgagttaatactgctacattgataaaattagtaaagatatttatgttatgggtattttcgactactccaaaatcaaattccttacgaagtctctttcttccttacatttctagtgtcattccttcctcgaccttcacaatcttcatggagaaataaatagagaacagagaagggaccaaaagttaggcagtctttacttgtgaacaaaaacagaaagaacattaattgcaagattaccttaagaactttggtaagaagaaagcacaagacagaggaaaagatcatatggagtaaagtcaatccaagaggataagggaaattaatttccttagatgacaaaacccactgcagcagagcaattcaaagacaaaaacgttagtcatgacgaaaagagagaaaccacaatctatgaatcgttacttgctacagattgtaaaacggtgaactctgatgcataagcaataacagagaggtcaaaagcaaacacaacacgatcaaacaaaagcaaacggatgttgaattctacacaaccgagggattctaaaatctgctagtcaacttcctagaaactagcacagtacattgcacataccagctcaattccttacgaaaactagcgatcggtttctacaaatcgaaagagcacaaaacaatacgatgcgagaacatagatccagggaaatatagattgtgagatttaaggtaaaccttattgaagaagatttgaccactagaaagagcgatatagagaagaatgtaagcataggtcacgaattcagctctcataaagcctttgctccgatccgccattgaaaccgattattatgatctcagattacggaataaaagttgtcgcttctggtttttatgtaacacttttccgagtgctttttgtttcttttccaatcgtcttctccttcactgagtatttcactttcccatcttctcaaatttcaacaacagctaaataagagcgacggtgacgactttaagtgggtcccactttttattatcctctctcattttatgggcttttctcacatttaaagcccaaatactgttgggtttataagctattgttatgtttcgtcaagcccatgaatttggttctacctcgcacacttttttttgtttcagtttcatcatccacccttggatatatgtccaatgaaaagaaatgaaaattattaagtattttttctcgagattgtgaacgataatatgaaagaaatgtaaggaacacacaagttgcttgtggattagaccacaacccatctgatatttgtccgcatctccacaaccattcttcacctccaacttctcatccatattataatccaacttgccaataattttttcaactgttacagattactacatcaacgaaatattaaacatttaaccatatataaaagttggagatatatgatataagcttttcttagcagtcccacccttcctctctcgagagagctccattccaatcaaagctgtgtaagattctgtgttctagaccaaacagagacgcgtctgtgttctggagattataaacatatgtctgataatcacaactgataactaactcggggttttttgctcttttgacagaaacacacttcagaagatg

SEQ ID NO: 22156 - DNA, 3000 bp, Unknown; identical to SEQ ID NO: 2240
  misc_feature (1)..( 3000): 2750-1469P.txt file - cDNA_ID_2047775; gDNA_ID_1620510; Annot_ID_159096

SEQ ID NO: 22157 - DNA, 3003 bp, Unknown
  misc_feature (1)..( 3003): 2750-1469P.txt file - cDNA_ID_2047816; gDNA_ID_1620510; Annot_ID_159085
acggtacatttaaccacaacgacaagaagttattaatctgactttgcttgttacgtaattgtgcatttcattttcatattgttttgatttattttgctttgctgattaaaataaaaaaaattatgacaacattttaaaatcatcattgattttgtttcactgcatttattatataccatttcacatacatatgaccatttgttcaactataagtatagggatggacattcagttatttgggtttccggtttcggttttttggtttatagaaaatagatccaattcggcttaatattataattcggttagtgcatatggaaacaaagttatattttggttatgtttttgacaaacaaatcataaatagcttactataactgattgtagttatagattgtagtcttgtagattattaataatataagctctttaatgaattttggctagtttggttgttttatatagttcgagcttggttcgattcaaaattgggttattcggtatagaatattttttcttccatttaaatcaaacataatttggatcgggttagagtagacttttggttcggattcgagaagtttggttcggcttgaaaatttgacctagctctaactataactatttgaatcgttttaaccaattcctaatttgccatagtatgtcgagtttttggtttgtaattttttttaaaaatgattccaaaaaaaaaatgaatagtcggattaatattataaattaacaaaataaatagaaatgatggtggaggcgtggaacaataaatagttaacgagatttgatgaccgatgacttgtcggagaagaagcaaactctctgctgacgtatgctttgtgtcagcttattttcgaagcttctttcttacgcgttattccttatttttaattgttttttcatttactttcctaaatttactgtttctcaatctattcaatttattagcttaaatttccactaattttgtctctttctgttggttttatctttccctcagagcacattttccatcttatactctctatctacatgaaagtatgtgctcacgctgtttccataaaggaatattaattttgtacagtataaaatccgttaaaagtttcacactaatgaatactactatcttctctcacattggaaaatgcgctaaaatataaaaggagttaataactgcgtgtttatcactagtgagtttgtaatagttattgtggtgattaatctaattatagttggtccttgatttaatcttaattaagaaaagagaaattaagtattgcaagtgtaatatgaaaagaatcggcgacaagacgttcaagtcaaaatagaattaggctaaataagtataaaattttacgtcaggagaggatcacgaaaaaaaatctttccccttaaaaaaacaattacaattgtattggaaaagacaagttgtcgttaaaagttaaaaatcaaacaaagccgcgaggagtttaaaattgaaaacgaaaaataaaacaaaaaagagtactgtaataatcagatgcgtcagacccacaccttttggtttcgtacgtgtcttcccttacgcgcctatcctcgtatcccttggtctcttaccgttttaaccggttatttctttgtactaatacgcgtaaaaaacaagagtcttgctaaaagatcatttgagttcatcaaattctgttacgttatttgaattgatacgaaaactatttaagaaattatgttctaaaattctaaataacctgtttatactatactttccataacatacaaaaatttgctcaaatactaagaaattctctcttagtaactatgtccagccatacttaggctatgaatgataaccaaaactgcatctaaaaccgtaccgcaacagtgctgtaacagtatcaaaatctctacatatacatatgtatttatgtattttcattactatttgaaccgcaccgcacttctcccgtaccgcaaaacgcagtcaccattcggagccttaatatttaatcggctttcatgctcaaacgttatgacgtaaaattttaaaaattcacaaaatgagactgtttattagtctcctcaactatactttagtttggcctgatgtctacaaattgtaatctagttaatagtaagattttgtttgtttaaattttttttatttttttttgcatatatggttgtgagttaaatgcccatatgatatctatcaaaagtatcttttctaatttcgccccctttacaattatgaaatatacaaaacgtatatatttttctgattatgatgaaatagttgaactattcgaaagctcataaacggtaacccatccatatatagcttatatcacacactaatcattggaaatagttaattttgctcacgttcatagtaaaaatgaaatgtaacaaaaaaaaaatgaaatgtaacgaacccgaattatatttggacaagaaaaagtcaagttagtattcaagaattagagaccaaattgtaacaaatgccgtttggagacacgacacaatgtgggaataaagaagaaaaaaaactgcaatgaagtgaagggacaaaaattaaatgctcggcagaggacggcaccgtcttgatccattcacaaccgtacgccacacacccctcaccggcgtttaccggtgaccagtgttttctttctttctattatattttaattccatttttattttatattcttttgcccgcgtaaatgagacgaaataataaataattattataaaaaaaaacaaatgggaaacctcctaaatccaagctgttttccagaagaacccaaaactccacaaaagttatattcacacctctctcttatctcaaaaatcttataaaccattacaaaataaaaaacatataatcacccagaaagctaaagaaaagttttccttttttcccctcacgaaatctcagagaagatgatatatatctataaaagtatcatctcatagattccatcttttctctattacatg

SEQ ID NO: 22158 - DNA, 2528 bp, Unknown; identical to SEQ ID NO: 2249
  misc_feature (1)..( 2528): 2750-1469P.txt file - cDNA_ID_2047850; gDNA_ID_1620511; Annot_ID_159125

SEQ ID NO: 22159 - DNA, 3000 bp, Unknown; identical to SEQ ID NO: 2251
  misc_feature (1)..( 3000): 2750-1469P.txt file - cDNA_ID_2047860; gDNA_ID_1620511; Annot_ID_159121

SEQ ID NO: 22160 - DNA, 3003 bp, Unknown
  misc_feature (1)..( 3003): 2750-1469P.txt file - cDNA_ID_2047895; gDNA_ID_1620516; Annot_ID_159299
tgtgactcactaggcaagaacaaaggaggactaataccaaagtttttatcatcaatattctttcagcagagtttgtaaaatgagacttagcaaactacaatgttttcataggtaactggagacttgacacccctcaactcgaagacggttgctgtgaaacttcaagtgtttaaaattctcggctttgtaagtattaccaaaactcttgctgttataagggaaactggtagtactgactcatacatacaccatatgcttcttttactgatcattagtgtttgctgtgtgcagattccggtaaaagcacctgatggtactgcacgcggtgaactagagattacctatgtggacgaggaactacggtcagtagtgaatgatagtttttcatttctctatggaactgacaaccaaaaacatttgaatcttgaaacaatgttcattttttacaggatatcaaggggcaaaggcaacttgttgtttatattgaagatgtttgatcccacttatcgaatccctctctgatctatcgaaaaaaatagtttcgagctatcatacatacttaaaatcgcttgttctgtctctctattcatcatgtatgtaaaaatctaataagagagaataaaaagagactagcttttgtcaatgattcaacttgttttgatcgacattgcaccacattagattaaaaaagctctaaactttgaattcggtacagaaaatcagaaaaggactcatgtcctcttcttttgaaatatgttacaataaaaatttggtttcatttcttcttctttcttggtgcgttttctctgataaacgacgccgtatgaagctggcgagacacagacctctcatttcgacgctttcttcttcgtgaaactcttcatttgttttatattggaaacagagtctctcttatgaatcaaagcgacaaactttgagaaggcaggcgaaaatctcggatgggttccatcgctctgcaatcttggagcagaggagcttcaacttctcttcatctcctttttcgtccaggtaggtaagtgcgattcctaacttgatatgatcatatatatgagaattcgacaaagatttttggttgaaatttgcttacttgatgatcagttggctcgaaccctaagctatatgatgctcgaagagtacaagtaagattctttaatgttgccgcttcttggtccgaacagatgatctcttatactatagtctgtttattttgtcttttgggttttaagtttgatgtaagagcctcttcaagtcgtaaatcacttaagaaactcaaaagagagtcacaacaaggtaaagacataggcttaagaaatgttacagatgaagaagtttcttctccaagatttgaggaagctcaagttgattcttcaacttcaaaggactccattgatgtttttgttgctgctcctcgagacaaagtgcttcaggcttgcactgtaacttccggtttgatggctgcactaggtctgatcatcagaaaggtgaatcccaaatctgaaagtttatgattttgtgattctagcatttgtatcttgctgatttggttaccgcttgcaggcgtctcatgttgcttcgactgaaggattactggttccagactgctctatagatgtaccatgtaacatctcggaaaacgattatgttgtgtactaagaatcctttgagagattcagtaaccaaaacatgttttgtattgcatgatctttcttgcagttgggtttgaaacttggcatctcggtttaattgctggaatcgttgtgtttatatcgtcaagtaggttcttgctacttaaatcttggccagattttgctgattctagtgaagcagcaaaccgacaggtcaaaacattacacattatatacatttatacgattctttaaactccgcttattgtctcctttggtattcactacttgcagattctcacttccctcgaacctctagattaccttgttgttgcaatgttaccgggaataagtgaggtaacaataaacaatcacaataaaacacagaaaggctctcctttagaaaatgtcgttcattggtttgatttggtgtattcacaggagctgctgtttagaggtgcattaatgcctttgttcggaactaattggaatggtattgtagcggttggcctcattttcggtttacttcatctcgggagcggaagaaagtattcttttgcagtttggtaagccgtttttactgaacattttggtacctcaatgctgatgagaattgcgtagaccgaatcttgatattagatgattgcctttaacatgttcttgcatctctctatcacatttccgaggttttcctattgaattctttgcggtttcttgaaattttcagggcttcgattgtcggtatagtctacggttatgcagctgttttgtcgtcgagtcttatcgttccaatggcctcgcacgcactcaacaatttggtgggaggtctgttgtggcgatatagttccaagatcaagtcattggagtgaaataaacaaaatttacaacagggttgaattaaaaaagtatacaattttaatgggtgggtttgtgaaatctctcaatagtatagggtggttatgtcaaaaatctataatagagggtggttattgtaattttaatgtaccaacttgtcacaaaggacaagtatgaaaaatctataattatagaagtgaaaagtgaaaaaccaatcagaattgttaccggaaaaaggaagtgtcttctggtcaaaaaagtcagagaagaagagagaaacgtgaacaatgaagagacagagacgtctcttctcttatgcgaaagtgtgaatcttttaaagctttttgtttcaacatcgataaatgaagtttcttttattgaatttatagaaatttgcacactttaccttgacattaaagcaacaagctttgaaaccaaataaaatctcaaaaacccagaaagcgagtggagaagagagagctgatatgctacaatagaaatg

SEQ ID NO: 22161 - DNA, 3000 bp, Unknown; identical to SEQ ID NO: 2289
  misc_feature (1)..( 3000): 2750-1469P.txt file - cDNA_ID_2047921; gDNA_ID_1620516; Annot_ID_159292

SEQ ID NO: 22162 - DNA, 3000 bp, Unknown; identical to SEQ ID NO: 2303
  misc_feature (1)..( 3000): 2750-1469P.txt file - cDNA_ID_2048000; gDNA_ID_1620517; Annot_ID_159338

SEQ ID NO: 22163 - DNA, 3003 bp, Unknown
  misc_feature (1)..( 3003): 2750-1469P.txt file - cDNA_ID_2048012; gDNA_ID_1620517; Annot_ID_159335
ttccaaaaaataaaacacagacttatccactaaaccttttaaaagtgcagtactgttaccagttaaaatgttattcaagtcgcagtgataaaaatctcaaaagtatatgacaattttcattcgtagcacctatatatttgcatttttacatcttccacttcgaatttattgattgaggcttcgacctctactacaaatgttttcacgaatatatccattgcaaaaatttagccacagacgaacaatgccgataccgcattgatgactatactattactaatcttatggtacgtagtatagcacatttgttttaggattatagtttgtaatgaagaactacagctgttggaaaaaaaaaaaaagagttatccgacgatagaaaatgcagcatatagaatttgtaatgaaaaactacgtctttgagacgacgtaatctaaagcaaacactaatcttctatcttgttaatccgtttcattttttttgctgtgagttcttttatcggtcaaacaacaaatgcatggtggggttaacaccaaagtccttttaccacgtggttttaaactaaattacttaattatacacatggataaagacatatatgttgatgaagagaatataataaagcccttttaccatgaagtttctttttcgaattttgaccgaaaagagattcaataagatccgttatatagatgagaagtgttattgggaaataaagcaagagtggcaagtggacgatagtgtgcttgcacaatagtcgagagaaaaacacattattttgagtttaaggagtccattaacaccatgatcaaaccaattactatctattcaaattcaagattaatcactaattttctagctttttgagtaattacattcgcatttgattgttcttcacttaaatcaacttaattttatgatgaaccacaagactatatctatttaagtatttatagtaaaacttcaatgtaagttcttgtaatgaaaacaaagagcgtttttgtccactatctatatgttacaaacttacaatacaattcgtttaagaatgtttggtgggagattttcacatgcaacatatctaatgtgggcaagcaagagattgcttgaaatagaccaatcctcgagcgatatccgcgggcaaccattttaatcttggtccccttagccgctttttgaatcaaaatcttttaaagtttctttatttcatgaaatcaatcaatattaagaattttttggaaacatacaaaatatttatagttacagtagttagttcgtcattaccaatatgcaaagttcgaaacatgtattaacaaagatgattctaaagctaattttgggcgacattctaagtttttgcttctttttatagttcttttagttagtggggaaaaagaagtattaaagtgggttgttgggatttttatggtaaataacattgttgggaatttttgtatcagacaactcaaaaatatattccctctgtttcttaagtactatatgtttttgtgatttttgcacaatttaagtaattatttgcaataccaaattaagtttcaatttattaattgattattataagtttataactaagatttacattaaattgaatttaataggtatgagtaagaaaatgaaatattactgtcacaaaaataaatcttaacccttttttgtttgtaccgaacacatttcattttgttttccttcttcctttacttcttctctttatgcaattcttgaggatcgttctcgtcacacgttagcacttagccttagcagaccagaggagctacaagagtttttttttgacaaatacctttcacttaagaccaaaattgattgaagtttatataaaataataaatgattatgtggtataaacaaaaggagggagagatgagacagaaggttgcttttgcagtattccgggaatgcaatgctgtctctctccgaggattggcgtgagtgagtgagagagagagagagagagtctcattcatctcttttgtccttcttgtaattaattggttttcactattacaataaaaatgatactataattttcgataaaaatatgcctttattggagattaaacaaatgcgagtctaaataacctttttaggaccaacctaagatatacataaaaagatcaagaagatctttgtttggtcactcctacgcacatcaatgcaaaaagagacaaaacttctcttaaccaagaaatgaataaatttttactttttacaaatgtccaattcaattagcatgcattttaaaaacgattttttctccacaagttattaatgtgtaaattagtatatatttgaaaaaaagacagcttttttttatgctcttattcgctaataatgaccaaaaattaaaagagatatgatgagtacactgaagctgcactgttactgtaaaaccaaatgagaggagaggaacaaagaaaagagagaagacaaaaaagttgagtgaaatgcaaaaaatcaaaagcatacaaaagctgctcatttgtccaaaaagaaacccatcataaagtaaaagcattataatgagatcaaaacccttcgaaaaatttaaaaataaaaaccaactttttcttaaaaaataattcaacaataggaacagaaaacacacagcatgaaataagtataaaggaaccagcttggtctaatttccttatctgtctaaaactctcttaaacctctgtctcttctctctctttcttctcttacttatcttcttcttctcttctctcatttcttgagttctctctcaagactcttcttttcttcagtcttcaaacataagaaaggaagttccttttgtttcttctgttttagttctcttgtgggtttatctatttggggtggtggttaaaggagggagctttgggattagaagtttttcagtgaaatcagaaagctttcgagagaggtttttttcaatttcaaaacgtgggggtggggggttagggttagggtttacaagttatg

SEQ ID NO: 22164 - DNA, 3000 bp, Unknown; identical to SEQ ID NO: 2348
  misc_feature (1)..( 3000): 2750-1469P.txt file - cDNA_ID_2048071; gDNA_ID_1620523; Annot_ID_159511

SEQ ID NO: 22165 - DNA, 3000 bp, Unknown
  misc_feature (1)..( 3000): 2750-1469P.txt file - cDNA_ID_2048091; gDNA_ID_1620523; Annot_ID_159506
atttcttgaccaccacagcgatcttgagagtcttcttgggtttagaagggaaagtgagatggttccaagcagaagagaatcgaagaagatcgatggtttcattgttttgctgatgatcgaatgtgttaacgtaggtgttgtgatcgtaaagacaagaacagagtgatgtgttgtgtctgaagagaaaagagacaaaggagaggagagagaggagtagagcaaagtgacagagatatctgaaactaaaggagaagctcatcaatgggttttctctagccatgggaagtgatagatcgaatcttgaaacccaaaaagttacatctttaagagaaataagaagaagtaattaattgtcatcggtcgattgaatcttgaaaaaaagtttgaccaagagacttgattagattagatttaagattattgtcgtgttctctaagtcacatgcacatgctctctattgaattatcgtagtatagtcacgcgcctccgtgatgtcgctgccgagaaatatgacggcgctggtggttgacttgagagagagactcaaatcgtttttttaaatttatttaactaaactcgatttatctataaaattaaattagggtttaagagaaaataactattgatttacaattcgagagatatagactgcgtgccgtctcaagcgaagaaaaacgtcaagacgattgatgttgtagggttatttaaaacgacgacgatcatagttgaaagggaaaacaatactaaaaatagacgccgtgaccatctattctttgaatgcagcttctccatggcggtttggtcttcttttgctagtaagttcttcgtaaatccgccaagctctcttcgtgatgttgcgagttggatccagtccagaccagtcattgcctctcaacctcggccgcctaacgctactatcactaagctcatccttcaggcgtcaatctctgctatttggaaggaacgcaactcgcgcatcttctctgtggcttcttgctcgatacctgtcatccgcaagtctattgatcgctctctccgtgatcgcctgctttcgttccctgctccttcttcctccgctccttttttacttgcagtttactttggttgtattccttttgtttaatttctgtttatcgttttatccttccactaggttgattaataaattgtatgcaacatgaaaaaagaaaatagtataaaatttaacatttacaccaaaaaagaaagaaaaaaaatagacgccgttgccggggatcgaacccgggtcacccgcgtgacaggcgggaatacttaccactatactacaacgacatttttgattagcaatcacataagataaaataaaaagtaaaacagagatagataatacataatttataacttcgcagagagtctcgtatctcttttgttacaaattcatgtatttttctatccctaaaagcttattctaataaagattagtttcttgatttcatccataaaaaatgtcaacattagaggtttgattatcccatactcaaaagccccccatatggtaaatggttgttagataaaggctttgctataaagggatataagacctactttcttgtaataaaaacaattaatggcgacttaaacgttgtagattcaaaatactaatcaatacaattttttcctcattagaatgtgaatgcgaaatgcaattagtggtagggactatttatagtatttataccgttattccaagaaaaaaggtatgcatagttgcatacgcatggttggtcagatcttaataggtgaaccaatctttccctctaacatttgttacttcaaaacatcgcatgaaaagaagaaacatatatgttttgtctccaaatcactcatcctaagttgcatttgttgacttaatccgcactaaaaccaaataaatcacataaaccaacatattatactgtgtatcactagtatttgtaatggttggtatataatggaatcttaatttgatcacgatctggttatggttagcagatcttcattaatgaaaagttagtagaagaatcatattttatgttttagctaccagagtttgacggcattacataacacattacttatattagaagttatattccacatttatttttaaaatttccttcgtcaattatttactttcactggaatacgatggtcatttggatttctgggcttctgtccgaatgttcaacttcgttgtgggcttgcagaaattttttaatgaaaaaaattgtttacatgtgaaattagtcggaattaccttagcagatttgtttatcataaaatatttgtttaccataaaaatttatttgatggcaagtttgtttggaaaaataatgatagttttgtttgggaaaaaaaataaaaaataaagaagacaaattttaaaattacaaaaaagtttatttataggtcatgactaataacattattactatctagaattgtcaaatactaataattattcaaactataaatagaagaaaaatcaatttgttgaatacattgcttttagagattttattaaacaaaaatcaccaaaaaaaggtttgtcataaataaaatgcattcattcatcataaaaggaaaaaaagaaaagaaggaaagataacatatttatacatgtataccttttaataatgaaaaaaagaaaaaaacatatgtataggtttccttaatcctgaatccttaatctctctcgtgagtcgcaaactcacaacaattggcaggtgatattgtcgtaacgccttcagctaaatctgtccatctgtacggtcttcttctttataaatctttaaactcttcaccactaacccaaacttctctctatctctctcttctctcttttctctgtttcggatttgctctgtttttctctctgttccggatttgctctgtttcactctgttcttgatttgttctgtttttcttgggtttattctgtctctgtcttatctttttcttctagacaagaacaatcaaatg

SEQ ID NO: 22166 - DNA, 3003 bp, Unknown
  misc_feature (1)..( 3003): 2750-1469P.txt file - cDNA_ID_2048133; gDNA_ID_1620524; Annot_ID_159540
aactatgtttagaatatggttagggtatttttaactagttgtttaaagagccgtctttaagtattttaagacgactaaaaataaaaaggctgttttacacatattgataataaattattatttatgattaaactaaatataaaactggatatagtttaaacattctaaaaaggaaattgttaaaattagcgtttctagtgactcaaaccttagtgttgaagattatttagaaccagcctttaccactagactacctaacaaatacaaaattataaagctgaaattgtttttatagtatttgcggccgcaagtttgggtttggcacgcttgtgcttgtgaccggtttgtaagtgtatgtgagaagtgaaagctatataaaatcatatgtatttaaacgtatttagagcatctccaatgaaaagagttcctcataggatctctctatttttttaagtataaatttcaaaaaaagttaaaaagagagctttagtatttttaaaaaaaattcatactccagtcaaagtttctcttagtggggttctcagaaaaaaatatattattttaaaatttttttatttaataagacttaataattattgtaattcataacatattaaacatacattattttgaaatatttttttaaaatagatgtgcaaaaacaaaattgaatatattatcaaattgttgatcgagtaattgatcaaaactttactctatgacatcgtaaaatggaatacgggacgaaaaagccatatcgtttgatagcttgtggtagaaaaagaaaaaaaaaattaaagaatgaaaacaaaaaaatctctttattttttgttaaaaatatgcgtccaatcacaagacgacaagtgtcagactctattaaattctcaaagctctctagagagagtcaatgctctcaattataatgagtttagaaatatttttttgaaataagtgagagagaattcatcaaaaaaataaaaattgaatagaactccccattgttgatattatggttctcttcttgttgttgttgatttagactataatttgtaacgctatacctaatatatgtgttgctccccattgttgtccttaaggagatgctatatacatatagatactagccatgcaaggatcattagaaaatgaatgtgattaaattacaaatagacccttcgaacaatgagaatctcatggttattgttataatgactaaagattacataaacataaataacacaaactaaacatttgtaacaacatcaaatatcctaacctccgtactatgcacgaatttaacgtgtgaaaaatcgggccggagaacaaactgttttaaaataaacccaaaaattgaaatatgaaacgtataatataatcttaaatgtagtatgaaatctccaagaaaatactagtaatattcaatcatatgaagaaaagccatgcaacggctgcgagaacagagcccgagacagagatcacaagcgatgaggctcctgccgcaggagccgaagcttcagggccgtcactggcgccagttccgtcatcggaagatggagacatttctggagtcggagctggcggagaggaggcggtaggtgcgtcagaggagctggtaggaccttcggaagaatcaccggagcttgagtcagggcttgaagccggagttttggctgatgatgactttggagatggggaagatggggaagggcttggagttccggtggaatttttcttggccatggttggagcagctgtaggcggtgaggttggggcggaggccgtgggtgattttggggatgctgcggcggcgggagaaggagaggtagagttcttttcgccgttggctttcggtgcgtttgccggtgttggaggatcggcggccaagacggcggtgatggccaaggcagccacggcgagagataggagtttaagtgtcattgtcattttgtggtgaatgtgaattgcttttgtggtgattaattatgtatttttgtggtttatgattagtgctaaaaaagattaaaaagaagaaaagagttatttttgagagattaaggaagaggtaaaatttaatttatagggaattctacagatttgaccaaagttttggttgaccgggtccatcggaacttgtcttaaaattttattggtttgatcttttgttagtaaaaagagaacatgtggtaatgataattcccaactttcaagaaacaattgagaacacgtgactattgagattgattttgtggtaactaaatgagcactgtttcaacaaaagttaattttaatttaagctatacaaaatactaagaattaaaacttgattaacgtaccagttagtcaataactcaatattaagtggaagttcaattgttcaatacaaattcatacacgtaactgaagaagcacatttaaaagtcaacgaaacatttacatttcgtaaactaaaaataaataaatctactgcaatcttgtgaatgagtctaattagagatgagaaagtaaactgagcccaaaataaataaggcccatttaaaatgtaaggcccatgataatactcataagctttgtaatccacgacgcacgtgttccataatggctaacataaaaacggcaagcagtctacttttttgtcgttatcactttttaacccttttcggcttctatccgtcgattcaaatcggcggcagttcccagcgacattaatctccggcgagacagtttactcggtgagtttcgcggctacatagtttttttgaacttccttgaattgttcattatttcgggatataaacggaatttgcttttccccgatcgtcgtatcactgtagagaaaccgatacttgattggttcttcgctatttttctctattttgatatgcaattcgatttcacactctcaaattcataatcctagtttgtatagtactctatctcgtgaaattgtctgcttttatcgattaaggcgttgttgcgtacattgcagtgtttattgaagctatg

SEQ ID NO: 22167 - DNA, 3000 bp, Unknown; identical to SEQ ID NO: 2349
  misc_feature (1)..( 3000): 2750-1469P.txt file - cDNA_ID_2048171; gDNA_ID_1620524; Annot_ID_159524

SEQ ID NO: 22168 - DNA, 3003 bp, Unknown
  misc_feature (1)..( 3003): 2750-1469P.txt file - cDNA_ID_2048208; gDNA_ID_1620530; Annot_ID_159710
acctaacattgatcctttctttcctcacactcttcttctgaaactcaaaccgctctttcgtagagagattcgtgcaaataaccttccaaataccaaaaaagattcatcatcaatgatcaatccaaggtaaagtaatcgattttgaatgatactcacaatcctaatttctccttttaactcaattacttgaaaactaaagaaaagaagcccttaattgccaaatttacaagattagcgtctaggactatctcaagatcatccaaaaggtaagaaccctaaacaacaatttctggaaatcgagtaacctaacgctaggagtgaataaagaagcttatttgtttgatacctttggtcgtaaatcaagtgaagctgaagaaggtctgaaaatagaagccatggaagagaatcttggattaggctctcaacacaggagcaagagtttttttttgtctttaaagtaatgatttcatgttttttattttctttattggccaagaaaattaaggagaaaaacaaaacctgagccactcagccacataatcactgggaaaatcaatttcgtattgtctcgaaaaatataattgtttcaacgacaacaaaaaatcaaacatgcggtgtggtggcaaaagtcaaacgtttatttaatgaaagtttatcagagaatcgatgggcctagcccagtccaataggtgattcacgtctcactatttttgcagcttcacaaaaatggtaagttggtaacttactatttcgagcgaaaataactcagtaataacttccagattcgtcaaatttctcttaccttgtaatgaagtttagatgttttagctttatgtataaaaatttaagaatatggtctaattttatataattttcttattatcattttgtatttgatatcatattgacaaaatttaacaaatagatattagttgtacttctatgtgaccgccactttattcaatactaccttttaagttttaacagatccgtgtagcaactgatcatctcaaaatatgtgacacatagtatactatacaatatgagctggttttgttttttattttatatcgaaagatattttactttatctgacagctgcgagagatcctaaaaaaaatgaattaactttaaagaaattgcatgcgtctatctatctacgtatatctcaaaaataaaaataaaatcaaggtcacatgactcatatccagtgaataaaaaatattcatgaaatcgtaaataaataaataaaaacagaaattcatatatacgtttttagttatataactatacgattggttcagtgtatttgttgcccaaccaaagctactttcacttcacatatcattacatggtccaatgattatggaacacgtattattatttttgtttaaaaacaagtaaataaataaaacagacaccaaataaaaaaggaaacacaaagatatttacggaagttaaaagagaggtgttgtctatgtcagtgcaatgaacctcttcggctcatcttttcccgccatcccaactaacagatctctcaccgtacacgccatcctcttcaccaaatctaatgactttctctctgtctacgtggcgatcatccggtctgttttccgacaataatgggacccatttgattgttatttcgaaaatgattttatttttcttcaatattgtttttttcttcaatattgttttggaagtaaaaagaatcatctgttgacaacacaacacttcttgccttctcgagtttgattctcctcctttctgtttttggtatccacccgattgtcattattttattttgaactctagaaccaaaaatatcagagcaagctctctagtcagtaaattttgtaattattatagtacctcatttttattagtagcattaatgtactagtgtggtcagtgtagatgaatatattttctactaaactaataaaaattgtatcataatttgtatattttttggtgttttcatcttttactataaaatatatttttgtgacatatggcatgttacactaaacaaaaaataaaataaaagaaatttgtttttgtataaaataagtaaattacgttttttgtcgaccaattttgattaaagctcaaaagaaaagagcaattcctaagagatattatttttatgtgaaataagtaaattactcattatgtaaaaagtttggatttatcttaaatctaatttcataacgtttaatgcaagatattttggtaaaataggaaacgtataaaacatctgtattcaaaacttctataaagatacccaataataatggaggggtgacacgatagtaaatagaataagaaataaaatttaatcaagtcaaaataaaataaataccctttgtttttgtttccacaattccttaagtctttctaattactttgttgttcactaaaacatctcacattgtgctattttttttaataaataaagacctctctctttaaaactgattatcccctaaactatttgtttgtgagaaagaaagagaaaaaaaagtttttttggttggaaattaattgagggagagagagagttcagaatctctaaatggctgaaacgaattgcccagaatccaggaaactctgattttagtccttttttcctcgggaaaacgtttgctttttcttttttgtgtgtgtttggttctttaattgacaaatctctctctatctgtttcatgtgctagctaaggttgtcttcactttcctctaatgagtcatgagtttcttgtcttcatcttcatctaataaagttaacaacactctcatcaatttttattatgttcaaatctgtctgacttttcgttcttttctcttacacccaagcgttttaacaatctaacatctgtctctttgaatacttagatatccaacttcaatttctctcctttctcttcccaactttgattcctgatttgggtttttgttaaagttcaagaaagttcttttttctttttttttcctcctttaatg

SEQ ID NO: 22169 - DNA, 3003 bp, Unknown
  misc_feature (1)..( 3003): 2750-1469P.txt file - cDNA_ID_2048212; gDNA_ID_1620530; Annot_ID_159708
ttatggatttgattgtggatttttgtagttgcctcctatatcaattggtgatggtgctttggatctagtggttattggttgtggtcctgctggtttagccttggctgcagaatcagctaagcttggattaaaagttggactcattggtccagatcttccttttactaacaattacggtgtttgggaagatgaattcaatggtaaaaatctcaatgatccattgttttagtcactatcttcatggtctgtgtttaacatgttgtttattgttactgttgaagatcttgggctgcaaaaatgtattgagcatgtttggagagagactattgtgtatctggatgatgacaagcctattaccattggccgtgcttatggaagagttagtcgacgtttgctccatgaggagcttttgaggaggtaaagtatggttccactatgcatatcttgagaggctttttctctagttatttttgcatgactttgaactgttttaaatacataatttgttattaatgtcttctaggtgtgtcgagtcaggtgtctcgtaccttagctcgaaagttgacagcataacagaagcttctgatggccttagacttgttgcttgtgacgacaataacgtcattccctgcaggtaacaagtcagctagtactattctggttttaccactacgaaaaggttctgacttctagcaaatgcaggcttgccactgttgcttctggagcagcttcgggaaagctcttgcaatacgaagttggtggacctagagtctgtgtgcaaactgcatacggcgtggaggttgaggtataatttgaatatgatattccacagcaataactatatggaggaatcattgttcattgagactgtttttctatttgaaatcttcaggtggaaaatagtccatatgatccagatcaaatggttttcatggattacagagattatactaacgagaaagttcggagcttagaagctgagtatccaacgtttctgtacgccatgcctatgacaaagtcaagactcttcttcgaggttctctttggtgtttctctctccttctagttaaatcgttattgtgataagtctgttgctcatcagctggaaatcctttcaggagacatgtttggcctcaaaagatgtcatgccctttgatttgctaaaaacgaagctcatgttaagattagatacactcggaattcgaattctaaagacttacgaagaggtaagaattggtggtcctatatcaacatagaaacttcttatttgcttttttaattcgtttaatataaaactgtaggagtggtcctatatcccagttggtggttccttgccaaacaccgaacaaaagaatctcgcctttggtgctgccgctagcatggtacatcccgcaacaggtagtaagagcaagaagccttgacccgatgtacttttattcacatcttgaatctgtaccatctctgacttagctttcccccaattaaacaggctattcagttgtgagatctttgtctgaagctccaaaatatgcatcagtcatcgcagagatactaagagaagagactaccaaacagatcaacagtaatatttcaagacaaggtgagctctatataaaccacaaagttaactatgctgttctttcacacaatgagaaacttttaaaacttgtgattttctattttttggcagcttgggatactttatggccaccagaaaggaaaagacagagagcattctttctctttggtcttgcactcatagttcaattcgataccgaaggcattagaagcttcttccgtactttcttccgccttccaaaatggtaagcaagacactgattcgtgattcataacaatgttactgtaaacaagaaaattgattcttcttttcacttactcaggatgtggcaagggtttctaggatcaacattaacatcaggagatctcgttctctttgctttatacatgttcgtcatttcaccaaacaatttgagaaaaggtctcatcaatcatctcatctctgatccaaccggagcaaccatgataaaaacctatctcaaagtatgatttacttatcaactcttaggtttgtgtatatatatgttgatttatctgaataatcgatcaaagaatggtatgtgggttactaggaagttggaaacaaacatgtatagaatctaaggagtgatcgaaatggagatggaaacgaaaagaaaaaaatcagtctttgttttgtggttagtgaccgagaaatgtttaaatcaacaagagtaaaaatgttcaacacatgcttttaatttttatcaatttatttcgcttatattgtttacgattgccatttattttaaatatgatcactttcgtgttcctaagtgcaaattactcaataatctatacacattatttataaacaagaaactgctaattttggattagtgaaactacaagtggttagtgtgccgtctttaatcattaatctaatattaacaagaacagagaacaagtatatgttcgttgcatcacatacagaatctaagaacaagcaccacataattatcaattaaattaatcaatccaatgaaacttcttcttaaccctttaaaaaaacaattactagtcaataaaatcacttctaaattcgctatttgcacattttattcaaaatgaattatatatctttattaatgtcaaccccttgaaataatatagaacattctttctaatatttttctcacaattatatcaattaaaaccttcaaaattatcaataaaacgaccatatcttaaatttcacaaaaatataagtcccaacataacaattttttcgaaaaagacttttctaataaagtaggcgctttcaattttcacaacagtcaataaatacatcacccactttttctatccaagtcaactaaaaacgcgggtcttcttctccaaaacccatttcctcacaaaatccatctgagaaaaagagcaacaagtttcattttcatggtggtgatg

SEQ ID NO: 22170 - DNA, 3003 bp, Unknown
  misc_feature (1)..( 3003): 2750-1469P.txt file - cDNA_ID_2048225; gDNA_ID_1620530; Annot_ID_159705
cgtctccgaaacgaaggaacaggggtaacttaacggcgttaagtttaccagcaccgacgccattttggtctccgagaccgtccacggagctagacgctgccgccgttacgttacaaaaggtttacaagagttatcgaacgcgtagaaatcttgctgactgtgcagttgttgttgaagaattatggtacgtttgaatttcagttttatacattttaacccaatgttgatatgaaaattatacttaagtggtgtgtttggtttaggtggaaagaattggaattggcaaagttagaaccgaacaaaaccaatgataaaccagagtctgctgtatcaaggtgggcaagagctggaacaaaagcagcaaaggtaataattaattattcactagtcatacattatcatcattaattcttactttggttaataaaatagtttgatatgcttgataggtggggaaaggattgttgaaagatgataaagcacaaaaattagcattgcgacattggttagaagccgtaagtttaggcttttatttattttactttaatgtatacatattcctttgatttatagtaatgattttaaaaaattattattacagattgatccacgacataggtacgggcataacttacacttatactatgatgtctggtcagaaagtgagagtactcagccatttttcttctggtaaattttacacaaacttagtcaaattttgatttcgaatgttccttagtaaatggagctgattttgatagcaaaccttctgaatgatactaaaggttagacattggagatggcaaggaagtaaatctcaacaaatgttcaagaactcttcttcagcgtcaatgcatcacttaccttggtccggtatgtacacatggtcttcggttatttccggttggtaaaagaaaaccgattttagttctggtttttgactaacagaaagagagacaagcttacgaagtggtcgtggaagatgggaagttagtcagcagacaaaccaagagccttgtggagactactgaaggaaccaaatggatctttgtgttgagcacgacaagaaaactgtacattggtcagaaacagaaaggtcggtttcaacactcgagctttctctccggcgccgcgattaccgccgccggtagaattgtttcacacgatggagttgtaaaagctgtgtggccgtacagtggtcattatcttccgacggaagagaatttcagagaatttatctgtttcttaagagaaaaccacgtgaatctcactaatgtcaaggtgattaagctaattaaatctctaatcccgcattttattatttatttctttgctatattttaataaactttcgtaattaattgtgttgtagatgaatgcgattgacgacgatgatcatctggtcaataatgatggaagcactaagccgtcgatgatggtggcgaaatcggacggttcagatgaacagaaacgattttcatgcaagtggagtacaggaaacggtccaaggatcgggtgtgtgcgggactacccaatggatctgcagacgcgggcgcttgaacaagtcaacctttctcctcgtgtagtcaacggaacaatgggattatttggcccaataccatcgccaagacccagcccaaagattcgtgtctctcctagactatcttgcatgggtcttccaagcccaaggcactaattttaccaattttcctaatctgatcaattaaattatttcaaaatttttgaatattccttttttttttcactcccctaatagtattgggcgattctttatttagagtataacttgtactcatttttatttaaaataatttaattttacatgtatttttatgtttttgaggtttgtaaccttttatttactttgtaccttcgatatcattattttcttcaatcaattataataaaatccacttaaaataatgaatgactatttcataatagaaaacagttatttatttcgactgtccaaagttacaaatatttaattttcctcctcgtacaatttatgattaagaatttagactagtaaagtcaaaataccgagacaaaactaaaagaatgaagtcacgtggggattacgtttgagtatatttgactcataatgatggatggaagtcacgtgccaaacgatctttaccgctcaccaacggcacgcgtagctctcacgcttggtgacgcatttcttactcgtagccaatcccaattttctcacatttttttaacttttaaaaataatttaaaactctacgcgtgttataagtccaaattccaaaataccgaactaaaccggaaaattaaaaaatcgttatgatacgtaattaatatgagttgatgaaatttaagtatggtgataataagtgattgatattgggtttaagtttaacataacgtattagtttgaaaatttgaaacgatttatagttatttatttaaccggatttcggtttaataaaaccgggatatgtggaaccgtgtaagctgaggaataatagttacctgtaaggaaagagaaaaaaggaaagaggagagaagaaagaaaaggaaaagacccaaactttgagaaacaccttcattctcttccttccttcatcaaagcttaaccttttttaatttttatcctcgttttttcaattcgcgtgaagagacagagagagagaaagataaagctagaagagaatcgacattacgaatcttttgttccagatcgtgagagaggaggagttggaagaatgaagatgactattgggtctttgttccaaccctaattttgcagattaatttcgtttttgttgatttctgttttgggtttgcgttgctgattccggtggattaaagggttctttttggagagcacaaatttgttgggtttttttttggggaaagagaattaaaattttctcctttagagtcggcgtttgggttgagagagattattatagtttttagggttttggatttctgaattggtgattatcgatg

SEQ ID NO: 22171 - DNA, 3003 bp, Unknown
  misc_feature (1)..( 3003): 2750-1469P.txt file - cDNA_ID_2048229; gDNA_ID_1620530; Annot_ID_159704
cgtcttgctttagacgagaatgagcaaattcgatggaatttagggattttgtaggggttttattgtgagagtctgaatttgggaaaaatccgttgagaggtaaaaattataattgcatgattcccacaaggcaacactggaattggtcctaatttgaaacatcgccagactgttttagcttaatattgggtcccacttttatatgttttatgctaattaagtcattaaatccttctcttttctttgtttagaccgccacgttaactattttataatgggcccttacaaatattatggcccatgggtcttacgttataatggtcatctttgttttttttttggttcagtctaactttaacatgcggagaacactattggatagatttttactcaagagtcgacttttatgaaatcgatccattcatattttgagttgccatttctttcttatatgaataaaatatatttttaataactatggaaaaataacgaaaataaaaatcattatagaatagtattttttttatacaaaactacataaatgatatggatacacgtctagcaaaatagcccgttatttatttacactcttcctttaaagttgcaagtcatatcgtgtctctgacttatcggtgcaattttagacaatacagtttcaaactttgacctcttggtcttaggtcaagccaatacaaaagagaagaatgatcattttataaaatttaattactcataatatgaaatcgacattgagaaatgtggccagctcgtcgacataaatagaagaatataaatgaacatatatatcagagtaactcataatatgaaatcgatatccaaaatgtggctgtaatattttagacttaacgacaacgcattatgtagttattttcacctatgcgagaactttaacatcacaacgacacgaaaaaagtaaacaaaaatattcaagtcgaaatactcgtggtacggtcttatttgttgaccaaagttattagttttaaaattttaatccattatctgggaggggatggatgttttacttggtaaaagggtatgcataaatttatatccaaaacccttttcttacggctcaagtagagtcttctaaaaaaaagaagaagaactagagtcttctcaatgcccacgaagaaatcaaattgtatatgtgtagttctctaactataacgtacatacagtattgttattttagctattcaaaatatattggtaattaaaaaattatttgattgtttttcttgaatataacaatcactaattaattattctcgaatcaaaaacgttcaaactaacatattctttttagttttaatagtattgattagtattaatatgtacaaatttgtgaaacgtttttagtccatttgtgacgactgcggtattagcattccgattatatattttgggttaaagataaactttaacgatcatatgacaactagttaacaaaaaatgttgattttgtataagtgtaatcttggtagtaatatattaacacaaacgtgtcattttgtgtcgtgtaaaaggagaacaagtgagacaaatagaccaacagctttgaactaacacgtacgctgcacaatttagtagaaaacaagaagaagaaactcttttgagaaaacccaaaagtaaaaagacttgaccacaattggttgactccgcatttacacaattacacctcaacaccccgaaccggttttggtgctctttaatatgatgtcttaatcacatacatatatggttgctttctttgaccatcataaatcatgctagtaatatttatgtttttaattgaatttaaaaatatgtatggaccactgaatatcaatttaatcaaaccttttcagcttttcttaatcatattggctttgcactatcataatcgtgaggatattatttaaattttagtgacccgcactcaccaaactcgaatgttatatatctgatttgatgtgaaaccctctaaccaagccgagatttattttacaagtttttgtttactagtaacaatgttatatactttggacataaaatgatatatatatatatatatatatatatatactcattaacttattgtataggacatgaaatcaatatactttggtattaccgtcacatatttagctgtattcttaacatatgattgtgttgttcttgtaaatttgataggtttcttgattcaataagaaaagcgcacaacccaagagaatttgattatactagtactcgttatcgaagatagatatagaatgaatccgttgaccgaataataaaaacctaaataatcatcgggattaaaaatatgaaatgcatataagctagtaataaaaaacgacgacgtatgcaatgatgtccccacacgctccggacgtaacgccgtgcgtagatcaacaacacggtcacacacatatgtacagtgagattgtatatatgtgtatgcaactcctaatagtgttatcaaaacttaaataagtaatgagtaccgataatataattcctacgacgacgtattcaaagttgccccacacgctagtatgtattggaaaaattaacaaataaatctaaacattgaaatatgaaaatcaagagctcgtgtggtttgattttttatggttttaaatccgaggaaaacgtaaaacctttgaatcaacaagactcgaagaaaaatcttcactgcgtatcttaaggtccaatcccaattttgttctcacggaaaaaaaaatctaaaaaacattcataaatatattctcattaatatatatatagagacgacagatgagcaaagaagagacataaccataaccataattcttcttattgtctttaataagtgtttctgttttcctaaaacattcgacgaaacttcttcagatcgtaatcagtgtaagtaccttcctcaatctttggatttaaaaccatttttctttcttcatcccatgtctgaatcttttctttttaattttaaaggtagctttaatg

SEQ ID NO: 22172 - DNA, 3000 bp, Unknown; identical to SEQ ID NO: 2405
  misc_feature (1)..( 3000): 2750-1469P.txt file - cDNA_ID_2048243; gDNA_ID_1620530; Annot_ID_159700

SEQ ID NO: 22173 - DNA, 3000 bp, Unknown; identical to SEQ ID NO: 2412
  misc_feature (1)..( 3000): 2750-1469P.txt file - cDNA_ID_2048320; gDNA_ID_1620531; Annot_ID_159741

SEQ ID NO: 22174 - DNA, 3003 bp, Unknown
  misc_feature (1)..( 3003): 2750-1469P.txt file - cDNA_ID_2048337; gDNA_ID_1620531; Annot_ID_159735
ctatgacggagccacgaatttcatttataagagtcacaaaacatttatttttctaaacctaaaataaaactaaatattttattttcttatatatatacattttaacctaaaatgtttcatatttcatctttcaaaataaacatactctcaacttatctttttttagttgtatcatcaaattccctttctcatcaacactctttttgttaatatattgtggagattgagtagttgttgtgtttatcttgattcatgatttttagaatatatattttagattttttttttgaaaagaatgtagaaactaaaactggatatctaaaaagaagaaaaaagtattgatttgttaatgaatattacagggtttttaataagatattatagtttttataattagccaaacaaaaatgcaaaaaggcattaagattaaatgacaaaatgaatatgcatggggtcaaagacaagcataaatcacataacatgaggtcattgtgagtactttaacccaaaacatataattatcttagaagatataccctatattttttttttaaactataaattttatgggggtcgactgagcccccttcttgtatgttgcctccggcacacgtatgattggattttatcatctccatgatacttcagagttctgacaatctcgaatataatgccactttgtttttttgctttgtaatggacatcatcgatgcttcaatcttcgaaaactgaaaataacgtccgtctgttttcttccaaggtcgtgtggtagacatgacatcttttcggattatgaacatgagaacagcccttatcaattgtttgaaaacaaatcgaagatactcatatttcggatgatgtctattgatcgtccagaatagattctaaacctctgcttccaatacgacgagaaggatctccgatcgaatatggaaacgtactaccaacgatgatcccgaataattcatgttgcaccacaaagcatgaaacatcttctttatttaattcgtacgacaacattctattagtgacagaaaacaacaattaactttgtagctgttaaaaatactggtaaaagataaaaaaaagattgagccgagtttatctgttgtatatactattctttttgatagatacatacacccaagatattttatcttgacatgtgatgaagagatacggattatcctctgaacaataattttctaaaaaaaaagaagcaaatttttgataacttaacttataaatccacctttttccctaattagaagatggattctggctgattttcttggattagtgttagacagggatactactatttcttaacaatgagatgaggcaatctatcaaggaaagtaaaaaaaaaacgaaacttaaccctctttttttctttttttttttatgttagaccaatcacttcttgaaaagattccgtaactagacgatttttatatatatttttttattttttaatttttaatatttccacttcaaatataaaaagaaagtatatttatttgttatagaattatgattagaatatgaatacaaatgtaaaaaaaaaatgatatagaattctatagaaaaaagaaaaaaccttataagctagtcataccatttcatttcattatattgacaattaaaaaaaactgatcatactatgatcatagtatgatggcggttgagcaagtatgcccccatcgtctagtggttcaggacatctctctttcaaggaggcagcagggattcgacttcccctgggggtagggtactacgaaaggaagttgatcatggattatccataaagttagaatagattcttcctgggtcgatgcccgagcggttaatggggacggactgtaaattcgttggcaatatgtctacgctggttcaaatccagctcggcccaataattagctgtctacataaccattttttttttttgcataaatgacagagaaggggtaagaaaaaaaggtcaaatttcagggtatagggtatagttcgactttacttttttttttatttcttatgtttagttacttttttttccataaaaaattccgatcttgatcttgctaaggattccgatatggatcctttaaagagaaactttaatgaacagagtcgataaaataatctatttgcttctgttcaatatataatgactgaagctaactttggttggttaatccgatcagttcatcgatggtcgtatagtttagttatttaggcaataaaaggtaggggttagaaattcagatgatggtacaaaaattaaaaatagatgccaatacgtatatttttcttattaaaaatattatatcaaataataattaaaaaaaaatatatatatatatatataaatatacatagcacgcaaataagaaaatgcattattgaatattgaagaaactatgattactctttgacaacaaagagaaactataatcaattaaaaactttaattagaataaacttgaaagaaaatatgagtaatacgttttcttagcagaaaaattcgttttggaagagttgagtgtgaatatgaggttttttttgggtgtatttactatttacagtaattgttagaagtcatgcttatcttttgagaatttgtatatacataattcattcataaacgttaaaaaaaatgtgtttatatgatagcttttaatcaattgatgtacaatgaggtaatgaaactcagatgagtcaccaactaagttgagaacttgagatggattcaatagtcaatgatgctaggtgaaataacgtaatcaaccaaaaatattattcaatttttaattcgcattcgcaaacacgaggcacataaaataatattatcagtctcaataaaatcttgattcttgatcttgagcatcccaaagcattattaactaagcatgtatctcccactaaggcacaaattactaaccatataagtctcagtactctctgttctgcaaacttcatacacaaaaccaacattaagagatg

SEQ ID NO: 22175 - DNA, 3003 bp, Unknown
  misc_feature (1)..( 3003): 2750-1469P.txt file - cDNA_ID_2048370; gDNA_ID_1620531; Annot_ID_159726
tgaaatcaatcgcacaagaatatgatgtaagaaaggataacagtgtccataaagttttcaaattcttttctagtagaaactaactatctaagagatgcagggctttcttccatatccatattcaagaccaatcaaagtgcagtggaaggtgttcgagaaactgtttgtagatttccgtgacttgcttgatcattcagagtactgcgacttaataggaattgccaaaaataagtttcaaaccataccttatgtttggttaggctactaaacttagcctgcttcttccagtttccacagccctgtaaagtaatttgaggtccaattctacaacatacttgtacataagacattcaaagtctgcatcttgtaagaaagaaagacgtgtaaaatgcagattcttggccatgtataattcgtggttcgttttaaagcaaaagtcaaacattttgttgactattttaacttcttcgttacttgctaagttcagttatccatccactttattcttcttcttggaaatggctctcatgaaagtaatgacgattctggttctcttcgtctcggtgtcatcgaccttggcgcaatccaacaatggcggtcacatttcgataatcgtctcggaaacaggtcttgaatttgctaaagattacctcatcaagaaagtgatcactacgacgcttccacttcagctaccagacattgagaataaggttaagatccctctaatcgggaaagttcgaatgggtctatcgaatattcagattgatgcagttcatgtccagtcttcgaagatggagactcgaaaagatggaatcattttgagtgttttaggtgctacagcaaatttgagtatggactggtcttatacttacagagcttccttctttgagatttctgatcatggagatgcttctgttgaggtaaaactctgaaattatcgaaaaccaaattgggtctttttagttttgttgtttgtgttcagaacattgtttcatcatcagaagaaaaagcttaacaggtgaatgattatgacgatgaaggttaaaggaatgaatgtgagaatcactgccactttggttaatgataatggaagtctaaagattgcctcacgggaaaatgattgtacagtaaagaacattgatattcatatcaatggtggtgcttcttggctatatcaagggtattattaaatgttccataagttttcgtatctctaaaatctcttattccaagattataatatttgttttcctttttgcagggtggttgatgcatttcaaaaaatgattatatctactgttgaaaaaactgtctctactaaaattgtagaaaaaatgaagaagcttgattctttcttgcaatcacttccaaaacagagaaagattgatgactctgctgcagtgaatctcacttttacaggcaaccctgtcttagggaattcgtcggttgaagttgacatcaatggtttattcatgccaaagggtgatgatattaaagttgcagggtctcgttcttcttccttctttggtggggttaataagagaatggtgacaatttcagtagaagaaggagttttcaactctgcaacacttgtctacttcaacgtaagttctcaaatcttgattagagtatggtggaacaaaacaatttgtaagcttattggattggttttgattcaggctaaggtgatgcatttagttatggaggaaacaaagaacgggtccattctaagcacatctgactggaaactcatccttccagagctgtacaaacattatccagataataaaatggtgcttaacatgtcagtaacatctcctcctgctgttaaaatcacagagaatggaattgatgcgacgattcagctagatatagcgttcgatgttcaagactctggagaaaatctatctgtagcacgcctatcaacagtaagactaatagtaatccaccaaacaatctaacttaagaagcatcttttgatcactaaagttagaatcttgttcttgtttgcagattctgagtgttgcgtgttctacagaaatcgtaaagaataatctaatcggtagcctcagattaaatgatttcaatgcaacaatgaagtggagtaaaattggagagtttcaaacaaactatgttcaggtaagtcaagttaattatcttgagtttaagatttatcttgattagcatcaaactggtggatatgtgttcttgttgttaggctgctacgtctaggattcttgaagccttgtttttgccgtacgtaaacacacgtctcaagagaggattccctttgccgattcccggcgatttcacgatcaaaaacataaagattgtttatgttaatagtggcattttggtatgtaccgatatcggcactagcacaaaccagtaagcaagtattatatagcttcttagattgcatgtacgtaagcctgaagaaatataatgacaaccataattgtgatttgaaccgtttggaacttcccctctaagaagcgttttgacgagatctctttatttctttggctacttgcattatatctggaacttccccccctaagaccaatgcatctttctgagaggttaaggaaaacttccattaggcaattgcaagacacggcccaatgatttatattacaggcctgttaaatatgggcccaacttcgtaaacaatcaaaatattattcatatgtacgcaaaacaacaatagaaaaggataaaattgttattctattatatctctctaggacaaaaaaaagtaaagtcaaaagatcctctctcatcgatctctctctaacatctccgtcttctgcttcgtgtaatttgggtattgttggctccctactctgattcctcaaattccttatttttattaacccgcgaaaataaattataaagagggctttcaaaattttgaacctttctctaacaatggagatctccctccttccctttttcttctttcgcgtttaaggtttctcctcgtctcttctcttttcaatg

SEQ ID NO: 22176 - DNA, 3000 bp, Unknown; identical to SEQ ID NO: 2407
  misc_feature (1)..( 3000): 2750-1469P.txt file - cDNA_ID_2048382; gDNA_ID_1620531; Annot_ID_159724

SEQ ID NO: 22177 - DNA, 3003 bp, Unknown
  misc_feature (1)..( 3003): 2750-1469P.txt file - cDNA_ID_2048407; gDNA_ID_1620538; Annot_ID_159964
aatactatttttatttaaaaaatacaaaaactttcccttgtggccttgtgggtcatatataataatacttgcaaattccttggcaatttctatttaaaccgatttcagtagacttgctattgtcatcatttcatatcttagatcatctctcttctctctctttctcttaagaatattggaaatttctgaagcttttctatagttgatctcgagccatgcctccaatggtacgccttctttttcctatgatatctcttaaaataattatgcgttgaataatcgtttgtatataaatactatttgactatatatagttatgttaatcaggttgaaaatatgtaattaaccatactgatctctgttttgaaataacagaaagctgtgttgcaattgagcattcacgaggaaagaatcaggaagaaagcgtttgtcaccgtttctcgatgtccaggtaactttattagttacatttttcgaaatttataacatgatatattgtttggaaaatgaacttatattcatgtttttttcttttgtctaaataggtgttacttcgataacaatggatgacaaaaccgggaaaatgacagtagttggtgaagttgatgtaccggttatcgtgatgaagctaaggaagctatgtaacacagagcttgtttcggttgaagttgttaaaccacctgagaaaaagcctgaaccagagaaaccggctccacctaaaccagctccagctccagctaaaccggctgaaattgttgcctggccggttcagatgaacaacccttaccaatacaatcctgcctatgcaaattcttactatcaaccatatgggaactctagatttgtaacggacgaatcaaattgtgtgattatgtgataacttatttcaaataatgtgttaagttagttttgatggaagagtgtaattttttagctactgtaatatacatttctcatatgagcttattcagaaaaatttatgttactgtatgataaatttgatctttatacgttttgttaactttaacttttaatcatttagtaatagttgatctttttcctatacagaatattattctctatactttgtcttttgcttatatactaatcaaatggatacaaaaatatcacacacacacacacatagttaagtcgctctcaacttatttatgaatatcaagtaccaagatcgttcacgtaatacattcaattgtccaaaactaaaataattttgaaacaattagagaatgagatattagtaaagatgtgatgtagagagtcaagatctgaaagtctcctttagcaaaacaaatactaatcaataaaattcctacttggagggatccacatgtaaactgaggctttcgaggacatttcctttcttgactatgaaatagcagtattatccgagtcttcttaccatttttcaaatataaatcgcacatttacagattaaaaaaaaaaaaattggattcatgcattgagttgattttgaaatctaacaaaactcttgtgttacttttaagtcatgacttctaaaattttagtttaaatcatgtgttattaaagtaatcgtttaaaatacaaattaaaatttgtgttaatctattagtattttaaaattacaaattaagaattatgttttttttgtctgcgaattttgttttcgttgcgcaaccaaagaattgtgggtaagaaatgtgtaatacaagtatgatgcatatagaatggctcgccatgaaaaaaagctgcataaatgaattgctaggatcatgaatgttaagttgatcaattatactggatataaaagttaaagtatcttcaaatgatactgtatcagacaaaccaaagaaacgtgtgagtatattagaaaatgaaggtatttagtacatttttatatatttaatgagattaacacttctaattatagtataatttatacactaacgcgttaatcaaaaatagacaatttgacgtagtaggagagtcagcttttaatctaaaattcgaaaaaatgaatatactaaatagctcatctctgccaataatgcttctcttgtttattatactctttactcacagataaatatagcgaaatggagagactagctagaaattacaataaaggatcacatacattgttacctaattattattttcttaaaatttgaacaaatacgtgtgtcagcattatgctaatcttctttgtatcgtttcaaaaaatttcaaatattcccggtaacaaaaatttgaccttaagaaacaaacatgtacacaaatattcgttgccatcacaaacacaaaacccatagatcacaaacacgttacaacttgttacctttttgttgttgttgttcttaatgattttgctacttgttactttcctcttgacttctttgatgatctcgggctttcaactgttttttgggcagcttcgaattattttcgtgtggctctgagtaggcattatattgttacgatacctagagacaacaacgataacattgaaacaaacttatctttcctctctcactattcacaacaactttaaaataaaataaaagaacaattgtgacaatctcggttttatttcgagtttatctattagttctgaaatgattcaacttttccaagaacacactgtatagaactttcctgagaatttcttacgtgcccaaagtgccaatagggtcaacatatggacagggtcgtacacgcggcattctgagtgatccgtaatgctttcgtagtttcgttacaaccaaaaatagtaaaatactaaaaaaaaattaattttttttgactactttactctttagtctttacaacaactttttggggtcatcatactcgcaaattcctacgcaatttctatataaacagatatcataagacttgcaatatgtcatcaagaagcttcgatatctcaatctatctctactcattctctcttaaaaaaaaaaaaaaaaatcaaaaatttctggagtagtttctcgagccatg

SEQ ID NO: 22178 - DNA, 56 bp, Unknown; identical to SEQ ID NO: 340
  misc_feature (1)..( 56): 2750-1469P.txt file - cDNA_ID_2048407; gDNA_ID_1564067; Annot_ID_148788

SEQ ID NO: 22179 - DNA, 3000 bp, Unknown; identical to SEQ ID NO: 2500
  misc_feature (1)..( 3000): 2750-1469P.txt file - cDNA_ID_2048538; gDNA_ID_1620548; Annot_ID_160218

SEQ ID NO: 22180 - DNA, 3000 bp, Unknown; identical to SEQ ID NO: 2499
  misc_feature (1)..( 3000): 2750-1469P.txt file - cDNA_ID_2048541; gDNA_ID_1620548; Annot_ID_160217

SEQ ID NO: 22181 - DNA, 3000 bp, Unknown; identical to SEQ ID NO: 2501
  misc_feature (1)..( 3000): 2750-1469P.txt file - cDNA_ID_2048545; gDNA_ID_1620548; Annot_ID_160216

SEQ ID NO: 22182 - DNA, 3000 bp, Unknown; identical to SEQ ID NO: 2503
  misc_feature (1)..( 3000): 2750-1469P.txt file - cDNA_ID_2048579; gDNA_ID_1620548; Annot_ID_160206

SEQ ID NO: 22183 - DNA, 3003 bp, Unknown
  misc_feature (1)..( 3003): 2750-1469P.txt file - cDNA_ID_2048590; gDNA_ID_1620548; Annot_ID_160204
cagtaaatgtttagtgaactaatctgtgatttgacttttcgctcaatgtgaatactttcttatatgatacaatcgtaattgtgtagaaaatacaatattgtagtcgcattatctattatgcctgaccactagaaagtctttagaattttggtcatagtcatacactcttacttgtttagttgtttggaaagagttgacttttgtaatcccttcaataataatcatctatctcctaattctcttttcaacaaaaatatttatataaataatgattcaaataatcaaataaataaacaaaatcataacaataatatagcacagcgggataaacaattaatcaacttagttttgcattttaagtaattttttggataattctttctagaactcaattctcacttttataattcgattttctcttataatcccaaaacttatcattcaagtgaatcttatttttgtgattttcctccttctcttcttttacagagatatactcgaaatcttttttacccttttatataggtcacgaacattctatccatcttttacgtaatagatacacacacaaaaatacagtaaaatattttaaaacgaataatataattaaaatgattacgtacactttgggaccaatccaattacaaaaagggtttcgtcactgctttagtttccaacaccaaaccaaacaaaaaaatggatttaacaaaattaatatcattctctctcttgtttctatctcttctaatcccgacgacgacgacgaccacttccaccgttacatgcactaacgccgtttgtcgccgtgacggcccgatcatccgttttccattccgtctaaaacaccaacaatctcattcttgtggttacgacaaaggcttcgacttaacgtgcgatattaacgccggtaacagaacaaccataacgttaccgttttccggtaacttcaccgtggaagagatcgattacgcagctcaagagatttggatcaacgacccaaacaactgtcttcctcaacggatcttacagctaaacctcaactcgacgccgtttagtggcgtttacatgcgtcagttcacgttctttaactgtcctacttcagagtatctccgttttaggccgttgaatccgataacgtgtttgagtggtaaaaacagcacggtgtttgctactccttcgcctagagtgataaactacttgtcgtctcaatcatgccggttaatgaaaaccgtttatgttccggttcggtggccgttttatgagcaaatcgtgtcgtcttcggatttgagtgataacctctggcttacttggagggttccaagatgtagtaggtgtgagattaaaggtggtaagtgtgggattaagagtaattcttctcgtgaaatcatttgctctcatgttcataaaccaggtaattaatatttctttgttttcaccctaattttttcatttttttaattatatttagttttaaaatttctagaacgttaaacgtatttgtttaaaaaaaaaaacgtatttgtttttataatgtgaagatatgattttgacgattagagtatattagtttgacgtagaccatgacgaaattttgtttgaatgagtcatgtgtttatgtgtgtatacaggtttataaatttcgttgaaagacgagctacatataaccaattatatttgtccgttctggttgtttaaatatgaaaactacatgagactattcaactagatatttttgactaatgaaaccaataggcgaaaaatacatcctactatattatttgggaagtacattttaaatataaccttaatttttgtaagtaattacataggtatgccattagaaataaaattttaaagagtaaattaatttatctctttaacgattaaaaagtcaattactaatttaattaattaaatttaattaaaaaacgaaatacattattaattttcaaaaataataaccaatcaaaatcaacatataagatttaatatctaaattttaattaatttaatttaattagaaaaacgaaatacattattaatttctaaaaaagtaacctattaaaatcaacaaattagatttgatatctaaattatcatattaatttttttattaattattatagttcacttctcatctttatatgattctattttttcaaaaaataatatcatcattataaaaaaataattagagtttttcgcatatgccataatttgaatttttgaaaactaatataaactgttcaatacatgaaaaaatattataacgggtgaaaaatagatttaagaaaactttctactgagtaacgggtcataatttgaaatatttatattcaatttcatacatattatattgaaaatttataatcttatatactacaataattaataacatattagatttttttatgtgtatgatgtgattcaatttttaatacaagctggaaaatcctagaattaacgggtttagatcgatattaatacaagatggtatattacaggtgaaactcttaaattaacaatcaaactacaagtgtataatcttaaacactaaacaatatagataatatcaacaaaatatatacaactcacagtttacttttaatattttatatacaaaatcaattaaatcttaatcacataaaaattagcacaaaaaaaagtattcaacaattaaaattttatcaaatctctgtgttatataagttttgatactatattcgaataaagtgtaatataccttttcaatttgtattctttaactaatttaagctaattaatatatttactaatcttatacctatcaaaaccgactatcgtttcttatttctatagtatttttgcaagacttttttggtggatttgggtaaaagtgcattcggtcatatggtacattcccctattaaataaaaatggtatactcctatgttattagctaaaatgtttagattataattcagagtcatatcattaataaaattaatattaataaaataaatg

SEQ ID NO: 22184 - DNA, 3000 bp, Unknown; identical to SEQ ID NO: 2511
  misc_feature (1)..( 3000): 2750-1469P.txt file - cDNA_ID_2048606; gDNA_ID_1620549; Annot_ID_160263

SEQ ID NO: 22185 - DNA, 3000 bp, Unknown; identical to SEQ ID NO: 2512
  misc_feature (1)..( 3000): 2750-1469P.txt file - cDNA_ID_2048612; gDNA_ID_1620549; Annot_ID_160261

SEQ ID NO: 22186 - DNA, 3000 bp, Unknown
  misc_feature (1)..( 3000): 2750-1469P.txt file - cDNA_ID_2048616; gDNA_ID_1620549; Annot_ID_160260
cgtagaatttagacaggtgatgttaaagaaaacaaaaaaagagaaaactaataattgtatatatatatgtatataaataaatattagaacatcagccattttgtgaataaaccagttataaaagtctaaaaaaggtaaagagaaaaacatttcaccaaaaaaaatcctctggttaatgttttctcactttctctttgttttctttctaacctctttccacgaaaagtcacgatgggagataccgcagaggatcaggacgaccgagctatgatggaagctgaaggagtaacgagcttctccgaacttcttatgttctctgacggcgttctcagctcctcttccgaccaccaacctgagggtaatgtcggcgatggtggagaagacagtttaggttttgtattctccggcaaaactggctcaagaatgctctgttttagtggaggctatcaaaacgacgacgagtcactcttcctagaaccttctgttccaacctccggagtctctgatcttgacccttcatgcattaagattgattgcaggaactcaaacgacgcgtgtacggtcgataaatctactaaatcatcaaccgtaagtctctcattactgattctttatttgcatagttgcatgtaattaaggattacaaatttaaagatgtgttttttattgtgtgtgtcttgtgaagaagaagagaaccggaacgggtaatgggcaagagtcggatcaaaatcgaaaaccgggcaagaaagggaaacgaaatcaagagaaatcatcagttggaattgcaaaggtgtgacatttaatagtatgtatatacacatttctttatgatccatattgttatagattaatattctcttgaccataatgttatagatttactgtttatcttttttcgttttggttgttaaaatattaaaattaggtcaggaaagaaaggttaggggaaagaattgcagcgttgcagcagttggtttctccatacggcaaggtgatttttatatctaactcaaattcttttataatgatgcaatttatgattttgttaagtcaagcaagaaagacctctaatcataacataacaccaaagtaatgaaaaataatttgttttgaatattaatatagtatttcatattgagtttttccaaaaggaagcttaagaagtcgcgatttggggtagtgtagcataaattggcatccaatgtgaacttcaaaaagacatgaaagacaatgaaacttgatcaataaattaaagtatctttgtttttctttattctagtctggtttatgtttaaccatcatcattgtacattagttaaacaatgtgtacctttttagaggggtaaaattaccaaacaaatatctataaatgaccctatttgcaatagtaaaatatctataaatgacactatttgcaatagtaaaatttgacttttctgactgatacaaaaataaaattaaatgacagacagatgcagcttctgtgttgcatgaagcgatgggttacatcaaattcttacaagatcagattcaagtcctttgctctccttatctaatcaaccattctctcgtaagtagaagtctctctctttctctcttaattattttttattaatgaaatgatacttctgacatgtcggcgacgtttattaggacggtggagttgtcaccggagatgtaatggcggcgatgaaagcgaaagacttgagaagcagaggattatgtctagtacctgtctcatccaccgtacacgtggaaaattccaacggtgctgatttctggtcacctgctactatgggtcacactacgtcaccgtcgttacctcaaggattttaattaaacggtcgtaggctgatatatattagtagtattttagtagccttttttcttgggttttgtttttggctgaagaactattactagtaaatgttacacccagacatttttttgggattatctgggtggtataaaaaggttggaatcttttgtgtttgtaaaattagattgtctaagttttcttaaagtttctttgatgtcactgtcacagttgcgacgagtagtgatggtacttactgaaaggctaagcttattcacgctcttaaagtgttgtaatgccaccaagtcaccaacccacataactcactcactcacttgagctaaagacgtgcaaaacgttttttctttgttttcccacattttcacaagcgcggtaacaaagaaagcaagaatactataatattattagaccaaattattaacatttaaaaatagattgaatcttttgtgtttgtaaattttttctggtccaatttttctgaatgtttctcagatgtcagtcacgtcgagcagtggaactgagaggctaagatttactcacacctaaatattgtagtaatgccaccaaaccacatcactcactagtcactatagtagacgtgcacaaattcttatttgtttgtttcttatttcaacaagcaataatcaatgaaaggtttattttgttactagaccaaattagtctaaatgattaagaatagtttaatcccaatcatgtcccaacttaaaaaaagaagacatgaaaatgaattaattagaatttttaagcataatcagattagttagaaattatagtatagttgtttgtgttagtgttatggatgttttttcatcaatcaattagatatgaaatgttattatttatttattttgaaaatagactgaaaatttgaaatttttttaactagttaatgtgctaaaatattatgtaacttttccagtaaaattatattaagcttaaaagtagttgtttttgttttaaagggattagattgtaaaatcccagaatttaagatatttgcaaactacacagacacacttctactttgaccggtaatttcattacatcgccggacggccggagattttatcgctctctctcttcctctccatcttcactacttaaatctctccctccgtatctttctctggtgttcgccaatg

SEQ ID NO: 22187 - DNA, 3003 bp, Unknown
  misc_feature (1)..( 3003): 2750-1469P.txt file - cDNA_ID_2048620; gDNA_ID_1620549; Annot_ID_160259
tcttcaattgttttatatatatcgagaggccgaagaaatctgtaatcacagacagaggaaaaataagaataaggtgcagtttttttgttctttgttgttatttaagaagattaacgtaaatagtttccgacattaactagtttgcgttacattggtcctggttgataatgaagaagatgtacaatcttccaagagatttgccggaggaggtgctctgtagaattccgttgacatctctgaggcctgtccgatctacttgcaaaaagtggagcactttatccaaatgtgggagctttgcaaagaagcaccttgctcaagcaaaagtactagcagacgcaaaggagtttatggtggtcttgatgatgaattttagggtttatttgatgagagtcaatcttcaaaacaacgttgttgaatcatcatcatcatcatcatcatcatcatcatcatgtataaaacgtgaagctaaacttattagcttaggcgatgaagaagctgatatatctcaagtctttcactgtgacggtttattgttatgcatcagcatcaccgaatccaagactaggctcgttgtttggaacccgtattgggggcatacccggttattcgagcccacacatcaattcaacaaattcgatagctattcgtatgctctcggatacgacaagagccgcaaatcccacaaaatcttgaggggtattacttgtttggatcccttcaaaatctacgattttaactctgacttatggagggatcttgatgtaactccggagtggcacttatggcaaatgctccatggcgtgtctctcaagggaaatgcctactggtttgctagagagaattataccgaaacaatggacacagaccattttttcttactctgttttgatttcacaagcgagacatttgggccgcctttgcctcttccgtttgagtttgctgtttctgaagatactatgagtgtatctagtgttagagaagagcagcttgttgtattatatcagccgtgggattatttacagttggacatctgggtgacgtctaagattgagcccaacgctgtgtcgtggaacagcaaggtgttcttatcagtgagtttaaaacaactcgtcagccctcagtttcagttaacttttgggagtttcttcatcgacgaggagaagaaagtcgctgtggtttttgataaagactacgataataagcgcaacatagcttacatctttggagtggatggatcctttaaagcagttgatctcggagattcagaccgaaagtgttttccacttgtgtgctcttatgttccaagtctagtgcaacttaattagtcgaccatctattccttgcttactttttttcttcctcttttgtcatcttctttgaacaagatcattatttgttagtcaataacatattaacttgtttctcatacttgtttttgtttgccatatatatttgaattcgtttccaaatggtgcacacgctccttcccctgcagctaatcgtttgttactttcagtccccttaagttggagcaaactgtatgcttcttggttggcattctccgcgaaagcatgcatcgtttcttccaagagtctttaggtattgatagttcatcgttttctttttctattgtaacacagtagcagttaaagataagtcgaacgggtgatctttttgttcattagacaaaactagagaggtttctcttctctttcttctagtaaggaacaaggctaaggttaatagatagctagctatctgagatatctcacaaaagctttcactatggccctgtactatatcaacttcatattttaggtgtttcatatttcagataaaatgtgctcatatcttcttcctctttgttcagcgtcttctgcaaaagtgatatagatcttgacatgctgctaaaatacctcttgatatatttagtttttcttaccaatttaagttatagcataatccttttatcatgttagttattgttctatcctaattgtctagcatggagtagaatgattttgaagcagggacttgtagaacgatttttcgtgtgccacaggtttactcccttccttaatgtggtgaccagcgcttgtccttgtggtctgtccactcattctgctatctttcaacgaatatcacaaaataatagtggttagtatgtctcatatgattaccttaaatttagcggctactgactgatgaatcatgaggctttacgctactactatttctcttgtgttccacaaggcgtttccaatacttggtgatatcctccaacgacatctgcctagtattttgaccttgccagttgccaaatcaattaataaacccttcaccagaagattcttactacatcaaacaataaataaaactaaagtttgactggaagaagagttttggaacgttagacaaattttcagcatttgacgatatgaaagatgtctaaatctaaagaaacagagatacaattctttcaatattatatacttgctaactatcaagaacaggcatgaaaaaataaaaatattaaaaaaaaatacatattactatatagaattcatatgtcatcgataacttttacattattttttacaatccgccttacttaaacgcgccttatctaatagatatataaatgtatctctatttatattataatttaatttaaaatcaatataaaaaaatgtgttttttcaatttttaaaccacataacctaatagtataatatttgatatattattattttgttttaagaatgtagtatatttgtattttattagcaaaaccattattaaattgtaacttttttttcttctatataaagtttcaaaatccacttaagaagtgaagatataagtgaacaaaggatgtagcgtaatctagcacaacatatttaaacctcacaaaacccacccgaaagatgaacccatatctctctactctgttgctgacgatacatacacctttacttacattatattcccgccatcgcgatg

SEQ ID NO: 22188 - DNA, 3003 bp, Unknown
  misc_feature (1)..( 3003): 2750-1469P.txt file - cDNA_ID_2048633; gDNA_ID_1620549; Annot_ID_160254
gcggtggtgaaactggcggagggggacttggcataggatcagtaggaactggtggagtgggacttggcacagaaggtgtaggagtcggaggtggtggtgaaactggtggggtgggacttggcacggaaggtgtaggagtcggaggtggtggtgaaactggtggagtgggacttggcacagacggtgtaggagttggaggtggtggtgaaactggtggagtgggacttggcacagatggtgtaggagttggaggcggtggtgaaactggtggagtagggcttggcacggaaggtgtaggaggtggtggtgaaactggtggaacaggagcaggaggagtgtatccaccgtcatcaccaccactgtcatcgccgccaccatcgtcgccaggggaaggaggaccacatatgggtttgcaagaagcacattcgacatggcaagagtcagggcaaaacttgggacaaacatgttccaagttgtaacaatgtttgtacttcttgatcttacatgttgcgtggcttgggttcttggctatgcccgggggtgtatcggccattgttaatgcaagtgatgccaggagtatgcatcccaatatttgaagtcttgtgtgtttagctagatccattgccaaaccaaacaaagaagatagaaaggtgtttgttttttcagttgttgtgtgctttaggatttgatggtatgaatgatgatgatgcagtacaagtgctctgatatggtttatatagataaatatgttgggtttattaaatatcatgttggagtctttttaatcttttaaacaagggttccttcttaaatctatatggagcttgtaatttaagattattaacacctttatgcataacttagttatattctgtatatacatgcttcaagtttttatttgatcgcaaaacggattctcgagtgttaactagtagtaggttaaaactttcacaatataattaagatgaattaaaagatttctcgaaattttgattaaaaggataaaaactaattagcctaccattgaaaaaaggcttggccatgatcattattttggttcgaatttttttattaaaaatgagaaatggggttgttaaaattttagagattaatactgataaaaatatcatcaccttagttgacaattaacttgacatgtaaacaattttagcgtaaagtcaacctcatatttaactaggcaatatatacaattagccattagatatgaaatatataatatctagcaaaactgttagaatgagtttcgattccactttatgcaattctacgtaatacataatgtataaatgtgatattagtaattatatgtataatcatgtaaaggctacatgaaagtttatggggaatcactttgcgatgaagtgatccgcatgctacttgaatttcgtgtggtagcacattttgacattttggaggtcacatgatagaaaacaacaatgataagttaagctatgataaacacctgctttacagctatatgttttcatttttctactttgtcttctatttgaagaaacatcaaaatactgccattttctctgttagcgttaacaattcatcaaaattaattttgtcgaacgatactttgtttcttattcacttaactacatgcatgctttggactttatgcgactcaaggaggcaccgactatatgtgttattatcaaaattctcttctttagttacatatgtgttattatgttccctctctgtggttatttggtcctctttattttaaggactactgttagtccatagtatatcagatatttgataaattgatcggcctgaaccagacctggcttgctcaaagaatatgcagaacaaaagccataaagagagctctgtaaagaatatacagtaaacatgttttatgaattaagaaagcttgaagttgaaaataaaacataactcttctttatgtaaggaaatcaaatttgatcataaaaaacttaacaaactgtgtcaattaaaagcaaggaatactatataccaccacttgttattgaaatatatcagtttattgaattattcaagattacagtgaagtaaatccaaaaaaaggtacaaagggtttgccctgtggtttaatcactagctcgcctcttcttcttgctggaattgagttaaacttggaacataattaaacaaaaatggccagtttgaaaagaatcctaaatccacttttctgacttgattgtcctctccaacaatgtatagcacgtttttgaagttggttccatcatatctagaatatttatcacaacacacgaggactttcttctcctcatcgaccaaaaagcttttaccataccaacacctcaaataattcaaatccaatgctacgaccatgctccaagacaaaacgttggtcatctcatcaatcttataattatgacccatatctctgtccttgatgtagcataaagttgtaataacaccgaaagtttctcttctttaacaaccaatagagacgcaattgcataaaaaggatactgacacggaagtagcagacttctaaatctctctgttttataatcaaaactcactaagaatgtgcaaagatcaacttcctttttatcaaatatttatctttttcgcaagcaaaccaatgagtatttctcttcaaattttttggttactatatctcttttttatcacctaagcgccgtcgtttctcttcaaatctctctgttttataatcaaaattcagttatttttaacaactgattttttgtgattatttagaaagtgaagacaaaatgttaatcctcacctcatggaggatttaccaaaataacagagaaattaacgctaaattaacagttacagtattacttttgtcagaattaccaattaattataagcaaaaatatgaattatttgattaatgagtaatgactatcggttccatctttcccaagttcctctgctccaaaacctcttaaaccctaattcgaatttagcctaaaccctaaaatg

SEQ ID NO: 22189 - DNA, 3003 bp, Unknown
  misc_feature (1)..( 3003): 2750-1469P.txt file - cDNA_ID_2048645; gDNA_ID_1620549; Annot_ID_160251
aaaaaaatattatactaataaatgatacctcattaataaaaataaataattattaaaaggcactttacaaatgttaagagatttgcttaagatatatatatactagattttaacccgcggtataccgcgggaataatttattttttaatgttagtatatataaaagtttacaaattgcatctatctataaaatatttttattttatagtttacaattgttattaagtaacgtcctgccaaacccgtcccgtcaacccatcccgtaaaaaaacccatttattttattaatgttgatcttatttatgatatgtttatgaatcattgtctaaatattttgtaattttgtagtaattaaatgctatcaaattatatctatgcgctttgatgattataatccaattgttatagtcatggagaaaagtaatatcaaaaatgataattttgtagtaattaaatgatattaaatattttggaagttttattttagtaaataatcgtgtaatcgtgtagttaatgtgaagagattttgggaagattgttaaatgtcaaatatttaattcgaaattttttttctaattatcaaaaacaaacatcaaaatctagtggcagccattgtaaataagtcccaactacaggatttatttcacaaaatggctgcaaaaatgtatatataggtacacaatagtgaataaagaaaatagtttaaaagcaaaaccctaaataaaataaaagattgagaggcacgttttcctcaaagatcaatgacgatacccgagctgccaaaggatttgatagaggagatactctgttacgttccggcgacatatctgaaacgattacgttctacttgcaaaggatggaaccgtttattcaaagatgatcgaagattcgccaaaaagcattatgacaaagccgcaaagcagtttctacccctcatgtcaaccaacgaagagctttgtgcgatgagcgtcaatctccatggaacgataccatctttagaggtaaaagataagccttggctattcgtttcagattctaagcattgtgatatcgaaatatctcgaatctttcacagtggcggcttgttgttatgcttctcccgagacggcgaaatttcaatcatagtttggaacccgttaactagtgaaaccaggttgattcgaacccggaatcgtcgcgataaaggacgcaactttgttcttggatactatcaagaagacaaaaaaacctactacaaaatcttgagcttttatcttgatagcaaagatttcgaaatcttcgagtttaactctgattcatggaggtttattgatgatatctgtccaggcttgtccttgctatactctgatcaatgcgtgtctttgaagggaaatacatacatgtttgctatagatgacttaagtgtatccttgctcaaatatgatttttcaacagagacatctgttcctgtacctcttccctataaaagtcgttcttttgaagctattagtctttccgtggttagagaagagaagctctctgtgttattacagcgagataaaagttcgaaaactgagatatgggtgacaaatgtgattgatgaaaccaccaccaaagtgatggtggtgtcgtggagcaaggtcttatcattggatttgagccctgatcttaaaattaggtatggagaaagtttcttgctggacgaagagaagaaagtgatcatgatttttaataaccggatggaagaagagaacaaatccgaagacaaactatacattattggggacgacgataataaagccacacaagtatatacaatccatggatatggaccagctgtttttaactattttccaagtttggttcaaatcgagcaaagctctaggcaagaggaaaagagttgactgaataaacatgtaatctccattttttgttctcttaacgtaaacatgttcaaaacaaagatttaaatccatactacaaggtgtttttggtgtttttaataaatattatggtgtttttttaatttatatatttgacctttgaattatgaaattcagagtatagataccaaattaatttatatatataacaccacaatatttataaaaagaatttgtggtctattttgtgatatatttttttatataccaaaataaataaataaaataaataaaaagtattgttcttctagataacacatcttttaagttaaaattgagttaaaatagtcaaaatttaattaattttagttaaattatgggtaaggcaaacttgatgaatttctattagttaactgatcgattcaattagaaacgtagttttagaataaaacaaaaatatatgtagctttatctagattaaaaatttttttgataaatttttcagtgataaaaagtttggaatggaaaactgaaattataacaaaaaattcaggcaaccctcttcacaagtttattttagtaagctcttggaattttatttaacgttaaaataaattttggagagatcacgtgcaacgttggattcagatctaaaaaccatcaagatctaacggcaaggattaattgttgactgaaactccccacgtgacttgagatcaccgatacactgtgtttttgtttttccccaatctaaaaatgtatctctctcccgaaaatttaaatccctagctattaccttactcgtcgttctcttttgattttcatttcccgaagaagcgttttctcaggatatgcttctcgatctctgaggttttccccttcaacttctattggatgttccttttttggatttggtcattattatgtgattccttttttcctgatctgaattcgagatttttattcctttgattaaatcctcaaattttgcatgttttattaatttcctgattcagaacatgttttatttgatttagatgtataaagaatcttttactcaaatgtattttgattgatgcttacagaagaaagggatttgcaaatttgagaattcacattttggattaagatagaaacgatg

SEQ ID NO: 22190 - DNA, 3003 bp, Unknown
  misc_feature (1)..( 3003): 2750-1469P.txt file - cDNA_ID_2048658; gDNA_ID_1620549; Annot_ID_160248
aagaaatgaaaaaggaatatttttcattagttagtgtacattttaatagtaataccgtgtatgaccacgacatcatcaaataataataatatgatatcgtatgtaatttttatatagtagtgtgttatttaaaagtttccaaagtgcgtgtaacatatgggttcctagtaccttccgggaatggttagcgtcgtcaagaaactactctgtaaaaagttagaattaggttttccaaactaagaaacatgcttgtaaccaaaatttaaacaatggacaaaatacgaatggaattatcttgcccatgtgatgtgacgtgttttttattttcaatttgtttttattccagaaaataaaataatgacacgttggagccaatacgaagaacacatctatccatcccaatcgctctccacttttctgctcttcgacgacaaaagtttcaaactctataaatacttgaacgcaacagttacaaaaatgtcaaatcgaaaacaaacacaaaaagcaaacaaatatggctacttcaatcaaatctataaccctagctctcttgatattctcagtgttactaatctccttgtctctcggctccgtcacagcgacggagactacacgaaacgaggcggaggcacgacggatgtatgaaaggtggcttgttgagaatcggaagaactataatggtctcggagagaaagagagacgctttgagatcttcaaagacaacttgaagttcgtcgaagagcacagttccatcccgaatcggacttacgaagtcgggttgacccggttcgctgatttgactaacgatgagtttcgtgcgatttacttgaggagcaagatggagagaactagggttccggtgaagggagagaagtatttgtataaggttggagatagcttacctgatgctatcgattggagagctaaaggtgctgttaatccagtcaaagatcaaggatcctgtggtaagtccaattgcgtttgcgttttaatcgcttattttttggcgtttctattttttggttttgagctaatcagggattttttttgggttggttgatataacaggaagttgttgggcgttttccgcgattggagcggttgaaggtataaatcagattaagacaggagagttgatatctttgtctgagcaagaacttgttgattgtgacacaagttacaatgatggatgtggtggaggtcttatggattatgcttttaagttcattattgaaaacggtggtattgatacagaggaagattatccttatattgcaactgatgttaacgtgtgcaattctgataaggtaaagaaccactgatcagtgataacaacgacattgtttgtactttatttatttatggtgtatagtacttatctgttatgttctgttttttctttcaactcatgcagaagaacactcgtgttgttaccatcgatggttatgaggatgttcctcaaaacgatgagaagtctttgaagaaggctcttgctaatcaacctattagtgttgccattgaagctggtggcagagctttccagctttacacatctgtaattttctatgaaccttactttggtttctcttaatccaagatttgtttcgagttcataaaataatcccttttgttgttgttttcagggtgtgtttacaggaacatgtggaacatctttggaccatggtgttgtagctgtgggatacggatcagaaggtggtcaagactactggattgttcgtaactcatggggatcaaactggggagaaagcggatactttaagctcgaacgtaacatcaaagagtcatcagggaaatgcggtgtggcgatgatggcttcttaccctaccaaatcatcaggctcaaacccaccaaaaccgccagcgccttcaccggttgtttgtgacaagtctaacacttgtccagctaagtccacttgttgttgcctatatgagtacaatggtaaatgctatagctggggatgttgtccgtatgagtcagccacttgttgcgatgatggttctagctgctgcccccagtcataccctgtctgcgatttaaaggccaatacttgtagaatggttagtttcttgttctctcttatggcttaaagactttgcttttgtttgtttacttgactgattcgtttatgaaatttggtgtccacagaagggaaacagtccgttaagcataaaagctttgacacgaggaccagcgattgcgaccacaaagtctacaaacatgctagtgggcagcgcttgaggagagataatacaaacgaagaaccgatttgttttcagcccacgttatcaagattcagtcttttgtctttagacacttccaagttggatcatagtttgattactcttgtcaaatttaatgttatcttggatttgattttacttgatgtaaatgtttaagaagtaatctgatatttgcttccataacattgtgtcatcttcatttgataagtttgtaacagagtatcatcattcacatgatgtaagatagattctagtttaaaacataacgtgttaagctataggaaaacagtttggtgatttaaccaaaataaccaaggaaaagctgatccactttaatcaactacaaaatttgttctcttaaccttccagtaagatagtaaaaaacatctgtacaataatgccagacattagcgttaccatacttcctttggcgatcatcatagaatccatacacctagatagcataaatgattttgtgttagagcatccacattggtgggctctcaaaaatataatctctcacgtttgatgaaaagattataaattgtaattttctagaattaaatacgtgacagaatcatatgattttgatatttaaaaatatttattggtctgaccaataaaatatacaaaaataataaagaaaaatcccaaaaacacaactaataattcatctgcctcttcttgtcttgacgtcaactgtttgcagaaatctcactgaaactagagagaaaaccaaatg

SEQ ID NO: 22191 - DNA, 3000 bp, Unknown; identical to SEQ ID NO: 2505
  misc_feature (1)..( 3000): 2750-1469P.txt file - cDNA_ID_2048687; gDNA_ID_1620549; Annot_ID_160236

SEQ ID NO: 22192 - DNA, 3003 bp, Unknown
  misc_feature (1)..( 3003): 2750-1469P.txt file - cDNA_ID_2048691; gDNA_ID_1620549; Annot_ID_160235
agagcattgtaagataccggtggcgaagcctgaccgtctgatccttcttgatccggtttaatccggtggggatctttgccacaagggagataaaagaaagacttaaagttaggacaactctgtttccgcaagaaaaacttggcgcattcccatggtgttctttgattcgtaagatctagaatacaattcatacccacatcaagaatcttcctcttgatgagtgttcgacattttggaccgacctgtgtgaagtaattgtacgagagagaaaggttcttgagggctgagagctcgcagacaatctccggtatagtaccgtagaaattgtttctagccaaattcagctgctccatcttctttaggcatccgaaagagtacggaatcggaccggttaactggtttaactcaacatcgaaaaccgtagctcggttaaggttcccaatttggtacggtaagcaaccagttaacttgttattcaagaaaaggacttcttgtagggacttgatgtcaccaatgcttcccggaataggacctgtgaatctgcatcacatcacatgtaattccccccaaaaaaataactttagaaccttaaaaatacaagatacaattcacaaatatctcgtgacatcataataccaaacttgaaataaaaacagagtaaataactctgtaatttgaaacagagtaaataattccctgataacaaaacgagaatgaaagtgtggagcttttgagacctgttattagcgaatgtgaggtaaagagcggtgatcgatccaagattttcagggagtctctgaacaagattgttgttgttgatgaacaatacgtcgaggtctagattgaaaacctgaggagggacagaaccggagaaagaattgaatctgagatcgagaaacgtgaggttcgttgcttttaacacagagcttgggaactctccagagagcttattgttgctgagatcaagctcgaaaaggtacttcaatttgctgaagtttggaacagagcccacaaaattgttactgtttgcgtgaaagatggtgacttcttctaacttgttgaggaagttatctagccggagtttcttgccacccaagttaaaattgttgaactgaatgctggcaagtgcgaggtcgtttgttcccggtaacttggcgcactcgagtcctatgtatttgtcctgagcgcaaatgtcggtgcctacccatgttttaagtatgctctttggatcatcttcgattagcgtctggaaattcttgatgactggataaactttctttattaatgggcttgagaaatgtagcggcggtggcggtggaggaggaagtggccgtggtggcggtggtgatggtgttatataatgatgataaggagggggaggatagtgttcaggctccggagatggggatggaggagggagtgactgtggtggcggcgggggtggtggcgtttgaggaggaggaggcagcggaagatagtcttctggctccggagatggcgcaggagaattgtaattggtgctatcactgccaccgccgatgatgatttcgagagattttctgtaggtgttgtggttgtttccggtggctagaattgaaagaaagtgaacagacagaatcaagaaaatggaaggataataatttggggccattgctgatagattgatgagagccttgaggattggcttaggcagagctacatatagagaaagtgactgaaaatgatgagaagtcaatgcacatgtcttcttgtgggctggttttaggttacaacttacaatgcaattagctaaatttacatttgaattattggtaagaaaaaatattaattaagatcttcatattataatgccaaagggtggttggatacatgtgtagctatagcttcgttggtgtatgatttttttccgtcaacggcttccacgaaaaatcttggtaatagaaaaagagtaacataaattctttagtgtgtgattagcaaaaaataataaccaattagtatttgcaacaaactattttctaatagaatctgatcaaggactctaccatagattttggtgctttggatccattcttagagtcaaaggagcgaatgcctctggtgagtcaaagggcattggctttgtacagtacaacactgaagaatcagctcacaaagccatagaacatatgaaacgaatgtttcttaacgataggaaagtatatacgttggaccttttcttcagagagatttccaagcgaaaaggagatttaatttcacggatatttatgtcaagaatctctccaagtccttgactgataaagatctgaacacaatttttcaagagtttggaccaacgaaaagttggtgtgatcattagggatggttttggatttgtcaattttaagaatccagaggatgcagagaaagctgttgatgctttaaacggaaagaagtttgaggacaaggagtggattcttacaaaatcgaaaaagaagtatcagagtgaatctgaagtgaagcgaggtttgaaacaggctatcaaaaacagatcacagggttcgagtaacttgtgtgttaagaaattggatacacgagtaacagatgagagcctcaaagacattttttcttcctatggaactataacatcatgcaaggtttgaaactctatacacagaaaaatttgaggtcgttgttggattcaagatttttacatttttgaatgtaaacaggtcactcatgagcgacaatagtggagtaagtcaaagatcaggctttgtttcatttttgaagccagagggcggacgcttttaaagttgtcagtgataccctatgggtttctcaaaaaaaaaaaaaagtattttaataagagagtataaaagactaaactaaaaagtaaaaagaaaaagaattaagacattgaattgagtagcaagttagaactaaattaagccccaaaactgatcagctgttatgtatgattcagtagctttccattgatgaatcaagttcatcttctagatg

SEQ ID NO: 22193 - DNA, 362 bp, Unknown; identical to SEQ ID NO: 2504
  misc_feature (1)..( 362): 2750-1469P.txt file - cDNA_ID_2048705; gDNA_ID_1620549; Annot_ID_160230

SEQ ID NO: 22194 - DNA, 511 bp, Unknown; identical to SEQ ID NO: 2617
  misc_feature (1)..( 511): 2750-1469P.txt file - cDNA_ID_2048793; gDNA_ID_1620566; Annot_ID_160719

SEQ ID NO: 22195 - DNA, 3003 bp, Unknown
  misc_feature (1)..( 3003): 2750-1469P.txt file - cDNA_ID_2048860; gDNA_ID_1620566; Annot_ID_160702
catatttgtagattactgcataagctagtggtttttaatcggtttatttgttccggtttaggaggaacaagggccattacggtttaggatgagcaagggccagtttcaatgaatgtgaatggcggagaagtaaatatagtcgaggaagcagcggtaaaagtaagaatctagtttatttacctatctaagagtaataaagctgctgcatttcacgaacccttatgttctatgatctttaatggatgatatcatttttaatcttcgtcctgtaataattcaccttcaaaacgcggattatacatgtcgttttcctgacaaaagacaaaaattagtaaattactgaataggctctaacttactccatgctatttcaatggttaacgacccaaattgtctctcaaatttaaagattcaactagaaattgccgataatattggtccagttttgggctaataaattttgtttattgggccgactcgatgaccattttaaagaggactcaatagatttttattgatacgaaaatattattaaatcagaccgaattaaaatgccttgaactccggtttagccgacatgtttggcaccctaatgagaatagcttagttagttttgtgttagtctaaagattaaaagtaaaaagtttgattctgccgacaatttcttagatttggtgctatttaaaagatttccctcttcaattttatcgaattccaaccttcaaataggcttttccatacatttattgaagaatttatcattatcagtcacaattatgtgtcttcatctttatacgtacataattactagtaataattaaattctactactaatagaggacggccaaagtgtcagtaatgatgcatgaatggttagttgataaacatctctttcttatgaattcaatttttcaattttttttttttttttttatatttatttcgtatacttgtattttgttgaatattattaatacatagctacataaaatgtgataaaagattaggtaaagtaacaattggtaagaaaatatcacaaagaagcaaatgacaaggatagtctcataagtcataatcaatacagtttacctatgtcaaaaaaagagtctcatatacagtacctataatgttaaaaaattaaaatacttaaaccttttctctctttttttttggtcaacaaaaatagtaaaactttcatatgaacatttgtctgccaaattctattatctagttgaagtaaacatatccaaaatattaaactgagtaggcgcatcatattaacgtttgtaaaaaaaacaactatacatggtgtatctctaaattctaaaactacatatatgattggttatgttgacagtaaacatgtaatttgcttaccgacgagaaatcatgataatatataattgcacatgtacatctatatctctatatttaataattttgaaaaattggacgtacctcaccagatacatgtttaattgataataaataaaaatttgacatgtgtcttcccagatttttgaacatccaactaatagcacatgtgcatgtaaccttcatcacaaacgaaatcgtgataattaaattcagaattcgaattaaactatactaaaccatagttaattagtaaatacttcaattattacacgatattttcatatataactcttgacatttctccagtttatttatcagcgactagtcgattacatcattagaatgcaaacataaaagatagcttgacaaaacgaatttcgacatccaatttacagttacaaatgatgtactgtatgttaatttcttaagaaagcaaaaaaaaaaaaatgataataaattccatgtgcctaatcaagtgtaggagtcagattccgacctatatgaaagaccttagcatgtgctacttcattcactagcaccacaaattcaactctctctttttttatccctttctaataaaggagaatagttctagtattatagacatgaaagttcataaaagttaaatcacataattgaacttgtgtgatatatcaaggttttagtagtgacatataagtgaaaactctccattattgttagattatatatgtactgcacctagctataatttccactattggagaaaaatataaagatataaaaagtgtctacctgaattcagatatataaaccaatgaaacatttaagagttgaatgtctactcgaattatattagtataagttgttttcattgaaatcaggacatatatatatatatatataataggggtaaaagaacaataataattttgtaatatgaataaatatcaatattaacgaataagaatataaaataggtacatttaatgattaaaggagagatattaattgttgaaaatatgaatcctatgttttgttttctaaacgatattgttaaaaagtctaatcatcatgagtcatgattaagtgaaccaaaacaagtttaaaatcttctgaaaacgacaaaacaacacaaaggaaaaaaagaagagaaagttaatttcaagggacttttaatttcaacttctttatatagcaaatatgaaagagtgataactcaccaaacaaacaaatttaaattttatttcatctttacacgaaaaaaaaaaagagaaataaaaacatgaaagagtggtcactcaccaaacaaacaacctaaatttagataaaataccattaatgcttaaaaataataattaaattaggaacggttacacattcaaatatgtgttttgactgtagaatacaaaaacaaatacatacaaatatcattatctaatgttatgcatgagacactatatatgtatgctccacataagaatcatacaaagcttcactgtgattgctcaacggtctagattctgtcagagcctctctcttcttattctcatgttacattaatctttgaaccaaagtctttttgtaaccgtctctgtttcttcttcactctgctcgtaaaaaaacattgaaatcttcgcatcaatg

SEQ ID NO: 22196 - DNA, 3003 bp, Unknown
  misc_feature (1)..( 3003): 2750-1469P.txt file - cDNA_ID_2048914; gDNA_ID_1620567; Annot_ID_160746
atatataatcgaaacttgtcttcaatgacaagagctagtaattagtttactaaaacatagtaatgtatatagattacggctttgttatatatatagcatggtttaggcatatcgatacttttaaaatttaaatggttaaacctcttaaaagtatacgtacttgtagattcctttacggacatggacaataatccaattagagttaccaacagggacagcatcgatggctttctgaaccgaagtgtagtctcctttgccttcgatatctacaattatcgatctatttgtcgcgattttttcagtcaaaagtggggcgtcgaatttcgtcttttgcattgctgatgcgtccgaaccccatatggacattacaactagggttaggacaaggatcattcttgttcgatgacccattattttttttattttttcttggggtttctacttttcttttggaatggggttatgagaaagagattatattggtgaagggagaggtttaatttaagaaaacaggtttttaaatttagggtgctttgttgtgtttgtttagttttgggaggtaagggattttggaggaagaaatggtttttacttggaatgttttgttttttatttttagacatttattaaggattaatggacgataaatactttgaagtatatttctatctttggtaactaattacaaaaacaaattgtgaatgttgtgtaaatgatacactgtataagccgcttattcattaatcaacggtaatcaaagaagtaccttagtcgggggccattagaatctcgtgaagcccaatccaccaatagaacgtcaattattgtcataattaatttcttataccctacaaaaacattactgaaaatcaaaatcttgattaaaaaaattcaatggatttatgcattctccataatatacgataaaagttgtctcaaaacttcaatttgggagtgatatatcatcttatatgattcaatctgtatatggttcacaacttcttctctcatgttttttctttttattggttcacaacttcacattcgatgtacgtattactagttttcaacgtattaatgtaattaagttagcaaaatatttattgtgtttagctgtaataagggtaggaccaatatattcgtttatagaaaggctatattttgtccttaacgaatccacaaacctcaaacttgacgaggaacataggaaaagaaacctataactttgatcagtttgatgctactttattagtatccaacaaaaaaaaaaaaactatgcttgtggaagtttaccagttaccactacactctacactctagttgacattaaattaaattaaagtaatttttcgtattatagttaaattactgctgcatatattttcacaagaaagctttacgttttcttaccaacaaaaaaaagctttacgtttactaatatcaccacatttattactcttaacggagactctagctcctcaacttgtggacctttgtatgttattgcggatctaaaagaacacagagaattaagagaaagcaatagagagagttttaggatgacgaagggaaatagtgaagtcacagtgttgattccacatttggaaaacagctagggacattaatttcaccgcaaattcgtattaatgacttccaccaatattactcactggagtctctagaatctctactcgtctttttctactaaccctacacctttgggtcattgggtgtatatatttcttctgttggactctgttttctcaatatattgataactatattccaattatttatatcttatagcctatagactatagataatgcttatctgattttttattttattttctgaaatatgaaccctccattgacgattgtaacaatgaatgtttttttttgggtctagctaggccaatttctttttgctattttctcacgttttaggccaatgattgatgataaaaaaaaatatatatatatatatatatattcacgtttcacttaaattttagaatattttttcttttctacttcttttaattcaatttaaccaagcattcacatcatcatatatatatatatatatatatatatatgtatgttgttgaaatatttaatcaagcattattagtttatgataaattaaaatgcagaaaattgaaatgttattttatagtataagaacagtaattaaaagagaaggctaaaaaatccaaaatttgataatacattaatagacatcatgtggatagataatatatgtgtgtagtatatggatgcaaacgtgaaaatcaacctaactgtttcacattatccatgcatgttgcttttacccattctctgtcttgtcttctccatcaactgttacctataaccatttattgaaccaaaccggtccaccggttcgctacttttatgtaagcaaatgcgtgatttcaattcccatgtaccgcaactatactgaaacaaaacaaaacacgaattttttttggctatttctctacaatataattgaaaacatatactttatccaacatcatattaatacagatatattcggttcagaaactgttaaccaactttaaccggaaatatagtagtctttaaattagtattggttgactttttaataactaatgtcacatctctttagcaaaattttataaataacgcatataacattagccacattagtaaacctagcaatctggtttcgtttcgtataatgagtcgagaggatgactaaactcaacccaaaaaaatcaataacctatcggttaaaactaggtgggatctcaaaccaatttcatgttttaaaaattcttttcggttgggattattaatgtcacgaattcacggggactttcttcagcttcctatttatacatacacttccaattgcaaatacacaagtcatcttctctctctttttttagtgtgtgcaaagtcatcttctcttttaatatttacctaaaattccaaacaaaagagaaagttatg

SEQ ID NO: 22197 - DNA, 3000 bp, Unknown; identical to SEQ ID NO: 2622
  misc_feature (1)..( 3000): 2750-1469P.txt file - cDNA_ID_2048928; gDNA_ID_1620567; Annot_ID_160740

SEQ ID NO: 22198 - DNA, 3003 bp, Unknown
  misc_feature (1)..( 3003): 2750-1469P.txt file - cDNA_ID_2048936; gDNA_ID_1620567; Annot_ID_160738
tatggtgttaagcccaataagctttataaaagcccaataacattttcaaaagcccgagaaaacccgtgaaactacgtccgatccgaagatcgatcacgcgactctgttatttagaacgacgatcgcattatttttctcctaataaacaaaacgagcccgccagatttctctgagacagtgattcagttttggttttggaacctaattctctctcaagagattcagctaagatgagtactatgaaattttgccgcgaatggtaagagctctcttatgctaattctgttcctagtttctggaattgcacctctctgctcgtctaggttttttcaaagtttcgaaatttgcatgaattttttagtttttgttgtttacttttgatgtatttcttccgtggttgaaccatctatggttgataaggtgacaattcgctaaaagtgagtaccttttttcgaattttgtttttgggtcctttcttaattgcattgttgtttctgtttgattttggttcagtaataacattctgtatcctaaggaggacaaagaacagaagatcctcctctatgcttgccgtaattgtgatcaccaggtatagcttttggtcattttgtaccttttttttgtgtggaaaaagggtttttagtgttcaatgtagtgcacaaaattgcgagtgggacttagtttcattgcaattaagagactttaatgaaactgtttcctgcttttatctctcttttaatgctcctagtttccttagttttaccaacctctctatttactaactccttcaattaaggcttagcaagttcttatggtttatctttctagtgttgtgtttatgagatctatatgaatacttgaagggcctcttttagcttattgatttacacaaactgagtagttatttgcaattttttaagctgcattatcaatcttgttgttacaaattgacagattagattagatcatgtaaatgggtttgttgtcctcatctcagaatttatactttttgtggcactgacttgcaggaggtagctgataacagctgtgtgtacagaaacgaggttcatcactctgtaagtgagcgaactcagatcttaacagacgtggcttctgaccctactcttccccgaaccaaggctgtgcgttgctctaagtgtcagcatagggaggccgttttcttccaggtataactctcttaagctccattatttatttaactacttggttatgctgtatcttcactgtttgcttccccaaaacattatgctcaaattctgtacaccgcttgaggatttaatgtagctatcattgaatgtgcaggctacggctagaggtgaagaaggaatgacactgttctttgtctgttgcaacccgaattgtggtcatcgctggagagaataaagagcttttcggtttcaattggtgagttcttaagagttttaggagttgatgtagttaccagtaagtgtaatatgtggaatgacgggaacaaccttctgccccagtcagagacaaatccgtattcatgtaatctgttatgaaaccataatctcaacttgtgtttcaccaaacataaagattggaacttgtttctctttggcatttagaggaaatgagaaattcaaacccaaacattagctactgtcctccacggctcatctcccagaaggcaacctctagttcaagaactcgtacaagtacatcttcagcttcaccgagcacctcaccggaggcattctccagacaacgttcggcaatgttcttgacagacgaacaatactgtttaaacccgtcattcccccaacgatgacaagcaccggtaagctccaccggagttttgttcccgtcttctaaacaatgagcaaagctctcttgatacactgcttcaattgcccagaaagctgtcataatcaccggatacttcacctcactgctcatcagatcttccaaaaacctgaattaaccagaaactccggtttatttgctggttcctaatttcattttcgagtgtgagaaatctattcaatcagcatatatgaaatcaataacctgccatattcttgattagctctttgaggcacaacggtcgagaaatcaacatcccatttcgatccttctcttttaaaccattctatttcatcattcaacgatgctataccaccaagcaccacttccatatcggaactctcgccggaatctttgcaagctctgatcaacacactcgctacaaacggcacaaacctcctcacgaacagataatcttgcccctacaaggaaacaacgtcgtttaaaagtcatcgagtgagatttcatattttgccttgttttcatcagtaattactaattacagtaccagccaagttctgaaggacgagagatcaacggatccgtcacggatcgagacgacaaaagcatgacgtgtagccgccgtatagatcgaacggtgcttatcaatccatgtgtcgatcacccctctcttctccattgaaattgcttcttcttcctttctctcaagactcaagactcaagactcttcttcttcaccgattcactgtcaacgctttgattttctgttgtctgtgacgtgcacgtttcattgggctttaaattaatgggccaaggcctattaaagtctcgccacgatagcttaatgattctcccaaatcgacggctgtaaagaggcgcttaaatttctcagattacgtgacagtttctgaaccgttgagatgtttggatgactaaagtttattaattacgtggcacttactcagaagctctctcacgtcacgtatccgtcgttaaagagtgtgacgtggaaaatgttttggaattaattttgtgtgtttgtattatatcaccgtactaattagctcatctcccgaagccatgtggtaattctaattttgtgtatttattattttctgttaagacgaatcggacagagagaactccggcggcggattgcacttccggcaagatctcgtggggataaataagatg

SEQ ID NO: 22199 - DNA, 3000 bp, Unknown
  misc_feature (1)..( 3000): 2750-1469P.txt file - cDNA_ID_2048940; gDNA_ID_1620567; Annot_ID_160737
aaatctattgatttaaaaatttggatacattttagacatcatgtactcaaaacgggaaatagttatgaacatagtggaggtaatcaacaattctattaacaaagcatcaatgtattgataaaacggtcgtcagtgttcaattccaaaatacatattgttaacttggtcacaagctataatccaatctatcaactaagttgcaagacaatgtcacacagaaattatttacgccattatgcactttaattatatttataaaatattaaacaacacaaccccatttcttaaacgcagcattgactttcatcagagttcaagactgatcatccataaacccagtactgtaaccatttgattttatgaacttcttcagaagaagaaccatgatagcgattgtgagcccaaccgccgcccacgtgaagagtctgtcatcgactggcttctgagccgctcttctggccatcctttgctcaccacttacagaagctttgaccacaacttcaaccgctggtaaaggtgctgcagcgggaaccacactagctgctgtattgactgcttcagctgtctcttctatgatttgatcatcaactatggtgtctgttgtagcgatggaccgctcttctactacagttatcgcttcctgtggctcaacttgggagtgagcttctgatacgatggaaggtgcttggctacattccagaggaagaggttttggaaccacggttgctttgctaaggatgtactgatgaatctgcgcttgttaaaaggtcatggttactaaaagttttttccaaaattgaagatgaatcagaggtatgaaactaaagtcataacaaaaatcatgaagaaagggacgagagtttagaccaaaaggagattgttaacactactattgtctttttttttatatttgtgcaactgactactttttaaaaacgacaataatcagtaaaatggtgtgttaggacttgagcagcaaattttactgtatggagagaataataacagctgtgattgcagttaaaacaaagcagatactcttagagcaaacattaaatcataaccgctagagatatgcaagcctaatatataatatattgcgatcccgttttgaccaccagctagtcctatggtttataatgatgcaatgcaatggtatggcacatactctacaggttcagcaagcatctagctaaattcatatattttcatcaggatattatgcatagtggttcaacacccaagggtattctagtggggaactatacctcatcaataattttttgccgttcaggagagccatacttaggtggtgtctcacgtgatttaatggctagtgtacgtctctcatcctttggataatctactgagcccagtgctccattgggacttgtgggcataaatgcaatgagagccaccaaagcagtccgaactgaaaagaaacaaagctcaatcataatacaaaagagctgatatagttcaacctcatgtaaattacaagtgtctgagtaatcttttaggaaacaacataaaagtcaagagataaggtctcttgagatccatgactttaccactccatgaaggttgccaatgctcagggtggtagtttgaaatgctcaagcaaatcttggtgttagtttcaaagcgcccgttaggctgaaacaaaagtacagagattctttagatacatactctcttatggaacttgcaacatctgtgtgtttttatatatgaaataagagtaagatccttacggtcaataacatgaatgaaggaggtttgaatggataatctgcaggcaactgaattctcccatgataaatcccgccctcgaattcagtatcaccaggacctcggatggcgaattgccactcaaagatattctcctgaagttaaaagatagataagagtaatcatgtaaactatttggtatcacacaagaacttgtaaaaaacagctataacatcgcgcgcaatctatttggaccatgacatgttggaaaaagtcttcacagttaaaaaaattagaaacgaagaactagtatgacagctgagtggatcaaggaatcgttcgtaatcttccccacttgactcagttattccaataaaaacacaaaaatccaaactttatctgttgcacgagtgttgaaagtagagagacttagtaaattcagtgtatacaagaagatatatcgatcctccctaatcatgatcgcctaaaatcaaacaccatcactcagaacagatacacaattacaacacaacacaacataacacaacaacataagacaaggggattttctcaaaaaaggaaatttcaaatatagattcgaatcaaaattcccgatctaaaaagctagaatcggagatgttacctcaagaggaagagacataaaatcatcagacggattagcttgcatctccttaacctcctgcaaaatcctcttcaccgccggattcttccgattatacctctcatccgccatcttatttatccccacgagatcttgccggaagtgcaatccgccgccggagttctctctgtccgattcgtcttaacagaaaataataaatacacaaaattagaattaccacatggcttcgggagatgagctaattagtacggtgatataatacaaacacacaaaattaattccaaaacattttccacgtcacactctttaacgacggatacgtgacgtgagagagcttctgagtaagtgccacgtaattaataaactttagtcatccaaacatctcaacggttcagaaactgtcacgtaatctgagaaatttaagcgcctctttacagccgtcgatttgggagaatcattaagctatcgtggcgagactttaataggccttggcccattaatttaaagcccaatgaaacgtgcacgtcacagacaacagaaaatcaaagcgttgacagtgaatcggtgaagaagaagagtcttgagtcttgagtcttgagagaaaggaagaagaagcaatttcaatg

SEQ ID NO: 22200 - DNA, 3000 bp, Unknown; identical to SEQ ID NO: 2633
  misc_feature (1)..( 3000): 2750-1469P.txt file - cDNA_ID_2048968; gDNA_ID_1620567; Annot_ID_160731

SEQ ID NO: 22201 - DNA, 3003 bp, Unknown
  misc_feature (1)..( 3003): 2750-1469P.txt file - cDNA_ID_2048974; gDNA_ID_1620567; Annot_ID_160728
tacacttgatagaagcccgtcaacacccatttgtttcagataccggtcaccttcagagaacctctgagcattcaacagagcttgaactaacacaagataaccattgaatcctggcttaactccacggctgacaaaaccgtcaaatatcctacaagtctcaacaagatcatgcccttttaggagacaactcatcgcagcattgaatgttgagctatccggaatataacctctctcacctatcttcctcaagaattgaccagtctctttagccattgagttgtttgaaagacaatacaacacagcatcgtaaccaactctttgcaagtttgagtctttctccataaacccaaccaaaacctcaaacgctttacacggcggcaagcaacggaaaatcccgtgtacgaaagttctgattgtagcttcattaggattcaactttctcacccgcatcatctccaattgcttcaacgcctcatcaaccctccctgctatcaaaaacccgtcgatcaaaatcgtgtatgtgaacacattgggtctattcccttcctgttccatctgtttaaccaatcgaatagcttcatcaaccacacccttcttgcaaacaccatgtataagtatattataggtaaaccgatccggtttacagccatcactacgcatctgctgaaacttgaggtaagccaaatcaagtgaattagacttcaccaacgcatcaatcacagcattataaagccttgtacttggtttcattccaagaaaagatatctgagcaaaaacatcattacagtacttagctaaacctaatcttccccagcttccgatcaaaacacacatcaattcatcactaatccgataccctgaatctctaatctctttaagcaattccatagacaacaataaggggcctttacgaaaaagtgcgttccctagaacactcttcagagactgatccttagcgtaaaccgggtcgaagttggagacccagaggtaaaatcgcagggagtgtaatgggttgtcttgattctgcaaaacgctgatgacgaatcgagtgttgagaccaattcgatgagtggtgaattcttgattcagtatcaaaaaccaatcttttctctctatgacttgcgaaatgtaacgctggttcagaggattggtgggtttacctgaagagtttagggtttttgagagcttagggtttacggatgtggaagcgtttagtgatttggaagctgctgccgccgtcgctattctagatgctgaagaagcaaagcctctcatgtcgtgaccagaacggagctgagtgcaagtgaaacattgatttggtctctaacctcaagacgatgtttcctaaacgacgctgtttaatacaccaatatcaatatgtgttcgaatttaataattttttttttagtttcagaataaattaagaaaaagtcatgaccaaaaagatcatctcctttgaaacaaacaaaaacaaaagaattttggttgatcctaatgactcttccattgccaccatgaaaatgagggttttcattatagtttatccatctcttgattactatgaattttaattttcttgtaataattatatttctaagtgataattttctaatttctatcttaaattgtagcattgactaaatatttccatcttcatcttcaaaaatatattatgataatattaagttattgctaatgagagatgtaataaaaagagttgtgatgaagtcattattatgctatttatgtatgattaataatatgttataaaaattactattgcaatatatatagttttcttatatcattgcatttatttataagaataagatacaaatcaagtccaataacttagagaaaataaaggcaacgctagaatcatcaattttgagagaaaatggatttataagtttgtattacttttgacaacaacatttcactggacatggaatacaaggagaaccacactgtccacctttttgaaagccagctctaagacagtccttattacattcatcattccagtaatcttcggaacacctaatattgcagttgtcaaaagagaagccttcgatccttgcatctacacaagtccacatatatatcaaacatcatcaataccaacatgtgtaaattttatatcattccaataaaaaatagttatataacatgtccaaataaaagtttttaacgaaacttttgaattcatgtataatatatatataaacaaaaacgtgatcataacgaattccaaatatttagatatatagcctttgaaatgatcactactaaattgcaaaatagctaaaccaaactttgaaaatacctgaagccaaaacgttgttgttaggcaacgaaactgcaagtattattacaaggaaacatgtcaccaaagttttcgtactacccataataaatttttctatgaactcttttgaggtattcaaatgtttttattgtttaggatcttaaggattgactatttatatataacttttggtcttcagtttgttttattacaattaattgatgatccatttttgtttctcaaagttttttatttttggcaaaaaaaatcatttacatttatgaatatataattatttacaattaataatcctaaatgagaacttaaaaattgaaaaaagtgtgtgacacttgtgaatatggtcaaaggtaatttgttggatatgttgtcattatgttcaatcaatatctcaagttaaatgcgagattttaatttcataattcaatattggaaattttttttttataattaggtatattataaattttaactgatttcaaaattgatattgacaaaacaaattgaaaggaaaattaaatattatctgtaaagtcattattgtttttgttaataaatattttttagtttcataataaattaggaaaaagtcatgatgaccaaaaagatcaataagttgaaagttgataaatgtcttgttttttttttaatcatcttctttgaaacaaacaacaatg

SEQ ID NO: 22202 - DNA, 3003 bp, Unknown
  misc_feature (1)..( 3003): 2750-1469P.txt file - cDNA_ID_2048988; gDNA_ID_1620575; Annot_ID_160973
atcaacaagttaataatatatttatatatttttcctttttcactaaaaggaggtctaaattggccagcatgtttgacaaatgtcacatgtcactatgtcagatttagattgatattagctacatataaatacttgttcactactatataatgtgttagatttatcgtgttcataagatacatcgaaagcacatatacacgttgaaatatcatttcatataacaaagctatggagaatgatatggaagagaagtttgaagattggaaaggtaaagaggcaatcccagggaaacatggtgggatcagagctgcatctattgtttgtggtaaatatttaaaactcaaaacttcatatttttattttgttccattttcaatgtcttaatatatggtgtggtaaatgtagttgtggtgatgatggagaacatagtgttcatagctaatggattcaatttcgtgaaatatttcatgggatcaatgcattatacaccagccacagcagcaaacatggtcactaatttcatgggaacatcgtttttactcactctttttggtggttttatcgctgactctttcgtcactcatttcacaactttcatcgtcttctgttgcattgaactcatggtaattaaaaacttcataaaatgttatctaccatttagataattgtactttaatgatgaaatgaataatcacattaactttaaggtttaatcattttatagggattgatcttgttgacgttccaagctcataaccctaagttactgcctgaaaaagataaaacaccttcaactcttcaatcagcgattcttttcacaggactctacgcaatggctattggtacgggcggtttaaaggcatcgttgcctagtcatggaggcgatcaaattgatagaagaaatccaagactgatctcaagattcttcgattggttatacttctctatatgctctggatgcctcttggccgtaaccgttgtgttgtggatcgaggaaaagaaagggtggatatggagcttcaatatatccgttggaattctagcgacggcgctgtgtatttttactgtagggctaccgttttatcggttcaagcgtcctaatggaagtccgttgaaaaagattgcaattgtgattatttctgccgcaagaaaccgaaataaatctgatttggatgaagagatgatgcgaggtcttatctctatctacaagaacaatagtcacaacaagttaaagtaagtattgaaaattgcattgaaacataatctaatttataactgaactcaagatacaaacactcatttggtccaagataaatgtgctaaaataccttattttttaggtggatagataaagcaacgttgaacaaaaacatctcagaaacagaagttgaagaaacaagaacgtttttgggtcttctaccaatctttggtagcacaattgtcatgagctgctgcgtggcacaactctctaccttctccgcacaacaaggaatgctcatgaacaagaaactctttcactctttcgagatccccgtaccttctctcaccgccattcctctcatcttcatgctcttatctatacctttatacgaattctttggaaaaaagatctcatcaggcaacaacaatagatcatccagtttcaatttgaaacgcattggactcggcctagctctctcttcggtttcaatggcggtttctgccatcgtagaggccaagaggaaacatgaagtggttcataacaacttcagaatctctgttttgtggctagtgtttcagtatctgatgctaagtgtctctgatatgttgactttaggagggatgctagagttcttttatagagaagctccgtcgaacatgaagagcataagcacggctttgggatggtgttcaaccgcattaggtttctttcttagcacaactcttgtagaggttacaaatgccgtcacgggaaggcttggccatcaatggcttggtggggaagatctcaacaagacaaggcttgaacttttttatgtgctcttgtgtgttcttaatactcttaatcttctgaactatattttttgggcaaagagatattaagtgaaagaacaaagtatacggatattgtgttttcgtaacttcgaggcactttatgcttatagtgttcaatctgaagataatataaacagtaagtacaaatatcctcatgttatgtgtagtatcactttgttaaagtgtatctacaaacaaacaaacaaacaaaatatagaaaaatggtggaaagagtaaaaaaccccaatttattatgtcatgtgtactaataacattttctagtttgtcttaccaaaataaaaaaataatattttcaagatttgccacttaaaatgatgatattagttagaaacaattatgtgattctaatgatggtgataagcatgttggcgatgatgttttatgatgacatgatgatgatgatgatgatgatgatgatgatgataagtattagataatatggctgcttaacatttcaaaatttaagaaactaatctctttttttttttgttaaaagaaactaatctcttaaagagtaaattataagaaaatttatgtcatattattggttttttgttaacatattatatatttttttcccaaacgtttacacaatttacaatcaatatttttaattgttatggaaatatctaattttattttagacgaaaaaaaacttagaaaaccaagaatttatccttcttggtatgaacaaagtccttctttggtgtaatgtataactatcaaaacgtacttactctgaaattgttctctttagattccttacatcattctgatgtattctcaaaatgcaaaaaataaaaataaaataactaaaaccgaaaaaaataatcaattattggctagtccatgttaaatttcacacaccaaaacacatgctagttttatctccaccttctatttattccgccaaaagcctttacggttactacaagccatccaacaatg

SEQ ID NO: 22203 - DNA, 3003 bp, Unknown
  misc_feature (1)..( 3003): 2750-1469P.txt file - cDNA_ID_2048995; gDNA_ID_1620575; Annot_ID_160971
caaaacaaaaaagcaacaaaaatatgtttaatcaattgagatcacaataatcttcataatatattaagcctattaaaatttcctaatctaaggaattaatcaagatgtgaagaaatttcaaagtatatttacgttggtaatttcctaggttcagtccaaaaaaaattgaactcatttttctagttaattaggtctgactgatatggatttaattaaaagagctgagttcgatattatcgaattctaaacttcaaattatttgctacaagttatataacatagttattgatattttgaaaattaatgtagtattacaaactcttttcttcggaaaaagatatatgtaagaaattaagaaaatatgaaatgtcaatacaaacctagtataagaaccgtgaagacaataagaacagtaaacgagagttgaaaggatttgatcatcgtaaatgatagaaatgaattgatagtactttgaaagttacaaaagaaaaccaattgtagttatatataataaggaatatgtatctcacattcaaacacatatatctattttaagatttttactactttgtactccgaattaaaagatctaccttgactcaggttccaggttttttgcttatatgataagtaaaagtgtcaaactcttatttcattttttattaaaaggttgtaacttgtaagccaaaaggctcgataataacatgtgatattattattattttttaacgacttcatttcattgatagaatcaatgatcataatacaaagttgatgttatgaaagcgggtacatagtagtgaaatttaaaactctgatttggttgaagatgatgctttgcgaggatatctgcaggttggttgtttgttcttggaacccatttgaagacagcctcctcaaatcgtttttgccaaaatctgccttctcttatccagttgaatcttccaaagtttagcttttcgttgttcataagctcttccacttgtttactgtccccttcaaagataactttgcgatagccttggctccaagcatgttgcattgctataatcaaagcctgaaattcactctccaatgagtctgatgttgttgatcctattgcttgacccgaacccatgtatactccattctcatctctcattagccagccagctttcgcatttcgtgtttggtggttgaaagctccatcataattgtactttatccaagtgcttggcggccgttgccacttcgtacgtgccatagttggttgttgatgtcttgatgaatgcacttgttggttgagactctgaacataagtgtttgtgtcttcccactcttgaacatcattccgtgcacgttgtagggtgttttgccatgatatgcttttttgttgaaacaccaattgatttctgctcttccatagtctccataagatccagatggccaaattaaaaagttgtggttgtctgttggctaaacaactcgataacagcagctccatctttgtctccattgtaattcctgtagttcgtaactcttggtgtggtatccctgaagctcgccaaacctgttgggcataaaaacaatcaaagaataagtgttgagacgtttcgtcctcttggcagcaccggtgacattgcgggtgattccgtatatgtcttcgttttagattgtctcctgtggctaaggctcctgagagtagcttccagaggaagtgtttgatttttggcgccgttttgagtttccatatcttagctttaatctctgcttttcctgggggtggttgaatttctggatccatgaacacttggtttgctaaccagtaagccgacttgactgaatagatcccatcttcagtgtaatgccagcctagaaagtcttgagtagccgctgtacataacttgagagacaaaatgatttccgcatcttcttctgtaactagatcgcgaactaagtctctgttccattgatttccatgaagaatccaattgttgagaagacagtgttccacttggttattctttggtttcggtggtcttggagggtgagttggcaaccaagggtcgatccaagtactgactgttgaaccgttccctacatgtgatattatttatcatcgaaaatttgaagcagtacaaagaaataacaacttggtattaaaaaaagtggaaagaaaaataaaaattaatataaaataataagatataactatttttgaaaataggtgtaagaaattaaatgtatattaattagtcagatcatgtaacaaaaatataaattaaatataatatatttacctaataatagagaagaaaatattatgtaaaattaggtatctatagatttgtattcattaaattatgcttaagagattgatcgataagtaattctaaacaatttcacaaaagtaaagtgttataccaaattaatagatatcttctaggtaatgcattcatgtataacgttatatctattttatatgatatttacattttagcgcaaaaaaaaaaagaagaagaaaggaagcataaaatgtaaaaagaacaatcgaaatcagtttttaattatctgtattttgaaagttttggcatatgagtaaacaagttttatcatatactaatttaagatattatgttaaatatatggttcatttatttacatatatgaattcgagatatcttaaaccatatatatacttttctaaaatctataataaatgtaaaaatcttgataacttttgtaagattagtttataattttttatattataaaataattatttgtatatttatcaacaagttaataatatatttatatatttttcctttttcactaaaaggaggtctaaattggccagcatgtttgacaaatgtcacatgtcactatgtcagatttagattgatattagctacatataaatacttgttcactactatataatgtgttagatttatcgtgttcataagatacatcgaaagcacatatacacgttgaaatatcatttcatataacaaagctatg

SEQ ID NO: 22204 - DNA, 3000 bp, Unknown; identical to SEQ ID NO: 2681
  misc_feature (1)..( 3000): 2750-1469P.txt file - cDNA_ID_2049052; gDNA_ID_1620575; Annot_ID_160953

SEQ ID NO: 22205 - DNA, 3000 bp, Unknown; identical to SEQ ID NO: 2680
  misc_feature (1)..( 3000): 2750-1469P.txt file - cDNA_ID_2049062; gDNA_ID_1620575; Annot_ID_160949

SEQ ID NO: 22206 - DNA, 3000 bp, Unknown
  misc_feature (1)..( 3000): 2750-1469P.txt file - cDNA_ID_2049066; gDNA_ID_1620575; Annot_ID_160948
ctccaaatgattccgataatcttacaaaacaggcaataaaatagtcaaaatacataactttatttcctaataaaaagatctttaaaaaccaaagatttgcaatgaagatttgataccacaaacaaaaaaccattactcacaagtgtcttaatacgattagttgatcagatcagaaaaatacgaccgccacgtcatcgaccgcatgccctcgtcgtgtcttcgctcactcaacaaaacgtatccttcgctttcacgaacgtcgcataaaagctctgcaaaacacacacaacacaactgagagagatcagagaaagagagatttgtaataatcaaatcatggggaagagaagaggtgtctccgccgtgaacgttgttttcgggtggctgcgacaacaatcgaacaaggttaaaatagctttaggaattatcatctctttgatcctcgtcgttcttctgaaattcaccgttaggaatcacaatcactttttcatcgcctccgagctcatccacgccgccggaatcttgatcctcatctacaaactcactcgccaaaagacttgctccggtaacaataaaaatcccaccaccttatcataattcataagattttgactttaaatcatagacctttgtttcttggtaatgtgattagaagtgaaaacatttatatgtttatattgtgacaatgttgtggaatcttataagctcttttggttttgctagtgaacatttatgtttatattgtatcaatgttgtgtggaactttataagctcattttggttttgtctcatagaatatgtgtatggtttgaattattaggtctttctttaaaatctcaagaagtgacagcaatatttctagcggtgagattgatatgcagcataaacatggaaggtgatatccatacagttctcgatttcgccaccttggtttcgactctatgggtcatttatatgattcgatacaagctgaaagcatcttatataaagtctctcgacacttgctacaattactatgtggtaatgctttgatttaaagagtgtaaatatgttgtttgccttttcattctctcgaaatgatttaagtaaaatgtttctcgctttttcgccaaccagcttgtaccatctgctatccttgcgttgattattaacccgagtacgagttattcttacttccaccgtatattgtgggcgttttgcgtctacacagaatctgtctctgttctacctcaacttcgattaatgcaaaatgctcaggtcagacacttttgacatatctatgtatctttagatttattttatgtcaatgtagagactagagttagcactttaacaaactatgatatgatctagtggttgatcagtattcgtcatgttggtctcgcggatgagtatcatccagtacacttatatattggtcaatgtagacatatttatagtggcaagaaaatttggttttcttaggtccaaaacttaggccaatgtagacaatctaaatggttattagagattctggttgtctacaagtctcgtgattagtctagacttaggtccaaaacctatctcgtggttagtctagacttaacaatttctcgaacaaccatttcagatcatagagcctttcacagctcattatgtgtttgcactcggaatagctagattcctggcatgcgctcattggattatccaggtaaagatcctttcttaatccactaattaagctttcatgaataagctcaagagactaaatggtctgaagatgtaggtcgttgagactcgtggacattacctatggctactcggggctggttacttctggtttccggtggctctactagccgagatcgttcaaactttcatcctcgccgacttttgctactactatgtcaaaaggtaatcgttttacgcataaatgatcaacttcgttgtaacaatttggaggactagacaatgttattgacctgtttttatcacttctttcagtgttatggagggtcagcttgtactgaagatgccggtttaagatcatctagtataaaatgaaccaataaattttgcttgttttatctttcaacttaaactacaacttttaaccaaagtagattgctcaaaataatctagaatggtttctttcttcttctctatttcctgctttttgtttaagaatctttagagaaagttaatcactatacaattgcttttgttcttacccattttcaactattttgagctatataatacacattgttgagattatacaacgacgttttaaccaccagattgattaacctcgttaaaactaaagaaatgaatttctctgtattactttgtaaatgtcaaaattttataacagatttaacgaaaattaattacagtaatcatgtggaagattagaagaagaatttatctgatacacgtacaagtacaatcatacagatataaactctaaagccacttttttttcttcttcttccatttttttgttctcacgtcgctctctctttttttcgagattcagctgtaaaaccctaactagcgccatagccaaggaagctttcctcagatcgtctctccgaaattttccggttaatcgtcagttaaggtaaactctaattgtatttccaccgttgttttcttcatcggaaacttctccgagcaacggcatacttacttactccactctttttcttcttttacttgatcgatttgaattctagactgttccagttcttagatcggttcttcataacttcgatttgtgcttatcttcttcgcgaatcttcgtcgcatttggcgtttgaattggatactgatactcatactgttataacttgttgaattggatcttcattgatttttgtatctagatcagagatctgtagtattactgtttcgttttgcgtttctaatttgctagaatagatgagattgaagtggaattagtgattgtcacaaggtgatgatgattgattttgaattgcaggggaaaattaggctatg

SEQ ID NO: 22207 - DNA, 3003 bp, Unknown
  misc_feature (1)..( 3003): 2750-1469P.txt file - cDNA_ID_2049070; gDNA_ID_1620575; Annot_ID_160947
gtaaaaagttaagtttttaaggacaaaagagattgaaaaagtaagaaccattatgggtccatttagaagaagtagaaaagataaagtgaagagacaaaagaactaataatgatctgcacttgagtacccattatgttttatttcccatatgcaaccactaagagtactctctttggtttgaggtattagtatgaactaactagctccgtgattgtaggtgttttaggataagataattgaatgttgttagtacactcataacatgaattgggacagtttggttaggctcttgcatatgacattatcagtttggttctaattaaggagataaacatgctaaaactttgatgatctatgtttcttaggacttgatcacaattcacaatcactgcaaattgttgtaattgttctgatcaatctgtttatggttttgatttttggtcaaggtaaggaacatttagactgatcaaaagaaaaaggcaatggatggtggtggttattgaaatggccaaacagatgaaaagaaaggtaactttcaaaagttgctttctttttttcttgtcactgtttctttatctttctctttctcacacatctctttcttatacccacaccactcttgagagagcagatcaatagagaaaaaaacttggctagtttttctccacaaggttttttctgcaaacatgtctgaacttgcattgtcatctcaagaagagtctccaagtagtaataagattggtttatcttctcttcttctctctgactttcatctcttttgctcatttatcctcactcaccctttctatttttcttacttgctcttcttttcaccttacatcttcaagattctctcttttctttcaccactctttgtcaccaccacactcttgcttcttgccttattgagtactttacatgttcaagacacttgtctcgactctgaatcactagaaacacaaccaagcttccttttctccttttgtagtaagcttggaagtgtcttggaacacaagtttgatgtcaacaatgagggttttaagtcattggaggagttggaagcgtataagatggtcgtcgaggcttgctcgatggaatgtgcgtccgagaatgagatatgttcggatgaattgacgtttgttgacaaattctgtagccatgagagcacggtgtcggaatctttgaccgatgagacccttgaggagcaagttgagatccaaccgttgaagtttgaggatgtgattgttttggagaaagaagaagaaaccaagaaatgtgaaaaggaagaagtagaagaacaaaaagtcaagcataaaagtgacgttgtcctcgataacagagaagagccgacaaaagaagaatccaaagctcaaaaagttgaccttgtcggagatagtaataatgaaagttatgatctcccaaaactgagcaattttctcggagaaggagaaggtaaaagaaatgtagtgactaagaacgaagaagaagataatgtttctctccaaagctttggatcaatgagaaaagagaaagaatggaggagaacattggcttgcaagctatttgaagaacgacacaatgctgacgttggacaaggcatggatcagctgtgggagacttacgagacacaaacagagaagaagcagcaaaccgaagaagagaagaagaagctcaagaagaagacgaagtcgatgatgaagacaaagagtatagagaaggaagttatagtggaggaggaagatgatgatgggattgatcatcagcaactttgttgtttacaagctttgaagttctcaacagggaagatgcatttgggaattgcgaggcctaaccttttgaagctatctaaggctttcaaaggcattggacgtttttacaatgctaacaaacattccaagaaagcttgaaaaggagatgaataataaaactttgtattaattgggatctataaacaatgtaacttgtaagtttccattgttttgggcaagttctatgaacaatgtaagggaaaataaaaggtaaaggctaggattttgccatatgtgtttagctttgatcttaactttctttcctatccttgtatattttgggacggataacccgtaatggcccgtatcgattgagaattacttgtcccataaggcatgttaccgttgaaatatttaccttttttaaaatgtaaatttttgtttaacaagtaagggattgggtaaaaaattcaaagatatccgcattttctatattttccgcttgagtaatataatatttacaaagtgtataaaaattatccaaaatttcttcatatacttcataaaaactatttttttcaaaatttcaaaaaaacaaaaaattccgtcttgccgtagagttttacctctttcgaaatcgacactcacccaaattaatgagagtttgagaattgaatttagatacccgaatttcacattctctatacattacccaaaatatttgtcccgtattttatcaaaaatagttctgatcatgtttttcaattactacctgaactatttttcgttctgatatccgaaataaacatgtctattcattatatctcttctaatgatctaatcccacaataattttttccttaaactgtaattttaagtcatatatttcattaccattcattctattaataaaaatattgtaacattttatggttgcataaattaaatccggcaatggaatgtctaaaagtagtataatcggtcttgttcccacttttgtttcctagttgaacagatttgaatctcagatctgatataaaaattcactaatcgacaacattttactacaaaatttaatagaaagtcaaaatatgattgttacacttcaattaacttaaaaaaagttgaaaaaatggttaccgacatatttcatagtttggccgcgtacgattagtgagacactccattaaatagcttataattgaaaattgaatgacactgtgagattcaagtgtaaagtgctctctccccaatg

SEQ ID NO: 22208 - DNA, 465 bp, Unknown; identical to SEQ ID NO: 2719
  misc_feature (1)..( 465): 2750-1469P.txt file - cDNA_ID_2049105; gDNA_ID_1620581; Annot_ID_161168

SEQ ID NO: 22209 - DNA, 3000 bp, Unknown; identical to SEQ ID NO: 2721
  misc_feature (1)..( 3000): 2750-1469P.txt file - cDNA_ID_2049142; gDNA_ID_1620581; Annot_ID_161153

SEQ ID NO: 22210 - DNA, 3003 bp, Unknown
  misc_feature (1)..( 3003): 2750-1469P.txt file - cDNA_ID_2049263; gDNA_ID_1620605; Annot_ID_161753
gttcattgttatagcctcatgccttagctgtactttctgtatatagcaaaaaccattttcttcccgtctcaatgagtttgacataatctttattcaatgttgaacagttgaagtcggcgaatatctaagaagattttcataactatcgacttactaaattatatcatgtgcagtaactatctttgaaatcaaagaagatcttccattaaagatacataagcaaatattctttttagtgaatatggtttttaatttcactatactagggtaatatatttttcggttcatgcaatattcattcaattaaactatcatgcctttaccattacaattcacttggttccggttagatcaactttgtttttggctttggtcgattattaacttggcccaagtcatgcattccacgcatgaagcaccctccgaagttcctttcctatgttctctctaatcttgaacctgagggattgattgagagtgacaactctttcggttgagagcaataaactcatttgatgaataaggttttcgacctttgcatccattttttttttcctttaatctagagggttgtcgattcagaagcaagagtcaaaactaaatttggaagtttagttccacctaattcaaacaatgatatatatgttaaaccaaggttaataatgttaaacatagtttcttacactattatgtctattatatgtaggaattgattgattattatttttaattattatgaaaatgtctactgaaaaaaattaagagttttggctaattaaaaagctagacaaaaaaagtttttggccattttctctatagaatttgctctttctgttgttacttacattaaatgctgtcttgcacctatatggcctgaatgtgaggaaggcccatatctattggtgaaagagcccaaaggttaggccattcagtatttttctgttcttgaacctgatatggatcttcttgagtttatttgcctcactattcctgagcctattatcatcacattatatcatacagttgcatcaattcaaagcctaaacaattgcattaacgtgtttctaataaaaaaggatcggaggattattgatagttatatcttattttaagcccaaaagataaacacatttgtggtggttgtttacttcgcgtatgtgtccttaccattcagacacaaagttatactgtattatttaatgtatcttatgagccacttggcagagagatatggaacgtatgaactcgtacttaccacacgtctacgataaaagcttagttttgtctatcgataaatataaattattcgatttgtaacgttttggattttaatatatcatcggaacatcatcctcatctcgaccacacttcccaagaccaaccacatcatggtttttgacacttgacatacgataattcgtcatttcatttttctttgttttaacatgtacaaactatacaagttgttattttgttcctatagtcaaatttactaaagaatatatagaacgatcctttgaaattttagtattatgcggagaagataatttatttgagatgaaaatttattatagaagttgtactgcattaattgttaccattcacaaaaacttaattataaatgttataaatttttttacttgtaattttattgtacaactcttttctaccgctttccactattccaaaaaaattacaacttcaactaacaactaaaaatttaaatttttgtacagttttatgtaatcaaactggatttagagttttttttgtttatctcatgattgagtgggtgattggttgggctgtaactgtaaagtttttgctgtagagattttggtgtagctgtgttagctgtaactgtaacttttattgttgtagaattattgctgtaagtttttttattttaaataatttataaaaaagaactaataaaatataatagttgtaatacactttttttatatagtaaataaaatgccttgcattactaatttaaataaatatattatgatgatataaaagtaaaatatagtaaatattttttttgttatatatttatgttgataattttaatttcttagatttatttaatgaattaaaatttctacaccaaaaaaaatttggctttgagaatttactctcctacaaccttaaaaataaaattaaaaaaaattgggctgtaggtttaaaaataaagctacaacatgattagtacgtaatcaatacttttaaaaaaattaaggatgtaagttagacttatacgccaaccaatcatgcactgaataacatcaactcttatcatttctacacaaattattctaaagtatttgattgaatataatttcagttaaatttgatcattattctttatcatctaaaatatatatacttttaaaaagatgaaagcatatgcatcagcagagaaaaaaaaagatgttcaatgcagaaaaaaatatttaattttcggaattaaatttaaaaaataaaacaaatttaaataaaccccattaaagcttcctaccaaaataaaaacctttaaagcttattttatttatcactaaaatcataaaaccactaattattacctaaatcgttgaatatttcaatttgatgtaattttacttttaacgaattaaataataattataccaatgatgatgggccaagcaagtcgtgcaagcaaagagttaagctaggtcccactctcataataagtccagaaaatggacgatctagatctagtgtagtctctatccaactctaatcttcaccgtttgttattacacaagtcaaataaggataaaactgtaaattcacaacaaaatcgtcgaaatatcatatcattcactggtggaggaaactgaagaaaacgatccgataacagcattttctattttcttctgtgcctcaaaaaatcataattttctcggaaaattaaaaatcatgtttaagattttctcgagaaagtaaaaaaaggaagaagaagaagaagaaaccatg

SEQ ID NO: 22211 - DNA, 60 bp, Unknown; identical to SEQ ID NO: 2829
  misc_feature (1)..( 60): 2750-1469P.txt file - cDNA_ID_2049270; gDNA_ID_1620605; Annot_ID_161752

SEQ ID NO: 22212 - DNA, 3003 bp, Unknown
  misc_feature (1)..( 3003): 2750-1469P.txt file - cDNA_ID_2049313; gDNA_ID_1620612; Annot_ID_161944
cttatgatggtatactttttcacttgggttcttttcgcatgtagcatcgtctctggtaccaccctcttcatcctcagaacaaacgaaatcactatcagagctctctacatcagaagaatctgaactttcccccacgtaatcagatgagtcagaatcattagcatcttcatccatatcactctcaccagaatctctatcttcgccactaacttcctctcttgaatcagtccctaattcctctaaagggtcttcctcatcatcagaactagaacttagacttacaacctcatcagacacataagtcttctcctcacccctcaaattagcatcatccagaagaatatcacaaacctcagaaccagcattgacatcctcgacatgctgattctctcccgcgatagttccaaggaaaacaacatcatcatcatcatccggagataaagggttctctttaccactcactttagcatcatcctcatcaaaatcacaaaccctaggagaaatcaccgaagcagaaccaacattgtcatcatcctctacatgatcattctctctctgaacagttccaacgaaaacaacatcatcatcatcatctatagggttaaaattagaagctttctcttcacatcccaaattacgatcatcagcatcaaaatcacaaaccctatcaccaaaatcaaacgatttcgattgtaaattcccagaagtagaaccaacattctcatcatctcgcttaccttcaggatattcagttctaacaaatacaacatcgtcgtcatcatccttcctccgccgtcgtttcttcttcctcggagaaggtgaacaagcatcacgcatgttaactctcctcttctcagtcctcgaatttacacaacccagagactgatcttcttcttctccagaaatcccctttgatttattgagaatcgagttcaagtaagattcagtcctcgaacgagttcttctagcaacacaactagtcatatccatggctgaagagagaaatcgaaaaccctagaatagtggatttgacgaagaaggaagaaagctcatgtcctctctcctctgttgtctctgcaaatttttttttttttgcctttggcggtaacgattcaactttctcgaaacattcaataaaaaaggtttttttttgtttgtttctttattagggtaaattgtaatatttgaaaagatgaggggctaagtgaaaattaatagataagtttgcttcatttctattggtgggaattgattgacatgagagtttcaaagttaaaggtggatgttactggttctgtcagtagatagaggtatttaataggggtcaaaatattagtggaaaaatgaaaagcttttagtatttcaaatatattttacaaattggttactaattttttttgttgtaatggtgctggtaaggacaaaaattctattatttgcttaggattctctcctttatgttttgatgtgagtatgtgactaatatttctgcaaacgatttagtgttgggttattagagaaagatatcttctggagaacgaaaatctggaggtgagatcattgctgatttgaattgtaaattttttatgaaaattttgtggtaatcaaatctaatggcgaaaattcatagacagagtcactcacagagatatgcaatttatacaacttttacgattatatattttttgcggtttaatctatcaaaacatgtattataacttaaatagaagattattattatttgtttgtttcaaaaataaaaagagtttgcggaataattagtagaacatgttagagttaatataaatatgatagagaatgagttaaatagaatgttaactttgacacttctaaatttataattacagtaataaattatacataccagaggctatatataaaaatactaaaaaaataaattatatcactttaatacttatttaaaatgtgtaacaatctaaaaaaatggtctggtagtatattacgaattaaattttattagttatataaaaaaaaatatgatgaagaggctcaattcctcaaagcaatttatgtgagagttcaattattattagatttctaaaattatatttttgagattggatttctaaagttctatttttgagtttgaactttcaacgagttataaaattggaaatacaaaatcttatggaatcgaattatctaaccgggtttaggttccaccgatcagactaatcggatcagctcaagttctaaaatatgtaaaagctcgtaacgagaactttcaaatttggggcaaaaaaacatgaactttctaaatgtcatttaaatctcaaagtttggtttgactttataataaaatggttaagttttgttgaccgagtcattttaggcatgtcgttaaatttttgttaattaaaagatgaccgagttaacttttcataatgtttgggtttagaacgataccttatatgtatttagaaagatacctcataagctttctgataccctacgttgtgatggtttttctctttaatgacatcatatatgtatataagatttatttatttcccaaacgaaaaattaactctgtcgtctttttattaacggaaatttatcgatatgcctataatgattcaatcaacgaaatttactattttattataaagtcaaaccaaaatttaagattttattaacattttgaaaattcatgtttttatgtcccaaatttgaaagtttgcaaaaaaattttgacatttttcccgatctaaatttaccatttaaacaataaaaagtaaaaggtcaaaatgtaacattttagaaacacaaaggacaaaatgataaatatcatgccaacgcgttgatcggtttttagctcttttcttccgatttcgttttttctttcttcatctctaagattaagcacaccttggcatccattttcgtttgaatctcaacgttttttgcttgattttagcttctgagagagtccagatccaaggaattggaggaagaataatg

SEQ ID NO: 22213 - DNA, 2042 bp, Unknown; identical to SEQ ID NO: 2875
  misc_feature (1)..( 2042): 2750-1469P.txt file - cDNA_ID_2049353; gDNA_ID_1620612; Annot_ID_161930

SEQ ID NO: 22214 - DNA, 3003 bp, Unknown; identical to SEQ ID NO: 18700
  misc_feature (1)..( 3003): 2750-1469P.txt file - cDNA_ID_2049387; gDNA_ID_1620619; Annot_ID_162203

SEQ ID NO: 22215 - DNA, 3003 bp, Unknown; identical to SEQ ID NO: 18700
  misc_feature (1)..( 3003): 2750-1469P.txt file - cDNA_ID_2049387; gDNA_ID_2926207; Annot_ID_202304

SEQ ID NO: 22216 - DNA, 3003 bp, Unknown; identical to SEQ ID NO: 18704
  misc_feature (1)..( 3003): 2750-1469P.txt file - cDNA_ID_2049420; gDNA_ID_1620619; Annot_ID_162187

SEQ ID NO: 22217 - DNA, 3003 bp, Unknown; identical to SEQ ID NO: 18704
  misc_feature (1)..( 3003): 2750-1469P.txt file - cDNA_ID_2049420; gDNA_ID_2926207; Annot_ID_202289

SEQ ID NO: 22218 - DNA, 3000 bp, Unknown; identical to SEQ ID NO: 2981
  misc_feature (1)..( 3000): 2750-1469P.txt file - cDNA_ID_2049430; gDNA_ID_2926207; Annot_ID_202280

SEQ ID NO: 22219 - DNA, 3000 bp, Unknown; identical to SEQ ID NO: 2981
  misc_feature (1)..( 3000): 2750-1469P.txt file - cDNA_ID_2049430; gDNA_ID_2926238; Annot_ID_203958

SEQ ID NO: 22220 - DNA, 3003 bp, Unknown
  misc_feature (1)..( 3003): 2750-1469P.txt file - cDNA_ID_2049449; gDNA_ID_1620628; Annot_ID_162568
ttctcggtaacttccttgtcttctttgatctcttgcttttggttaatttgtgtaactgtcactgttgttattacaagttttttttttttttgttcttgttccatgagttctctgtttgttgattggaaaataaactgacaaaagtatagtatgataggagactgaaactgttctaaatttggaaactttaagcatatggtttcttattgaaagatctgtctcgttgatcctgaactctctcccagtgagcatagcgtatgctaaacttgtctactgtttgcagacacggagaagttttacacggaggtccaggaaaagatacttgctagatacaataaaacatttgattggtctttgaaagcaaagatgatggggagaaaagccatagaagctgcaaggcttttcgttgacgaaagtggaatcagtgactctctttctgctgaagatttcattgtagaaagagagtcaatgttgcaagacctcttccccacaagtgacctaatgccaggtacacaatccgcattgattaggccattctttcttttcatatatatatatatatatgtctttaaattctgtttgtttagtttcatttgaatcagcctctgatttattctctttgagtcactaatcactgaaagagacaagctcttagctcttctacttttcgctgtatccaatattcttcctctaatgcaggagctagccggcttcttagacatctccatgggaaaggaattccaatatgtatagccacagggtatctctttctgtattagcacatgctcttcttatagatcactgagagtgcaaatggctttttcagcttctttttataaatttatggtttatggcatatgttatctgatttagctactttttaatgcagtacacatacacgacattttgatcttaaaacacaaagacaccgtgagcttttttcgcttatgcatcacgtagtacggggggatgacccagaggtgaaggaagggaagcccgcgccagacggctttcttgctgcatccaggagatttgaggtacagatggtcactaaaactgtacttatcaaactaaagcaccagctattagcatgtgtttccacctttgagaagtttgtaaaccaatgttttccctcttctttgcggatttcataggacggtcctgtagatccacgcaaggttctcgtgtttgaagatgcgccttctggagtccaggcagctaaaaacgccggaatgtaagtggatttcgtgtaacattttccaagttctcttagctgatgagctattagtggttcagttctgactggtgtgtgtgcaggaatgtaataatggtaccggattcaaggttagataagtcctactgcaatgttgcagaccaagttctggcctctctgctagatttcaaaccagaggaatggggcttaccttccttccaggattcacacaactaaaacaacaaagctttcagggcaacgttatcctcaagctaacgatacttgactcgttaactttgattctttaagcctcttacgctatacgagaaagattattgcaaattatagattcttattggggtaatttaaaacaatatatttatgttcgtgatttgttttcttgattcatgaatttgtaattgttatccagaccgttaagtgtgactttggtgagaatgatattagaatgattgttgtgagtgtgggttacattcgaaggtcataggcttagattttgcgggatgtcgttaacagaacttgaggtcaactttatagtcggtagccaagttcataagcaagtctttgctactattattgtagaaaccgacatgattggtacatgacattgaatgttaaaatcaaaaccaatcacatatctctattctctaccaaaccaaattgcaacttatctcttgtaagaaacttcaatgattgcaacgggcgaaaatattgtctcacttttttattttatttgtgtcgtccgcaattaacttactcacataatcggaatccaagttagcactaatacaaagtatgtctttatgtagcaatgttgcatcgttttcaaagaagtgttattcattgcttactttcgtaatgatgattttttcccactcgtttgtcgttactatttactatcaatgatttataaatcatcgttaatgaaaatttagatctattttagtaatagatttgtttggtttagtacaagggattgtgaaaaagataaatttgatgattaaagaggacgcaaagtttggcgagtctttactctatatagagatagggtctaagcattcacatgcacttatgaaccgtccaacatcaacgttaataacgtgtgattcgtatcaaagtttacatatatttggcaaactttaatttattatcttgaaaactatatgtttcatttttgccgttttgagtaaagaatcgtacacccatcaattttcagatatatatgagccaatccataattaatctgattgattagagagaacgttataaacatctttaagatcaacagtatattattggttgaccaaaaaaaaattattttgatggtgaaagtcacataaatcaagtataagttcttgtcaaatttaaagtaatctctacgaataataatattggatacatgaatcataatttgtgatggtataatatatggtacctttcccgtgcaaaagaaattgagtcattgaagtgttaagcaatagtttgaagtttttatattgaatattacaaagtcaaaagcccttaattacatcatacacatcaagtcatgaaatacatataatatcacacatcaacttgatcattcataaagtcttacgttccatcttctctacaggacaagagtctcccaagatatatatacccactaatacccaaatccatagacacaatctccctctatatatccatttctccaaacgaaaacaaaaaaaacattaagccaagaaccgcatatacgaaccaagaacacatcatcgttagttctaattatg

SEQ ID NO: 22221 - DNA, 3000 bp, Unknown; identical to SEQ ID NO: 3158
  misc_feature (1)..( 3000): 2750-1469P.txt file - cDNA_ID_2049474; gDNA_ID_1620693; Annot_ID_164858

SEQ ID NO: 22222 - DNA, 3000 bp, Unknown; identical to SEQ ID NO: 3158
  misc_feature (1)..( 3000): 2750-1469P.txt file - cDNA_ID_2049474; gDNA_ID_1620628; Annot_ID_162554

SEQ ID NO: 22223 - DNA, 3000 bp, Unknown; identical to SEQ ID NO: 3158
  misc_feature (1)..( 3000): 2750-1469P.txt file - cDNA_ID_2049474; gDNA_ID_2926187; Annot_ID_200751

SEQ ID NO: 22224 - DNA, 3000 bp, Unknown; identical to SEQ ID NO: 3462
  misc_feature (1)..( 3000): 2750-1469P.txt file - cDNA_ID_2049485; gDNA_ID_1620647; Annot_ID_163277

SEQ ID NO: 22225 - DNA, 302 bp, Unknown
  misc_feature (1)..( 302): 2750-1469P.txt file - cDNA_ID_2049485; gDNA_ID_1620628; Annot_ID_162585
ttcttacttccatgacctctctgcctctctctaatcttaaatgttctcttcttttttctgtaggagtttcctttttagtatactgaatcttaccttttccccatttaagttttaacctttttgctatatttagtaaacaagattttgtcatagggtttagggtttaacaatagacttcatacgaaaactttctgactttatatttttccttttcttaaaaaacacacactaactttaacctcaaattcaacagtcatcaagatttttctcggattctaatcaaacgtccacaggtgaaaatg

SEQ ID NO: 22226 - DNA, 3000 bp, Unknown; identical to SEQ ID NO: 3462
  misc_feature (1)..( 3000): 2750-1469P.txt file - cDNA_ID_2049485; gDNA_ID_2926188; Annot_ID_200794

SEQ ID NO: 22227 - DNA, 3003 bp, Unknown; identical to SEQ ID NO: 19155
  misc_feature (1)..( 3003): 2750-1469P.txt file - cDNA_ID_2049489; gDNA_ID_1620628; Annot_ID_162583

SEQ ID NO: 22228 - DNA, 3003 bp, Unknown
  misc_feature (1)..( 3003): 2750-1469P.txt file - cDNA_ID_2049531; gDNA_ID_1620634; Annot_ID_162819
tgtgtagaaccagtgccgcttgaatggtttgagccagagctgcttccccaaccccagtttgtatctgttccgtcggagctccatccccaaccccagcttgaaccacccgagttggagtctgaaccacctgaacccgagccagaagaaccgccagagttgccggatctccatccccaacccccgttcgaaccggactggccagaaccccaactccagctccatgcttcagcactcccggagaacacgaacgcagtaaccatgaggacgacgagtaacttacgtccacaataaagaaccatcatcgtgtcttcttcttcgttttttttctctctcttttttttttatggcttttgtgagctcttcagagtttagagtttcggtatttatagagtaatgagagtcggttcccattatttagtgaatataattttatttgtttttttagtaacagtaataggatttttttctttttcttggatcaaatagtaataggattttaaaagtggataaatctagctttagttattattgtttgaattttgatgagtcttttttttttttttttttgcatatacgattaacattgcttaaggatattgtatatatctttaacacacaaaaaaaaagatatagtatacatagttttgtttgatattctttttattttcgcacaaaaaaaaaaaaaaaatcttatttatactataatgaatctaaacatctgtccacctttaatccaagtacctctcccaactactgcgactaaatgacccatttgcctaaatgtagtcctttaccttactgaaaatagcgaggacaaatcagtcattcaccgccctaaaacacgctttgacatgtatttatccatttactgttattttatctgtaagaaatccaaataaactcatttctgtaaattaggaaacttctgagaaagtgacgaaagcgaagaaggtttcggaagtaaatatgtcttccttggggagcagcaaatccctgagggatgagatggaggtaacaaccgccgatgtttttccggaggttaacgccgccgctgtgacggaaaatcttgatcggaacgagcttgtgcttgctgacggagtcgtgtcggctgaggaaaggaatattgagccagacaatcgtggagagaggaagatagagagcgagtcgcctccagaggatgatgtttgcccgatctgtttcggctcctttacggttccgtgtcgtggaaattgtggtcattggtattgcggttagtcttttcatctttcttcttcttcttgattctcttgagccatttcatctacattgaagtatcaagcttgtgtctttttgggatatttctgttcgtcagaggtaaatttggagaattgtttgggttggaattggtttagggttccttttggtagccaagaatgatttatcacaactgattaacttttgaaagtgttgatttttaaaccatgctctgttactatggagtgttgtttgcaatgtcataaaaagatctgaaagtttcttaaaccggttgctgattttgttacaggaaattgcatcttgcagtactggaactatgctgcaatatctaggccttgcaagtgtcccatgtgtgttaggcacatcacgaagctgtcaccagaaccatctttgcaagagcgtcaggagcaagaggtgaaggaggttcttgataaagtccgtaggtataaccgtctctttgttggaggtctaactggctttgttcaggtacggtctttttgattcatgattttgttttgcttctctttactgtttcatgcatttcttatctatgtatatacttatttctcctttttatgacttggcaaaaccaccatctttcgaataattcagaaggtgcatgagcttccgtttctagtgaagagaatggtgtggcatatgatggatacagatgtgaacaatctgtattttcacgaagtgcgcatctttgcagttaagaacatcttaccctgaaatttacatttcatagtttagtgtttagttatatctctacccacttattcttgttgtcatttgttgtctgtactaatggccaagcaagacaatctttgtaatcatcataggagcaactagtttgtatttattcttgtttttaaaggccattgaaagatgagaaactaagtttctgtcggtgtttgcagatgttcatgagtaccctttacactgccgcagagtttaacttcattccaacgggtaagttgcctcacaaatcaaaaaccagcaatgaagggttaaacaatctcaatgtggtgtgtttaaggcttttaagctttccaagattgattttgccctcttttgtacaggcgggttcagaatagtgacagtttttgactacgctgcgattgctatgatcctgattctacgcttagtagggatatatcggaggagacgcctagctcagcaggttagacatctagcagctgcagcaattgagccggaattagagcaaagggaattgtaacagacacgtgaatctattaagtcttgtgcagtttgatccttgtggataagtttggtagtagatcatagaaacctcgagagtcgtgtgcagttttacagacaatgatattgcagactttaaaagtatatacatatctccttttctaacagtggaaataaaatattgattggaaaagatctctctggaaaaggatcttaatctttgattagatgatcaaagggttgaacaaatgttcgaagagtagaagtggatattctaaaagacgagtgatgagtgatttaaagattcaaaaatttcataattatctgaaataaaatgatggtagaagaaagaaacagtgcctgtggtctcgaaacagtgaaacgacatcgttttaatttcaaaaagacaccgtttctgttttaattaattgctttcaaatcagtagaagaagaaacatcgattgagctttctacttgaaaaccatcttttccgatctatcgaatcggagcggcgaaggaaggagaatg

SEQ ID NO: 22229 - DNA, 3003 bp, Unknown; identical to SEQ ID NO: 22228
  misc_feature (1)..( 3003): 2750-1469P.txt file - cDNA_ID_2049531; gDNA_ID_2926206; Annot_ID_202215

SEQ ID NO: 22230 - DNA, 2812 bp, Unknown
  misc_feature (1)..( 2812): 2750-1469P.txt file - cDNA_ID_2049603; gDNA_ID_1620636; Annot_ID_162922
ttctttttaacaaaaattgaacatttgtttttatgtatgttcttgcagttggacaaacttacttctgaatgaccaggagtgtgtataagttcgacatcttcatagatactccatggtccacttccttccagctttaactccacatcagaggtcgaaggttcaacctaacaaaaaaaaaattcccttaatggtcgatcagagatgggtttagtaacaaaattgtttgcgtggctagtttactttttacttttatccaacctcataatctttttctattttctacagagcatataagcagcccaaggttcttgtaactatgtaagcaagctttttcatttttcacgaaatctagatgttgaaaaaacctatcaagaatgtgcagagaggtgtgaaaaattcaaggacatacatcatcagaatgcagaattctggtagacttgaatctgtctgcccatttcttgtgatctgcaacatcatccctgaacaatgaaatcgcttatcctgattaacagagattacaagagaaaacacggattttctcctttaggtgttatcaattctacctgtgtgtcaaaaacatgtagcgaacaccacccttcatctcgatctttccagcaagtttctccacgtacctaggactgcagcaaacagcaaaaccttggtttaatcagttgtgtagagttaatagccacaacgaagtatatcaagaaatacattgcatcaacaatgtataagatactaaacaacaaagaaaataagaattcatgatgcctcctcccaagggtatatacctatcaacaagtatatttccctcacgatgaaggatcaggtaagaagttgctccatacgatttcttggaatgaaatccacaatgaaaaacgccctgagcataatgcaaatctcaaactttataaacctcaaggacagcagacaacatataagaacaaggtagtaagagtcctcagtggagctaaatcagttaagaacttaaggtcattgtatctaaatctattcaaaacctacgtatgcttacaatgatctaatcagagttagttgacttgttaataaccatcctaaaaaaatgaaagcttaagggattaaaaagtacaggaagtgtgtctttgtccactacaagtggaaaggtctcttgagcttcccctatgtcagcaggtggagtttgagtgcgaatagagcccgtcggacaagatagtaaggcctgaaagaatcaagaaaccatgagtaatcaggacaacctcagaaattttactcactaaaatatttttcttcataagaaatttctcagtctatgacatcctagcagacatttccacaaaatttgtctatctgttttataaggtaacaataaaagctatcaaagacaaaaaaacaaggagattcaaaaacatcctcaatgaaatgtcatcagatattaaatagaaagaaaactaaaatcgacgtagttaaggcacctgaagagcattcagtctttcctccttacaagttggttgctttgtaaccgcagacatgttgtccactcgagtgaataaatcctgtgaagataaatcagagaaaagctgtttacgaattggctgaaaaaaatgtaaagggaaagtaaaatcctgctctcacagctgcattggcctgctaacaaacaactataacatgaacattctaacttcttgttctcatataatgactgtgatcaaatcagattatattctaatgttagtatatccttcttcgagatcaatcctaaggcatcaacttcccaatacccaaaatgaaaaccccccaactactttaccctaccaaccaatagacccaaaatgcttaaatcaattcatcaatttcaaaggaccaccaaaagggtccacaagacaggggaaagagcagaaaaatttaggagctttacagatttcagagaagaaaagcttaccggaaccatccaacgacatgtatcacaatcaatacaagtattgtctgcaaaaaaatccattgaaagatagacagagagagggcgttaatgatctctctttgttttcaatttgcaataaaaagtaaccagactttatttaccaacaaatatatctccttcgacgttctgagttcgtcttctaggattctcatggcttgtcacttgagctgctttgatagatccaaacactctccttcctgataaagccgtcgagctaaaacaggaagctttcgatgaaaagatcgcttcttttgaacggaattgatacgagagcgaagaaaccgcagagaaagaagctgaagccatgagaatggtgattgatcctcgtctcttctcttctctttttgtgagctttgatgagtgtagtaactcatcttgaacttcgcccctatgaaaattatttgactattaaaaaatctatatttgactacttgtggacccagctaaaatccggtttacatacggttaagcttgattaaatcgttcaatcctgattggacacgtgtaagcttcttctcattcgtgccgggtcctgtcctcctttgtagatcgtctctctcaatctttcaaaacgagaacccggttttttagcggttaagcctaatttggtctggtttgtttttccttaaaccgtgagtctcgaatccaatcatgattggacacgtgtaagcttctttctcattcgtgccaggtcctctccagtgtatgtagatcaatctctctcttccatctctcaatctctcaaaaacaccaattccaatcctgtttccttggatcagagatacgaatctgaatcacaatctcgagatcttcagtgttttccaacggtgattgatg

SEQ ID NO: 22231 - DNA, 3000 bp, Unknown; identical to SEQ ID NO: 4398
  misc_feature (1)..( 3000): 2750-1469P.txt file - cDNA_ID_2049603; gDNA_ID_2926204; Annot_ID_202072

SEQ ID NO: 22232 - DNA, 3000 bp, Unknown; identical to SEQ ID NO: 3299
  misc_feature (1)..( 3000): 2750-1469P.txt file - cDNA_ID_2049607; gDNA_ID_1620636; Annot_ID_162919

SEQ ID NO: 22233 - DNA, 3000 bp, Unknown; identical to SEQ ID NO: 3299
  misc_feature (1)..( 3000): 2750-1469P.txt file - cDNA_ID_2049607; gDNA_ID_2926204; Annot_ID_202069

SEQ ID NO: 22234 - DNA, 3000 bp, Unknown; identical to SEQ ID NO: 3290
  misc_feature (1)..( 3000): 2750-1469P.txt file - cDNA_ID_2049619; gDNA_ID_1620636; Annot_ID_162915

SEQ ID NO: 22235 - DNA, 3000 bp, Unknown; identical to SEQ ID NO: 3290
  misc_feature (1)..( 3000): 2750-1469P.txt file - cDNA_ID_2049619; gDNA_ID_2926204; Annot_ID_202065

SEQ ID NO: 22236 - DNA, 3003 bp, Unknown; identical to SEQ ID NO: 18969
  misc_feature (1)..( 3003): 2750-1469P.txt file - cDNA_ID_2049627; gDNA_ID_1620636; Annot_ID_162911

SEQ ID NO: 22237 - DNA, 3003 bp, Unknown; identical to SEQ ID NO: 18969
  misc_feature (1)..( 3003): 2750-1469P.txt file - cDNA_ID_2049627; gDNA_ID_2926204; Annot_ID_202061

SEQ ID NO: 22238 - DNA, 3003 bp, Unknown
  misc_feature (1)..( 3003): 2750-1469P.txt file - cDNA_ID_2049633; gDNA_ID_1620636; Annot_ID_47377
accgcgtttacagccatcgcctctgtttcttctctcttctattggttatcaccatatgcggtatatatgaagacgcagcttggtctatctgatccctttctttcacgctgctgctccaaatcgtttacaagaatccaaggattgctacttgtggcttgtgctatgacagttgtggcatggctcatctctggccattgggtgttgaacaatttgctcggaatctccatttgtattgcgtttgttagccatgttcgtcttcctaatatcaaaatctgtgcaatgctcctcgtgtgtctctttgtatatgacatattctgggttttcttctctgagagattctttggtgctaacgttatggtggccgtggcaacccagcaagcatcaaacccagttcacacagtggctaacagtttgaatcttcctggactgcaattgatcacaaagaaactggaactacctgttaaaattgtgtttcctcggaacctattgggcggtgtggtgcccggtgtgagtgcctcagatttcatgatgcttggtcttggtgacatggtacagactaatcccttctttgattttaagattggtatgtcgttatatgtgtactaactgtaagaaatgttctctctcagactatagtgacgaggagataaaaaaaacatgttgtattgattaactgttttgttgttccaggctatccctgcaatgcttttggctttggtcctctgctttgaccatcgaaaaactagagatgtggtgaatatttttgatctaaaatcttccaagggacacaaatacatttggtatgcacttcccggatatgccattggcttggtggcggctctagctgcaggtgtcttgacccactcacctcagccagctctactttatctggtaatattctcctcatgtgacttctttgttcctcttggtctaacatcaaaagtatatattctactacgtgtatttgtgcacaaccgatatcaacacttgattcaactgaaattttgttgatagaatctttgtagtctcaatccaatgattttaagagcttgatcagtgtgaagtatagtgagattatgatgtataatctgttttcgatgtggatatataggtaccatctacgttaggaccggtgatcttcatgtcatggcggagaaaggatcttgcggagctgtgggaaggacctgcattatctaatcccattgagaaatctcatgaaatagagatctgagtttattatatcaatcaagatgattcagaaatctaaaacatattacataaaacaaagacgcttagtaggaaaacatcagatcaagaattcttgtattcttaagttcccaaaaaaagaaaaaaaaaaaaaaaattggtcagaaagagagatgatgtcttatatccctcattttttttgcgttactcaaagggaggaaaaataaacaattaacaagttctttaattttttcttatgaatagagataccaatactaaaaaacgttggcttttgtaatgaagaagttttagtgataatataagttaaaattaaaagtgtgtaaccaattagtcttttttttttccgtcaaaaaaaagaaaaaaaaaaaaaagactaattggttacacacttttaattttaacatatattatcactaaaaccaattagtcaattacacaaatttagtaataatacatagggtctctaatatatattaagctttatataaactaatgaggaaatctgtaaaaatatacaaataagaatttccaaagtagatcctatgtaatttcgaagcgtattactgtgcataagacagtgttaaccaaaaaaaaaaaaaaacatttccgagatgaactgtgttttgtcctcaccggataagaaagtggaagaatgaaccactacaaagtccgcgtcgaaagcactcagttataaaagtaaaattgacatgcgattacattaaaaataccaaactcgcttgtccatttttattgatattgcttgctaatggaagccagctacatgtccgctttcttgtttgactttctttcttttctctttgagttctcttcaatattaatagatgcattttatgttttgcttcttctgagtagcatcgtgaatcaagtcgccattatcttattcagcactaatataattatatatagccagaatttctaaatttcaagaatgtagacaagttctagaaacgccgtccacagttccataaattctagctagttttctgtaatatttcacataacgattcatagacttttctgttcagacaaatatatactttgcaaaacagaacatcaagctcagtagctcacaaccaaaattctctgtccaaatttgaagtaacggaacctagtgtcttgctgggtttgagacttctcaatcaccatatagtcagaaatacctatgaataagattatcttgatgattttttaaaaaaagattttcttcgttaagcttttcttttgtaattagttataaaccttctcactttcaatgaaattcacattcatataagtttaaattttaaattaaaatattggtcagctatagactatagtaagtatattaaataataataacattttttgtggacaaagagaattcgggttttggggttttggcaaaggaaagaaatggtcatatgtggaacactacgtgccacttttcatgcaataacatgcaaatattaggtcagccactaggaatagaataagttgaatagttttttacgatgataagagtaagcgggaagccataatagaccactatcccaaaactttaatctgcttccaactcattatgggaccaactaatacaaaatgatatgtattccatgttccaaccactccaatacgaattacgaagcaagcgtgtctcagtgtctgagtgcgactgccttctctctatatataagagatatacatagtgaattaaacatcttaattatactgatctttatcatgttgactagatttaagaaacaaaataataagatg

SEQ ID NO: 22239 - DNA, 3003 bp, Unknown; identical to SEQ ID NO: 22238
  misc_feature (1)..( 3003): 2750-1469P.txt file - cDNA_ID_2049633; gDNA_ID_1620636; Annot_ID_162909

SEQ ID NO: 22240 - DNA, 3003 bp, Unknown; identical to SEQ ID NO: 22238
  misc_feature (1)..( 3003): 2750-1469P.txt file - cDNA_ID_2049633; gDNA_ID_2926204; Annot_ID_141650

SEQ ID NO: 22241 - DNA, 3003 bp, Unknown; identical to SEQ ID NO: 22238
  misc_feature (1)..( 3003): 2750-1469P.txt file - cDNA_ID_2049633; gDNA_ID_2926204; Annot_ID_202059

SEQ ID NO: 22242 - DNA, 3003 bp, Unknown; identical to SEQ ID NO: 17236
  misc_feature (1)..( 3003): 2750-1469P.txt file - cDNA_ID_2049637; gDNA_ID_1620636; Annot_ID_162908

SEQ ID NO: 22243 - DNA, 3003 bp, Unknown; identical to SEQ ID NO: 17236
  misc_feature (1)..( 3003): 2750-1469P.txt file - cDNA_ID_2049637; gDNA_ID_2926204; Annot_ID_202058

SEQ ID NO: 22244 - DNA, 3000 bp, Unknown; identical to SEQ ID NO: 3273
  misc_feature (1)..( 3000): 2750-1469P.txt file - cDNA_ID_2049665; gDNA_ID_1620636; Annot_ID_162896

SEQ ID NO: 22245 - DNA, 3000 bp, Unknown; identical to SEQ ID NO: 3273
  misc_feature (1)..( 3000): 2750-1469P.txt file - cDNA_ID_2049665; gDNA_ID_2926204; Annot_ID_202046

SEQ ID NO: 22246 - DNA, 3003 bp, Unknown; identical to SEQ ID NO: 17101
  misc_feature (1)..( 3003): 2750-1469P.txt file - cDNA_ID_2049708; gDNA_ID_1620642; Annot_ID_163070

SEQ ID NO: 22247 - DNA, 3003 bp, Unknown; identical to SEQ ID NO: 17101
  misc_feature (1)..( 3003): 2750-1469P.txt file - cDNA_ID_2049708; gDNA_ID_2926195; Annot_ID_201368

SEQ ID NO: 22248 - DNA, 3003 bp, Unknown; identical to SEQ ID NO: 19061
  misc_feature (1)..( 3003): 2750-1469P.txt file - cDNA_ID_2049714; gDNA_ID_1620642; Annot_ID_163065

SEQ ID NO: 22249 - DNA, 3003 bp, Unknown; identical to SEQ ID NO: 19061
  misc_feature (1)..( 3003): 2750-1469P.txt file - cDNA_ID_2049714; gDNA_ID_2926195; Annot_ID_201365

SEQ ID NO: 22250 - DNA, 3000 bp, Unknown; identical to SEQ ID NO: 3349
  misc_feature (1)..( 3000): 2750-1469P.txt file - cDNA_ID_2049722; gDNA_ID_1620642; Annot_ID_163054

SEQ ID NO: 22251 - DNA, 3000 bp, Unknown; identical to SEQ ID NO: 3349
  misc_feature (1)..( 3000): 2750-1469P.txt file - cDNA_ID_2049722; gDNA_ID_2926195; Annot_ID_201358

SEQ ID NO: 22252 - DNA, 3000 bp, Unknown; identical to SEQ ID NO: 3441
  misc_feature (1)..( 3000): 2750-1469P.txt file - cDNA_ID_2049737; gDNA_ID_1620646; Annot_ID_163254

SEQ ID NO: 22253 - DNA, 3003 bp, Unknown; identical to SEQ ID NO: 19129
  misc_feature (1)..( 3003): 2750-1469P.txt file - cDNA_ID_2049766; gDNA_ID_1620646; Annot_ID_163242

SEQ ID NO: 22254 - DNA, 3003 bp, Unknown; identical to SEQ ID NO: 19129
  misc_feature (1)..( 3003): 2750-1469P.txt file - cDNA_ID_2049766; gDNA_ID_2926179; Annot_ID_200086

SEQ ID NO: 22255 - DNA, 3000 bp, Unknown
  misc_feature (1)..( 3000): 2750-1469P.txt file - cDNA_ID_2049786; gDNA_ID_1620646; Annot_ID_163234
ctcgaatgttatcaaaatcatcaaatttatttggttatattattttcaagtaatttacacttataaacttttggttgaatttcgagcttgatttgcattattaacaatatgttttaactaaaactgaagagactttttcctaaagtcaacgtcatttttaaatcctttcacactttagaatattgtttgggaaatttcgtttacatgtaccaaattttttttcaaatattcaagtaaacataatgatatttttatttatcctaacgaaatacatttttcttattagctctagctattagattgagcaagctagtatttagttatttaccgattcggtgtaacaccttggattgcaaactatgtcataatagttggttatatacaatagcaaaacaaatattaaatttatcataagattctctgtctttttactctttttagatctcactcatcaaaaagtttacaattaattttatttaaagatgtttgggccttctttgggtcaagagtacatcgaccattgctccgtattgtccgcaagtgaaggtgttttgaaacgcggcgtgtgagctgtcaggaggtaagaatcacatgcttctgttaaatcttgaattgaatagttggaccgccggattaaatattgagctgaagtcaatgctattggacggtggagatcacagatcggagttatgaaggtgagggtgtaccgtggaaatgaagcggatgatacgagtttctgcgttttcacgtgcttgagtaccattctgcaccattagcaaagattgaagaaaaagacaaacaagaaaaagtctgttatttgaagtgtgatattatatatcataatggaaataaccaaaactcatgtatgtgtgaatgtataatgtgtcatgttttgtaatcataggtacattcgacaaaagcaagtctggttatgtcatcaatgagttccgataatttcggtagaaggaagtcagtcctttgaaaagtttgtgatttatgggttttaagcttaattagttgtaatggtgattattggttttttctttaagaatatgacaccaaccgaaacattttgttaaaaaataattataataatactaacaatttttgaaattattttagtttctttttttcacaactcatgaatgaacatttatccaacattttggactaactaggaatattattgtatattcgttacgtgtaggaaagttcctcattcctcaatgaatattaataatatacatattgccatgcaccgctttagttattacgacggaatcgacgggatcttcgttactaaatgcaattttagatctcaatcaatgctatctacttacgtgtttcttttccaacatcatcattctaacatgatttgatgaatccgtcatatgacaccaaaaacacatgtaatgatcatcaactgcttaatttctaaggatgttagcgtttgtttgggtgagttggcaacttttcctatggataaatcgtgatttgtcggaataaaaaagtggcaaaacatgtaaaagttattctagaatttgctatttggggggcttagcacttagcaatgtagtagtaatgtataagaatgaacgaaacattctttggaatgggccaattgattacctaatatataaggccacaattcacaaagaggccatgaaggccagtaatactctttttttgtctctctccacctattcctaataatgtatcctttggttctgtagtagcccaaatgcaatacaaacttacttatggatgaaataagttatcagatttacagtgatttactgtattagtgatctattaaaaattaaccatttatcgtgacccgtctagaaaaaagaaagttggttatttttcaatttcgtttaagataatactttagactatgcaatcacaatactatatacacaatggacggtcctatttgtaattaagcttattaatttatatatatttacattttttcaaaaactcaaatatgtaatttaatgattttacgctatatctagcatagtatatataagttatttcagtaaaagtttaaggcgtggtaaatacattgcatttgtatattaaaaaatcaaaatcaaaattaagcaaaaaaaattttgaagatggaattgtataaattaaatataaatactacactagtttagaattgtatagtgagaatgtgagagtaacctgtactatttatactttttttgtcttctgaattttatttggaaatatacatgatttttaaaatatttatactaagtaattacaaataatttgggtgagaaaacaaaaaagaaataggaaaagggtttactaacgccaaaaaacccaacccttgtctgcgttcttcatcagcgccgcgttctcaaagttgctctcacagtctccgatctccaattttatgtaagttctttctctcattccgattccaagtttcgtatcgatctctaagtagattcgtattaagctataagagattgatgaacctagttgctcccgtactcgagaggcttagatttggaatcgaaatcgattgtgatgatgtttagttaacgaaacccagtcactaaatccttgcgttgagcttatcaaaccctaattttagaggatttagatccatttgcatcacatttctgcgtagtaaatcaagaattagtctccaaagactcttcttttaacaacatttcaaccaatctgcgtttgatttgtaagaaatgttgtgtcaagttcactctcactatgatctctctttggattcaaagtttgtatctttttgcttctatgcatcaccaaatctctctttggattcaaagtttgtatctttttgcttctatgcatcactatcatataataccttccttcaattgatctcctctgcttttagctagcaagtttataggtttcttaacttattgtgagctaattggattacaatgagatattatcatctttaaagaattgtggttttgggcatatgcagaagttatg

SEQ ID NO: 22256 - DNA, 3003 bp, Unknown
  misc_feature (1)..( 3003): 2750-1469P.txt file - cDNA_ID_2049808; gDNA_ID_1620647; Annot_ID_163305
ttcttcttctccttttaccaatctttgtacagttgaagctgaagctcaatgaaggaagaagaagaagaagatattaaaattgagagagcgaaaaaacgaattgttcttttgtgatcaatcaaaagacttggtttctgtctgattctcaccttctcctccaagttatgcaaatattattctccattaattagtggaagttaattaattagtatgattttaattttaatttctgctttcgctttattttatttgtcttgaagattcgaagttaggttcctttttaaatgtgacgattagactctgaattgataatgtatttttgaacgagtaaacaatcaacgacaaattacaaatctgaatctaaaaatgtatcgacgctggtctcttcgaaacacgagatacaatatcaattaagatgtaaagtgagctgaattacacttccaacaggaacttcatctgtgtgtgcatcaacacttgcttgttgtgagctctagagagtcgacagcatttacataacagtaaaaactcctgttgaggaattacttatgtgcttcgacggccttagagtaaaactcccatgactcgtgtgtctcagttatggcagtttgaccgaatggattctccgctacaaacttctgaacgttctccgcatccgctaatctttctagatacttccttagctcaccctcaggccctgtctcaagaaataaaacatcagtgtgctattatgcttaccattttattgaaagagaatgatgagtgatttaagactaacccaatgcagaatcttgacggtttgtgtactggtacgggctagggaagattccagtgtgtggctaaaagagaggaagagcaataccaacggatgttgaggttaaaagtgacacattcaatgcataagcctattcaaaggtgctcgagtacacttacaggattacacaaggccttgtcgggtgaatcgtcaactagcaaagtgtttgtctcatcatactttcgctttccacaactgatgcatgtcccaatatggtcccatactcttcgtaggtccttgaggaacaaaggtttatccttcttctcctgagttttaaacttcgttgtagtgcatatattctgatcctgtgtccataagattcattagctagctggtttttggaccaactattagaatgagttctgctcatacgtaagctacatatctcatagtcaaagaaatgcaaagttcacaaagattgtagactgtgtttctacaatctcaatctcaactgcatttctcataatacagtccttctcatataggaactgcatttctcataatctactctcaaagtcaagaaaatagctcatagaggttgcagggatcacttacaaaacagaacaacagattcctcgcatggtttttcatgacaatgttgatcatataatccaacccactagtaagagaaaaaggagagacagagttaattgaggaattaaacttcgtatatgtataagacacctaactaagaagagtcaaagacaatgcattttgggttttgaatcagttcaagaagctcacacacgtctggaagaccatatcgcaacatcaaatctctcaaagcaaaagtcgagaaaactaggaagaaaaggcctcctgaagactataaaaggacaaagaaattactctgcagtaaaagaaacataaaacaacttacaagtagcgacgttgaaattgattctttcttacctgatctgtatgatactttaccatctggaagaaatgtacctgtaaaaccctgaacaatatctgcaaggattccatttaaatcaaatataaccaactttctggtacgttgagctttacatgtgcatctaggtacatctccagtttctgatgaaataactccttgagctacgttatcattttgtattaagacagaacttgacaatgacgtttcaagcttttccctgtcaaattctggttcttcatctttcctaggtaatgaaacatcatccttcccctccatatcatcagttttatgatctaaagaattttttttcctcttgctcttctttgttttgacctcaaccttgctaacaccttctgctcccaaatcattctgatcaacttcttcctttttttcatttttctttatactatcctcctccatattgtcagttttatgatctaacaaatttttcttcttcttgcttttctttgttgtcacctcaaccgtactaacaccttctgctcccttggcatcctgatcaacttctccctttctatcctttttcctttttttggtatttttatcatcttgaacgctttcccccttagttgcagaatcttcaatgttactagccaaatccttactggcaatctccccatcagcattcccttcataatttttcacaccttctccattcgattgatacaacaaagactgtactgactcactatccatggtggcaactgattcgcagtttgttttgttttttatcttcctcttctctcttttgtgaccatcatcactaacaccttctgcgtcgagtgcatcctgattagattcaatatttttatcttttgtcatttctttacgttttccagatttctgaactccacttttctctctcgttgcagatttttcaattttaattgtcatatcctctcccccgaactcttgtccagcattcccatcaaaattttgcatgtctttttcgtttgactgattcaacaaacactctactgatcctgatggctcaaagacctccatatctgcagatgaagttttcttcttctttcccttccgttttttgctccttacatcacatacacctgctccaagaacgtcctctttaacttcagtgttttcatctgtttccttctctttagtttttccgagattctgaataccgttttcctccccatttacataattttccgtctgacttgccgaataactaattaactctcggccaccattcccatcattattttccacacgctctactggcccgcttttcatg

SEQ ID NO: 22257 - DNA, 3000 bp, Unknown; identical to SEQ ID NO: 3147
  misc_feature (1)..( 3000): 2750-1469P.txt file - cDNA_ID_2049863; gDNA_ID_1620647; Annot_ID_163271

SEQ ID NO: 22258 - DNA, 3000 bp, Unknown; identical to SEQ ID NO: 3147
  misc_feature (1)..( 3000): 2750-1469P.txt file - cDNA_ID_2049863; gDNA_ID_1620628; Annot_ID_162579

SEQ ID NO: 22259 - DNA, 3000 bp, Unknown; identical to SEQ ID NO: 3147
  misc_feature (1)..( 3000): 2750-1469P.txt file - cDNA_ID_2049863; gDNA_ID_2926188; Annot_ID_200788

SEQ ID NO: 22260 - DNA, 1600 bp, Unknown
  misc_feature (1)..( 1600): 2750-1469P.txt file - cDNA_ID_2049871; gDNA_ID_1620699; Annot_ID_165018
cttaaagctctgttttccccaaagctatatgtgatgggtattacaaatagcaagcatacttttcatttccatacatctaaattgagaatataccaattattgtccttttgggtggtcattggagtttattcattaagattttgcagttttttttttccaaacctttgatcattttttaaatgatactattatattattttctcaatcaaattattttaagataaatatcaacttatcgtttaatagtaatgtgtatataatgtaataattgattttaatgttgaaaaatagtatttctaggtttccaaactaaattaaaatgaaagtacaaatgtttgataattttacggtgtattttctgtaggattttggtgttatatccacataatctatctataattaataaaatatatacaagtaaaccgttgaaagtttggaagcttaatccatattttgaccatgttttgtagtactaggctagccgtctttattaaaaaaagtaccgcgtaactacatctagttcaaatttggtaatctctaatatgaggttctaaattagcaaaatcatattttaaagaatttataacatttagccatatttgtcttaggttccaaataatacatagttccaaaggcaaataaactgtcttttatggtttagaaagatttctgccttgagagtaaacttcttaaaataaggttaattccaagagatttgattccagtttatttctaggaataacacaaagaaataatcatttttggtaaacaagataatcagaactcaaacggaaagaaatatgtcagtctgtcaaatccattaagaaaattgatattcacttctactctatttagaaggcacgtcaataattcagaaaaataaaccaagtgcatgcgataatgcaaaagaacacataaatccaaaatatcacaaggttacaaagtcaacttctaaaacttcatattttcttcacacgcttctctttacatttatacacaaagtacgaattaccttttgaaataagttgctaggtacttaatatttataagaaaaacaaaacaaaaaactttgggttgaaatgggaatgttcgttgaataaataagaaaaaaatcgagaaagcaaaagtaggaatggttgatgataagtcactccattcacaaacaatttgagctgtcaataatgtgattttccaaaatctcttttggtaccacaatgttttaaatcattggacatcggaatcaatttattgtattatagtatcgtagtatacaaaagaagttggcttcttctgtttttttttggctctgcagttttcaaatccattgttttaaaataaaacataattcgacttcataattataatcaaagtgttaatctttgaattttaataatctaatattagtggtaccatattgacaagaaggagacaatgtcacagaaacttacctcaggagtcaaaacagaagaattgaaaagaaaaaagaagaaataaaaattggatttttatatttgtttcgaccactatcaactctttctctctcttacaaggagcgaaagagaaacactttccgacttgggtaaggaaaaagagtttgatg

SEQ ID NO: 22261 - DNA, 3003 bp, Unknown; identical to SEQ ID NO: 19306
  misc_feature (1)..( 3003): 2750-1469P.txt file - cDNA_ID_2049871; gDNA_ID_1620655; Annot_ID_163646

SEQ ID NO: 22262 - DNA, 3000 bp, Unknown; identical to SEQ ID NO: 19307
  misc_feature (1)..( 3000): 2750-1469P.txt file - cDNA_ID_2049871; gDNA_ID_2926209; Annot_ID_202452

SEQ ID NO: 22263 - DNA, 3003 bp, Unknown
  misc_feature (1)..( 3003): 2750-1469P.txt file - cDNA_ID_2049893; gDNA_ID_1620655; Annot_ID_163639
aatcttttcagattcaacccaaaattgaagacaaaaatgtctcgcagatcgctaactctcctcaagaatctagctagaaacgcgaatggatcaggtattcaaacccgatccgtgacttacatgcccagacccggtgacggagcaccacgcgcagtgacgctgatccccggagatggaatcggtcctctggtgacgaacgccgtggaacaggtgatggaagcgatgcacgctccgatcttcttcgagaagtacgatgttcacggagaaatgagccgtgtgccgccggaagtgatggagtcgataaggaagaataaggtttgtttgaaaggtgggcttaagactcctgttggtggtggtgttagttctcttaacgtccagcttaggaaagagcttgacctctttgcttctctggtcaactgttttaatttgcctggtttacctactcgccatgagaatgttgacatcgttgtcatcagagagaacactgaaggtgagtacgcggggcttgagcacgaggttgttcctggtgtcgttgagagtctgaaggtgagaattccgatttctgctcctcgttttggattcaatctgtatttgtggaatcatcttcgtttgcaagtggtctttgtatgttatgtgtgattgttctgatcctatttctatgcttaggtgatcacgaagttctgttcggagcgtattgcaaagtatgcttttgagtatgcctacctgaacaacaggaagaaagttacagcggtgcataaggctaacatcatgaaacttgcggatggtttgttcttggaatcttgtcgcgaggttgcgaaaaagtatcccagcatcacctacaatgaaatcattgttgataactgctgtatgcaacttgtagccaaaccagagcaattcgatgtcatggtatgtttcagagttatatacatatgaattttcatgacgttctttaagtcttcgatgttttactttgagaaaaagataccagtcatctctccctagtttggtatccctctagattgcctgttttagagtcatattatcttattggtatgagactgatgttgtgttgccatatactatagttaatcgccccatttgcatactatttaatctcgtcatttgcatatcatgctttcagggaatcttttaaattgtacttctgtgaccttgtctatgtatacttactactttgcatacactattgttcgttagagcagtaacttcactgttgctaagtattaacctttcattactgtatgtagtagcgtcttttggcttttccccccttttataacagcaatttatgaaatgttttgcaggtaacgccgaatctctatgggaatttagttgcaaacactgctgctggtattgctggaggcacaggagtcatgcctggaggtaaaaaaacatcctgtattgatattctctcgagctatacattagtggataaagaatagttctaaaatttatacatctgcgacattaaatacaaaaacaggaaatgttggggctgaccatgcggtattcgagcaaggtgcatcagcaggaaatgttgggaaagacaagatagtattggaaaacaaagcaaacccagtggcattgcttctctcatcagcgatgatgcttagacaccttcagtttccttcatttgctgaccggctcgaaacagcagtgaagaaagtcatcgctgaaggaaagtgccggacgaaagatcttggtggaacaagcacgactcaagaggtcgttgatgcggtcattgcaaaactagactgactttgacaaattacgtgttcccgctctgcataaatcatcaaattcctgatacagattttgtgttgccaaaatatggggtatgatccaagcacaacggttatctggttttgtacctcgagttttattatattctttagccgtggaatatttcgataagaaaaaaaaacatgttccaaataattcatgttgctacgtttgttggcgccttttgtcatgtcaaagtttcttaaacacttgttcgtggaatatgcaaacttttatggattcgtaatttcaagaatatgaatgaaaaattgatggtatctttgatcacctcgaatggtggtttcttaagagcatccacattggttaatttttgatggatgtttttaaatataaaactttattttaagaggtttttgagtagttaagaaactctaacgtgtcattgtgtgtgtggttgaacattgtgacaacatcatttatttatttttcttttcgcgtttttctctcttttttagtccatatgatttttaatatatatatcatatttgtttaaaattttaatatttgtattatttattaagttttataaaataaaatataaataatttttattttaataataatatatttttttaaaagacccacttaaacattagaccaaaaaaaattaatggtccaacaaaaacactttaattttttataatttaaaattttaaaaaacccttttaagggctcaaccattggggttgctcttactccaagtctttaatttaatttgtgaattaacattgactaattttaaaatcacttgaaattgtttcatcggatttgggatgtcacatttggtacccggcaagttcgaaaatgacttttaaactttgacacctcttgcctcttggtagagttttggatgaggcttgaaacttttgtattgcagcccataactgaaaatagtttattagtataatatatcttctcaacaaacattgcaaatattttgaaaatccagctaaaactatacccgatcagaattagaaaatttgagcccaagcccggcccgtaagtattattatagaaaccgatataaagtttcctttttcttaataatatttattccgtggcagcaaatgcaagccaatccaatgtcaaaacaccagctgacgtggccaaacgcacatcaactgtcgtctctctatctctctctccctcacttgtctctctctcttctcttcgacactgatg

SEQ ID NO: 22264 - DNA, 3000 bp, Unknown; identical to SEQ ID NO: 3661
  misc_feature (1)..( 3000): 2750-1469P.txt file - cDNA_ID_2049939; gDNA_ID_1620655; Annot_ID_163620

SEQ ID NO: 22265 - DNA, 3003 bp, Unknown; identical to SEQ ID NO: 19321
  misc_feature (1)..( 3003): 2750-1469P.txt file - cDNA_ID_2049939; gDNA_ID_2926209; Annot_ID_202470

SEQ ID NO: 22266 - DNA, 3000 bp, Unknown; identical to SEQ ID NO: 3694
  misc_feature (1)..( 3000): 2750-1469P.txt file - cDNA_ID_2049986; gDNA_ID_1620656; Annot_ID_163673

SEQ ID NO: 22267 - DNA, 3000 bp, Unknown; identical to SEQ ID NO: 3694
  misc_feature (1)..( 3000): 2750-1469P.txt file - cDNA_ID_2049986; gDNA_ID_2926211; Annot_ID_202614

SEQ ID NO: 22268 - DNA, 3003 bp, Unknown; identical to SEQ ID NO: 19333
  misc_feature (1)..( 3003): 2750-1469P.txt file - cDNA_ID_2049991; gDNA_ID_1620656; Annot_ID_163672

SEQ ID NO: 22269 - DNA, 3003 bp, Unknown; identical to SEQ ID NO: 19333
  misc_feature (1)..( 3003): 2750-1469P.txt file - cDNA_ID_2049991; gDNA_ID_2926211; Annot_ID_202613

SEQ ID NO: 22270 - DNA, 3003 bp, Unknown
  misc_feature (1)..( 3003): 2750-1469P.txt file - cDNA_ID_2050038; gDNA_ID_1971822; Annot_ID_58346
acaaaagaaagaagtaggtccattatcaaactccgagtgaatattgatgatgccaccgccaaaacagttcactaatacatcttctgttgcttcactttccttcttttaataccttctctaaaccacccaattttctttcttttttcatattccaagatttggatttgagtttctctttttggaaattcctcttaaatcgaatatataataatgtcacaaaattaggactagatacaaaaaaaaaatcattgtgaaaactaaaaaagcaaagcatatcaaatatatctcttgaagctagttggcataatattctctgagttatcgaatattctatatatgtaaatggccagtttgacaattacctaaaatcatatgatagacataaataattctacaaatttttaaaataaatttaaactaaaagacaataaaattaccattatgttcacatttagtaaatatttcatggacgaatttctccacgtcgattttcgaaatctcataattttccggcgccggaatatacggtggtcgtgataccttaagcaccaaatcccaatccaaccctttaaagaaatcatgtcccttgattccttcaacattaatcctacggctaggatctttctccaacagttttcttaccaagtctcttaacgatgtcgtttctccgaccaaactcggcggttcagttaatatctttaaaaaagtctctttacggttggaccccctaaacggcgtcgctccgtacaacatctcatacaaaaccactcccaacgaccaccaatccacggcgaagtcatggccacttccggtgattacctccggcgcaacatattcctctgttccaacaaacgagttcgacttctctcctgaaaactccgactcggaggatctcgaaaccgagtcgtccggggagattccggagttacataaaccggaaaatgcgaagatagacctttctttcttcgtcgccgtcgaaagtctcggtgacgacgaaaaagaagattgtggagttctaggaggtagattcgtcgaaagatcaaaatcaacaagcatcagatgaccattctcttgaatcatcacattatcaggcttcaaatctctgtacacaattccttgattatgcaaatactcaagtgcaatcacaagctccgccgcgtaaaatctaatgatctcatcggaaaacatttcttccgactgttttttccttaaagagttgagatctcttccaggacagtaatcaatcgcgtaaccgataactttatcggtggatataacaccatgaagacgtggaaacagaggatggtcgaatcgagacaacactccttgttcgaaacttatgcgtttgtactcatctttggccttctttgactcgattgattctcttagtatgacttttaaagcaagccatttgttatcggcttttactaagaacacaactcctttagatccacgtccaagggctgagaaaatctctagatggtcgaagttgagagtcgggatcttgttctccggtggtaagaggtggttgctcatcgctcaagagtttatttttgatttttttttatggttcaatattcttttggttgtctttaaagcagtttttataagagagaaggggttaagcttttctaaaggtaggtccgtatagattttgtttccttgccgggaaagacttgaataaacgttttaaccaaaaaagaaaaatgcaaaagatttacgtagtaagacacggattacttttaccattttactccttctcgaatcaccattactaagcatcaaatattttcagtcatttcaaacatcagtttttgcgtttatatttgagtaaaattgaaaattttccatagagatacacaactatttagcgcaacatacaataacattttccaaatagaagaaaaaagaaaaaatttacttgtttcttaacgttcctactcaatacacaaactaacaaacaagttaaaacgagtaaagattcttggcgaaaacaacaacaaataatgattcaatattttaaaataacacataaacagttggtctaaatttataaataatctctaaaaaatatcataaaaatcacatggtttcattctcatatacaaagacagtaagaagattttctttttttccgaagtggtcttcaatgaatatcgagttagaaaatggatttttttttcctactaattacttacaaaattttgatgaaaaaatagagtagacgaaatttggtagaaaatttcttgcgaaaagatacaagaaattcactaccaatttatgtaacatttggtaggcaattcagaagaatcaaactagattcatgacatatggggagaaatgcaagaaacaaaaacaaccgaggatgagtcttatgctcttagctaaaaacatttatttagattttaggtgtggttgcgacaaccaaaaaaaaaaatacattacaaacgattgacgtgctgagcgagaaattaagaagtcgagtccctaaacccgtaggaaccaaccatatatggtgagaccactgtggaatctgccagacaacacccaagcatattaaccataaccacagtggctgagcaggaaactgtttgactggtaatgactcattaacagaaaaattaacattgcagaaaaaaaagttataataaggtaaatggatcgtcccaagatcattattggataattaaaatcactggccagtggaattaaagcccaaacaagcccatgataactcaaaactagatcaaccagtaatggcccatgatgtcgtacttgaggtgacgtggcaaattctgaattcgcgcaccggtagattcttttctttttccgtataacacctttcaatacttgaggtgacgtggcaaattcacaaccactttttatatgatataccgcttttaccccttaagcctctccgcgtaaaaccgagaacaaaatcttaagcaccgttgttccgattcagagatcatcgtcgtcgtcgttcagaaaccttcaaaaatg

SEQ ID NO: 22271 - DNA, 3003 bp, Unknown; identical to SEQ ID NO: 22270
  misc_feature (1)..( 3003): 2750-1469P.txt file - cDNA_ID_2050038; gDNA_ID_1971822; Annot_ID_176216

SEQ ID NO: 22272 - DNA, 3003 bp, Unknown; identical to SEQ ID NO: 22270
  misc_feature (1)..( 3003): 2750-1469P.txt file - cDNA_ID_2050038; gDNA_ID_2926156; Annot_ID_139527

SEQ ID NO: 22273 - DNA, 3003 bp, Unknown; identical to SEQ ID NO: 22270
  misc_feature (1)..( 3003): 2750-1469P.txt file - cDNA_ID_2050038; gDNA_ID_2926156; Annot_ID_198422

SEQ ID NO: 22274 - DNA, 3003 bp, Unknown; identical to SEQ ID NO: 19459
  misc_feature (1)..( 3003): 2750-1469P.txt file - cDNA_ID_2050088; gDNA_ID_1620665; Annot_ID_163911

SEQ ID NO: 22275 - DNA, 3003 bp, Unknown; identical to SEQ ID NO: 19459
  misc_feature (1)..( 3003): 2750-1469P.txt file - cDNA_ID_2050088; gDNA_ID_2926196; Annot_ID_201494

SEQ ID NO: 22276 - DNA, 301 bp, Unknown
  misc_feature (1)..( 301): 2750-1469P.txt file - cDNA_ID_2050137; gDNA_ID_1620665; Annot_ID_163890
gaattcataattggatttgctcatagtttagtgagttcttctatatagattacacaataatgattgtattatccgtgtttaccaatataattttagtgaaaaatgcaatgtaaagttttactgagaaatgagaagaattgagtcaccaagctgatggtacatactacataagatagactactaagaattttacattgaccagtagaaatcttcaaatctctataaagtggcccaaaataaaaacgatttaaaattgcataaacgatgttgttgtttaagccttcaacattggcaaatgatg

SEQ ID NO: 22277 - DNA, 3000 bp, Unknown; identical to SEQ ID NO: 3835
  misc_feature (1)..( 3000): 2750-1469P.txt file - cDNA_ID_2050294; gDNA_ID_1620669; Annot_ID_164025

SEQ ID NO: 22278 - DNA, 3000 bp, Unknown; identical to SEQ ID NO: 3835
  misc_feature (1)..( 3000): 2750-1469P.txt file - cDNA_ID_2050294; gDNA_ID_2926170; Annot_ID_199452

SEQ ID NO: 22279 - DNA, 3000 bp, Unknown; identical to SEQ ID NO: 3834
  misc_feature (1)..( 3000): 2750-1469P.txt file - cDNA_ID_2050298; gDNA_ID_1620669; Annot_ID_164024

SEQ ID NO: 22280 - DNA, 3003 bp, Unknown
  misc_feature (1)..( 3003): 2750-1469P.txt file - cDNA_ID_2050324; gDNA_ID_1620669; Annot_ID_164012
attgtaagctcaaactcgtctcttagcatttgtagcatcttcctaactcccgcttctccatccgctgcaagcgagaacaagctcggcctcccgacctaacggaacaagtaattaatcacatgtcctttggatatttatatgatcagtgataatactcatatgcagcaacgggacacacatttgtttcattgtttggcttcatttcgacaaattaaaaacaacttaataaaacagaggatatatttgggtttgttttgaaaatttagaagtttggtgcaaaatgttaacaatttgtaaaaatcaagaagagataatcaaggttattgcaatgaaactgaaaatgaaaggagcgatttgaaaaccgtgagagaaaacaggggaaatgacaagagctaagtgtatatgatgaatgaacttacaaagacacctgaagcgccaagagccaatgccttaaagacatcggttccacggcgaaccccaccgtcaagaaaaaccggaatccgaccctccacggctttaaccacctgcgatttgtgtttgcttgattaatcaatgaagaaagctgaaactttttgttttaacagttttaaatcttgatccatttaaaagtttacctcttctaaggccactatagttgcaggaacataatctagctgacgagctccgtggttagagactattatccctgcagctccatattcaacagcaattcttgctgccaaaaatttgaatgatcatagaaattatcttaaaacataatgaaaacttcaagcaaaaggttgatgcatattctcattcttagtatatttgttttaccatcctcagctgtaataacacccttgacaagaattggcaagcttgtgatagattggagccattttatatcctgtaagaagaaaacaaacagcgaaaagaagcgagtttactatgtttctgaatcttggtatgcaaaaacaaagaattgatcatgttacattttctgaccttccagctaagtgattgatcaacttgaccagcaacatatgaagctagccctgagtcattcgtctgcaattatccaccaaaaaaggttagttaactattgagcttttaggtcaattgaagactttgttatatgtcttttgaccttgtctattttcccaagatccaacccttcgaagttcttcaacgttagacctcgaggaagcgcgaatctgcaagagaataactatcaagaaaaccaaaagatctaacaatctggtttatgtgatggtggagtagtttcatatcacctgtttttgatgtcagattctctgcgtccaagccttggagtatctacagtaagagcaatagctttgaatccagcttcttcagctcgtttcacaagctgtataaccacatttctatccttataaacctgaatcaagagagcaaatagtcaacacagagccaaaaaatcaataagaaacaagtaaatcttctgaaacatacataaagttggaaaaaacgaatccctggtccggttgaagcaacttcctcaacactacaagtagcccatgaagataaagtctgaaaacatcaaacaatacagataatgaaaacacaacaataagagaatatccaatcaagtaaaagagacagagagaatgaatcaaaaccatgattgttccagcagcagaagtagctctcgcggttgcaagctcgcctacaacaataacaaaaacattctccatagtgaaactaaagttttcttcttgacaagaaacctcaagattgtgttttggttacactgatcattacataacactaaagacttaccatcaggatgagccattttctgcattgcagtaggagcaatcataattggcatagaaatattaaaccctaaaaccgttgtgctcacatcaatcttgcttacatcgataagaatccgaggcctaaatctgtttccagctcataacacaagcacatcaataaaaagacagagaaaggataaaaacacattttgagtccttgttgtgaatagtttcacttacagaatcctagagaaagcgtttcgattctcttgaagagtccattgatcttcagcaccagatgcatagtaatcataaaccatctttggtaatttctcctttgcgatcttctcatattccatcacgtttgttatctccatttttatttactcaacactcaaaaaaattcctgtgacagataaatacacattttcatcatcaaaatcactttttaaaacccttgaattcaagaatgaagaatcaggaacaaaaaacgacactgacactaaaaaaagtcaattagcagactaataaaatctgccccggctcagattctataatcacaggatcgtcactcgttgagtttgatattgatgaaaatctaacaatcagataaacaagcatcgacgagaaaagtaacagagagcttcttacctagaggcctagagagacttggtcttctcgggaaggtggcgaagaataagaatataagaacaaaacaaaatgttgatcgagtactcttaatataatatagacactcataactaagtcacaaagaaacatacgtctctgtgactgtgtaaataattgtcagtgattgtcacgtgatggatcacgtgaaacacaagctcaccagacaccagggcttttcatttgttacaacaacatgcatagtttaagacccattattctcaaataagatggaccagattagtcatttgtgatttggctccaattttatgatttataaaagagttgggagtccacaaaatattggttatattgtgagtgggtaatggatgttgttcagaggatcaggtagttagtactctgctgttttaaaatccaatagactttggttaacaaattgtttaaatcacaaaaccatttacggttcgaccgaaagaaccgaattttattctctctgccttatcacctctgagtggaaaaaattgagtgagcgccattgtaggagagcttcgggaaagaagaagaagaagaagaagccatg

SEQ ID NO: 22281 - DNA, 3003 bp, Unknown; identical to SEQ ID NO: 22280
  misc_feature (1)..( 3003): 2750-1469P.txt file - cDNA_ID_2050324; gDNA_ID_2926170; Annot_ID_199439

SEQ ID NO: 22282 - DNA, 3000 bp, Unknown; identical to SEQ ID NO: 3858
  misc_feature (1)..( 3000): 2750-1469P.txt file - cDNA_ID_2050395; gDNA_ID_1620670; Annot_ID_164068

SEQ ID NO: 22283 - DNA, 3003 bp, Unknown; identical to SEQ ID NO: 19620
  misc_feature (1)..( 3003): 2750-1469P.txt file - cDNA_ID_2050425; gDNA_ID_1620679; Annot_ID_164371

SEQ ID NO: 22284 - DNA, 3003 bp, Unknown; identical to SEQ ID NO: 19631
  misc_feature (1)..( 3003): 2750-1469P.txt file - cDNA_ID_2050441; gDNA_ID_1620679; Annot_ID_164364

SEQ ID NO: 22285 - DNA, 3000 bp, Unknown; identical to SEQ ID NO: 1165
  misc_feature (1)..( 3000): 2750-1469P.txt file - cDNA_ID_2050499; gDNA_ID_1620366; Annot_ID_154838

SEQ ID NO: 22286 - DNA, 3003 bp, Unknown
  misc_feature (1)..( 3003): 2750-1469P.txt file - cDNA_ID_2050499; gDNA_ID_1620680; Annot_ID_164416
atgttctgaacattatatttattaccactcgtaagtcactttccatttgcaggatttacttatacctaatggtgtcagattgagtttgtgtctcttttacaacagtatcgcaccttctacatccaatagacaactaatgaaagctagaatcaatcaaaacagatttacactagaaagaaaaggatgataccacattgaaaaattgatgaatgtatgaacaggatggtaacaatttaacttagaatcgaaattttggtatgaaatcctctgaagtctgaagagttttaggtttagttgaaaattagagtactgtagtagtttgagatcctctagacgaagcagaaggttccatcaaattctatttgtttcgcgggccaacccgcaagcccgatattttatggacatatgtagagttcaagcccgccctgtgatgatgcttattggggcaagctggtgggtttgtgggccgcttgacaaaagaacattaaaaaaagacaaatttgatggacaatcatgattgttgtggttagtatacatacttttgaggatcggatcatgcaatgagtgaattcttcactttaattaaactcatcagattctctcacagtaacaactaacaaacaaaggaaacaaactcatgaaaagccatccaaggaaaaaaggaaatctttatgtgaccgttaagtgtttcttgtcaaatattatgtgaccgttaagtttatcttgtcaaatattatgtgattgtgaccgttgttaattgtgattagcaatttccttgtttcttttgaacctctttgctccccttataaataaatagatgagagacgctctcacgcagtctcaacaacgcttcttctaattcttccttgagagacaaatcaaaactctctctatttctttctttctcatcttcttccttcagagacaaatcaaaactctctctttatacataaactctgtggattccgatcgatgatgatgatccaagtagaagccgacgacgatgatccaagcaaaagccgatgcaacatccgtaagatttcagactgatcggagccgaaattaaagcatatcatcgtttcatagattgaatgataatctccttcaatccacggccgtcgtctaccgtccaaaacaaaatagatttcagttcaccggataatgatctagccaccgagatgctttcaccggagacaacgaggaactaagaggatggcgaaagaaaacacgaagacgctctcgtttgtggtttcaagtttcagaacaagcacgagtcgccgcctgagtatatcacgacttttaggtatattactttactaccctttttcttttttaataaagattatgattttgattttaaaaagaaaaaaaagattttatgtttttccgttctgatttttctgatttaaaactaatcacaaggttttcacaaatatttttttaaataaattgttttaatttttgtttttaatagattttttagtgttaaattttaaatatgtgtaaactattagatacattatcccgtccataatatgaggtctttaagaggtgttttaggtttaatatgttttgcacatataaatttttaacacttattctttttatttaaaattgtttttaaatttgtattttatgcactatttaatttttgttttgatttttaagtaatattttagataaaatgttttattttttaaaatatacataatatttttgtttttaagtgttaaattttaaatatgtgtaaactaattggacacaacatcccgtccatagtatgaggtcttttagaggtgttctaggttcaatatgttttacacatataaatttttaacacttatgtttttatttaaaaattaaattactactattttaaggttttcgattttttaactaatattttagataaaaatattttttatttttaaatatataatatttttgcttttaaatgttaaaatttaaatatgtgtaaactagttggacataacatcttgtccatagtaagaggtacttaagaggtgttctaggttcaataaattttatacatatataaattttaacacttatgattttatttaaaaatatatatattttttttaataccactattttaaggtttttgatttttaaagtaatattttaaatatatattatatttatgtttttaagtattaaaatttaaatactgtatgtgtaaactaattggacataacatcccgtcgatagtatgaggtccttaagaggtgttttaggttcaacatgttttacacataaataaatattgtaacacttatatttttattgatttgttttttaaaaatttgtatatttttaatacacattgtgttctaggttcatagtaaaaggtgattaaaaggtgttctaggttcaacatgttttacacatataaattttaaacacttataattttatttaaacatattttaaaatttatattttataccactattttaaggtttttgattttttaagtaaaattttatatttttaaatatataatattttaaaacaaaaatattaaaatttaaatatatgtaaactagttgaacataatattcggttcatagtatgaggtctttaaacacttaagaaaattaacttactatgttttttttatgtatttttgggttacttttatttaataaattatggggtcttccctctctcgaccaaaaaaaaaaaacattgtaaggtgagttttgagagtaacaataatattggggtatatttttaaaaatattgtagtggtaaataccgaatttccatatagtttctgtgtggcttatatttgtccttttatagggtgcaattttagagtaaagatagtatctaggtttaatgttaaagattctaataatgatggggcgttttcgtgttttctatttatttaagctccatttattattaccggctgttttctattttgtcgttcccggtaaattttgccggcgaagattgaaacttttccaaacgatg

SEQ ID NO: 22287 - DNA, 3000 bp, Unknown; identical to SEQ ID NO: 4035
  misc_feature (1)..( 3000): 2750-1469P.txt file - cDNA_ID_2050510; gDNA_ID_1620680; Annot_ID_164403

SEQ ID NO: 22288 - DNA, 3000 bp, Unknown; identical to SEQ ID NO: 3725
  misc_feature (1)..( 3000): 2750-1469P.txt file - cDNA_ID_2050676; gDNA_ID_2926149; Annot_ID_197923

SEQ ID NO: 22289 - DNA, 3000 bp, Unknown; identical to SEQ ID NO: 3725
  misc_feature (1)..( 3000): 2750-1469P.txt file - cDNA_ID_2050676; gDNA_ID_2926149; Annot_ID_139219

SEQ ID NO: 22290 - DNA, 3000 bp, Unknown; identical to SEQ ID NO: 3725
  misc_feature (1)..( 3000): 2750-1469P.txt file - cDNA_ID_2050676; gDNA_ID_1620659; Annot_ID_47931

SEQ ID NO: 22291 - DNA, 3000 bp, Unknown; identical to SEQ ID NO: 3725
  misc_feature (1)..( 3000): 2750-1469P.txt file - cDNA_ID_2050676; gDNA_ID_1620685; Annot_ID_164564

SEQ ID NO: 22292 - DNA, 3000 bp, Unknown; identical to SEQ ID NO: 3725
  misc_feature (1)..( 3000): 2750-1469P.txt file - cDNA_ID_2050676; gDNA_ID_1620659; Annot_ID_163760

SEQ ID NO: 22293 - DNA, 3003 bp, Unknown
  misc_feature (1)..( 3003): 2750-1469P.txt file - cDNA_ID_2050748; gDNA_ID_1620689; Annot_ID_164715
tatatgaaaatgataatcctaagcggcgtggtctaacccacacatttctcttgcgatccagtgaaaaaaaaataaaagtttcgattatcacgtaaaatttacattgtgaaatatatcgagtttctatgaacttatcgttgtctcaagaactgatgattaatgattgtgtaatgattattatttcgtggaccaacaaatttttcattatcttaataattagtgcctattattatactgatttatttccggaaacgaaattttatttgtttcgaaatgagacatatgaaaataatgttatgggattcctgaattacgtggctcgaagtaaattttgctcatctagggtttgatgcttaattatactgtagtgatttagaataatctatttcacatttttcactcagctctattgtctgagaaattttataccacatttattacaactatatatatttatcaacttaaatctaaaatctatacatcaatgttgtccggaatataacatatacataatacatgatgaattatagtattatactatagttgtttgttatgcatgtattattcaaagattcgaaattagtgatactatatatatgtacatcagtacatggtcgagagtttgttagatgatattcactgcaaatctacactaaatattcatgtgaaaataattttacaaaacgcaggtagagtgttacatgttaaacgagtacgcttaaactagtgcgtacattgcagagtaaagaagttggacaaaaactgcatagcataaaggaagcaaataaaaaatgaagggaaagacaagacataacaaacgggtacatggttcacataccctgcgatcagattgtttcgttctttggtaatgtagcatgggcttccaatatcttctctatgcaaattatattattatatcagtacgtttttaaacatttctgtaatcaaaactcaaaaataataattcaatatatatgaaaactagttgtacgaaatacaaagtgttacccgatcgtgtcaaaatcaaaaacatttcaatcatgattaggaaacttaactcaaccatacgttacataggaaagtagatgctgcatagttgaccattggtcaaagtgtttaacacttttaaagatttttaacttaatagagaaagtaaatttttattctctaattaattagaaatgccaaatatgcttgtctttaaaaattgtcagtaaattaaagtcactctgttattatacattttatagtcacataaaatctgcaagcaaataacagaaaattatcaagtactcctaatcataattaagaagtagtaatacaatgattccaaaaaaaattactgtacttttttttaatgtgtgtgtgtggcgcaacgtcctagattgttgtctgccacgttagccagcaccagctgtaataactaaaaagtggcaaggttatgactggtaaaggttaaaacagtaaagaactacgagccgtaacggtctcttgtctttcttctttttcacaacgcaacttgcttaggtgaaagtacgatactatccctgtggtgaaaaagagaacttcgcacggaggttatgagattaatcacctgctgttaattataaattattggttctggtcaaaagtaagactggaccgtgtctccggtgtcacgtgacctgaatctccaattacgaggaaattttaaaaaatgattatagaagtaattagtattagtaatacatatgtttttctctttgtcagctgccccatggaaaggcacgtcccagccgttggattggacccaattctgtaattacacgtgtcgatatctcaatcgtttgacttatgcggcattttggttttgccaagctcgttttttccggctataattagtttttgctaaaaatcagtcaaaaattaagatttcattctaattttaaaaagacaaatttccttggtcggcactaatatctaattatcgaccattaatgtcatgattcttatttgcgttacaataattactgtcgacacttgttgtagttcttagtttttgttttttatctagttttgtctctaaatttcaatttcaattaagtgtacatttggactgtaacaagcatagttttgacaattgtctttcattcatttcatcatttgacatcaccaatgaaaagttaaaaatctcttaacactaattatgaaatgtctttcatattcttgtacatatatataaaacactaaactcaaagtgtttagcaaataaaaaagaatttagatacaaatgaatcttgtccacctcccttaaacagaaagaaatatctttgtcaaaagttttttttataagatattcgaaaattaaattaaataccaaaaaagaaagaaaggagtaaacactaataatatgagacgtttcaaagatcctataaaatagtcactctctaccattacatgtgctctgccgcttttaaatctctcatcttcttcctcgtgtcactctttctctcacactctgcaaaaacattttcttgtctctcctctgcccaaattttttttctttccaggaatatttcctagaaaaacccaagcaaagctttaaccccttcctcctccaaaagtagcatcttcctctttttctatttctcctttcctcttcttatctctctctcgtttgtgaacgattccttaagaatataaccaaaagcccttttctcctttcttcaactttccgggaaaaatcttcacgcagcaaggtttctctctcggctctcgcagtgtttttcgtgccttttgttctttctataaaaaaaaaattcgcgtcctttaagaaaactttttccacctagagaagaagaagagtatcactcttgttgttcaagtttctctctttaataaaaaatccatctttattctttgtcttctttcctttttgctttccctaatctctatgttataaacacacagagagaaacaaagtcacagtctcgagtcaaaaacagagaatacgaaagaaaaatg

SEQ ID NO: 22294 - DNA, 3000 bp, Unknown; identical to SEQ ID NO: 4233
  misc_feature (1)..( 3000): 2750-1469P.txt file - cDNA_ID_2050799; gDNA_ID_1620691; Annot_ID_164792

SEQ ID NO: 22295 - DNA, 3000 bp, Unknown; identical to SEQ ID NO: 4233
  misc_feature (1)..( 3000): 2750-1469P.txt file - cDNA_ID_2050799; gDNA_ID_2926159; Annot_ID_198638

SEQ ID NO: 22296 - DNA, 3003 bp, Unknown
  misc_feature (1)..( 3003): 2750-1469P.txt file - cDNA_ID_2050886; gDNA_ID_1620691; Annot_ID_48582
gtcaatttaatagtgtttatttatttattcgacatgtagaaaattaaacgatctacgtaaaatatgaatacaaaaatattaaatattagaataaagtgagagtatgtgtaaatcacgttttggtgaattttttccatgtggtagaataatagaggaggacttttgttgtaaagtaagcttcaccaacctcgatttttagacctgtataattggaaacccacctacctccgcaaatacaacgaaaagtattgtcttataatactttcttaattaaataacaattcttttggagtcatatcatatatatactcctattgtggtgtcgacatggtgacatactacataatgaaaccggtgagattattcttctgctaaacttgtatgatgaccggtgagattattcctaaaatatattaaaacctagaatgaattctttcttttatacgtcatggtttgcttacaaaaagaaatgaaataccaaattttcacgtttttcaaataattgtgttgtctttttctgttttgaaaaatagttttaccggtatgttatcacatttaaaaattttaataaatacttctcatatactgaaagaagtaatatatttttatatcatattttattattttcgatcgatttccaatagaaacaatttcgataaaattacatttttttgtaaataatatataaattttttgtagattacattaatagaactgctgaaaatggtctttaaatcctcttcctcttcaacatttttccaaatttgacattttgactccgaatctcacttataagttgtaataataatgttcattagtgcattagtttcctccttcgttgcccaacaaaagaataagctatcattgacagttttatgatattcggagttccaaaatcatttttcgaaactcggccttttaaggcatttggatcaaaacttcggtgcatatactaaaaacatatggatatatcgggttgagtcgcctcgtagaattcctcgagaagatatatattttgacttggtgctggccatttgtaagaatagcataagccaccagtcaccaagattattcatcgtaaattgtaacaaactcaccattatttggagagcccaaagatactactcaatcttcttaccataaacttttgtcactgtcttataagctataagattactggtctacttaactcagaaatatttatgtcctttgtagccaaaagctacactgaaattgacacaactcgagtgttgtccttttctggtcgattgaatagaatcgaatgtcttaatccagtaccctccagcttttatttcgtgtaatttattttccaaacctaccactaccagtttcataactctcgaataaatttatcaaatagtcttttgagtgctcaaagtcttgggataataaatggtcagtgctatgtatcacccggatgtgaaacattatgggtggagatagactattataaatttattgaaatatacgattgttactcgtttaatagcaaaagtagtacaatgtatatagtttctatcgagaacaagatctatttaaaattcgaaaagtacatttaaaattcataaacatataaagatagtaacatgttagatctgcatagtaccaccaaaacaagaaaaaagaaacgcacatcgccacataattgctatgattctcactgtcggctgctttgaaatattacgattcttttggtaaatcacacaacataatataattacaataaatatatatatactaaagtataattaatataattaataccacattgtttaattctgttttgatcttttaagatcagtcagatccaccgacgttcctacacgcgcaggtccagatccaaacagcacacacacacacacaatgccactagtgtaaatgcttggtggctattgcatttgcacctattgatactctttcttcaaaaacaagttattgtttttattttcaacccaactttaatacggattcatactgggatttaggtgttaaatctgataatttaggtttgaataagttgtatatttgtttctttgattaaaaaaagaacctatatatatacaaaaataaataaaaagttctagatttcaattttccgtatatagcgggttgaattgtctattttaatatgaaaattgacggatcttataaacaaaatgttctgaaatatgtaaaaggatttagccaaagttaaccaaaaaaaaaaaacaaacagaaaagtcacattcacatgtcgtggtagatctaaggcattaatttagaaatatgtcgttacaataagcggagaacatgggacgtttctcgtggtccaatcagacgaacgagatctcataaattaaatgacttcagacgagggaattcatggcagaatgataatgcaacttaagtgactttagagtgaaaatgatacgagaacaatgcataatccatatgaccgttgagtgagtgataccattagcgcgatacaagcgggactataaactgatctagattgtttttcttgggaaaaaatgttacaaattttaaatatgtagtttgaattgttaaaccaagattcaacagaaatataccgtaaataaacaacagttgataatagtcatcgaaaagatatcaactgattcttcacttgggctactgtgacggcccgttagggttctcaatataagtcaataactacgatctacgattcactgaaacaaataaaacacagccacgtgtccaccctcccacatcaccgtccgatctaacccacgacaagcttacaacacgggtcataccgctcgtgcagcgtgttccgtcatccacgggattacaacttctaccagatccaccaaaccctcaaaacaatctgaaccgttcatttcattttgacctcatctatatattctctgtcactccctttctcttctcctcgcacacacttctctctctctctctctctgcctcctttcggattcaaatctcagatctagctcaaccatg

SEQ ID NO: 22297 - DNA, 3003 bp, Unknown; identical to SEQ ID NO: 22296
  misc_feature (1)..( 3003): 2750-1469P.txt file - cDNA_ID_2050886; gDNA_ID_1620691; Annot_ID_164750

SEQ ID NO: 22298 - DNA, 3003 bp, Unknown; identical to SEQ ID NO: 22296
  misc_feature (1)..( 3003): 2750-1469P.txt file - cDNA_ID_2050886; gDNA_ID_2926158; Annot_ID_139618

SEQ ID NO: 22299 - DNA, 3003 bp, Unknown; identical to SEQ ID NO: 22296
  misc_feature (1)..( 3003): 2750-1469P.txt file - cDNA_ID_2050886; gDNA_ID_2926158; Annot_ID_198576

SEQ ID NO: 22300 - DNA, 3000 bp, Unknown; identical to SEQ ID NO: 19879
  misc_feature (1)..( 3000): 2750-1469P.txt file - cDNA_ID_2050905; gDNA_ID_1620693; Annot_ID_164857

SEQ ID NO: 22301 - DNA, 3000 bp, Unknown; identical to SEQ ID NO: 19879
  misc_feature (1)..( 3000): 2750-1469P.txt file - cDNA_ID_2050905; gDNA_ID_2926187; Annot_ID_200750

SEQ ID NO: 22302 - DNA, 3000 bp, Unknown; identical to SEQ ID NO: 4256
  misc_feature (1)..( 3000): 2750-1469P.txt file - cDNA_ID_2050918; gDNA_ID_1620693; Annot_ID_164850

SEQ ID NO: 22303 - DNA, 3000 bp, Unknown; identical to SEQ ID NO: 4256
  misc_feature (1)..( 3000): 2750-1469P.txt file - cDNA_ID_2050918; gDNA_ID_2926187; Annot_ID_200743

SEQ ID NO: 22304 - DNA, 3003 bp, Unknown
  misc_feature (1)..( 3003): 2750-1469P.txt file - cDNA_ID_2050942; gDNA_ID_1620695; Annot_ID_48674
agaccggctttagctttgtaatattgatttctcgttagccattcgattagtagttttggccagttatggactcatggttctcacgggaaaatttgtcaactagctaggtttacattatttaagtctcaggttcgttagaaatttccattgggaattgctctgttctggtcctttgaggttggacctggagtcatgtagtttgctactgtcataacacttagaaaacatatgcaagctggtgcatgagagaatcttggataagttttgcttgtaaactagtttatcgttttgttacgttcctcaagtggaatgtaccaagacatgatgattatattggatagttttagaacatatgtataccattttgttcggagaacaagctgcattctggcttatctttatgttttctttggacctctttaccctttgctgtcctctaatcgtgatgatatttcttgatttctataggacaaacatgaagagaacaaagaatgcaaggaagatgaaagccgtggctaaagctatagcgttgagcgagaagtatgaagcgaaagctacaaaggacaaaaccaaaaccctcagaactctttcggccaagaaattgtacgagtgattttggttaaaaggctacaaaagaaggaaaacagttataaatttttgatagttcgatttgtctattttggtcttgttaacgtttatgttttcttctagaaagagcttttgcaattttgtaatctccttaagttatcgacctatagaagttacgagtgcttatggattttgaccagatggtaaaatatattctttagcaagactggttttcttaacaaatttccaatcttcataaagtcatatctcaagtaacaaagaaacaggcgtacatgcgagactactacttttaacattaaacaatcattcaaagatcaaagtgtgataacaatgtcaaagacatatacatatgggcgtgtattctatactacttttatatccaacaatgagctctttacacaagatttgttgtctctaccaaatcaccttggctcggtctactgaaatatatgcgctatttcgcattgtcagtctgcatctgttacttctgcttctatgtctacgactgctgttgaggaaccctttcctgcacattcaaacacttaatctcaccatttgatatacaagagatatggttacttgatttgcgcagaagtaaaacaaaaatttgggtaagtaacctttcttaggtttagaagaaaacccatttaagtcttgtccaaaagcagtagtttggttggagaatttcactggttccttaacaaacttatcatccacgactgcattttccacgataagaaaacacaatgctaaatgctttgaaaagagatatacttagataaattggaaaaaatggaagaatcatcttattacctgagaatggttgagtacagaaagggcaaagctgaacttcatcatccatcgctgacctgcagacattttgatattcaatcaagctcgatttggcgaaacaacaaaaacaactgagagggatttgattcttgttatatccttacttgaatatctgaaactcatttccacaattaggacactgcacaagcgtaaacagagagatgaaaaaccgcaaaaactagctaagtggaacatactcttgacggatttactcaaaacacaagtgctagctagctaacttatagtcacgaaactgaaattcttgaaatgcttttttaagctaaagagacaagtagacttacattgctctggacaatatctcgttgtgcccaccaaaaaaaggctcccaaacccaaaattggaacaatcaccacaatcagctgcaaaattgtaagaacttcagttcaccagcacaattagataaccagagacattaaatgattaagactttagagagatagagagagtaatacccagacagagacaatagcatccaaaatccaaccaagctgaccagtcatagagagataagtcaagccaatggccaaagcaaggtttccgagaatcctcccatttccgttgttatctccaccattaaacttcaaacccctaaccctaaccacccgtcttttacggttaagagatttctcactagctagcatcccaatatctcccagacccatcactcgctgtctctgtctatgctcaatcaagcaagctctcaaccccaacttggtttggagcatagaaggagccaagctccgtcttttagcgtgtaatctgttactgggttccttgttgaaaccgtcgtgtatggagaagttacaaaggataatctgcggaatcgaagccatcgtctgaattttgatttcccaaacacaaagctcgagttgagaaggatccacttcaacgacaaatgatatttcacgacaatgctgtgttttaaggttatattgaacattaacagaaactagagcatcgcggggatagctcagttgggagagcgtcagactgaagatctgaaggtcgcgtgttcgatccacgctcaccgcatttttgttatttgtccctactttaattgaaacgcgtcgtttaggaacaacaagtcttattttattttatttttaattcacttacttgaaacgcatcgtttttgacgcgtaatgaattaaactgtttacctttgacttgagagatgtagtagaaaaactttaagatcttcgagaacagacttaaattcatgttgcattagagtttgatgaaaaccgattgattttattttattttatatacatgtattaagatcgagtgtaatagtatatttgtcccatgttcattttttggatgtatatacgacttttagaaatttatgcgttctcaacaaaaagaaaccatcaaaggtagccctcttccgaagaaaaatatttgacttttatcaaccttataaactaacaatcgaaaactcatcccaacacaatcttctaccttcttctctaatccatatagattccacacttcagccaaaaaaaaaaaacgaggatg

SEQ ID NO: 22305 - DNA, 3003 bp, Unknown; identical to SEQ ID NO: 22304
  misc_feature (1)..( 3003): 2750-1469P.txt file - cDNA_ID_2050942; gDNA_ID_1620695; Annot_ID_164932

SEQ ID NO: 22306 - DNA, 3003 bp, Unknown; identical to SEQ ID NO: 22304
  misc_feature (1)..( 3003): 2750-1469P.txt file - cDNA_ID_2050942; gDNA_ID_1620666; Annot_ID_163940

SEQ ID NO: 22307 - DNA, 3003 bp, Unknown; identical to SEQ ID NO: 22304
  misc_feature (1)..( 3003): 2750-1469P.txt file - cDNA_ID_2050942; gDNA_ID_2926191; Annot_ID_141024

SEQ ID NO: 22308 - DNA, 3003 bp, Unknown; identical to SEQ ID NO: 22304
  misc_feature (1)..( 3003): 2750-1469P.txt file - cDNA_ID_2050942; gDNA_ID_2926191; Annot_ID_201024

SEQ ID NO: 22309 - DNA, 3003 bp, Unknown; identical to SEQ ID NO: 19950
  misc_feature (1)..( 3003): 2750-1469P.txt file - cDNA_ID_2051015; gDNA_ID_1620698; Annot_ID_164980

SEQ ID NO: 22310 - DNA, 3003 bp, Unknown; identical to SEQ ID NO: 19950
  misc_feature (1)..( 3003): 2750-1469P.txt file - cDNA_ID_2051015; gDNA_ID_1620682; Annot_ID_164478

SEQ ID NO: 22311 - DNA, 3003 bp, Unknown; identical to SEQ ID NO: 19950
  misc_feature (1)..( 3003): 2750-1469P.txt file - cDNA_ID_2051015; gDNA_ID_2926181; Annot_ID_200255

SEQ ID NO: 22312 - DNA, 3000 bp, Unknown; identical to SEQ ID NO: 4312
  misc_feature (1)..( 3000): 2750-1469P.txt file - cDNA_ID_2051061; gDNA_ID_1620698; Annot_ID_164963

SEQ ID NO: 22313 - DNA, 3000 bp, Unknown
  misc_feature (1)..( 3000): 2750-1469P.txt file - cDNA_ID_2051116; gDNA_ID_1620699; Annot_ID_48736
aattaaaggatatataaggcacttggaacatatataggagaatttcctttattcatatataaggcacttggaacatatataggagaatttctttagattactaaactaactcgactatattataaagcatcaagtcacttgattcccgctttcactttgagggagaattggggacgatgtgcgcacagttgtccttaagcagaggtggaaagaacgggttaagcgggaacatatgaggccaacagttagcatctatggtcgacaatgctttgcaacatgcaactccaacatttccaaactgaccagaaaaaactgactttaaaagttcgaatacgcatccctgagtattgaaaagtgatgcccaacatttttccacatcaataggaaaatccggtggaaattgtgagcggggcggtggttgttcatcatgagctattccgggggtgattaaaattgcagcacataaggctacaaccaagaataaagagaaaatagctcttgaattgtttcccatctatctttgacttctatttgctttgatatttggatggtttgggtagggaaaacagtttagaatttataggataaaataaaatataaacaaaactgtattaaattatgtaattaattagagtacttaagtgtttataagttataacatattttttgtctttatcaaaaatagttataacatataagcaacggaaaatttttaaagctttcttaaataacttatgtccttttaattatctggtttgactaacggaagatgtgatggtgttgaaattaaagacatataagaaaataatatttgatggaaaacaatttcaggaataggtccgaagatgtgaagacttaaatgtgtttgtaaagggcaaaccactctacatgaacagtttggttgacaacaacaaatttatgagaaaaaatatcatattcaatgaaagcaagagacataattaataatcgagtatgatcatggtccctgcacaaaatggctcagacaaaatattgtactggtgtttttggaaatatttcccaccgagaatagatgtcacaccagaactttcaacttttgtgtgcgtaactctttgcaaagtttttcgaaaaatccaaccttgtttttaacatgtttaaaataggacctcagatcaaggtcaagtgatcagatgtgtaggttatgtgtgtttatgccgtccatgctctgattcaacattttttgtgtttacatatatcaaagaggccatcccaataagcaacctcttttacttttcatgtttagaggaatttattgactacgtattatttcattgatttggtcatttggaaaatccttgaaagttttcgatttttattaaaaaaatgaatattacaaagctaaaaaaatggaattaaaatgatatatgtaaattttaactattatttagaaatgcgttcgaaataacaattttcaccctcatatttgaacttttgtttttccaacttgacacatatctgttaaaactcacaaactgataaacctccttgaatttttttaattttttttctaactattgcctatgttttctgttttactattgacgtcaactataatcttgtatcttgtatcttactgccttttttttgttattaccatataaaatgtgagaaaagagacactgtaaaaagtaatagtacacgagattagcgacactcacggagtgtaatctttattttaaaaaatctttgacgtccacagaacacacgagattaacgcaatttcattacttccatttttaaagctttctattaatatattgaaagaaatcctctcttacaaagcgtcgtgaatgaaatcgcaagttttttaattacattaatgcatgatatatcatatagtataatctaatcatcctttcgtaatcagtgtgacttcacttaactagcgtacatgcctatctatagtgacagtaaacacggttaaaaaatttgttgtcttattaacaaccccacactagctagttgtggatctgtaattttctggcttggcaaaattacattaaacattattttggcactaccattaatatatcgaaggaaaccaagacacgcacaggctccataatcaaaaattataaaactatatacaaattaatgatgatactacaccaaagtatatattcgaagcaaggctagctaattgaactgaaaacatagtcagtgtagtttatcaactttcaataaaaacatcatccatgatgtacatgtgtacgtgtatactagaagtcattctgcatgatgattttttttaatatacaaatgacacatgtccgagacatttgacagctacgttgatatgtattcgtttggttgacagagcttgagaatgcatttttttataagggaagatttaagtctatattcggtagaatttaactcatagacattactcctaagtttttgtttttatttttgaaaaagcattactcctaagtttcatgtaatatacaagacggaatgatggatcaaagttggttggccaaaaacaccgaagcaagcttgtcgatgccttttgtctcgactagtattattgttactagcttgagactaaatctgattggagtccacacaaaataaatcaatattatttattaatggatctgttttggaaatccaaagacaaataattcatatgtatatatatatatctatagtagtattcggcggtcgacagtcgtaaaccttcacaaaaaaataaaaataaaagacagtaaactaacaaaataccaggtggtctgaactctatcttatgaaaaaaaatattgaatcgaattcttaaatgtcatatatattgatgtcggaacaatatttttttattgaaacactaaattcattgaacatgttgggttcagtccggttcagaaatttactactgtgtctttataaaaccaaattactattgtgcccccattttccgatcgctataaaaaaaacctaattcctcaactctaattcaccatg

SEQ ID NO: 22314 - DNA, 3000 bp, Unknown; identical to SEQ ID NO: 22313
  misc_feature (1)..( 3000): 2750-1469P.txt file - cDNA_ID_2051116; gDNA_ID_2926208; Annot_ID_141865

SEQ ID NO: 22315 - DNA, 3003 bp, Unknown; identical to SEQ ID NO: 19894
  misc_feature (1)..( 3003): 2750-1469P.txt file - cDNA_ID_2051170; gDNA_ID_1620694; Annot_ID_164875

SEQ ID NO: 22316 - DNA, 3003 bp, Unknown; identical to SEQ ID NO: 19894
  misc_feature (1)..( 3003): 2750-1469P.txt file - cDNA_ID_2051170; gDNA_ID_2926208; Annot_ID_202406

SEQ ID NO: 22317 - DNA, 3000 bp, Unknown
  misc_feature (1)..( 3000): 2750-1469P.txt file - cDNA_ID_2051182; gDNA_ID_1620700; Annot_ID_48762
gttaggcgatatgtagtctaagcaaggtttataaccttttgtatatttcaaaggacgtggcatattaggtacatgccaagtggaattgaccttggctctcttctacattgataaagttcttcgcataattcacatccctatataaacaaatgaacggagaaggtatgagtacatccacacattgacatttctaaaatccaactcctctttttgaaaattaagaaactccacttggctcttcgattttttctatctaaataacagaaccaaatcattatcgaaatttaaagttgtgcgaaacaaaacaaagatgggaagatcaccttgttgtgataaaaatggagtgaagaagggaccatggactgctgaggaggatcagaaactcatcgattatattcgatttcatggtcctggcaattggcgtacgctccccaaaaatgctggtacgtataaactacacaccgttccttatattttgttctcatagattaatatatatgttctctatttattgagtcacacacttataagtcgtattgtacaaattaaaggactccatagatgtggaaaaagctgccgtcttcgatggaccaattatctaagaccggacatcaagagaggaagattctcgttcgaggaagaagaaactatcattcagctacacagtgttatgggaaacaagtaagcctgatcattcacaccataatttttgtctgaaattcatattcatcagctacatgcttttgtatgttaattaatgtaaaactcaaaaagggagagtgtacgtttgcatgcgggggtacatgtcaaatgtaggccatcaactccaataaactattattagtactttactagtacgtattgacctatattagaataataataaaggagttttgtattgatcatagattaatgtcactaatattgaattgatgaatattaggtggtcagcaatagccgctcgtctaccagggaggaccgataacgaaataaaaaaccattggaacactcacatccgcaagagacttgtaaggagtggtatcgaccctgttactcattctccacgccttgatcttcttgatttgtcctcacttttgagtgcacttttcaaccagccaaacttttcagcagttgcaacacatgcgtcttctcttcttaatcctgatgtattgaggttggcctctctactactgccacttcaaaaccctaatccagtttacccatcgaacctcgaccaaaatcttcaaactccaaatacatcatcagaatcgtctcaaccacaagctgagactagtacagtcccaacaaactatgaaacttcatcattggagcctatgaacgcaagactcgacgacgttggtcttgcagatgtattaccacctttgtcagagagttttgacttagactcgctcatgtcaacgccaatgtcttctccacgacaaaatagcattgaagcagaaaccaactccagcactttcttcgactttggaattccggaagatttcatcttagatgactttatgttttaattttcaacatttgcatacacatgtcttgctttcacacatatgattctttgttgcattctttcttttgtttgatgtataaatttcttgtttttattctctcaaaagatattaagttattagtctataaaattttcatgaatgtttatgtattatctgcttaggcgagatatctaaattctgctccattagtccatatacacagttgacggaagcaaacatagaattattagcgtcaaacacatcacatattcatattgctttgttcgaatcatcgtcaatcaagttaatcagtttatgcgagttctatcatttaggcccaattcaaggcccaattcaagttcattttaaagccgttaatttggccaatttaaggcctatattccggaagcttgtagaactattttctaaaaaccaaatcgataatatgagttagttaaacttggtctatataaaatgatattttcacttttcaattccaagcaagagataagtgtggaacagttaaatctaagtcttatatagataatttgaatttgagggatgaaggcattttgactaattggtatgggcaggtaagtaagcaacacaaagaacgtgtgaaaatgctttaattggtggaatttggaacttaaagaggaagattaggaaatgcattagtgaaagtggggacgactccttttttctcgccttttggagttttcacctttttccctgacggaccgtttccctaggctggcctccggctcatattcatatacccgtttgaaataagaggtttatttctttttatttttggatttgtcaatgctcataaagcgtatcaatgatttaatatatgattgtagagagtttttgtgttttgtcctttagatatcgatccttttcttcctgtgactatgctccattcgcatctcatcccacctcgttaagggctcgttatgtttctccaccattcatatcttttttttattttctctaactcctatctttaaatttttctctttcacatatttttgctagcgttttgcgaaattaaaagccaccatgttatatacatgaacatgtaaatacattacaaatgtacatggataaatatgaactatacattatgcttagttactaatgtagacatgtagttaagaattcttagttactactagaactagtagtacaaaacaaaaagacaaggcctataatttccggagctaaacacagtttacaaagggattatagactctaaaacaaaccagaaactgccaaaagtcaggaatctcttgtttttcttccctcacatctctcttctctctctcttcacaatagtcctttggacagaacaaaagagagagaagatagtgaataatggaaggctgcttttcttcgtgaatctcagaatcttaaaagactcagatttgagaaaacgtttcaatatctaaatccatttctctccctctctctttagccatttagaatg

SEQ ID NO: 22318 - DNA, 3000 bp, Unknown; identical to SEQ ID NO: 22317
  misc_feature (1)..( 3000): 2750-1469P.txt file - cDNA_ID_2051182; gDNA_ID_1620700; Annot_ID_165054

SEQ ID NO: 22319 - DNA, 3000 bp, Unknown; identical to SEQ ID NO: 22317
  misc_feature (1)..( 3000): 2750-1469P.txt file - cDNA_ID_2051182; gDNA_ID_2926192; Annot_ID_141091

SEQ ID NO: 22320 - DNA, 3000 bp, Unknown; identical to SEQ ID NO: 22317
  misc_feature (1)..( 3000): 2750-1469P.txt file - cDNA_ID_2051182; gDNA_ID_2926192; Annot_ID_201135

SEQ ID NO: 22321 - DNA, 3000 bp, Unknown; identical to SEQ ID NO: 4337
  misc_feature (1)..( 3000): 2750-1469P.txt file - cDNA_ID_2051189; gDNA_ID_1620700; Annot_ID_165050

SEQ ID NO: 22322 - DNA, 3000 bp, Unknown
  misc_feature (1)..( 3000): 2750-1469P.txt file - cDNA_ID_2051197; gDNA_ID_1620700; Annot_ID_165048
gtagaaaagagagatgaagcgagatatacatcaaccagtgtcacaaagcggtaagctgcagtcctattatggagcccgaagaagggtacaccttccagagccaaagtatgaaatttctctgtaatgaaatttgcatctcaagactaagcatcatgtaagaattccagtgcaatgacaaggtctgaaggcactggggtaagacttactgaataatccgagataatcggctgcgcctaggggtctatcacacagctcttcaaaaagaaagtaggcacatccatcagcagctagaggaacctggcgtacaacaaacaataaatttagaaataaggatcaagggatttcaaataagctatttaatggaatggtatctgaaggttttcggcctaatcaatcaataaagcactcttcagcagaaaatcgtgaagaactgcatattgatgcatctgtgaaagaagaagcaaagaaacctgcaatttccttcccattactacttcaaccacttgaggaccagccggttgatcgccaaccaacagctgaaacttctgttttagaaggcctgagatatcctttccaatgaagtaaaatccctcttcagcctgcacccaagaatacatagctataagattgtaatcactttgcaacaaaactaagacagttactgagagacgtgaaatcacgtacagaggtcagtttccgatagtccaccgatgagccaatctcacgaacgacacatctttcctacaacaaatcatttctcagtatcagttacgaagcataatggatcacatgaaacaagttcttcagagcgttgatagtgacatgcatttgcatttgtatacctttagtgtggaaataaacggaaggaataggtccctctgtaaaccaccttcatagagattatctggagcacggtttgatgtagcaacaagaatctacacttttctccaattaccgacatgtaaaaacttttaaataactataggtttaggtccagtaggctagaagagttgagaaagagaaaggttttatagattacttacaatgccattgttaaacaagtgtctaaagagacggtttagtatcagtgcatcagctacatcattgacctatacatgaagaacaataaagaaacatgagttttccctgaacacattttaaaacaataaagacgagcgtcacaaagacataccatgaactcatctaagcatagtaatatagcctcgtcagctatttccaggccaacgacttcaagtggatcttcaagacccttgtgcttctacagaggatattcaaatacacaaagaattgagtccaatgattattgcaagcctaagcttaaaaaataaagctttgaactgggagtttacttgcaggcggctatgcacactcaacatgaaattgtgaaagtgaatcctttgtgttctccagctagctggcctaactcatttaaaacaggatcagatgaatccataaaaaaatgtagaaactatatgaacagtgaccacctacttacaattgatgaaaaaacaagtccatgagcattgtctttccagttcctactcctccatataagtataagcctttgacaggagagacagaagagtgagacacaaatttgttccagaaccaattactcctagtggactttgcagatgcagaataacgatccaatcgacaagcatcagcagattgaacaagctcgtcgtagagtctctgaagttctcttagtgtacctagctgcaaccaaaaaaaaagaaaagattcaaaaatcgatttcactgctaatgaatgaaccataaaaggaaagtacctgacataaatctccatccaataactctccagctacgattctgcgttcatactccactaacggccctgcaatctttccatctccattggaatgtggagacgaacagaaggaagaagccgagaatagagatgaagaagatgtgctgggattgatagagatcaaacaattatgaatgggagcgaaagcgtatcgttgatgcctcgagaatagagttacacggcgaagggagagaagaagcaatcgcatggtgagaatgagaatgagagagagagaaaggtaatcggaaacctcttcagtgatcggaggatgacggattcaacgaagaagaagaagaagaagaagaatcgaagcgatgcaccttcctcactactcgcacctgctcaagctcagactctctgaactaaagaaagattcaacaacaaaagactaaaccgataataaccgattgaatcggtttaaactgtaaagtgaacttaggcccattagtattggagcccaacaatgaaagcggcctcattggcttctttttcttctagtcgtcgtcaccggaggagaaaagttggcgatttgcaaacttcattttcaatcgactgcgtctcctctttcttctcctacccaaccaaagtttctcatcattcatttcagatcagccatggaggacgaggtaatcttacatcttttcgtatatatttattataaacacgatttagctctgtttttccgccggagattataatttgccggagacctttattcgagatctgattgatcatttcttatatgcctacattaactttgatacccattagatttctttttgatggaaatcgatttgatgtgaaattagctgctcgttactctggctttttccactcatcctctatagatgatctggtggagtgtttgtatagagaagaaagacatatgagttcattagaattgtagaaaagtgatggaagattttccgtcaaatcgttttctcaaaggcgtggtggtctattgttgctcgactggaattgtataatagagtttctctgtcaaaccattttggcatttttttagtagacttgggaactgaaagagaagaaaagatggatctttgaagtctaaaagaaaatgttgttattgttggtctccatcttcgtgactcactaggaaaatttatggttttatctgagttttaaatg

SEQ ID NO: 22323 - DNA, 3000 bp, Unknown; identical to SEQ ID NO: 22322
  misc_feature (1)..( 3000): 2750-1469P.txt file - cDNA_ID_2051197; gDNA_ID_2926192; Annot_ID_201129

SEQ ID NO: 22324 - DNA, 3003 bp, Unknown; identical to SEQ ID NO: 19969
  misc_feature (1)..( 3003): 2750-1469P.txt file - cDNA_ID_2051210; gDNA_ID_1620700; Annot_ID_165041

SEQ ID NO: 22325 - DNA, 3003 bp, Unknown; identical to SEQ ID NO: 19969
  misc_feature (1)..( 3003): 2750-1469P.txt file - cDNA_ID_2051210; gDNA_ID_2926192; Annot_ID_201122

SEQ ID NO: 22326 - DNA, 3003 bp, Unknown
  misc_feature (1)..( 3003): 2750-1469P.txt file - cDNA_ID_2051288; gDNA_ID_1620706; Annot_ID_165300
atttggttgagaaacacagcgaagagctcgcgtctctagagacatgggacaatggcaagccttaccaacaatccttgaccgcagagattcccatgtttgcaagattgttccgttactatgctggtatcataaaacgaacttaaatcttgagaattctggtgcttttggtgttactttctgtgaatgaacattcttggttttgctttgatgtgtaggatgggcggataagattcatggactaacaattccagctgatggaaactatcaagttcacacattacatgaaccgataggtgtagctggacagatcataccgtggaattttccacttttgatgtttgcttggaaagttggtcctgctcttgcttgtggtaacaccattgtcctcaaaaccgctgagcaaacacctctcacggctttctatgctggaaagcttttccttgaagtaagatacatccgatagattctcctattgtcttctctaggaaaagaaaaactttgatgagtaacaatgtttcttgtgaaatttatgataggcgggtcttcctcctggtgttctgaatattgtttcgggattcggtgcaacagcaggtgctgccctcgcgagtcatatggatgtagacaaggtagatatatttatttacttgctgctaacttctttaagaaactaaattatcttacattcttctttttgcttcagcttgcttttacaggatcgactgatacggggaaagttatacttggattggctgctaacagcaatcttaagcccgtaactctggaacttggagggaaatcaccgttcatcgtattcgaagatgctgatattgataaagctgtagagcttgcacactttgccctcttcttcaaccaggttttgtcaatagtagaatatattcaccttgagctaagctgactcattttcctagctagttcttgagataatgttgagtaatgtttttgtaggggcaatgttgctgcgcggggtctcggacatttgttcatgagaaagtgtatgatgagtttgttgagaaatcaaaggcacgcgcattgaaacgtgttgttggtgatcctttcaggaaaggcattgaacagggtcctcaggtaacacatacacattccttccttccattaagaagagtttagcttttctactttgttgattggttttgtgatttccgttttcacaaaaactttgtatagatcgatttgaagcaatttgagaaagtgatgaagtacataaagtcaggtatcgaaagcaatgctactcttgaatgtggtggtgatcagattggagacaaaggttacttcatccaacctactgtcttctctaatgttaaggtaaaaagaaaactcttctaagacatctttaatgttcttctattaccgattctccatggcattaatctcgaacgcttggttcaactacaggatgacatgcttatcgctcaagacgagattttcggtccagtccaatcgatcttgaagttcaggtatatagagctaccaataaaactgatccagtagacaaataagtcacaatttggtaaaaatggctgagttgttagagatttggtaaactgaaactaatttcgaaccaaccaaacctaaactttttttaaagataaatgtattcaattaaaaaacagaaaccatgatagatttggtttaacactggttatgatgttgggttcagtgatgtggatgaggtgataaagagggcgaacgagacgaagtacgggctagcggcaggggttttcacgaagaatctggacacggcaaacagggtttcaagggctttgaaagctggtaccgtatgggttaactgcttcgacgtatttgatgcagccataccatttggtggttacaagatgagtgggaatgggagagagaaaggcatatacagtctcaataattacttgcagatcaaggcagtcgtcactgctctaaataagcctgcctggatctgatctctggagtgtggtttcagcatcataaatgctcaaacaaaagaaatagactctataaagttacaatagtaataattaaggtcatggtttgtaatttgagtaacggattgtgatacttctaataaatttttcattgttgtttattcatcacatagctgttgttacactgagacttgtgtgttcattttggttttgcaagatttctattgaaactgaaaacaaacatgaaactgaaaaatgcaacgaaaattagaaaatatatatcttaaagtaattaagagttaaaactcaataattaattaaaaacttttcagttgtttaaatatatactctgtttctatataaatgtagtttaagagtttttatttttttcaaaataagtgttgttttcaactttctatacaaataataaatatttaatattttaatcaattatatttaattaataatatttttatataaaagaggtagattaaatgagactttcatgatttttttaatatgtgtataaaaaccttaaactaatatgaaacaaaggaagtagttgttaattattaaattcatatacagtatattcttagaataaaatatcaacataaaattgatcacaagtatgaaaaaaatactttttattaaaaggtttatcagataaatatatttttccttttgtaacagacaaaaaattatactaattttgaatatttattatatttcttaataaatttcgatacaagttttctatttaaataatatttttaacatgactgaaaaatgttgaacgcatcagaagtgaccaaatcgtgaattttaacttgttcgtcagccagaagtttccgtttctctttagtttcttcatcgcgatttttgctacttggctccaaaatccctcctttttcttctttctcacttgcatcattagctcacgatttcgagtatcgattcaaccattttgatcttcaatctatcttagggtttctccttaattcttctctcggattttagctcttctcgactattactcacctctctcatg

SEQ ID NO: 22327 - DNA, 3000 bp, Unknown; identical to SEQ ID NO: 4495
  misc_feature (1)..( 3000): 2750-1469P.txt file - cDNA_ID_2051413; gDNA_ID_1620711; Annot_ID_165420

SEQ ID NO: 22328 - DNA, 3000 bp, Unknown; identical to SEQ ID NO: 4495
  misc_feature (1)..( 3000): 2750-1469P.txt file - cDNA_ID_2051413; gDNA_ID_2926155; Annot_ID_198369

SEQ ID NO: 22329 - DNA, 2231 bp, Unknown; identical to SEQ ID NO: 4503
  misc_feature (1)..( 2231): 2750-1469P.txt file - cDNA_ID_2051442; gDNA_ID_1620711; Annot_ID_165409

SEQ ID NO: 22330 - DNA, 3003 bp, Unknown
  misc_feature (1)..( 3003): 2750-1469P.txt file - cDNA_ID_2051442; gDNA_ID_2926155; Annot_ID_198360
tcgtgttcctaggaatcctccaaatagggtgagaggaaccgagatgcagaaccagagagccaagagctcaaaatacaaagagattgggatggctccagtgctgttgctgctccagagaaggaagttcaacactgtgagtataacaaaagcaatacccgggaagaagcatgcaatggaccaggaaagtgatctccatccttctgaagtccccttgacagttctccagagccgaacaccagcgtacccagcaacaatacccaagaaaagatagagaataatcatcccggttagtagcattcctcttgaggcaggcgacatgaatccaagtgcagcgaaaacaatagtgacaacagccattcctgtaattcgaaccccatctcccaccataatgcatagaagctttgacatttctggttctctgaacacatctccgacaacaagtttccatccagagagctcctcattcatctgtgcctgtgcttccttgtccagttcctcatactttgtcaaatcccttctcactgtcctcaggaatatgacgaaaactataccggccagaaagaagatcaccataagcgagttcaaaatagagaaccaatgaacacgagcaccttccattttcaaataggcatcccatctggatggccatcttgtctcactcttaacaaattccacttcataagtgaaggttattctttcatgttctttaatgatctgagctttgtcaagctccaatggacagttaactgaaggaacagggtcatacatgtgaagcttcgtcattttttcagcatcatacttaacactgcagggaacaacctcaaatccaacaatctcataccccaatgccttcttcttatcagcttcagagatcacacccataccttcttcaccagtaccaatcacctccatgacattgccttcatactcatgaaccaaaaccttaaacttgaggtgattaatgatgtaatcatcattactgttaggtggcgaatacccaacaggatatccagtccactggatagtaaccccattctgcttagcgaatctcaaagcaggcaagttatcaagaatcattattcacttgatacaactcacgagttctctgtttcaagagcttgacctcatgctcattcaaaggactcgtagtgcataagtaaagagactcattggttctcatccgaaacctataagcagagttatcaatctgatcacccatgagaagctcaccaagattctcagcacttttcttgataccttcaagtggttggcagtaaggaagactatagtaactgaaaggaagctcagtttcaatagaagtcaaggaattgactttggcgaagatagagtctccatctgaatatgtgtgcatataactccctggtaagtaaaacccattgcaaagctgactaacaaacaccagtaacacgaatactcgatacacaccaaacattgtcccttcctgtatcaaaatacaaaaactctctcacgattagtaaaaatcactactattgtaacagattcaagcacattctcacgaatacattgaaatcgaaatggtttatgcatgtagatcagattcgtagtaaccagattcgggattaatgaatcagatcggtggatcaatagatcagatctcaaatggatcataaacgcaaaactcagaagctaattgatataatggaatacgaaaacgatgaatacaaaatcagaaaacgcgaaagaagaagcagatgcgaatccaacagatctcagagtattcgagagcaaacctgagagagagagatccaggtatggagatctacgagggagtcagatctagaagaggtggtcgagggactttgggttgtttcgaaggtcacgctgataatctctctcactgctttgctttggttgcttaatgcgttcgcaaagagagcgaataacgaaaatcaagaaaatcgtgggtgtgttgggtagttattctctgtgacgcgcttatacaatatgtcggtgcggtaatcaccgtgcctaacttcatctgaggccaaaaaaaaaaaaaaaaaaaacttcatctaaggccttgaatttctattggttgaactggttataattaattatatttttaagtaaacgacggtttttaaatgagatttttgtaaaatagagagagtataatgtagttaatttttaaaaaaataaaacaaagccaaatgaccaattttttggaaacaaaaaataattttatcacatataatttgaacatttttttttttgctaaagaattcaatatttactacaattttgaattattttgaactcttatgtaagaaagtaaaatttacacaaaatacatattttgagaagctggcatccggcattttgacatgcgtattttctcaaacattaaatacattaatatatatgttaactagcattataatagagtaaaatattcacaaaataatgttttgagaagctgaaatgtaacatgatattctacagtctagcaatttgaggttttctaccgaattttcatagtttgtattgtaaattcaaattaaatttaagttcatgtagttataagcacataaaaaagttcggtgaatggaaacgataaagcaatttagttcatggtgaaataggccacatgattattagcaggattcatagataagaatgttaacaaaattaaatggtaaattgggtttaattaggtttatgacctccggtcgtccttacgctattatctccacagcgtttttgtttcatctaatcaacgaagtgaactttcgaaatcgatatctgaattttgatttaaaaattggaggtaatcattcaccaatcggtttgtcaacgtaaaaatctctctctgattatatgaattgatgtgatgtgagttcttagaattatgattcatcgaattggaaaaaataaagttgttcgttgtcagtaaaattagggtaatttgaatcattaacgagtatatgtatgtattgtaagacatgattgatatacataatg

SEQ ID NO: 22331 - DNA, 3000 bp, Unknown; identical to SEQ ID NO: 4604
  misc_feature (1)..( 3000): 2750-1469P.txt file - cDNA_ID_2051556; gDNA_ID_1620717; Annot_ID_165686

SEQ ID NO: 22332 - DNA, 3000 bp, Unknown; identical to SEQ ID NO: 4604
  misc_feature (1)..( 3000): 2750-1469P.txt file - cDNA_ID_2051556; gDNA_ID_2926189; Annot_ID_200852

SEQ ID NO: 22333 - DNA, 3000 bp, Unknown; identical to SEQ ID NO: 3470
  misc_feature (1)..( 3000): 2750-1469P.txt file - cDNA_ID_2051600; gDNA_ID_1620717; Annot_ID_165666

SEQ ID NO: 22334 - DNA, 3000 bp, Unknown; identical to SEQ ID NO: 3470
  misc_feature (1)..( 3000): 2750-1469P.txt file - cDNA_ID_2051600; gDNA_ID_1620647; Annot_ID_163303

SEQ ID NO: 22335 - DNA, 3000 bp, Unknown; identical to SEQ ID NO: 3470
  misc_feature (1)..( 3000): 2750-1469P.txt file - cDNA_ID_2051600; gDNA_ID_2926188; Annot_ID_200815

SEQ ID NO: 22336 - DNA, 3003 bp, Unknown
  misc_feature (1)..( 3003): 2750-1469P.txt file - cDNA_ID_2051606; gDNA_ID_1620647; Annot_ID_47641
atgtactcacgtgaacctcttaatttattacttttggtttgtgttttcctccacagtttgacaagggcgataaatattttttattcacaaaataactatagataagttttagatctcagccgttgtagttcgaattaagcaaatttaaccagcagtgcactagtagttcaatcggttatctaaactttagtatagatctcagctgtctataatctatccgttaccattatctcttacaatctctaacgatatcattttttactagcaccaatattcagacagttgattgctcttcatcagtctctaaacatggccatataatccttgcgtaagtttatataacactggtctctgccctaaattttcgagggatccattttcctaaaaaagatttaattgtatagatttttgttagtgagcaagacacttgttaataatgctatgtactacatatatatgtatctttcaccaaatcagtttttcaaatttataaacataaaaagtaagaattgaacccccaaaaaaatacaagaagtaaatataactaaacttctattcttcttttttttttcttttttgttgaagaaatggtatttgtatttcttaatttgtttttctttttgcttaataacttcttttttatacattagatttttgatattgtatatatacatcaaacaagttaaataatggttttatccatattttctaaattctcctaattaactctactagagttaatatgtgtgtatatagtcacacatatacacaaacatttgtttctgctcgtggtctatatattgccttttaaaagggtcaaacatagtatagcttggatccttctttacttgtccctgatctctcctaatctctcgtcttccctctcttttgtgcttcatcgatctctatcggtcatgggttccaattttcattacacaatagatctcaatgaagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgaggtataatttcaaatgaatttcatgtcaatatattaactcttgatccttatatatatggtttatattcatatggaaatttcagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaaggtattaatcacacgtctgttaattacacatatatgcgtaagcttttttttggttttaatgttaaaagtagatgcctaagtaatgtcatatatactcatattgattattagaagctcacgaagaatatgtctttttatagtactaattaatagcaaatgaaaagtaaatctacaaatctctaactggtaaaaacaatttcatgtagcattataagttggtttaaacagattaatctttgagatcttctaaaattcatgttacaagataattaactaaattatcatgttttttcttgttttgttattacagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtgattattttaagtattttaattataactcgcatgcttaagaaataaaatataaaccataccataagccctcatagctagtaatatctagattatttgatacatgaaattttgttgcggtgatatattaatttcagtcagtccaactttattataagagagtgttggggtttagtagattttgtatgaaaggcttgtattttattttttatggaacttgatatcccaacaatgtggttgttcttgttcattcgcatgttttttgtgtttctaagttttgagagttgatataagaattactttaatttgtcaagatctcgtcaagtgtttatacttgatgaaaatcttttggggatcaaaacggtttgaagtaaagatcgtactgtcgtactggtgtctgtagattgatattaaactcgaacaacatgattattgtaatataccttaactaccatataatttttttcaattctttctggatacaattgtaagaaaacagaaaaatcggaaaaatgagaaaattcaccaaaactaatggggttgttttgaaattagtttgatacttgaggattgacaaacgaattctacttttccggggaaagaattagagagcgaaacagaacaaaacaaacaaaaagtcatg

SEQ ID NO: 22337 - DNA, 62 bp, Unknown; identical to SEQ ID NO: 4611
  misc_feature (1)..( 62): 2750-1469P.txt file - cDNA_ID_2051606; gDNA_ID_1620717; Annot_ID_165663

SEQ ID NO: 22338 - DNA, 3003 bp, Unknown
  misc_feature (1)..( 3003): 2750-1469P.txt file - cDNA_ID_2051606; gDNA_ID_1620647; Annot_ID_163300
ttgatattgtatatatacatcaaacaagttaaataatggttttatccatattttctaaattctcctaattaactctactagagttaatatgtgtgtatatagtcacacatatacacaaacatttgtttctgctcgtggtctatatattgccttttaaaagggtcaaacatagtatagcttggatccttctttacttgtccctgatctctcctaatctctcgtcttccctctcttttgtgcttcatcgatctctatcggtcatgggttccaattttcattacacaatagatctcaatgaagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgaggtataatttcaaatgaatttcatgtcaatatattaactcttgatccttatatatatggtttatattcatatggaaatttcagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaaggtattaatcacacgtctgttaattacacatatatgcgtaagcttttttttggttttaatgttaaaagtagatgcctaagtaatgtcatatatactcatattgattattagaagctcacgaagaatatgtctttttatagtactaattaatagcaaatgaaaagtaaatctacaaatctctaactggtaaaaacaatttcatgtagcattataagttggtttaaacagattaatctttgagatcttctaaaattcatgttacaagataattaactaaattatcatgttttttcttgttttgttattacagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtgattattttaagtattttaattataactcgcatgcttaagaaataaaatataaaccataccataagccctcatagctagtaatatctagattatttgatacatgaaattttgttgcggtgatatattaatttcagtcagtccaactttattataagagagtgttggggtttagtagattttgtatgaaaggcttgtattttattttttatggaacttgatatcccaacaatgtggttgttcttgttcattcgcatgttttttgtgtttctaagttttgagagttgatataagaattactttaatttgtcaagatctcgtcaagtgtttatacttgatgaaaatcttttggggatcaaaacggtttgaagtaaagatcgtactgtcgtactggtgtctgtagattgatattaaactcgaacaacatgattattgtaatataccttaactaccatataatttttttcaattctttctggatacaattgtaagaaaacagaaaaatcggaaaaatgagaaaattcaccaaaactaatggggttgttttgaaattagtttgatacttgaggattgacaaacgaattctacttttccggggaaagaattagagagcgaaacagaacaaaacaaacaaaaagtcatgtctccgacgacgacatcgttacgatccctaagcttctcgctttacgcttcttctaattctactccgatttctacaccaattgaggcccgacagttactgagttcatgcaatagattctacggtctgtcctcttcgagctcttcttcctcccttactacttcatctttgatcggaaatcttgttttctcatcaaggaatcagtctctctccgtaaaggtatacaatttcgtaaatttttgtgatggatttcaactttacggcctaaattcgagaacccatgttccacttattgagaaatctgcttaattcttatgtcacttgtagtcgattgggaaattagggatttctatatgtgccattgattgtgattactctttatgtggtctttttggtccatttgaagatgttttaagttaggtctctcagccacatagacgattacattagtcctgtgtttaagttcacactgtcttactttgattgaagctaggttgcgttaagggcttttaaataacatctaactttatgagtgtttggtgttgtcagtgtggctacatattgatgaaatgtatgtgtgttttgggataggtccaagcgttagctgctgaaaccgaacagccaaaatggtgggagaggaaagcagggccaaacatg

SEQ ID NO: 22339 - DNA, 3003 bp, Unknown; identical to SEQ ID NO: 22336
  misc_feature (1)..( 3003): 2750-1469P.txt file - cDNA_ID_2051606; gDNA_ID_2926188; Annot_ID_140902

SEQ ID NO: 22340 - DNA, 3000 bp, Unknown; identical to SEQ ID NO: 4655
  misc_feature (1)..( 3000): 2750-1469P.txt file - cDNA_ID_2051633; gDNA_ID_1620720; Annot_ID_49180

SEQ ID NO: 22341 - DNA, 3000 bp, Unknown; identical to SEQ ID NO: 4655
  misc_feature (1)..( 3000): 2750-1469P.txt file - cDNA_ID_2051633; gDNA_ID_1620720; Annot_ID_165783

SEQ ID NO: 22342 - DNA, 3000 bp, Unknown; identical to SEQ ID NO: 4655
  misc_feature (1)..( 3000): 2750-1469P.txt file - cDNA_ID_2051633; gDNA_ID_2926214; Annot_ID_142123

SEQ ID NO: 22343 - DNA, 3000 bp, Unknown; identical to SEQ ID NO: 4655
  misc_feature (1)..( 3000): 2750-1469P.txt file - cDNA_ID_2051633; gDNA_ID_2926214; Annot_ID_202838

SEQ ID NO: 22344 - DNA, 3003 bp, Unknown
  misc_feature (1)..( 3003): 2750-1469P.txt file - cDNA_ID_2051733; gDNA_ID_2926148; Annot_ID_197865
ataattcactgccattagcattaaatctttctccaaaataattaattttactttaaattcttgatttaaattgttaaccacattatcaatcaaatttaatccaaacaaacttcaaatcaatcccttaaaattagcataaacatatttgttaacaatattttaaaacaaagtttttgtttaaatttaaataaataaatcatgtatttgaacttatttacaatgtcatgacactgacattaattatttaggaatgaaaatatttaatcttctaaatccttgcttttagaattattatgtcattacttaaaaggctcaaaatataaaaactttaaatattattatttatatatctaaactttataaaacattattaatatttaaacttataaaaagtttaatatatcatgattttttaacattattatataatatataaagtttaaaaaaatcttaattctttccgtcatattttgtgactcaaaattttaaaaatgaacatatattaaccaattggcgaaaaagtgtgagttctacgtcccacatcgactaaaatatttagacaatgattcataaacatatcataaataagattaacattaataaaataatggtttttttacaggacgggtttggcgggacgggtttagcagaacgttacttaataacaaatgtaaactataaaataaaaatattttataaatagttagaatttgcaaaattttatatataataactttaaaatataaattgtctccacggtgtaccgcagattaaaatctagttttttaataattttctaaggaagtcatggacctttgtcattcgtttatttcggttaaccaaaaattcacataaaaccaaaaaaaagaaaggatttagaatctttcttaacataatatatataaactatgtacggccacggcaatgttactaattcaacgtatttagggtgtgatattggttggggttgttactgaagtttttaactataaaattggctgcaagaaatttgattattgcaacttgtttgttgttaactatgacaaaaacaatgaaacaagaaaatatgaaccagaaataaaaatttgaactttgagtaacgttaagaaatgtgagaaattttagtaaataaaaaaattgattggtaaatcttccctatataattaataaacttatatcggtctttatatcaactcttaattaaaatataatgcctcaagatgtttcctaaggctttatatactagttaatcaaccaaaaaaatgtgattttagttaggttgaatttacatatgttttcttgtaatcgatcattaaaacaaagttgctcttcttgtattatgttcagacaacttggctgtattaatgacgagttagaaaagatgtagaagttgtgctcgaacttattttggaaacacgttttcataaagttaacaccaccggtctggcctaaacatagcaacccaataatacatagaacaaatactttttctttctaaacaaaactaagaagaaaatgattcttttctcctatagttttgtgtataacaggttcatcaaattaagtcttttagcacaaaaataaaacaaaagagatcatgtaatcgaggcaaatgagcttttgtttgcgaatttaattgatagagaaatagatacttgagaaaaataaaaaagctactagagaattgttacaaccttcatgttcacgaggatcttgtttctttttgttgaaccaacacatcaaaatcactcactgtccactcagcagtttcttgtctattgctaacatatatatctgtaacaacattgatcgatgtccacattcgctttgctggtttggttcccgggtactcctgtctacaaagacagattagtttaatgctaagtccaagtcttaagatatgtgcacataatcattataacctggtagaagtagagacggcttgatagagctccattgacctcccaagttcttgaatcaccaatccaaccatttccttgcttaattctcgggataaaattggctgtttggtcctgtggtgggtttataatgttgtagagaacattatagagacaaagaagtaaactaaaattggattctacaaactttaaaagactatttataaactaagtctcagtaacttcttgtacacgcaactcgaaatggtatgaagtatgaacacaatgattctcatgcttcatgatctcgtttcgtagagaatcgcaaaataaaatgacgaaagtaacgaatgatcggcgagcaatacctgcgaggatcaggcaagagagatcggcgcaatcagcgagtctagggttttccattgaaggagcttcgttatcaacttcattacagagattccaaacttctaatacgattcttcatccctctgtctcctaacgctgagacatatctctccgccgcgcagttttgaacggaggaagaagaactctccggtaggagaagcagagcaagcaagagtgaaatcgcaggcattgaaggagcaaacttaaaagcgcgtgaagttgaaggaatggtataggcgcgtgagagtggagaaattcgcgcgtgatttattgcggtaaaaaggtaagatgtcgcattctggaaaatctgaatgattgcttttctctgcttttggaagaatctcatttactccgtttagtatttatatttacatccctacactcttcataaattacaaatagacatataaatttcacttaattacaaacataacccggtactttttcacctagagatattccaaaaagcaaaaagaaacgtcattttcagaaacagaggaccctctgtttcgttcagtgagtgtttgagctgtctctataggcaaagaaacgataattggggaccatatgttcttctttttccagatgaagacgaagccttttagtccacgaagaagacaatgtcttctaagtggtggaacattttcctttcttcttctttaaatctttctgattgcctcttaaattttctgggtccatg

SEQ ID NO: 22345 - DNA, 3003 bp, Unknown; identical to SEQ ID NO: 22344
  misc_feature (1)..( 3003): 2750-1469P.txt file - cDNA_ID_2051733; gDNA_ID_1620729; Annot_ID_166039

SEQ ID NO: 22346 - DNA, 3000 bp, Unknown; identical to SEQ ID NO: 4853
  misc_feature (1)..( 3000): 2750-1469P.txt file - cDNA_ID_2051898; gDNA_ID_1620736; Annot_ID_166272

SEQ ID NO: 22347 - DNA, 3000 bp, Unknown; identical to SEQ ID NO: 4853
  misc_feature (1)..( 3000): 2750-1469P.txt file - cDNA_ID_2051898; gDNA_ID_2926157; Annot_ID_198503

SEQ ID NO: 22348 - DNA, 3000 bp, Unknown; identical to SEQ ID NO: 4847
  misc_feature (1)..( 3000): 2750-1469P.txt file - cDNA_ID_2051917; gDNA_ID_1620736; Annot_ID_166264

SEQ ID NO: 22349 - DNA, 3000 bp, Unknown; identical to SEQ ID NO: 4847
  misc_feature (1)..( 3000): 2750-1469P.txt file - cDNA_ID_2051917; gDNA_ID_2926157; Annot_ID_198496

SEQ ID NO: 22350 - DNA, 3003 bp, Unknown
  misc_feature (1)..( 3003): 2750-1469P.txt file - cDNA_ID_2051936; gDNA_ID_1620736; Annot_ID_166259
agaagaagggtgggcgacgacagaaacgacgccgtttcctttattggagacagctcgtgagactgtgtaaccaccgtcttgaggatcccaccattccggcgagtaaaaccagtctccttcgtcttttattacgacgtctcttccgcagaaatgtcgtacacatgacttgacgacgcttagtctttttccacgctgtgttgtcaacgagaaacgttgaattgagttcatctgagatgacccacgatttcaagatcgccggaaaattaaagggtctgataaaggttttgactttgcggcgtttctggttactgttgcgaaacccttgttagaggttagttaggcttcagggttttaattaaacggtcctatagagagttaagagttaagacttaaagagtgtcgcaagagtttttcacttggttaggtgaatttcacttttaaatgttgttaatatacaaatggtgttaatataagtaaatttagtttctaagaatttggcaagtctaaattcaaatgatatctaaaatatataattagttggaaataggttgtgcactctcccattagctcaatacgaatagagattgccccgctaattaaacctgtgaaattcgacgtcgatttccgaagaagaagaaaagaaaagcttgaacttaaagggggaaaaaagataaacttaaacaaaataaaaaattttatatatgatcaaccaaactatctataaaataaggatatttgacaaataagcagttaattaccttttcgtataaagaaaagaaagtttcatatcgatggattcattgacacatttgtagaagaagcattagagattgaccgcaactttcaaagcttttaatttattagctcgttcactgacgacctaacctctttttcacttgtaatcgccaagttaaaattaaataaacgagatttttcagtaaaataagacttgagttattactttttacaaaaataacatgtttaacaattttgatgtgttagttttcgtaacacgccaatagagaaaatatatgaatatgtgttcagtttttagggtttaaagttttgacggcttagtttccggaaaataaaatcatgccgacctttgtatttaacttttgttgtataatttttcagacaaaaacaaaactcatcaatatcttttcattttcccttagtctgttatttttttgtacttagagaaatgctatctttgccaaaaaaaaaaaaaaaaaaaaagagtaatgctatatgtaataaacagcttggccaaaagagtgtgtaataaacagagtttaaatagaaaaccttataatctctccgagaaaacatatcaaagctacaccaatcaccaatgtctccttagtaataataatcatacatatacaaaagcttatgcatgtgacgttagtttatcggatgggtaccataaccactgcaccgatcacgctatccattttagtgacaattacaacttttagcaaattccaacactcaaccgcgttatacaagttctgagaaaaaagaaaaaaatcgtccaacagaaataaacatttaataaacaaactcgtgattggaaaataaataaataaaaactcgtgatatcaccaaatttcatcggcaacgggcaaattgcaataaatcaaattaaaaatggttttgcagttttcacggtcaacctatacgccgaaactcggcaagaaaaacaccgacttgaccacttaaccacctctcccttaaatttattttttcatcattacacaactgcttcttcttttcttctttgtatgattattgttaatataagcatgattagttacgaaataatgtcacctcataataaattattagatgtctttattttgaagacttttgcttttgtttgcttctgtagaatctcttaaaaacgaatttcaacatcaaagaacaaaagagaagctctccaaaagctggcattatccttttcttcctttacctcctaatctttgcgcgttttttgttataaccacttttatataaacatgcaaacttattttttattagtattttgttaatcgaagaatgtcacataaatccgagttgtttttgctatttaaaatatctacaaatggtttaaggaaagcatctatcaatattaataagtcgtacataatacattaaatttaggcaatctcttacaactttcgtaacaatattaatggaatatcatatgtgctgtagatgattgggatgtatgagaaaagtaaacaaagtgaggccacaagacctttcggtgaagacatcttctttttttttttgcatagaatcaacttgattaatacgtcctaatttaggtgaaatatattcatacaactaatcacatgcatttcataataatatagaaaaccccattccttagacaaaagaaggtcaaaacgatatacaaaaatagttcaatcgaaaccaaaataaagcaaaatttatgaatacatgttaaaattatataaatcattctgaagtaactataatactaggttaatacttatgtttgtatatacaataagttgtttttctaaaaccgaaatcatgtcaaaccgaaccaaattgcaaagtttttgtaaacccaaaataccgaataaattacaccgaaaccaaaccgtaaaccggattgtcttcacctaaattacttatattataaatactacaaagagattatatgggaataggtaaaggataattaatttgataattataatttttgaaagaacaaattttgagaaaaaaaaaaaagataggcttgagagctgtgaatgagctgtctctctttcatttatattccaacctctttctccttccacacaaacataacacaaaacctccttctcttcctcatatctccatatcccaaaaatactcttataacattgtattattatacaatctacatttcccattttaccctcgcttctccttccaattctcaccccattgccacttcactcagatgtcttgtacactgacatg

SEQ ID NO: 22351 - DNA, 3003 bp, Unknown; identical to SEQ ID NO: 20463
  misc_feature (1)..( 3003): 2750-1469P.txt file - cDNA_ID_2051944; gDNA_ID_1620741; Annot_ID_166474

SEQ ID NO: 22352 - DNA, 3000 bp, Unknown; identical to SEQ ID NO: 5137
  misc_feature (1)..( 3000): 2750-1469P.txt file - cDNA_ID_2052045; gDNA_ID_1620765; Annot_ID_167326

SEQ ID NO: 22353 - DNA, 3000 bp, Unknown; identical to SEQ ID NO: 5137
  misc_feature (1)..( 3000): 2750-1469P.txt file - cDNA_ID_2052045; gDNA_ID_1620741; Annot_ID_166434

SEQ ID NO: 22354 - DNA, 3000 bp, Unknown; identical to SEQ ID NO: 4929
  misc_feature (1)..( 3000): 2750-1469P.txt file - cDNA_ID_2052065; gDNA_ID_1620745; Annot_ID_166645

SEQ ID NO: 22355 - DNA, 3000 bp, Unknown; identical to SEQ ID NO: 4923
  misc_feature (1)..( 3000): 2750-1469P.txt file - cDNA_ID_2052069; gDNA_ID_1620745; Annot_ID_166644

SEQ ID NO: 22356 - DNA, 3000 bp, Unknown; identical to SEQ ID NO: 4914
  misc_feature (1)..( 3000): 2750-1469P.txt file - cDNA_ID_2052106; gDNA_ID_1620745; Annot_ID_166631

SEQ ID NO: 22357 - DNA, 3000 bp, Unknown; identical to SEQ ID NO: 4910
  misc_feature (1)..( 3000): 2750-1469P.txt file - cDNA_ID_2052152; gDNA_ID_1620745; Annot_ID_166615

SEQ ID NO: 22358 - DNA, 3000 bp, Unknown; identical to SEQ ID NO: 4957
  misc_feature (1)..( 3000): 2750-1469P.txt file - cDNA_ID_2052198; gDNA_ID_1620748; Annot_ID_166716

SEQ ID NO: 22359 - DNA, 3003 bp, Unknown
  misc_feature (1)..( 3003): 2750-1469P.txt file - cDNA_ID_2052200; gDNA_ID_1620748; Annot_ID_166715
atattataaataaacgtttgtgtttaccaatagcatagttccagaatatgacactgccaactttgccaaactctccctcatgcaaagcacatccctggatgtcaggagtggctttcgcaacatcttgtggtcttccagagagcatgtgatggaacttctttgccgatgctttgatctcaatatctacctcaagttccccttgtagagaagactgacgcgtagcttgtgccatttttcttatacggatgttttgcttctctaggttttaatgagagtgagtgagagtctctttggaaattcatagccacttttatagaggaaagaataagcaatctgtggcaagagtcattattctaaaacaacagagtttcggaatgttggaatatatatggtcccttacggaagggaaggaatcagaccaactagctgataacaactacaatttcttttagtcagttgtggccttatgggaatcgattcagtgatgtgtccacaaaaaaaaaatatgtttcaagattgttataggctgctattatcgaccacatataccaacgacaaaagtaagcccgttcagaagaccaatatcgttattcgaaagcatgtacgttgtcttgaagccctgcttgtagaatctgcaaattaaataacttctcgtatagtactattcacatatcacaacacaacttccattaatcgatttttgggagcgtcatgtgtatttttatctaataactctaacaaatcattgtaaggaaggatgagtaattcctctaagctttttacgtagaaacttttgcatgtaaatacttatatgtaaaatttatagcgaaaatgaaaacatttgagaaatgtatattagtaaaagagaatcacttttttcatgtcaattttctcttttaggaaattcggtgcatggaattcatgcttagttagctttaggaatataaattcctcatcattgattaatcaataaaatagatagtataataccatactattagaaaataaatttatccaataaatagagtcatttaaaaaaaagacgattgtgtaaacatttaaaaatttaatggttggccatttgtaaaagtaagtgcacacaacaattgaaataggtactttgtgtcaaggatatgatatccttgacacttcagatctattctgtgagtaaaattaatactgtattttcatattagttaatatgcgatttgtttcatgtcatcatttatgaaaatttataaaaatattattttcatagcaagatctgatttatttgacaaggaactcggagacattgatgatatattcatgattcagacaacaatctagtctcgaggtcgcgtgtgtaatcttcaacgaacgcagtgtatctggtagggggaggaacgtcgtcatttaacttctcgtattcccatgtccactttgcaatacaaactttatgatccttaggaacaacgtcaagtgttatcttatagctcttatattgctttaacacatctccttcaagagctaagaaagacaccgacttgttctcttcatctacgtctatcttctctttgatctgctccatttttccatctataataaacccaaagtaaccgatggaattcaagaattagaaaaaaaaaaaaaaaaaaaagagagaaaaaaccctatttttcaagactccttaaaaaacatagacagctagttatagtacataccaacgatgaaattccagatctgaatagaggagttggatgtgggatcgtcacgatgaacataaactgcctctgtcttgtccgtgaaatttccttctttcttcttgaaagtcttgaagaatctctcggcggtcatattcacttggatctctaattcgagagtctggacaccagccatggctctaagataatccagtctctcacgctgacttttctgttgtttatctttaccataacaaaaagcatagagtagaaaaccaagagaagaaaacaaaaatagaggtaggcaaggtaggtgccttatgcgtagcagtttcttgataagcataacacgtgttgttaattcatattttaagtattgtctaagtgtattatacaatatgtattttcatttttgtgtttggtaagaacagtatttattttcatttaacaagtaacaggaagcgtaattttgttgttggtaaactaaggaagcgaaaattattttattaactaagaacaatatttaaatgttttcttttcaccataaccaaagaggacacatttcataagaatgaatatgcgacacacactacacgttggtcttagcccatatttggcccagacctataaagtataaaccatgcatgacgctgactctgagatacgttcttggttcggatcaaaatcaaaccggtatataaaccggataaaaccgggactggtaactgagtaagaatattgatgaagagaatatgccgtggaacagagagagttaaggaaaaagattcgtgagtcattcgcatctctctgactctgattctctctgcttagttctcctcgttccttctctctctctctttatagcatttcttctccaacaattcttttcgagtttttacggccattgcttcaggttctatctttctctataggtttgcatgttttctatgcaatcattttctgtaatatagctatgtgtgtttgcttcttcttagcttttccgttgaattttatcgaaacgctatatgctttgtggcccttattcacataaaattcatacgaaatggaaaagagaaaaagcagatacaattctggtcattgataattcagcatatcatgcagcaatcaaattttaggtgttgacttgtaaccaatatttctctctggaaaacacatgtatgaccaattattatggtttaatttatgaatacatttttatttttgtcatcagaacagaacaagggagacaacaaagtagtttgattattctggtggcgtatagataaatgttggttgtctgtggtttagcaagattaccatg

SEQ ID NO: 22360 - DNA, 3003 bp, Unknown; identical to SEQ ID NO: 20547
  misc_feature (1)..( 3003): 2750-1469P.txt file - cDNA_ID_2052254; gDNA_ID_1620753; Annot_ID_166863

SEQ ID NO: 22361 - DNA, 3000 bp, Unknown; identical to SEQ ID NO: 5017
  misc_feature (1)..( 3000): 2750-1469P.txt file - cDNA_ID_2052277; gDNA_ID_1620753; Annot_ID_166853

SEQ ID NO: 22362 - DNA, 3000 bp, Unknown; identical to SEQ ID NO: 5003
  misc_feature (1)..( 3000): 2750-1469P.txt file - cDNA_ID_2052322; gDNA_ID_1620753; Annot_ID_166838

SEQ ID NO: 22363 - DNA, 3000 bp, Unknown; identical to SEQ ID NO: 5018
  misc_feature (1)..( 3000): 2750-1469P.txt file - cDNA_ID_2052346; gDNA_ID_1620753; Annot_ID_166828

SEQ ID NO: 22364 - DNA, 3000 bp, Unknown; identical to SEQ ID NO: 4996
  misc_feature (1)..( 3000): 2750-1469P.txt file - cDNA_ID_2052355; gDNA_ID_1620753; Annot_ID_166824

SEQ ID NO: 22365 - DNA, 3003 bp, Unknown
  misc_feature (1)..( 3003): 2750-1469P.txt file - cDNA_ID_2052396; gDNA_ID_1620754; Annot_ID_166900
tttgtcttttaatttatttttttatctaccaaccaatccggtccaagagccaaataattactctaccacaaggttcgattttttcaaaatgttcgactaaattggcttttgtaaaaagcttatggcctactaggctgcataaactccgaaatcataaaacgtggatattcataaaggggttccactttattcaacttcttaattagaaaaatcttatagagacggtcgaaccctcttatataatttaaaggttctagtgttaggcactagtttgcttaagaagatactcatctatctctttgaagttcttgacagcaaagtccttgatgacatgtggatcatcgatctcatgggcggtcttctcaaactcaccagaccatttcagaaggctaccaccatccttagggataacggtgatggttcctttgaaggttttgtagtactccaacatttctccgccaatgatgctgtacgacatgcttttgttctccaaatccactgcttcgatcctctccgccgatatcttcaccagtggagatcctatattacggtaaagagtagaaacaatgagcattttttaaataaagatatggtgagagagtgaaatatagtcaatgaagacatagatcatttagggtttataatgagttattgaccattaagtaacatgaattatttattattatctttaatacatacaagtcttcctatctagaaccacacttgtttttttttttgaaagatgtcttcatgaatgtagtactcaatcttgaatgcgacaagatttatgctaattacttaattagccatttaggtatttattcgaaacatgatttattaattatggttacaaattaaagacaaaatgagaaatgtaccttctccataagtaatgaggcgaatggagccaggagcgttgccatcgccggctagaacttggatggttttgtagtcgttagggaaagctttggggaagagattgatgccgtcgccaagggctacccagaacttttcagccggagacttaacctcaacctccacatgaagaacaccactcaaccccatttgtttctaattaaaaaaaaaactcaattattttgtatgtctttgaatgatttgtttgtataacttgtcaatgaacgtgtctatatatagagaggttttaaagcctttagtgatatgataaattgcattaactatgtggagcaactcatccaactaatttttcatcctatgggtcctttttaaaattaacctaaagcttatacatttgccattcttcattgctatctcacccactcaaagaggtggatgaatcaataaatcgatgcatggtataacattcagtacaaagaaattaaaactggttttgtactgctttaaaacaaaattgtcggtgataaatgttgaaaaacatatagtattgagagtctatcggccaaaaaaaaaaaaaaaaaaaatctagatatttttcatatattcatacacgttatttttatggctacactcatctacatatatatttttcttattatggatttaaatttttaggaaacaaaattatttcaacttttcatgattatatctaccctttttaacacttgattaattggtttctcttctttcaaggtttttagatcaaagtttcaattgtttgatttatttgaaaaactatttatcatagagagtgtttatggcctagagataaactaatcccttgttcgtatttcttcagatcgattttgtgagattaccattttttcagatcacttacttggttctttgttgaacaatggtaatgtcacacaatcgatctgaagaaccaagtaagtgaagtagcatattttacataattggttctcatttacgacctctcataataactgtgggccaatatgtgaaacatgatgagatttaaatggttataaataatgtattatcattgatcaaaaataaatcagtaaacgttcacgtcacacaattagtcaaacataacaacttaataattgcaaattgcatttcataagaataaaactttctaatcataaagagctgaatgtttcctctttattttctacaataatcttcttggtggcactggcatggttaggtgcaatgcaataaagccaaaacaatttcttcatcgttaggtactttgatttcaccattgtgcgagaaaacagcatgttggtttccattgatataaaacgacaaccactcttcaatcgtaaaataaaaatgttctaagaatgagtcatcatttctattcgaagcaaaagttcatccgaacccaaatccttaatatacaattggatacgttaaagttacagtatcctaggatttgtcaatcttattaaaaaaaactaagattgctttaagaaaattataggttttctccacttataaagtttaacttttataatctctctctcaacgaactatgaaaacaacattagtaaatagtaatatagaagtctagagaaaaaagttgagacgaaaagggtaaggaaacactctgaaagcagcttcccatctctatttgatcgacagagatacgtacgtacacaaactggttagaaggagatagattcagacaagagaaccaaaccgagaatttgagcttagaaaagttaaggaaacatcaagtctttactttctcaagatggctctcaatttcttttgcttcacgtacatgtaatctacgtattcttcagctctaccgtctctttctctctctcttgaactttcggtagttgaaatactgctgttgagtatttcagaaacctaaccctcaaaatcaattaactttattgcactctatatttatcatcttcaaccacaacaatcttctgtttctttggaagcaactaactacaaagaacatcttcacgactagaaagacacatacccttctgtcttaaggacgagaccagaagcttcttctatcggctttgtaatggtctacaaaggataagaaaaaaccaaatccaaactaaagctatg

SEQ ID NO: 22366 - DNA, 3003 bp, Unknown
  misc_feature (1)..( 3003): 2750-1469P.txt file - cDNA_ID_2052454; gDNA_ID_1620754; Annot_ID_166882
atcgccatcttctatcgaagtaatagcaatggttcctttaagcgtcttgaagtgtttctggatttcagtgccactcattttcattgtcatcgtttctccaagtccatatcctcaagaatatgatgtaatggtaaagagaaagagttacaatttggttcaaaagggggcgatccgtttcctttacgaaagctgaaaagaatttgtctgccggagacttaacgtcaaactttacaggcaaagctcccttgtcattgtctatttgttttttttaagagcaaatgtttttagtggatgtgatattaatcttctcaactaaggtgtctatatagagaaaggttgataaaagttacattagttacttcaacttaagttaactccatccactttactttcttcaccgtaaggaatctcaccaactttagccaaaagctccaatatttgacctttgctttcatccgctcaattatttaacgtgttaggataagtaaaattgttcatatcgttttgatctgcataatataccaattaactccaatcaagcaagtattttacgtaataggtgtttttctaaatacattattcttaagaaatgtgatcaacagaaaatcgttttgactaatgacgactattgtgaaataaattaacgaagtcacgagttactcaactttcacaaactgatgagcaacctgaattttcaattatgtttagcaaccaaattttgatcttcttttttttttaatacatctagcgattaactacttggaagaaaatataaataatgcgacctaatctatttcccctgcttaattttgaaagaaactcgaaccatacgcaacttatctatatttagtactttatcatgaagaaaaatgtgaacatgtgaacaatgtctttgatgaaaagaaagtggttttgactaatgtacatcatcaaataaatatcactaaatgctcaagtcactcaactaactttagtttcaattaccatacattaggaatagtaataaaaatcacattagaattttcacaatatattatctgtactagatcataaaaaataagcgtgttacactgttacgttcttttttttgtttggttaagcgtgtaacaaaaatgattcttctctattacccttattaagaaatattatgactatatgtgcgaaccaatgtgcacgtcacttttgctggtatgctgatgaggatgtcttaactcttaacttttgctatttttttttcttatcagaaataaatattacaggaaatttagcgtatgtctcaattaaataattctgaagagagatcatataaccattttttgtcaaggaaatcacataaccctcaaagaaaataaaaacctagctagcttgctagctcgcacttaatttatgatttaactgattcaactgcatagtagaccactttttcttcttttttggtttataatcataatagaccacttacttcaaccaaaaaaagtttttgaagtagttgattttgtaagtacattattaaaaatatgattataaaccaatgtgaacatgatcagtggcggatccactaaggaaggaggggtgtcagttgacccaggttaaatctacaaattaagtttaatgcatagaaatccttaaagagatagcagcatagttggtagttctctttctgttgacacccctaaacaagagttcgaccctgccttattacacttttgagtaatttttattcttttaacatatatctatgacccccctaaaaataaatcctcggtccgccattgaacatggtgaatgataagtgttaacaaatgaatattataatataactatgttagtaaaaggattctagagatcataatagatacatatatttacggtttctgagttgatgttagtgaatcagataaagtgattgttccattggagatgagagtttgtataaatttcttaactgaaaatggcaatgcgtgaacgtgttgtatcattatgactcacacattgttattttgttcataatgagtctgttcaagtaaagtggatgtctacgtggaagaaaataacaaattgtgcaaagatgattcatttcatctgcttaatgtagcaagtaaatgtgaaaaaaggatttgacgaaaacaaaaattgcaggaacaattacttctttttttttttggtcaagagaacaattacttttttaaagagttaatttatctactaactaaaattgagcttgaaagacagctgcgcggacgattttacccttatcggcttctttaataaaagttgggttccagggaacttttatcacttatgccacttttttgaaaaaactgatctggactgccatcagttaatctgaatgccaccgaaaatgtgatataccagttgtacccttaatgagttgattaaaaaaatgaaaaagaaattcaaaagctaaataaagaaaatcgagttcggaggctcctcttcgtcgtcgtgttcttcttctttggtcgacgttcatcttcttcgtcggccaccatcgatttcctcatgccgccgacttgaaatccggcgtaaaagccacgaattaggtcagtttcttctcatatttcctttgacattggtgcattgtgattttagattgggattttgaattctatataattcccagctcgattcaatttgatagtttgatgattggtttgcaaagtaaagagtaatcgattagaggttgccgaaacgttatttgaggtgatgagcaaaggaatgtaggttgaatgtgagttgaatttgaattccgagatttcatattaaagatttggggggtttgtgtttgcaaagtttagattaaccaattagtttaacgaataggtatgtattaacattggaaatcaattgaaaggtaacgaattaggttcagtagaatcgagtgcgacgagagattgatttcaacgtatgataagagtacatgtggtataactattaaaatgtttgattggagttgaactggttgtattttcaggagcgatg

SEQ ID NO: 22367 - DNA, 3000 bp, Unknown
  misc_feature (1)..( 3000): 2750-1469P.txt file - cDNA_ID_2052629; gDNA_ID_2926144; Annot_ID_197632
tttccaaaaataataaccaatcaaaatcaacatataagatttgatatctaaattttaattaatttaatttaattagaaaaacaaaatacattattaatttccaaaaaagtaaccaattaaaatcaacaaattatattttatatctaaattatcatattatttttttattaattattatagttcacttctcatctttatatgattctatttttgcggaaaataatatcatcattataaaagaaataattagagttatttcgcatatgccacaatttgaattcttaaaaacgaatataaactgttcaatacatgaaaaaatattataacgagtgaaaaatagatttaagaaaactttctactgagtaacgggtcataatttgaaatatttatattcaatttcatacatattatattgaaaatttataatcttatatactacaataattaataacatattagatgtgattcaatttttaatacaagctggaaaatcctagaattgacgggtttagatcgatattaatacaagatggaatactatatgcgaaactcttaaattaacaatcaaagtacaagtgtataatcttaaacactaaacaatatagataatatcaacaaaacatatacaactcacaattaactatacatttaaaatcaaataaaataatatcatatatttttaaatcatctttacaataaaagtttttagtttaactaaaatacaagcctacctgcggtatactgcaggttaatatctagattatagggcttattggatctaaagacgggtcatcaaagatttcctaaactgaagcaaaatatactgaatattcaaatatctatctgttaccaaattataaacaaataagtcaatttaatattttatatacaaaatcaattaaatcttaatcacatataaaattagcacaaaaaaaattattcaacaattaaaacattatcaaatctctgtgttatataagttttgatactatattcgaataatgtaatataccttttcaatttgtattctttaactaatttaagctaactaatatatttgttaatcttatacctatcaaaaccgactatcgttttttatctttatagtatttttgcaagacttttttggtggatttggataaaagtgcattcggatcatatggtacattcccctattaaataaatatggtgcacacctatgttattagcaaaaatgtttagaatataattcaaagtcatatcattaataaaattaatattaataaaataaattggtttttggcaagacgaatttggagggacgggtttttgaatcaacattaataaaaaataaaatataattaatccaccgtttcaatacgggttaaatctttaatttattattttttaagaccactaatattaaacatatcaaatcatcctaatttagaaaagattatataaaaccaaaaatgttatgtggtatgtataatgttactatatataaaattaaacaataaaatataaatgtattagagaatgatacaatttgcaaaacttttatatataaaaaataattcttaaaatttaaaaattactactttaaacaaaaaaatcacgggacgggtaaacaaattacagaacgggttttattttggaattgggttatatggtggatgtatttgaatcaatatttataaaattttaaaatattattaatatgctgttttaatagggattaaaacttcagttttttaacaattatctcatggattcgtggtatagctttacttaataacaattataaactgtaaaataaaaatattttataaaaataaaatttgcaagttttaatatatattacttttaaaaaataaatcgtaccgcggtataccgcaggttaaaatctagtcgtttagtagatttgagaaagcggatcatttttcaggaaactgtataatcgagactaactttgaatcatttgtttcaaacgcataacaatcaacttttttttattctttataacacaaagtaatgcttcttactccgagtgaaggggtgaggggcacctggaaaaacactttgcaccaagcagtaaagtataatcattttcttgaaaacactaccaacataggcccataattggatccatgaattttcatgaaccatcaatccaacatcttatattttgatttgaactatccaatttttctctaataaactaatagctctagattcaataggatccaattgagttttttcccacattgctacttcccacaattggactatccaaagctattaatagattttctatatttttttttattttttttgtcttttgaactatgagtgattagtttttcgaaaatgttttgaagaacgttaacaatctatttttatacctcttagattctctcggttccttaagtcatatttcaatatacccattaattatcagaagagaatctctgacaattaacattacacaatctatttattttattttgatttaaacaaaatgtttgtcaagtaaaacccattgttttcttaaacaaaaaggcaccctactagctccaacgatttatcatcattttccgttatttcaaaattaaaatgaatatgagaagtcaaatgtatttatttttagtaatgtttcacgtattttactaaatctgattatccaaacagaaatcatcatgataacagataatgaattaattctataaaaaaaaaaacagatagtcaaatgatcacaaaacattaaaatcgatgacaacaaactaataacctattcaacaataatctctaatctccaagattaaaggaacaagaataggacttcaaaatcaaagaaaaaacaaacaacgcaattcttatcttttctttttcctaacttcacttccatatataaaccccattcttctatcatcatctcaatcaagaaaacataaagctaattaacaataagaaaccaataaactctaacgctcttcaaagcaaaaaaaaacatcaataatg

SEQ ID NO: 22368 - DNA, 3003 bp, Unknown
  misc_feature (1)..( 3003): 2750-1469P.txt file - cDNA_ID_2052629; gDNA_ID_1620757; Annot_ID_167019
taatttccaaaaataataaccaatcaaaatcaacatataagatttgatatctaaattttaattaatttaatttaattagaaaaacaaaatacattattaatttccaaaaaagtaaccaattaaaatcaacaaattatattttatatctaaattatcatattatttttttattaattattatagttcacttctcatctttatatgattctatttttgcggaaaataatatcatcattataaaagaaataattagagttatttcgcatatgccacaatttgaattcttaaaaacgaatataaactgttcaatacatgaaaaaatattataacgagtgaaaaatagatttaagaaaactttctactgagtaacgggtcataatttgaaatatttatattcaatttcatacatattatattgaaaatttataatcttatatactacaataattaataacatattagatgtgattcaatttttaatacaagctggaaaatcctagaattgacgggtttagatcgatattaatacaagatggaatactatatgcgaaactcttaaattaacaatcaaagtacaagtgtataatcttaaacactaaacaatatagataatatcaacaaaacatatacaactcacaattaactatacatttaaaatcaaataaaataatatcatatatttttaaatcatctttacaataaaagtttttagtttaactaaaatacaagcctacctgcggtatactgcaggttaatatctagattatagggcttattggatctaaagacgggtcatcaaagatttcctaaactgaagcaaaatatactgaatattcaaatatctatctgttaccaaattataaacaaataagtcaatttaatattttatatacaaaatcaattaaatcttaatcacatataaaattagcacaaaaaaaattattcaacaattaaaacattatcaaatctctgtgttatataagttttgatactatattcgaataatgtaatataccttttcaatttgtattctttaactaatttaagctaactaatatatttgttaatcttatacctatcaaaaccgactatcgttttttatctttatagtatttttgcaagacttttttggtggatttggataaaagtgcattcggatcatatggtacattcccctattaaataaatatggtgcacacctatgttattagcaaaaatgtttagaatataattcaaagtcatatcattaataaaattaatattaataaaataaattggtttttggcaagacgaatttggagggacgggtttttgaatcaacattaataaaaaataaaatataattaatccaccgtttcaatacgggttaaatctttaatttattattttttaagaccactaatattaaacatatcaaatcatcctaatttagaaaagattatataaaaccaaaaatgttatgtggtatgtataatgttactatatataaaattaaacaataaaatataaatgtattagagaatgatacaatttgcaaaacttttatatataaaaaataattcttaaaatttaaaaattactactttaaacaaaaaaatcacgggacgggtaaacaaattacagaacgggttttattttggaattgggttatatggtggatgtatttgaatcaatatttataaaattttaaaatattattaatatgctgttttaatagggattaaaacttcagttttttaacaattatctcatggattcgtggtatagctttacttaataacaattataaactgtaaaataaaaatattttataaaaataaaatttgcaagttttaatatatattacttttaaaaaataaatcgtaccgcggtataccgcaggttaaaatctagtcgtttagtagatttgagaaagcggatcatttttcaggaaactgtataatcgagactaactttgaatcatttgtttcaaacgcataacaatcaacttttttttattctttataacacaaagtaatgcttcttactccgagtgaaggggtgaggggcacctggaaaaacactttgcaccaagcagtaaagtataatcattttcttgaaaacactaccaacataggcccataattggatccatgaattttcatgaaccatcaatccaacatcttatattttgatttgaactatccaatttttctctaataaactaatagctctagattcaataggatccaattgagttttttcccacattgctacttcccacaattggactatccaaagctattaatagattttctatatttttttttattttttttgtcttttgaactatgagtgattagtttttcgaaaatgttttgaagaacgttaacaatctatttttatacctcttagattctctcggttccttaagtcatatttcaatatacccattaattatcagaagagaatctctgacaattaacattacacaatctatttattttattttgatttaaacaaaatgtttgtcaagtaaaacccattgttttcttaaacaaaaaggcaccctactagctccaacgatttatcatcattttccgttatttcaaaattaaaatgaatatgagaagtcaaatgtatttatttttagtaatgtttcacgtattttactaaatctgattatccaaacagaaatcatcatgataacagataatgaattaattctataaaaaaaaaaacagatagtcaaatgatcacaaaacattaaaatcgatgacaacaaactaataacctattcaacaataatctctaatctccaagattaaaggaacaagaataggacttcaaaatcaaagaaaaaacaaacaacgcaattcttatcttttctttttcctaacttcacttccatatataaaccccattcttctatcatcatctcaatcaagaaaacataaagctaattaacaataagaaaccaataaactctaacgctcttcaaagcaaaaaaaaacatcaataatg

SEQ ID NO: 22369 - DNA, 3000 bp, Unknown; identical to SEQ ID NO: 5133
  misc_feature (1)..( 3000): 2750-1469P.txt file - cDNA_ID_2052751; gDNA_ID_1620765; Annot_ID_167312

SEQ ID NO: 22370 - DNA, 3000 bp, Unknown
  misc_feature (1)..( 3000): 2750-1469P.txt file - cDNA_ID_2052792; gDNA_ID_1620770; Annot_ID_167503
caaaaagcaagtcctctttgtgaagttaacaagaagcaaactatttatcagaataagcaacaatttcgtcatttgcacaagctgccacattgatcaccattgtccccttggtcgttgttggcactaatttacaacaatctctccgtggagcctacaaaaacatttgactggcactaatttacaacaatctctccgtggagcctacaaaaacatttgacaacagcaaaaattatgtaccttgctccacctatccggagtaggctttttgtagacaaatatctgattgatctcggaaggatccgcgattccccattcacatttaggataccattcgtcgtgcctcaagtattggctaatcgtcgttgtatcagaagaagaagagttactaaacgcatgagagaaataaaacacacgaggacgctgacaatccgtccatgttaccggacgtgtgttgaatgcaagattagtcgctgacaatccgtccatgttaccggacgtgtgttgaatgcaagattagttcatccttgctggcatatacgtacgcgtgatttgaactgtgtatccccacgagattgacattgtccactgatgactcttatcatagcataccgattgttggacaagactcgctgaatcgagtttcgctgggatcattagcttctttaatgcgttgactcggtttgtttttgggaatataggatccactacgtctaggtgatggattgatactattggtgcttgtggatggacagataatagccctaagagtggattgatactattggtgcttgtggatggacagataatagccctaagagagtaagtgaagtaacaagagtcaatgacaaatgaatctaatcacggattttaagttttactatttcacatttactttgtgtttttccggctgatttttctcggtaataacaaaactaacctgatggaatccaacttctttagtgagaggaacaccaagctcagccatacaagcatgaatccgatcatcggatccgtacaaatcggagtatctctcgatacaccgatcttgcatcttctccaaaaccttggatcggagtatctctcgatacaccgatcttgcatcttctccaaaaccttgggaaaactgatgaagattctgcaaatgactctcggacggagctccgatgtaataaaactgtttatgatcgtactttctcaaaaccctaacaagattttccgtgaaaaacacggtatcgtcgtcacccatcacaacccacctcacgtttctctccgcttccgttccgtttaacatcctcaccgtctcggacacgattctcgtgatcctgatcgctgatctgtgaccgttacggtaacggtacttgaaactcggatcctgatcgctgatctgtgaccgttacggtaacggtacttgaaactcggtgtcgttgatgggtttgtcgagccaaacggcgccgttcatgactccgttaggtttccaccatgttttcacgtattctctacgatgcttccatagatctgaagacgcggcgattccgaagactatgtgtttgagctccgtttgttcctcaggtgtttgacccgacccgagacggataacgggtacgaggagagaattgggggatttagaaggtgaatatgggtttagaaaagagatgaaactgaatgagtggatttagaaggtgaatatgggtttagaaaagagatgaaactgaatgagtcatggagatgaagaagaagaataaaagggtttattagatttgtcgtaagaaagtgttttttgatctcccatggctctgattgacatagaagaagactagttttttttttgctttgtgagttgtgacagtggtggtgttggtgagattgaaggctttttattaagaaatgaaaccaagtttatttttttttaattacaattataatctgtattatctaatgccaaaaaggcaaggtttgtctcgatgctgtataatctgtattatctaatgccaaaaaggcaaggtttgtctcgatgctgtttaagacaacttaactcaaatttaagacaagatatattttgatgatgtctaaaataatcttatttagttaaaaaaaattttggatttagaaagaaatctcctttttatatttcccaatttattagagtcaaagctgtttttggaacattaattctccacaagaataaaaccataagatggaaaacgacatttcaacattaatgattacagtaattaataactgaaaatagcgtttttcacacaaatctatatgattacagtaattaataactgaaaatagcgtttttcacacaaatctatgatactttgtctaaagtcaataccttttttattggagtacaattcatgataaatatctcttctatttttagtggttgtatatattttgtcatttataagcagatttaggcacatattattttgtccaaaacatattgaatttgtaaccatatatatttgacaaacaccgtgattaattaatgattatatatatgtacgtagttaagtaaattcacaaattcacaactttgtgtgtgtgtgtttcttaatagttaagtaaattcacaaattcacaactttgtgtgtgtgtgtttcttaatatcattaggcccaaaaggcccagaagttgaaggtgactaaaacgacgtcgatgttaccgaataagaagcagagttgacgaaataaacctgtctcttcttcttcttcatcttctttccctctttgccaagcaaaatttagaattctttctttatctctcagcgagaattttggctaagaatctagctaccttcaagtctctccaggtaatatacaagttctatgatctcttcacattccattgacttcaattcaggtaatatacaagttctatgatctcttcacattccattgacttcaattacactgtgttcttcttcaattggttaagaatgtgattaagacttctaaatcctgatttttgattttgatttgtagatcaatg

SEQ ID NO: 22371 - DNA, 3003 bp, Unknown
  misc_feature (1)..( 3003): 2750-1469P.txt file - cDNA_ID_2052823; gDNA_ID_1620770; Annot_ID_167493
tttgggcaaagttatgtctttatattaaatgtcgtgtctatgagtctatatttatgtgatatagaacaagcttatcttttgatttacacttttagtaatagtagtttgttaagaaaacatgcataaagcataattctatgtgtgtgtatttcacttcacatatagcatatatatgaaaacttctctctatttcctagttaaaatctctacagtcgtagttaattggctaggattaaggaagttaagcttgtttccaagtgattgagatgacaaatcttcctctgttcgcaacaaccattgtttccaagtgattgagatgacaaatcttcctctgttcgcaacaaccacgttgttttacacttattcccaagcatcatttttttttttggtttatcttttaattgcaatatacatatatagtacacacatacacgagatatatacaaacgtatgcaattgcattctataaattgatgttagtgaaggatatttccaatattacaagcaagcatttatttatatgttatgtacaatgtcttttgtgttattgatcaattactcctgtcgtgtttttttggcattattgaatcaacaacattgatcaattactcctgtcgtgtttttttggcattattgaatcaacaacatttgctcgaattcggaaactcttccaattattaaagattgctgaaaatatcattttatctagattcttatcactctttcatatttgttggcattattatccatttcaatttcgttataaaaaaaacaggtggtaagtttgcaaactgagctttcatatctacaagcacacttagcaactctagagctgccacaacctcaaaacggacctcccaacaatatcaccgtcggtgtacgacctctcctccatctaacggacctcccaacaatatcaccgtcggtgtacgacctctcctccatcttcgagccggtcatgtcctccacttgggccatgcagcaacaaccacgaccgtctgatcatctcttcggcgtcccgtcatcgtccaatatgggcggaggcggtgagctccaagcactggcgcgtgagtttattcacggtgggcaaatgccagctcagccatcgccgggaaccagtggttctgcctcgtcagtgataaaacgatatagttagccatatgtttctccttgtaatatatatacttggtcgaattctatagttagccatatgtttctccttgtaatatatatacttggtcgaattcgtatttaaattgttgtctagaatgttaatataagaactatatgatttacattgattaaatggagtatcttataggccaatatgttgaagttgctttggtctcttggaccatcgaatatgttgttttaatcagcctagagtacaccggttctccacaacttgggtggaatcttgagcgtgaaggaggcttgattctggcgcgggccttaaatgggttcaataaagtttttttttcttatatcaagcagcccgggccttaaatgggttcaataaagtttttttttcttatatcaagcagcccaaaatattatttaaacccgactcaattgagtttgatactctggtttgctttgtagtccacactattttaacaacatcttcgaagcatgcatttgatttaacaatcttcctaatttactagagaatttgagccaattttgtcttttttttcaccatttttataaaagctggttttcaacttgtgttctcttagcatttccccgatgtctaaggactaagctacataaaccaatgagtaaaatacatatggacgatgtctaaggactaagctacataaaccaatgagtaaaatacatatggattggacaataatcaccaatcaaaaccccaacgtcgattgcatagccgataagtagtaccacaatggtgagaggaggatagtgccagcggctatgaagggtcgacgtaaaccaaaccttgatgagacactgtaaaacacgactattggttgaacaatcagttccaatcgaggctcacaaagtcaaagcatgcttgtaagatgaaatgaagtttagccctatggctatagaagcaataagccatttttatatgaaatgaagtttagccctatggctatagaagcaataagccatttttatattcataactttagaggtattaataagaaacatatataaatttttttataaatgtattgacaaaaaatcaagtaaaaataagcaagatgcaaaacataagcaacatttctaattaatattatataattttttataatgattttatacatgaaaaaatctctaattaatagatatgacacatgtgtgatcatgtgagttatcatgtcattttttgaaactaagtgaatgaataaagggttgagctaagcaatatgtcattttttgaaactaagtgaatgaataaagggttgagctaagcaatatataattgttgatgatgaaataataacatgaatacaaattatatttatatgtgtgtatcaattagtgtaatatttaagagagaaccattggagtagagccttacaagacaatatatgatcaccattggaaaactttaaagctattactatggtaaaaactcaattgcttgaattcgaattcaagtaatcaaaatcttattattaatctatgttatcaccaaaatagaaacaattagatatagcaagtgacattaatctatgttatcaccaaaatagaaacaattagatatagcaagtgaccactattttccttctaagacaccatacgaactaatttttatcaaaaacaaattatcaagctctattacaattccgcatgtgtgctatacattagattaattaaaagaaattaaatctgttttcactccatttatcaaaagtaacatctttaacgaatcaaacccataaggtactcttactctctattaatagaggagaatacaatgataaggtcaaaatgttcttgccatcatcatctacttgttcttgtacaatg

SEQ ID NO: 22372 - DNA, 3000 bp, Unknown; identical to SEQ ID NO: 5192
  misc_feature (1)..( 3000): 2750-1469P.txt file - cDNA_ID_2052834; gDNA_ID_1620770; Annot_ID_167489

SEQ ID NO: 22373 - DNA, 3000 bp, Unknown
  misc_feature (1)..( 3000): 2750-1469P.txt file - cDNA_ID_2052868; gDNA_ID_1620770; Annot_ID_167478
agaatccgtcggtcttgtttattatttgctaagtttattctctgctttatgaaattattttctcattcttttctttactccaatgaactctctgctttatgaaattattttctcattcttttctttactccaatgaacgatggttcagtggattaaagaaaacaattttaagtacaatgttgccaagaagaatcaaagagaaaacacttggtttaagtaagagtataacaataacagacaattaaagaagaatcatatgcatataggagacaaatcattattctcatcatcgtagataacatggacaggtttatcgacaaagtcgttgtcttgaacgtaacaatctcgatcataagtaggcttctccacgaaattgttgacatgaacgaacaatctcgatcataagtaggcttctccacgaaattgttgacatgaacgcttcaaacgattagacaccgaactcgtgtaatgaggaggtaaaaaagttttgcatagcttctccttaagtttatcccatgatttaataggattcttgccagctcgcttgcgtgttttctgcttttgttgccaccatgatgcggcttgccctcaaaatttcttaatcacaagcgaaacaaatagatcatccgaaacgttttgaaactccaaaatttcttcaatcttcacaagccaatctagtaacgaatcagaaactccaaaatttcttcaatcttcacaagccaatctagtaacgaatcatcatctcatgtctttcacagacatcgctgcaagggaatcaaaccactaggaacgacgtggctctgataccaactgatagaaagcggaagctaaataacagacaaaaacgcaagattttcaggaaaattcagattcacgaacggatcttttttagaacgtcaaaacttgacaaagaggcaataggatagggtcgagatcggtagcgatatcgacgaggtttaaaaagtcatccttgcaaggtttgaacacatagcgatatcgacgaggtttaaaaagtcatccttgcaaggtttgaacacataaaactctttattcaataatcaatagctaattcattctacaacgtaaggtaagaatcataaacaaaaccttaattcttaaaagaagttaaaagcccaataggtaaagcctatctctttaataaaatccataaactactaaatcatgaatgagaaacaataaagaggtttggtcacgacgaggcccatcgaaggcgtgaacaaagcaaagatgcgttgcatcacccatggagggactttctccgttagaacaaagcaaagatgcgttgcatcacccatggagggactttctccgttagaatttttttttttttttgttgttgttgtcgaatcatagtaatgtgttgtcaatgatcaaatgagagttagattatgtttaaggaaatgtatatgattaaagaaataaggaaattcctttaccaactttatattgtggtaattgttaattacttcccgccgatcttggttttttttttttaatcataattattattactttggctctaatgagatgaagaaatcttctctatttttctttatccttatcagtcctctaatgagatgaagaaatcttctctatttttctttatccttatcagtctcatcatcctaaaatctaatacaaaatgaacgacgcaatcatttatatatggttacatgcatacaaactctaacacgttatccttcaatataaattattgtttgacaagattaatatatttagctgacttgtttcttcctctaattatggcaaagcacgattctgttcatcatacgaactatccgattgagtggggttgggtgtgttgcttgtgatgaagggtgccttgagacgagagaaaagaacatgtgtgtgttgcttgtgatgaagggtgccttgagacgagagaaaagaacatgtttagtattccaatataccaaatattatattaatatatcatgaaacttgaaaatgtgttggtgtattatgtatgtcaataagaaataatattaatacagtttcgcgatcatttcaagatttataataattttgtataagaaagaaaagtgtgagaagtagttgttagcaaatcacatgggaacatataaactaattaaatcttaaaaatgaacattttaactttttgttgttatataaagtaagttaactattaaaaatgaacattttaactttttgttgttatataaagtaagttaactactaaaaattactatacaagaaactgaactctgtgtttttttgtgcggtcataattcgcatataaaagatagattcagaatctgatattgtttatacttttttttttttctttgatattgtttatactaatgaattggtttgcatagaaaagtaaatgctttttcattatcatgaatacatgataatgaaactgtcgccattcattgcaaaattggtccgattttaatttgtcttcatcaattacccaccttcattgcaaaattggtccgattttaatttgtcttcatcaattacccacctgttttccattggtagatatatttatatatgtatatatatggtgattggtgacttccattgtctgctcaataaaggactaccactcgttctttctcaatctctcgtgcatttaacttgtcacagaagaaacatcattcacagatcttcaatcacttttttccttcaaacgaaaagatgtaccaaagaaagtatgtttttatatacacgtaaatatatatataactccttctttgttataagtagtacatgaatacacgtaaatatatatataactccttctttgttataagtagtacatgaaaacaaaacagatatttttgatgtaactccaatatatacatagtttttgtttccactttgtttagatttataaatttagattatgtccgtagcaaaaaaaaaaaaaaaaaggaaacacaaattaatataagcactgcaatatgtggtttagctcgtacaatg

SEQ ID NO: 22374 - DNA, 3000 bp, Unknown; identical to SEQ ID NO: 5203
  misc_feature (1)..( 3000): 2750-1469P.txt file - cDNA_ID_2052911; gDNA_ID_1620771; Annot_ID_167551

SEQ ID NO: 22375 - DNA, 3000 bp, Unknown; identical to SEQ ID NO: 5205
  misc_feature (1)..( 3000): 2750-1469P.txt file - cDNA_ID_2052914; gDNA_ID_1620771; Annot_ID_167549

SEQ ID NO: 22376 - DNA, 3000 bp, Unknown; identical to SEQ ID NO: 5206
  misc_feature (1)..( 3000): 2750-1469P.txt file - cDNA_ID_2052918; gDNA_ID_1620771; Annot_ID_167547

SEQ ID NO: 22377 - DNA, 3003 bp, Unknown
  misc_feature (1)..( 3003): 2750-1469P.txt file - cDNA_ID_2052922; gDNA_ID_1620771; Annot_ID_167546
atatcgtagtaatgcaacaatgcatagaactgtgtctgagagtctgataaaccttacttggtcattgaaatatgattctctttgcagcttttgcttggttacttgccacctgaacgttcactctggtcaactgagttgaaacaaaagagatcccaatacaagcactacaaggatgagcttctgacgagtcctgtaagtgatcctggtcttttgtttcttgccttggagttattgttagtctgttagttttgcatgctatgtctgtctaagttgatttcaagtaaccggattatcacataaaagttatcaagtgtgtattatcctagctgtttttgtgaactttgtaagtcctttttctcatctagaaagtttctgtacacaattatcttttcttgaaatgtgtttgtacctctaaatgattctgtggtagttagtcagaaatcacatggaaaatggtgaggtcaaaggggttcgacaactatgacttgaagagtgaaagccgatgcatgcttgcccgatccagaattactgacgaggaccatcctttaagcctagggaaggcgagtatctggaatacatacttccaggtactatatcttacatcctgggcaggtctttcattgtcttaatcttttagagagacctcagtgcattacttaaggacaggattaaaggttatatagtatttaatttgtccactagttccatcatcactcttttgttaatgtaggatacggagaccatagaacaaatagacagagatgtcaagcgtacacatccagacataccctttttctccggtgaatcatcgtttgcgcgttctaatcaggtaacctttttgtgttctcatcagcaaattttcacctatttttgattaatcaaagctcagtgacatttcgatttacatgtctaggaatctatgaagaatatattacttgtatttgcgaagttaaaccaaggcatcagatatgttcaagggatgaacgaaattttagcacctatcttttatgtattccgtaacgaccctgatgaagatagttcagtaagtagactctttttgtttcggtgataccctttaaccaactttcaatgataacgtacacagttttaaggtaacagtgctagtctggaccctcaataatttcaagatatgcgttcctttgaagtaaaagctcaagactgttttactaaatgatgtgtcacagagttacaaataaaaaagaaccccgtaatctattagtatgaatctgacctctctgtctaattttcttagaagattggttcgtgtatgatcttttttcttcaaccttgtttttcttcttctcagcttcaatcaatttcatattaactcttttcaaaatatgcagtcccatgctgaagcagatgcattcttttgctttgttgaattgttgagtggatttcgagacttctactgtcaacaactcgacaatagtgtggtgggaatccgatctgcaattacgaggctctcacaacttgtgaggaagcatgatgaggaactgtggcgtcatctagagatcaccacgaaagtaagacattggttttttctttctctcatgtctttttgttgtgacaacaaccatatttgtcattctactactatagtcctaatgatctgctttgtgcggaagataaattccaatgatcccctcagcttactttgtattcttgttctcctatccataacataataacagtggattggatcctctgagattgagactgacattgtatagattctttgattacaggtaaatccacagttctatgcatttaggtggatcactctcctcctaacacaagagtttagtttctttgacagtcttcacatatgggatgcactcttaagcgaccctgaaggtccgctggtaagatcgtaatatcttctccttgatgcatacccgaaatcaaatcgatagatgcagaagtcacattagtttactgttccactcatttgcttgattaaagaagacccggtctgtatcgtattgttgcaggaaagcttactggggatatgttgtgcgatgctggtactggtgaggaggaggctaatcgctggggatttcacgtcgaatatgaagttacttcaacactatccaactacaaacatcagtcatctcttgtatgtagccaataaacttcgttccaaaatgttagtataaatccttttgttggttttttctagcttttgattaaaccaacttttagttgcccccattacaatatacaaagcgtttttgttttgtttttatattttactgtttaaatggcaagacatgtttgtttgttacgttatcgttttggagattttctcggaaatcatgaatgcaaacaaaatgtggttgttacttgtcctccgatttcagtcttagaagccatatgaggttcttggagaatcattctcctcctccaaaacgtacatatgccaaaactcagagccttgaccacttgcacttccaccctgtaatgatttacacaaaagagaagcttgatattaccatttcaggcaaaaaaaagtacaagaatatttatgaccaatacggtggtaccgaaatcatctccactacagctgctggagctcgaagctccgattttggttcagttcttatcatttcggtttactgttgactttggtctttagcaggttcaaatcgaattaaatttcggttaagttccacgcaattcaagggaattttgcagcttcaaaaataagagaaacggtcacaaaacgagcaaaaattcaaaattagaaaatacgcagctcacgagtatcgtgatattaacaacaacccaattacatcattacacgtgtcgttatatacagatgggtactttcgtttataaatacacatcaaacgccttactaaaaacctagaaatagaaaaatcagatctagattcagtttttttcatcaaaaaagagcgtcttcataaacgcccttcgtcttcttccctggaaatctagtttctttcttccacgaaaatg

SEQ ID NO: 22378 - DNA, 3003 bp, Unknown
  misc_feature (1)..( 3003): 2750-1469P.txt file - cDNA_ID_2052925; gDNA_ID_1620771; Annot_ID_167545
aagacaccgcaagtctccgccatgttcacgcccagatcctccgtcgcggcgtcctcagtagccgcgtcgctgctcagctcgtatcttgctcttcgcttctcaagtccccggattatagcctctcgattttcagaaattctgaagagaggaatccttttgttttaaatgctttgatccgtggtttgacggagaatgctcgtttcgagtcttcggttcgtcatttcattctcatgttaaggcttggtgtgaaacccgatcggctaacttttccgtttgtactcaagtctaattctaaattaggttttagatggttgggtagggctcttcatgccgcgactttgaagaatttcgttgactgtgactccttcgtcaggttatcattggttgatatgtacgccaaaaccggacaattaaaacatgccttccaagtgttcgaagaaagtcctgatagaatcaaaaaggagagtattttgatatggaatgttttgattaatgggtattgtcgagccaaggatatgcatatggctacaacactttttcgatccatgcctgagagaaattcaggatcttggagtactttgatcaagggttatgttgatagcggcgagttgaacagagcaaagcagctttttgaattaatgccagagaaaaatgtggtgtcttggacaacattaattaatgggttttctcaaactggcgactatgaaactgcgatttctacctatttcgagatgctagagaagggcttaaagcctaatgaatacacaattgctgctgtgctctctgcatgttcaaaatctggtgctcttggatcaggaataagaattcatggttatattttggacaatgggattaagttggatagagccatagggacagctctcgtagacatgtatgcaaaatgtggggaacttgactgtgcggctactgtgttcagtaatatgaaccataaggatattctttcttggactgctatgatacaaggttgggcggttcatggacgctttcatcaggctatccaatgttttagacaaatgatgtattccggtaaaagattttgtccagtctaagaatttagcttattctcatttttttttaattattattcatcgagtttagttctttaagttgtggtgtgcatgcaggagagaagccagatgaggttgtgtttctcgcggttctaactgcatgcttgaactcaagcgaagttgacctgggacttaatttctttgatagcatgaggcttgactatgcaattgaacccacgctgaaacattatgtgttagtcgttgatctgctaggtagagcagggaagttgaacgaagcacatgagcttgtagaaaatatgccgataaatcctgatcttacaacatgggctgcactctatcgtgcttgcaaagcgcacaagggttatagaagggctgaaagtgtgtcacaaaatcttttggagcttgatccagagctttgtggtagttacattttcttagacaaaacacatgcgtctaaagggaacattcaagatgtagagaaaagaagattatcattgcagaagagaatcaaagaaagatcattgggatggagttatatcgaattggacggtcaactgaacaaattttcagctggtgattattctcataagctaacacaggagattggtttgaagcttgatgagatcatatcgcttgccattcagaaaggatacaatccaggagctgattggtcaattcatgacattgaagaagaagagaaggaaaatgttacgggaatccatagtgagaaactggctcttacacttgggtttctaagaactgctcctgggaccacgataaggatcattaagaaccttagaatctgcggagattgtcattctttaatgaaatatgttagtaagatcagccaaagagatattctactgagagatgcaagacagtttcatcatttcaaagatggaagatgttcatgtggtgattattggtgatatagttgatcccttcaggttagtcaacaacaatgactcaaaccaaaaaggaaaaatgcgatgttctgtaacatcccagcctgagctgcttgaagtttttgtttattcatggcgctttccggtacaaatcttgtcatgttcttgtacacaagagtagggattaggacaagctcatgatttctgagaccaggccacacaccacagctatatcaggccgaagtgattcgggttaccccacaggcctagaagtgaaagagaaggggctcaagtgggttacttgtgtttttgagatggaaaattccaattcttttttatagaaaatatgagaagtttcgtttcataagctaagattttcgtaagataagattatgattaagcaaggagatgttagtatctgtaggtgtcatgtgtattattgaagacaacaacgaaacacatggcaattgtttgcgaagcacaggtatcacatgagaacaaataccagtcgccaaggtaaattgggtccatcactgttgctgattaatcaatcttgtgtttgtatatcactttatatatatggtaatacgataaaataaatcatagttattgttgctttctgttatacgattttaactcaaattattttgttgatatccaaaaattacctcaactctttagatatatgataatactaatgtacataatccatatatttattgtagtttccaaatatatccctaatcataaaaaaaatcttacaaatgactatggatttaagtatttccaaacaaaacaaacaggggaaaattgaataaagaaaaagaaagggataaatgtgtaaatagtcgacaatattgaggctatatttaatattaatttcttcgattcttctctctctttctctctctgtgagaagaagcaaaatcacgaacttccattaatcaccgactcgcagaacctttctctcattaaatcttgtggaaacctcggaaattgaatctgcgtgagtttcaatcgcttgatcgatccatcaaaccctagagatg

SEQ ID NO: 22379 - DNA, 3003 bp, Unknown
  misc_feature (1)..( 3003): 2750-1469P.txt file - cDNA_ID_2052939; gDNA_ID_1620771; Annot_ID_167541
aattcatggaggggcttttatagctttttccttgaagcctttcttggactttgcaatctcttattttcttgtttaagtttttcgtcatttgattctttgtggataatatttataaattgaactcctgtgtatgtatctttgagtttctttgatggaagacggttaattacactctgatctgatgtgtggagccttaaagtctctgacttttgtttcattaataagccggatagatagtaaatgctgaagaaggtttagtggttgttaaagagcgtaaatgatcttaaagtgcttacctttttgttttcttttttgtcttttggctgtgttaggaatggcatcaagctcttgtctcaagcaagggtcagtgccaatgaacaatgtttgtgttacccctgaagcaacgtatgaggctgtggttgcagaccctaggcttttcatgacttccttggaaaggctgcactctctcttgggtactaaattcatgtaagcttctttcttcccttatcatatcttacttagtagagtaagttcagttgttatctgctctgacagaaatttgtgttcagaaagtctctatctttgagatttaagctcttatgttgacgatgaatcatgctttgtttttcacctacaaaaattttaccagttacaatgcatgagattctctgtctatattatggattcctcttctgtgtgtatagtctgactaaaagtaatgttcttttttgtgtaacgcattgttccttttgcttcttgggggtaatgtattgtaacttttacatattggatatggatgcaatactttatagcttatagctttaaccattctacatattacattggtgattgtagggttccgatcataggaggaagagatttggacttgcacaagcttttcgttgaggtaacctcacgtggcggaatcaataaggtatgtgaatgccctctcaggctctcaatgataaattaattccattctatatgtattgtctgttttctatgtctcatatagttggttttgttctaaaatcttgaaatctacattgacatttttccttggatcattttccttctttgaattgcagatacttaatgaaaggagatggaaagaagtaactgctacatttgtctttcctccaactgcaacaaacgcatcatatgttctgcgcaaatactacttctcgctgctgaacaattatgagcaaatctatttcttcagatctaatggtcagattcctccaggtttgttcataaaaacctctttaactattttaccaaattttcaaatatttttcagtttcttctctgttttgtaacacacatatcttctgtagactctatgcagagtccatctgctagaccatgctttattcagggagccattagaccttcacaagaacttcaagctctaacctttaccccacagcccaagatcaatactgcagaattcctcggaggtctcaacttttttctctctttgcttctataaatgttccaactgagaaactgtgacttataaatctgagtaaaatcctttttcctttgatgttattgtttcaggatcacttgctggatcaaatgtggttggagtgatcgatggaaaattcgaaagtggttaccttgtaactgtaacaattggatcagagcagcttaaaggagttctgtatcagcttcttcctcagaacacagtttcttatcaaactccgcaacagagtcatggtgtcctcccgaacactctgaacatttctgccaatcctcagggggttgcaggaggagtaacaaaacgccgtaggagaagaaagaaatcagagatcaaaagacgtgatcctgatcatccaaaacccaacagaagtggttataacttctttttcgcagagcagcacgcgagacttaaaccgcttcatcctggtaaggatagggatatcagcaggatgattggtgagctatggaacaagctgaatgaagacgaaaaattggtatttcacacactgatctttgaattcttatcaaactctgttacgtatatcgagtttttgtctcatgatctgtttgattttcttttatttctagatttaccaagggaaggcaatggaggacaaagagcgatacagaactgaaatggaagattacagagagaaaaaaaagaatggacagctcataagcaacgctgttccgctgcaacagagacttccggagcaaaacgtagacatggctgaagctgaccttccaattgatgaagtcgaagaagatgacgaagaaggtgattcaagcggatcctcaggcgaaagcgagccacatgatgatcagagcatagaaactgatcctgaattggaagagccatctctgaatccctcaggtccaaacctaaaccctaatccgactgagatagtggtggctcctaaggagaaaaacggcgatgttgtgatggaaacatctccattgaagaaagccgatgagccaactgtggcggtgactgctgagcagaactgaagattcttctcttgtttcttactccccgttgccagtttcgtgttccataggtaaatgttagagagaggaaagggcttcagataccttgcttctggcccaagattatgtctttttggttttttttttggtttttttggatttttcttcggaaacaaggcaagtttatggttataacattttggcataagagaattttttactttcgttattaatgggatatcctgtaaattggtgattaaaatctgaaagggccttataaacttgggcttggaaagcaaatgggccgaagaagtaatccctgtaatatgattttgaaagcggaggagggagacttaaagactttgattgattgatttataaaaggaaccctaagtttccgaactttgtccgtcgccgtctgaaaactctgtagctctctcacttcagctttccaattaaagggaacaaagctttgatttttgccgcagtcagaagcattactttgcaagaacaagtgtgtaaacaaagatg

SEQ ID NO: 22380 - DNA, 3003 bp, Unknown
  misc_feature (1)..( 3003): 2750-1469P.txt file - cDNA_ID_2052959; gDNA_ID_1620771; Annot_ID_167533
ttccggtcagacgccaaattcaagatccgtcagctgttctttacccgtttgctctaccgggtcgagggttttcagcccgacctgttcgaggattcgtcgcagatccttccgtgacggctggtaatctgagtgggtaccctcctcgcccgagttttacttacgatcctggaccatatgagcagcgtcaaatggaatccttgttgcagcagtttataagggagagaaatcctcagattcgtccattaccacgccttggattgggttctcctgttgggttgggtcccattagagcaagtcctcaatttctgcaaccgcgggtgaggtttcttagatgaagtcctcaatttctgcttgtcatgtttcatttgttaatgcttagattctagctaagtagtggaaagattagtggggaaaatgctcgagatgatccaaagtttcttgattggagtcttagtagaactgaatctgactgtaccgtgacttaagaatcatcttggttaatattggatccatttttgtcagagtgattctcattcgaactaatgcatgtagttctagaattttgatcgactagtctagttatacaacaatgtgagttgttggacgtgtctttcatggttttcttataaaccatgtgatagttagtaattggatctagttatctttctattttggttctttgtcctgctatgtgcctgctttactctggtcttgaaaattctcttttgtggaatgaggaagacttgaaaatgcttttatatcttagcaaatgttaagctgttcttctcttaatagttggtttgcacctacttacttttgattattgctcttgctccagtcacattttctcattttcgtaaattttggtacttaggttgccccgcccccaacttcaattctagacactagcaggaatagaaaggccaggtgaacatcaaatttctctactttgatattacctttcttttggtttcactgaaaatattattttaaaaaaaacttgttcaagagacttagttgccttgctgtttcttcttccttgttattagaagcaaggatggggctcttgccgttgttagagggagaaaggtaagcctactatcatatgtactgcttgtttgagaatttggaaaagacatctgttaagtttagattgtaatactattcaactgtttacaggtccgaatcactgaggggtcttcttctctttattcacttggtcgatcgtggttgaaaaatggtgctcacgttggaattcaggttcgcactttatatgctgctgttagagtaggatgttagtgtcattgacgactccgcttgataaaagattcatcggttgtattttcaagatattggtttgtggggttttgattcagaaaacctctcagaatgccaaatttactcgaatttggaaactaaattacttttgatcactcacctatttgcatccgtgctagttagaggattctttcttgatatagttatatttttagaagccaatcttagttaaatgatcttcaattgcatactcaaagcttgttatctgctttgcaatggaaatgtgcatctgcaatctcttgagcgtaaccatatatctgggactaatctaactttcagtttctctgttgacagccgcaaaggagtggtataatgaaacctttgccaaaaccgttacctgtggatttaacaacagagacaagtgtaccagatgatccagatgaagaatcagcggatgaagacaaagaggtttgtgttaagtcttcaagaaccattgattctatctgagcagaacagaagacattagtctgattctttcctgctgttgctaatttcagctcttgaatatttactacatgacgtttgattccactcttttctttgatgatctcaggacgaggaagctgtaaagcaattatctgagaaggatcttttgaaaagacacatcgagcgagctaagaaagtccgtgcacagtaagctccccactattctctctttttgctccttaggtcgtgtagtatttgaaagataaagctccccacaagattcatggattagttttcataatcatcaaagcaaatctagcagaatattttggtaacttgaaaaagcggatttctttctctttcagattacgagaagaacggtcgaggaggatcaggaggtacaaagaaagaataactcttattctggcacaatccgaagaccgatgatgcttgaagaacgactaaaaaagggtaaagttttgttaggaattagcttcatatgactgttgttgatttagcatactagtaccacgtaacaacatacgtgtagtaatagtataggtgtgttcttcttcgtcttctatagattagtaggactactcaatgaatagtgtttcattcttcctaaaactaaagaggaagataaaattgtttccttaaagtcagcttttactaatttgacaataaaaatttcttctcttacacatgtgtcaatcagcgaagtggtaataaataaactttactgtcattcgactaattgtaactttataaacaagatttgagaaaaattgagattttgtagtaaataggtggaagtctctaattggattagaggcttttcgagagagaatcgcatagggaagcggacagagaagataacaaacgctcatatttaaactctctttccgttacatttgccacgtaattacaacaaacacgtgtcatcgccgctaagaactaatttttgtcattgctccacacatgcaactactaaactaccgatgatctctctcgctcacgtttaatccgccatttctgtaaaatcctcttcccttttctgaagtaaactttttcccgcaatcaactcttgctttctatttttctcgattgtttacacttttcattttcagctctctgtttctttctttcacactaaccccaattctagtttcttactctccaagaaacaaagagcaccgatctcagttttctcgagaaacagaggacaaactcagaatg

SEQ ID NO: 22381 - DNA, 65 bp, Unknown; identical to SEQ ID NO: 331
  misc_feature (1)..( 65): 2750-1469P.txt file - cDNA_ID_2052959; gDNA_ID_1563933; Annot_ID_148541

SEQ ID NO: 22382 - DNA, 3000 bp, Unknown; identical to SEQ ID NO: 5211
  misc_feature (1)..( 3000): 2750-1469P.txt file - cDNA_ID_2052966; gDNA_ID_1620771; Annot_ID_167531

SEQ ID NO: 22383 - DNA, 3003 bp, Unknown
  misc_feature (1)..( 3003): 2750-1469P.txt file - cDNA_ID_2052970; gDNA_ID_1620771; Annot_ID_167530
gtatttcattttcttttgctctgtaagcttatttttctcatcgatccaacataaacaatcggaatagaaaataattcatcactctttatcactaggccaatactggactcccctcttagtgacataatttttgttgtctcttgataaccagattcgacagcttgcaaacgagatcaaagaactaactatgaccaatccagttaccatctttaatggagattcaaactccagtggtatgtacaagtcttagtttctcataaaatatttatgtactacttttgataatgtaggaaatgtttcaaatatgtttattttttatgagaaacagagaatgatataatctttgcttttgctcttgtaggctatgcatcttacctggttccagcggctgccgttggagctatggggtactgctacatgtggtggaaggtgtttatctctttaaaatctgtctatttttctctatgtttcatgtgtcttttgttatagttttgtaacatgtggtttaccggtaaactatatatcattgacttctaaggtttacccacattgcagggctggtcgttttcagatgcaatgtttgtgacaaagaaaaatatggctgatgcggttgcctctgtttcgaaacaactagacgatttgtcagacacattagcggtgaacaaataatttttttgagaccttcctctgttatatattctatttcattatgattttttgacctagtgcatttgtttacgcagtcaacaaggaaacatctttctcagaagctagcgaccttggattggaaggtggaagagcagaatgagacatctaaaatgatcttaagtgatgtaaggaacccgttttatttctcactttcttgtattgatgccttattttttccttagacttaagattaggatacttatacattcgtctgagagagatctcctcttgtacatttaacatcttagaagaatttaaaacacatttaggaattccaaaagattgtagagtatttatttattaacgtcctatctctttggccctgaactgtttttcttcacatgtacagtagagtcctttgtttctttcaaattacagcttgattctcatatctgcgatttactccatctatgcctttctttgatattcattttaatgctaatgctcacatggaatcttgcttcaattcaggttactgagatgagatcaagcatttcgcaaattgggtttgattttaagcaacttaatgaaatgatttctggaatagtaagtctcatcattgccctctaatatgcatcattgccctctaatatgcatattttaaaggggctaatatatctttactctcttatatgaaatttttacaggaagggaagattgaaagtcttgaaagcaaacaagtaatttgtctacaaccattagatactacaaaccacttcacgctatcaattttcttaaaactaattgatctcaaacagatattttttttgttaaaattttaggatgtgaccctctctggactatggcatctatgtcaagttgcaggcgttaaagacagcacaagtactaaagtatttcaggtgagtgttaacttacaaattaagtgaaacgttttcttacttatttttcacgtagttataggccttaatgaaaaaaatcttgtttctggctttgtggtttaggatgttggtgagagattacctattgatggaaaaccatccactaatacttctctctctgtaagaatgctactatacctttttccatcatataaatgtgcatttccattctgttgacgcaaaaaagttgcttatagtgaaaaaattcaacgagatggttgatcttgaatttgcatatattcaaggcaatctctcatcaagcttattcgaataaaaattggaacctgaaaatacttgtggtagtagctgttatttgatgatttcatgtcatgatgtttctttggctttctaaaactataaaactatggaaactccagggtctgcggtttctgacggaaggcaaagaggatgcaaatgtaatacacaagccggttatggcgaaagaaattatggtgatgggggaaaaaacaaaagtcactgcagcgggaagaagcagagttcatagagcgtttccaggtggaatatcttgggtacgggatgtttcaggactatcctaatattattttggttgatatacaaagaaattgcttgtattcgtcccaaattctgatactgggactggcaattattttttcatgtaaaaagaagaaaaatctacatatgttattgcatccaccaacaatttggtttgcccctaattatatttggtcttgatgtttgtaaagaaagagtgtgattaaggctttcacgtatgttgatgtcttcattgatttggacttttgtgctcctttttccttttgtgtttggatcaattttgtttgtgtagaaaatagaaagaactaccacagaagacagaactactgtcttgaaacatttgtttcgtcctttctcgtaggattaattgtctttagttggcagagaaataaaatatttcgctcttattgggccttggcccaaaatagatatagagacagcccaaatttaatttaacccgaaatagtccaaccgggtgaatttgacagcaattaaaaaacccggcccggcttcttatattaacaagaggcttggcatcggttaatcggagcttctttcctctcaagtgaagtgtctggatcttcgtcgctcaacgcaaatccctctccggttcatgtaaatttccaacttatttttgtgctcgaattttggttaacgggacaaatttcacacttttacggagtatggaagcagcctttgtcttctgggctgttgaattgcgattcattgtgtatgcccaacaatggtttaattgggaggttccaatgattttttgtgcttttttcttacttaatataaccactgttgatgtttcttctgtgtccttgtatcgccacagtggataagcagcctggggaagatg

SEQ ID NO: 22384 - DNA, 3000 bp, Unknown
  misc_feature (1)..( 3000): 2750-1469P.txt file - cDNA_ID_2052974; gDNA_ID_1620771; Annot_ID_167528
tatagttttagaaagccaaagaaacatcatgacatgaaatcatcaaataacagctactaccacaagtattttcaggttccaatttttattcgaataagcttgatgagagattgccttgaatatatgcaaattcaagatcaaccatctcgttgaattttttcactataagcaacttttttgcgtcaacagaatggaaatgcacatttatatgatggaaaaaggtatagtagcattcttacagagagagaagtattagtggatggttttccatcaataggtaatctctcaccaacatcctaaaccacaaagccagaaacaagatttttttcattaaggcctataactacgtgaaaaataagtaagaaaacgtttcacttaatttgtaagttaacactcacctgaaatactttagtacttgtgctgtctttaacgcctgcaacttgacatagatgccatagtccagagagggtcacatcctaaaattttaacaaaaaaaatatctgtttgagatcaattagttttaagaaaattgatagcgtgaagtggtttgtagtatctaatggttgtagacaaattacttgtttgctttcaagactttcaatcttcccttcctgtaaaaatttcatataagagagtaaagatatattagcccctttaaaatatgcatattagagggcaatgatgcatattagagggcaatgatgagacttactattccagaaatcatttcattaagttgcttaaaatcaaacccaatttgcgaaatgcttgatctcatctcagtaacctgaattgaagcaagattccatgtgagcattagcattaaaatgaatatcaaagaaaggcatagatggagtaaatcgcagatatgagaatcaagctgtaatttgaaagaaacaaaggactctactgtacatgtgaagaaaaacagttcagggccaaagagataggacgttaataaataaatactctacaatcttttggaattcctaaatgtgttttaaattcttctaagatgttaaatgtacaagaggagatctctctcagacgaatgtataagtatcctaatcttaagtctaaggaaaaaataaggcatcaatacaagaaagtgagaaataaaacgggttccttacatcacttaagatcattttagatgtctcattctgctcttccaccttccaatccaaggtcgctagcttctgagaaagatgtttccttgttgactgcgtaaacaaatgcactaggtcaaaaaatcataatgaaatagaatatataacagaggaaggtctcaaaaaaattatttgttcaccgctaatgtgtctgacaaatcgtctagttgtttcgaaacagaggcaaccgcatcagccatatttttctttgtcacaaacattgcatctgaaaacgaccagccctgcaatgtgggtaaaccttagaagtcaatgatatatagtttaccggtaaaccacatgttacaaaactataacaaaagacacatgaaacatagagaaaaatagacagattttaaagagataaacaccttccaccacatgtagcagtaccccatagctccaacggcagccgctggaaccaggtaagatgcatagcctacaagagcaaaagcaaagattatatcattctctgtttctcataaaaaataaacatatttgaaacatttcctacattatcaaaagtagtacataaatattttatgagaaactaagacttgtacataccactggagtttgaatctccattaaagatggtaactggattggtcatagttagttctttgatctcgtttgcaagctgtcgaatctggttatcaagagacaacaaaaattatgtcactaagaggggagtccagtattggcctagtgataaagagtgatgaattattttctattccgattgtttatgttggatcgatgagaaaaataagcttacagagcaaaagaaaatgaaatacctgagcagcaaggagtgcaccgtcatacttaaaaggagtgctttcaactccttgagcaccattgagtaagtcttgaagttgggctattaggtcagacaacctcccatgtctcaatacgatcgaaccagatacaccttggacatgatgaaaacagaaccaagtgtcattaaaggtcattaaatggaacatccaagctagaataactaaatcattcttgctacatccaagctgtattaccatcaaaactacactaacgattgaagattagaagttctggaccattttagcaaagtgatcaatcaatttgccaagataaattcaaaccctaactcttcataaaacaattccctagattagagagtcaaagcaatacgaatcgaatttgattacaacaagcaaagataataaaacaagcatcaaagtgagaaagagacctgcgccgagtaggataaggaccttagaggtctgaacaccggcttgcatcgccatgaattccggttacaagctgaaaaagattctcgattaattctctgttccgtgtcgccaagccaccgcgagagaccaattatgacacccttttgccctttagacctcaattttagctttgatttaccacaaagataaatacttttcaaaacttatgttcttacccccgaagcttccaattttaatcgaactattgtccttagacacatattagaatatttaacaccacttgagcttatatacatatcaaacgttaatatgtacagtatatacaattacatatgtatttatacttttattgccctatagacctcagctttagctttgattgaccagaaacattaatattttaacaatttatgtattcaccccaaacacttccttttgaatcagattaccccagaaggcaatgcaaatcgaatgactaaggttattttagacatttctcaataatccaaaccattacgcaacttcactgtattaacctgttttcttcatcgaagaagatagagagaccaaaacaaaaaaagctttgaatatccgccatg

SEQ ID NO: 22385 - DNA, 3000 bp, Unknown; identical to SEQ ID NO: 5270
  misc_feature (1)..( 3000): 2750-1469P.txt file - cDNA_ID_2052999; gDNA_ID_1620775; Annot_ID_167706

SEQ ID NO: 22386 - DNA, 3000 bp, Unknown; identical to SEQ ID NO: 5270
  misc_feature (1)..( 3000): 2750-1469P.txt file - cDNA_ID_2052999; gDNA_ID_2926205; Annot_ID_202158

SEQ ID NO: 22387 - DNA, 3003 bp, Unknown
  misc_feature (1)..( 3003): 2750-1469P.txt file - cDNA_ID_2053058; gDNA_ID_1620775; Annot_ID_50269
atggttggaatggagcctggtctaagagataagaaaagttttggggaaccaagactgaaatccccttctaccagtttctataattctgtacctcgccacaaatcgtttaaagagacattcaaaggttcaccacgggaaatccctgtaactaacagcaagaagggttggataagttccaaaagttgggctgaagggtcgagaaaccatctggttgccaacgtccaaaatctttctggaagcaatattgaaaccaatcagtctcatgattatgataataatatatctaatggcggacgcaagacgggatatctcactaaatcttcgaagctgttacctccgagtagaagcagatcccctgagtcaatggatagaggtccatcttctgggatggtaaagatttgtctaatacttccatgtctacatgttcctttcttgcccttttatggaaatatgacttgtgttttgtgtgatatcttcttttaaaggcaggaatatatcacggggagaggaatcaaatgaaaatgcagagagagaaattgcattcgactgatgaaccaccggtgagtttgatggttaactatcttaaaaatatagatattgatgtatattttaacaaagtttagaggctctatcaagttcgtgttctgacctttaacgaatgttaataggttgccaaacgagtgaaacatgggtatattcagcaagtatatgcaccaaaatcatcatcatacagcgagattcttgaacgaaaaagccagataaatcggttagtaaccaaccattgtgtaatgcatttattgtcccaaagagatatcaaatcggcttattggatcatactgttatgtttgtaggtctggtgtggaactgccttctagtttaagcggggacgatgagactgacgaatctagctcgtcaatggattaagtaaagaaaggtacaaaggaagattaggaaattccggtttgtatagatatatgatgaaaccggtttaggatgtgaaaatgttgcatcgtgtaattggtaaaagttagagctctcttcattttggtaactaaacggtccccaaagagatacagtgagccagtaatgagcctttttttgtttaaatttgctcctaaaccgttaccggtttgaccgaattgagtatgtaaatcccagtgattacaaaataaccaaagtaaggcccatttattaataaagctcaaattaggcccaaaatattatgatagtccggtttagtcgtaaaaggcggttcggaaatgtgtgactaggagatttcgtcacatgagaaaaaatcagagccgttgactagttttcgtagaaagtatgtggtacaattttgattcggccaaaaaaggtttttttctttttcttttagggttagcgttgctttgcctcaaactcaaattttgaagataatttttttggtttctctgctactgatttcgaatctttacgcttaatcaattattcatctggattttcaaatccaatccttttcctccctggtaagaatctctcttcttcttcttcttctctctcacgacgattccactgttctccgattctgtgttagttcctgcgatattttccatcacttgttcgtgtttcgttattacgggtttgtgttttgtgaacttgttgacctttgtgtctccgtaatttcgtccaacggttgatgtttttgattgctgattagatttttgtcggtaggtattgaaaaagatgatctttatggattttgttttctgtttcttctttcctttttgtaatctgacttgcaagctttttgctttttttgtcggtcggtgttaaaaattgttccttttctcttgttcaattgtttcctcaggtgaccaagtaattggggattaacaaagggactggggctttattaagctcgaaacaattgttcttcactctggccgcttctgcaaagtcgtgtgcttctcgcacctctgcgcaggtgtggggtggccttgaagtggtgacttcactctgtcttccaaggatttctctagcttctatcatttggaggctccgtcgtgtttctgagggtcttacccttgattacggctaacatttactacgcccactataccacctcttaagcttttataagaactttttattcgtgcaaaaacttaacttggatcttaattgtttctagtttagttgtggttgtaaagtaaagaaccgtttttttgtggtttggttttgcttttttagtttccgttggtgatgtagttcgatgttattaagtttgacacaatggtcaggttttcatgcttcaacgctcacatccaccgccatagacctaaggtaacttgaaccatcattgcctcttgtgtctttagaacgatagttttacattctctgtccaagactcctttgtccaataagagaatgctaatttgtttctatgttctggtgatgcagaaatctgttgaaggattttcagaacgagtgatcaaagaagatgggtctaaatcaaaaggattgagctcaattatatttgggagaaacattgcttctgttagtgaaaacagcaagccagccgctgttgagcgtgtctggaaatctgaggaaattaagcccagtggcattcttgagcatggtattgggacgcaccaggtactgcatctcaagaaaagtcaatctcatggaaatgaactatacttggatgggcgggatgccacagagaatggaacagacgatgcatcagatcggattacttctccgaattctcttgaacaacagagtggtattcacgaggcaggcagcagcaagcgtgtagatgaaagtcctaatctgtatcagcaaggtcctcgagcttctgtttctgcttaccagggttcaaatcaagcactctgtgggtctattttctcggttggagatcttcatcatactgataaagacagccgtcaactcgatgatacctccttatatggtgaacagatggacaactcaaacagtcaaacacctcatgattcacctttgatg

SEQ ID NO: 22388 - DNA, 3003 bp, Unknown
  misc_feature (1)..( 3003): 2750-1469P.txt file - cDNA_ID_2053058; gDNA_ID_1620775; Annot_ID_167681
gtggaaagttctagatatgttgcacataaagacgttattcagcatcctcagttcatgagaagctatgggtataataagccttcgggatacttgaaagtgaagggagagagtgagaattttgctatcactgccgtaaagagacaattaggaagacaataccaagaggatggtccacctctgggggttgaatttgatcctcttcctcccggtgcatttgagcctcagactaatcctatagttcacggtgagtcatgataaaatgtttcaactttacctttaattttctggtttatgatgttatgagtattgagtaagtggctcagagaagctaaaaccatcttcttcgtgtgtcagattgtgaatgcctttacccatgtccagtcggatttgattgctttttctatcaactgttttgtcagagccaatatatgttgggaatcagagacggcctcaccttccacatttacttggaacgaggaagagctttaatcctggtcctgtaagtgaacattttctgtatactacatacccatgaagataatataaactagaatcttagtctgccatcacattctttggctaaattatcttactttctttgaagtattattaatattttcgttttctgtcttaatgtctttatagagctatgaattagctcgtaaatcaaagttgcattcgccagatccagattcagaggatgatgagcatgatgatgatgacaacataatggttggaatggagcctggtctaagagataagaaaagttttggggaaccaagactgaaatccccttctaccagtttctataattctgtacctcgccacaaatcgtttaaagagacattcaaaggttcaccacgggaaatccctgtaactaacagcaagaagggttggataagttccaaaagttgggctgaagggtcgagaaaccatctggttgccaacgtccaaaatctttctggaagcaatattgaaaccaatcagtctcatgattatgataataatatatctaatggcggacgcaagacgggatatctcactaaatcttcgaagctgttacctccgagtagaagcagatcccctgagtcaatggatagaggtccatcttctgggatggtaaagatttgtctaatacttccatgtctacatgttcctttcttgcccttttatggaaatatgacttgtgttttgtgtgatatcttcttttaaaggcaggaatatatcacggggagaggaatcaaatgaaaatgcagagagagaaattgcattcgactgatgaaccaccggtgagtttgatggttaactatcttaaaaatatagatattgatgtatattttaacaaagtttagaggctctatcaagttcgtgttctgacctttaacgaatgttaataggttgccaaacgagtgaaacatgggtatattcagcaagtatatgcaccaaaatcatcatcatacagcgagattcttgaacgaaaaagccagataaatcggttagtaaccaaccattgtgtaatgcatttattgtcccaaagagatatcaaatcggcttattggatcatactgttatgtttgtaggtctggtgtggaactgccttctagtttaagcggggacgatgagactgacgaatctagctcgtcaatggattaagtaaagaaaggtacaaaggaagattaggaaattccggtttgtatagatatatgatgaaaccggtttaggatgtgaaaatgttgcatcgtgtaattggtaaaagttagagctctcttcattttggtaactaaacggtccccaaagagatacagtgagccagtaatgagcctttttttgtttaaatttgctcctaaaccgttaccggtttgaccgaattgagtatgtaaatcccagtgattacaaaataaccaaagtaaggcccatttattaataaagctcaaattaggcccaaaatattatgatagtccggtttagtcgtaaaaggcggttcggaaatgtgtgactaggagatttcgtcacatgagaaaaaatcagagccgttgactagttttcgtagaaagtatgtggtacaattttgattcggccaaaaaaggtttttttctttttcttttagggttagcgttgctttgcctcaaactcaaattttgaagataatttttttggtttctctgctactgatttcgaatctttacgcttaatcaattattcatctggattttcaaatccaatccttttcctccctggtaagaatctctcttcttcttcttcttctctctcacgacgattccactgttctccgattctgtgttagttcctgcgatattttccatcacttgttcgtgtttcgttattacgggtttgtgttttgtgaacttgttgacctttgtgtctccgtaatttcgtccaacggttgatgtttttgattgctgattagatttttgtcggtaggtattgaaaaagatgatctttatggattttgttttctgtttcttctttcctttttgtaatctgacttgcaagctttttgctttttttgtcggtcggtgttaaaaattgttccttttctcttgttcaattgtttcctcaggtgaccaagtaattggggattaacaaagggactggggctttattaagctcgaaacaattgttcttcactctggccgcttctgcaaagtcgtgtgcttctcgcacctctgcgcaggtgtggggtggccttgaagtggtgacttcactctgtcttccaaggatttctctagcttctatcatttggaggctccgtcgtgtttctgagggtcttacccttgattacggctaacatttactacgcccactataccacctcttaagcttttataagaactttttattcgtgcaaaaacttaacttggatcttaattgtttctagtttagttgtggttgtaaagtaaagaaccgtttttttgtggtttggttttgcttttttagtttccgttggtgatgtagttcgatgttattaagtttgacacaatg

SEQ ID NO: 22389 - DNA, 3003 bp, Unknown; identical to SEQ ID NO: 22387
  misc_feature (1)..( 3003): 2750-1469P.txt file - cDNA_ID_2053058; gDNA_ID_2926205; Annot_ID_141695

SEQ ID NO: 22390 - DNA, 3003 bp, Unknown; identical to SEQ ID NO: 22388
  misc_feature (1)..( 3003): 2750-1469P.txt file - cDNA_ID_2053058; gDNA_ID_2926205; Annot_ID_202140

SEQ ID NO: 22391 - DNA, 3003 bp, Unknown
  misc_feature (1)..( 3003): 2750-1469P.txt file - cDNA_ID_2053079; gDNA_ID_1620775; Annot_ID_167675
tttaggtttatatgtcgttcgtccaggctctgtatggtggaggagggtggccactgtcggtattcctttcacctgatttaaagccgttgatgggtggaacctactttcctccaaatgacaattatggacgaccaggattcaaaactctccttaagtaagtaaaccctttttctcttattgtacaaaagcattctaggcttgtaatggtgcaataaaaaatagagtatgtatgtagaaacaaacgctcttggcgaagactatagttgattcgtttatgttctccatgttttctttgggtttggttcaggaaggtgaaagatgcgtggaacagtaagagggatactctagtgaagagtggtacatatgctatcgaagaactctctaaagctttatctgcaagtactggagccgataaattgtcagatgggatttctcgggaggctgtgagtacatgtgcaaaacaagtatgattcgactcgcggactctagaaaaatatatatgattgatacatcaacatgaaaaggtcttctaacagtgagtgtttgtgttaaagctttctcggagctatgattcggaattcggtgggtttggatctgcaccaaagttcccgaggcctgtcgagatccagctgatgctttatcattacaaaaagttgaaggaatcggggaaaactagtgaggctgatgaagagaaaagtatggttttattcagcttgcaaggcatggcaaatggagggatgcatgatcacattggaggcgggtttcatagatacagtgtcgatgaatgttggcatggtaaaacttcaaacagtatcctgtagtatcaaggtgatgaaaaatattttgagattgacgcattttttgctatttgtctggtgcagttccacattttgagaaaatgctgtatgatcaagggcaactagctaatgtgtacctcgacggttttagcattaccaaggacgttatgtattcttatgtggcaagagacatccttgattatcttagaagagacatgattgcacctgaaggtggaatattctcagctgaagatgccgatagctttgagttcgagggggcaaagagaaagaaagaaggagctttctatatatggacaagcgatgaggttcttttctctgatatatgatatattcatgagctgactctggtttccctctgcatactgacatttgttttgcgtgtgtgtttggtttcaagattgatgaagtcctcggggagaatgctgatcttttcaaggagcattattatgttaagaaatcaggtaactgcgatctttcgagcaggagtgacccgcacaatgaatttgctgggaagaacgtgctgatcgaaagaaatgagacgtctgctatggcatcaaagtttagcctctctgttgagaagtatcaggagatattaggtgaatgccgaagaaagcttttcgatgtcagattgaagcgacctaagccgcatctagatgataaggtaatactcttcttggaattctcatgttgtcttctctactgtttcttcagatttgttaaccatttaagatttctttcatagataatcgtgtcttggaacggtcttgttatctcgtctttcgcaagagcttccaagattcttaaggctgagcctgaaagcaccaaatattatttccctgtggtgaatagtcaggtaatgaatgctacaccctttcctttaatttcttctttgaccgttttgtaattagaagactcatttttcagccagaggattacatagaggttgcagagaaagcagctttgtttatcagaggaaatctctatgatgagcagtctcgcagattacaacacagttacagacaggggccatccaaagctcctgccttcttagacgattatgctttcttgatctctggtttactcgatctttacgagaatggaggtgggatcgaatggcttaagtgggcgattaaacttcaagaaacacaggcaagtgagatctttactagctcgatttgttaaagttcttgattttggctaaaaaagttaaaaacattttaggatgagttatatctggaccgagaaggaggagcatacttcaatactgaaggacaagacccatcggttcttcttcgtgtaaaagaagatcatgatggtgcagaaccttcagggaactctgtttctgctatcaatcttgtgaggttagcttccatagtcgccggagaaaaagctgaatcctacctcaacacggcacatcgtctcctggtaaacaaacaaacaactaatcccatttgctattcatagaaagagattattgagtctctttgttgttgtttttgcaggcagtctttgagttgaggttaagagaactggcggtggctgtgccattaatgtgctgctccgcagatatgatctctgttccgtcgaggaaacaagttgtattggttggttctaagtcttccccagagcttaccaacatgctttctgcagcacattcagtctatgatcctaataaaacggtaagagcttaaaaaattatccaaatttctagattcaagatttgtgacttttggtggttttactgagcaggtgattcacatagatccctctagttctgatgaaatcgagttttgggaagagcataacagtaatgtagctgagatggctaagaagaacagaaactcagagaaagtggtggctcttgtttgtcaacacttcacttgcagtcctcctgtctttgactcttcttctctcactcgcttgctttccaagtaaacaaagatcattccatgtttaatagttgcttgtactgtaaggaacagatcaacgttgttctctctgttacagtcttacagagtagataaataaagaagagaactaaaccgagtatgaggttttttggttgaactaaaccggaaataaccgggtttggtttggttaaaaaaacagagctttgacgattccttatcatcttctatcttcagcaaaaaggtgaaaacttggattcgatcgatcgctgaaaatg

SEQ ID NO: 22392 - DNA, 3003 bp, Unknown; identical to SEQ ID NO: 22391
  misc_feature (1)..( 3003): 2750-1469P.txt file - cDNA_ID_2053079; gDNA_ID_2926205; Annot_ID_202134

SEQ ID NO: 22393 - DNA, 3003 bp, Unknown; identical to SEQ ID NO: 20730
  misc_feature (1)..( 3003): 2750-1469P.txt file - cDNA_ID_2053142; gDNA_ID_1620783; Annot_ID_168048

SEQ ID NO: 22394 - DNA, 3003 bp, Unknown; identical to SEQ ID NO: 20733
  misc_feature (1)..( 3003): 2750-1469P.txt file - cDNA_ID_2053165; gDNA_ID_1620783; Annot_ID_168043

SEQ ID NO: 22395 - DNA, 3003 bp, Unknown; identical to SEQ ID NO: 20734
  misc_feature (1)..( 3003): 2750-1469P.txt file - cDNA_ID_2053176; gDNA_ID_1620783; Annot_ID_168039

SEQ ID NO: 22396 - DNA, 3000 bp, Unknown; identical to SEQ ID NO: 5548
  misc_feature (1)..( 3000): 2750-1469P.txt file - cDNA_ID_2053227; gDNA_ID_1620801; Annot_ID_168685

SEQ ID NO: 22397 - DNA, 3000 bp, Unknown; identical to SEQ ID NO: 5550
  misc_feature (1)..( 3000): 2750-1469P.txt file - cDNA_ID_2053237; gDNA_ID_1620801; Annot_ID_168681

SEQ ID NO: 22398 - DNA, 3000 bp, Unknown; identical to SEQ ID NO: 5551
  misc_feature (1)..( 3000): 2750-1469P.txt file - cDNA_ID_2053243; gDNA_ID_1620801; Annot_ID_168680

SEQ ID NO: 22399 - DNA, 3000 bp, Unknown; identical to SEQ ID NO: 5554
  misc_feature (1)..( 3000): 2750-1469P.txt file - cDNA_ID_2053260; gDNA_ID_1620801; Annot_ID_168674

SEQ ID NO: 22400 - DNA, 3003 bp, Unknown
  misc_feature (1)..( 3003): 2750-1469P.txt file - cDNA_ID_2053264; gDNA_ID_1620801; Annot_ID_168673
acctctttcagaattcctctgagaacatcagcgttactcaaagataaatcaaactccactttttcctctaaagcagaagcaacaccaacaccgttagcatcgctcatgcttggatcaaacatgaactccaagactctaagagacaggacttcattaatcctcttcccatagtcatcagagtactgataaccaatgttcatcaaatctgaaacaaggaacttcatattaacacttgctctcaaaatacacaaaaaccgtaagaggagtttcgggagttaccgagtaagcagcttagatccttgacaaatttggctacatattcaatacaccataaccattcagctatttgtgcgggtcgagaagaatactcatccatgagatcctcgaggctcaaatcagaaccaccatggtcatccataagagctgcgttacacaaaaatacagaatcaataaaccctaaaccattttctccttaaaaccctcaaatcgatcaattactaaagacaagcctagagatttcaacaatcaatcaaaaactagcaatgtcatacacttagattcaacatcactgatacaaaatcgctatcagacataccatagaaagagaaatgtaagtaagaatatgaaagcgaagcatcaattggctaaaacgtagaaataaggaagatgaattttacaaaccctagaagtgagttagcgcgaaattttccataatgaaaatagaaaaagaaaagcccattgatttcgcgaaactgccgccttaaattttgaaacttttccttaagaaaatttgaaatcgagacattcttctccggtcaccatgttggagtctggttagtggggaacttgggaagacgaaaagacagctgtgtatattgggccgtaaaagggccttactcgtttttctataactgatcagcaccgttgaaatttaaataaaatcatcacgtaggcttattaactaaaaagctggcataatatttacttaggccgacgaaaaagctttattgggcctggtccattaatatgtctattttctatgtctattatttccaaagaaaatagacatattaatacatgaaataaaaatagacatattaatacatgaaataaaaatagacatattaatacatggaaaatagactcgcatttatatgttgtctattttcgttgatccaaacaaaaaacaaacagaaatcaattatttaaaatatgcaatacaccaaccaacaagctacacgagtgttaaaaactatatgattaattagatatatagccagccgtaaaaaaaaaaaaaaaaaaaaaatagatatagagccaaattttaatttaaaacgtgaggcaaaattataattaaggaatgcagttttttcatgggctattttttttaagatagcagaagtaatgtatataaattgtgatcatttgaaaaaaggatttaatgtataatttgactaatcctgcgtactaattaaaccaatgacagtgaaaaagattataagaaataaagtaatagtaataaacaaacaagaaagacgcgttgcgaaagctgcgttcacacggacgctaatgatttaagatcaaatcatcttggagatgtatatctacacactacacttgtttcttgtcgactatatgtgaccctttttataacttacttttttatttgtctgtatcattacctcgaaaagaaacaaccaaacaccaatcgtcactacatatattttacctttaaaccttgacatgtgaatctaaaaacataacttatacgtatttgttccgtttattccgattctgaacaacttattaaaatgctacaaatactcgacatagaagtcaagctatgatatcgagttagagaggatgtaaacaatgcaattttatgttctgatgttgatgtgtatgtgtatttaccgacattgttttgtgttatctttatgcgtatacgcgattttgtagtcacatcagcttaatggtgtatgtgtgaaaacaaaagcaaataagagaaaaagaagaggcaacttctgtgtttcttatgtagatgcttttattatgtaagaaagagacgttagacattgctatccaaaattaactaatcagtcaaacaagtttttgaaataaagtcatgttcatattatctagttttatcacctaaactggaaatttttgatagggttaattagccgtgcggagtactacttccaaagcttaaattttagattgctaattatgataaactaaacgttagtgcgtattaccacttttcatgacaaatggaatgattgaaaattcgaaactaggaacaaaaaaaaagaagctgatttggtataatcagttgttaaattcatgtacaaatcgtatatatggttggagctagctagactgcgatcggtttgatatgtgatcaagtcataaaataagacttttgaaactctagtttcttcttcttcttgagacgcgggttaaattgtcaaagtcacaaatctttttgttttctgttttatggaaatttatatgcaattcttatggccaattttgattgcaacaaacaaaatttaaatgcatcacattcaattaaaccacatcaacgttagttaccatacatgtatggactaaaacatctgtagttgatttatagcgtagacttcctatggcttttagtatctaaaattctaattaatttaatatccaccaaaatcactataatgttttaacctttttaaagcataccgttgcaagtaatctatttacgtgttcctccgacgacttcgtaaacgatgctgttattcgtcgttttcatacttttggaataatccgataatcacagcatcacgttctttctcttcctctgttcaagattaatttatataataagttttttgattaatcatcattacaagcaatcaaccattaattatttatttctatattagtagtatatatacaaatgccttttctcctacaaaagactcgctgcttttactacaagaggaaacagagatg

SEQ ID NO: 22401 - DNA, 3000 bp, Unknown; identical to SEQ ID NO: 5543
  misc_feature (1)..( 3000): 2750-1469P.txt file - cDNA_ID_2053288; gDNA_ID_1620801; Annot_ID_168665

SEQ ID NO: 22402 - DNA, 1482 bp, Unknown; identical to SEQ ID NO: 9433
  misc_feature (1)..( 1482): 2750-1469P.txt file - cDNA_ID_2053370; gDNA_ID_1972120; Annot_ID_178919

SEQ ID NO: 22403 - DNA, 3003 bp, Unknown
  misc_feature (1)..( 3003): 2750-1469P.txt file - cDNA_ID_2053370; gDNA_ID_1620803; Annot_ID_168740
tgaaaatatgagattgattatttgtataacacggaaaatatgagattgattctttatattacaatgaaaatgaatgattcaaaactaaagatcatagtgtaatatagtttagcttagaaaataattaaaacgattttatttatttatttagttttctaaattttagtttagattcagaaaataattgtttaatttccttagaagatgataaacatatatggaagatttgaatctctatatattttaaaaatcaatcaataatgtcaatataattaaaggatagattagaaaaaagtttcttgaatgctaaataattaatttgttatttataaacaaaatattaaatgctgtaaaaacgaaatattaaataaatatggaaagaaaattctaccttaaaatattttgtactattaaaaccgattttttttttgcagcaaattaaaaccgaaaattaataaatacttaagagagattttaggaatgatttttttgaagtaatgttagactttttttgaagtaatggtggatttaatatagagacattttaggcaatatttttgttaggtaaatatttgatttaaaatgtcgattgaaaaaaataaattcagtggcattgagtcgtaaataagttctaagtccaggatttatttgttaaaatgactgcaaaaatgtatatatagatatgaatcatttgttttaactctacactacatataatggtcctagctggcttgtactaaatactgagaaccctagctaaatgctgcactttgattgatctggttcaaatcaagatgattatcccttgatcagttctttgattgatctggttaaaatcaagatgtccataggattttcgcaacatagcccttgcctaagcgtctaggcgcttagacaaaaccaacacatacattacatctacgaaaaattatgtactctgtatatataaacaataaaatacatgtagagagagagagacggaccctacgagtgggagaaacatgagaagagagtatggagaagagatgtttcatgcgcattcgtcgttctttctctctgaggtttcgttgttcccgtaatgacgatgcgcttccttctcctatttctctcgctctttccattcttcttcttttccttttttaggttactatgtttaattccctctttccaaatccatctctccctctataaatataaagagatagagagaaagagccgcgtaattttagatgaaaatgatgtttttcaaagaaagtcatggcttttctggttgcgtccatgagcttacacactacttaatttatacatatatatgcttcttttactttgtaagttccactcttagagatactaaacatgtccaatatgttttttacttacttggtaaggttttgttggacacatttctagaacctagatagtgttacgctaggttttgttctagtgaagcttgtagaaaatgtgcttatcaaaatcatttcagcagaacatagtaattaaattagtcggattatatgtgatgaattcttcacataagtaccatgtttggatcgacaaaaacaacaagggaatttttttgttataccatgataattatgttgatcatttgtaataggctagataaaattaaagatacctttaaatgataatgtaacaattccatgtttaattaataggtgtccatatttattatccgaattacactatacaggtcacatatgctaagacaatttggtgtcaaaaacgaagaatctaagattattcaacaagctatcattattccttaccgatataaaagactttgaactattttttggccgtaaagctgacatatttcaccggagatgtcgttcaattatacacttgaccaagtcttattctaataacaaaaataataattatacacgtgaccaattctagattgaactttctaaccaattctacatgaatcgttcaccgaataaaaacaaaaacataaaattaaacctcgcaaaattgagtcttggagcctttgctaatttcttgaatactaaaagcagatcactgttgatctacatataattatttatttctgttgttcgttatttatccataaccaaaccatgattagaactaaatcagttctgtggatgcggtaaaacaatctcttcgtcgaatgaccccaaccaaatattcaaatgtacacttgctaaaacccggttcattggtagtccggtttggttcgtagtatttgagtcaatttcatatccctagatgttatgcagaattttgccacctagaccgaacagagcgttttcaaaacttggaaaggaaaaaacacaaagcatttagaacatgatggaacacatgttagccgcaaagaagtaaaagaagaaaaccttcattttgtcttctttccttgttttgcaaaatcgtccaaaggaataacttgtgtatatttatctgtttttgggtataaaagatatatatatatatatcgcctagtcgtcgctgcttgttgttgtcaaggcacacatgtttattctttatttttgtcaaatatttgaatcaagatcagctactattctaagaaactggctatttctaaaataacactcacgaattagccattatttataaaatggtaacggtatattcgagattccagtccatacatgttattaataaagaaagattggatctccatataaaaaatagctgtctcttacattgtagcactagctaaagatctttcaatactacgtacctagtcatacaattctttgaatatggttttaaattgtatgtgaatattattaagtgagaatagtatcgacataacaagtatgaaatcttttatttctatatattttatttaacaacctataacaaacatttcacttcaaattctcactatatgtagtccatcatcaactactttcttttcgcatatctttgaagtttttggttttactaaactaactctatcataaaaggagaaagctttaaatttaaccagaaatg

SEQ ID NO: 22404 - DNA, 3003 bp, Unknown; identical to SEQ ID NO: 20764
  misc_feature (1)..( 3003): 2750-1469P.txt file - cDNA_ID_2053385; gDNA_ID_1620803; Annot_ID_168735

SEQ ID NO: 22405 - DNA, 3003 bp, Unknown
  misc_feature (1)..( 3003): 2750-1469P.txt file - cDNA_ID_2053402; gDNA_ID_1620803; Annot_ID_50515
acaaaccacccgatttgaacagaaatatcactgagatatttggaaagttaattaacatatatagaggtacaatctctggtgtttgtattctagactactcgcttatagtaagtaagtaacaatactctttcttttttttcaaaagctttgggtgaagatagacggtcctttagctattacaaagctatccccgtcattgaaaagttccccactaggattgaaagcgttgatcagctcaaacacctccctggaatcggaaaggcaatgagagatcatgtaagttgagaaatgcttcaaatgttttgtctaggttctgtgtgtgggtgtcaaaactgcaaacacttacccttttcctagtgcatacctataacctttgttttgatgtatttctgtgagaacaaagtcttattcttctacctgaatttggcagattcaagagattgtgacaacagggaagttgtccaagcttgaacattttgaaacagatgagaaggtaattttgaagtccttggttatagttattttgctatctcccattttcaattagatacaagctcacatgtagaggccatttgcttttctcttgttcctttttctctttaaagaaaaatactgtcaatgaccgaactggagctagagatgtctgatatgttttgtttaccactataaatgtttcattactatggttgaaggttcgtacaatcagtttgttcggggaagtttggggtgtcggtcctgcaactgcactcaagctatatgagaaaggacatcgcacactagaagacttgaagaatgaggattcactaacgcatgcacagaagttggggttgaaatattttgatgatatcaaaacacgaattccacgtcaggaggtgcgattcttaaacttcaacgtgaattttgtttgtctttattatccttcttgtaattttctcctcatatttcttcactttctgtattgtaggtgcaagagatggaacaacttttacagagagtcggcgaggaaactttgcctggcgtatgaactattcagtttatcggtctgctccatatttgggtgataaaagtttagtgaaatcctaaccaacatctttactgcaggtgaatattgtatgtggaggatcatatagacgtgggaaagctacttgtggagatctggatatcgttgtcacccatcctgatggacaaaggtacctacaatcttctttcctcatcttcctgcgttagtttcctgtaacaaagtttacttaaactgttttttcttattgtcctgaccagtcacaagggatttttgacaaagtttgtaaagcgtttaaaagaaatgaactttttaagggaggatctcatcttcagcacccacagtgaagaggtaagatgatctgataaaattatttaagagaggatctcatcttcattgaaaacacattacttcagttgtttcagtatcttataaaatgatctcttttagcattagataaagctttgttctctcagagttgcatgtgtaacaaaaattcttgttcaatcacagctcctcaatgatttcccttattgtgcagggtactgattcaggcgttgacacgtattttggtttgtgcacttatcctggtcaggagctacggcgccgtatcgattttaaggtaacacctgaaaactcctaatgtcacacaatgcagaaaagaactaagtgggttagtcaaagataaaaaggacaataccatgattgattcagctatgtctaggttgatctcttcccggaagatcattcaataaatagtcttttttcataggtctatccaagggatatctattcgtttggactcatagcctggacagggaacgacgtgttgaacagaaggtatggatatgatttcatttgtatacatgtctcactaaacacatttgttggtagataaagaacacagcatatgtatatatatatgcgatgataactgcaggctgagattgctagcagaatcgaaaggatatcgacttgacgacactggactattcccagctactcacagttctagtggtaaccgggtaagtaagggagaaaagtgaattaacttgatgtgaattcttgggttttaaagtgaaagaatgattatgttgaagctgtgataatgtttgtctctcagggtgctagaggaactgcaagtctgaaactctcaacggagaaacaagtttttgatttcttaggatttccttggctcgagccacacgagaggaatctctaaggcatcacaggcacacagcctttggtactaaattttttttttttctttttgaataggttctgtatgtaagtaatcggttcctttttgtaattgcatatccatggacaactgatttagatgttacatataatgcaatgcaatgtacttgtattagaaaccattgcatatctttaaggtaaactaagaaaacctatggtactgaggaaacttgggatctcaatttttttttaaaatacaattcctttactaaataattaattacacgtgtcataagatagttggattaagtgtggaaataagagtgtcaaatgtcccacatcgaaaagccagcagaaaaccaatttgtatatataaggacacaaaagatagatggtcacgaccttacttgaacaggatctgttctataggctcgtacctctgtttccttgatttctaaggagacaggccctaaaccctggttgatgaaccatgaccgtgcggtcagagcgtgattgatggctacgatcgtcttcggacgcatccggtgctgtagaggatcgttactcggcttggtcttccttgccggggtggtcgcacggcggtctgacaggttctttttattttaccctcggtttttttttttttttttttttttttttttcaccctcaaaactttcaatttcttacattttcaccctttaattgaaacctcgctaaaaccctcagctgttttattgcagaaaacaagagataaggttgaagagtgaagcaaagcttagtaatg

SEQ ID NO: 22406 - DNA, 3003 bp, Unknown; identical to SEQ ID NO: 22405
  misc_feature (1)..( 3003): 2750-1469P.txt file - cDNA_ID_2053402; gDNA_ID_1620803; Annot_ID_168728

SEQ ID NO: 22407 - DNA, 3003 bp, Unknown
  misc_feature (1)..( 3003): 2750-1469P.txt file - cDNA_ID_2053495; gDNA_ID_1620806; Annot_ID_168850
gtgtctggtggagtgacacgtgtaacttctctctttgcgctgttgagctccacggtgtaaagcgcagaccaattcttgaaataacgatcaggttgctcgtgagcagagatgaaatagagtctgttgttttgagtgatgataggacggtcgtggaagtagctctctggagctccgggaatctgctcgggcttagaaattccggatcgggttttgtaaatcctggcggatccgtttctttccgaaacaaagacgacatcatcgcttttatcgttgacgaattgagcgttgaagttcacggaaacgccgtctgttaaacggcgttcgacggaggtggctatgttgagagagaagacgtcgaagccgtagtgagttcgaccgacggtggtgaaaatgatagtgcctttgggagtttccattgtcgagtttttgatgaattgttggtggtaagtgattcgagtatttatagaaggttgtggaggtgtttgactatttgactgagtgtgaagtgtgaacggaacaaaactgatccgtacgtgcgtgtgtaatgacgttgcagtcttcataggatcttttatcgttaattacgtggaaaatcgacgcagaagagattcatgtatgtgtaatagaatgtgagaaaattggttttgaatactaaacagtggatttgaccaaagacagagaatgagctaatgaagttgtgacttaacaagcaaaatcgctgtcgtatacaccatgtgtaatatctcttctagttttcaccaaccaagtattaaataaccaacaagaatacaacatcaagcaatagaaggattgggttttccggcgatcagtaaagtattttccggcgagatgcttgccgggatatacttcactagctttgaatttaatccatgtttcttaacccacttcatcctccctgcatcgatgatctgtttgcatttgaatcctaaaacagctctttccatgggtttcattttcttcacaacttcctccacgctgatcaaagaagcatctcttacttctccttcttcctcctcctttgcactgcatcagaagaacaatcaaatatgaaacaacttatatgcagtaacttctttatcatctttaaatccaagaaaatgttactttgaatcaagaaggtcaatgtcatcaacaccgggaagcttggaaccgtgatcatcatctactgcccagctagtgaacgaagtcatgatatggaactcgtccttggaaatccccaggctaaggatatattctttatctgagagacacataaccatattcttgattaaatagagaagttatataataatctgatagatcaaagaagtcacagtgactgtgagtttacttatgtagcttttccattgggaaagatgatggcaacaagtcgcaatagcgagacctctaagtactgggctttcaccatcttgtctggataaacaacatcttaagctcaaatctattatcgacacataagaatgaacatcaattagcaaaaccagatgctataaatgaagtggaaatctaatagtgaaggagcaaagacataagcatgtagtgacctgttgcaggaccacagagatgtttccctacggccacataaggaacaccgtgcaaagattcaaccgcgttaaggttcaaatcctcaactgaaaacacacaaggttttttccatcattaatacataacctggaacaagtaaacaagaaaaggtactagatttacgggaaccttactatcgattctcatacgctctaatactaagctctccttttgcctcaatgacctatcagcctatatgcgataaaacaaatgtggactgaaaaacaagatagattactaaaaataacagaatgaacacaaactagcaagcttaaccaaccttaagcttgtaagatttcctctcaactagatacacttttttgatcccatagcaatctgctagcatctgtgttaagtatcctctcccagcgccaaattcaacaaccgctggcgcagtattatcgtctttctcttccagatcgctttcgcaacattccacatttatgttgcacctcttcaatacaccaatctcttccaagttaccaagaattgaaccttgctgcaaaacatgtttctcttgaaatggtaatttcctgccaaacaatatgtatcagtcccgaaacttctcctcgccctatccatacccaagaaccaaagctccaaactattctaaccatttatgatttacctatctatctccttattaaaccatatgttacaagcttcaggtgacaaatacgaatcttcgatatctttacaaataccgccatgaacatcctcaattttcttaataagctgatgaaacttagaaacactcatactatagagcagatttctcttcatctctgaagtaacaagagaacaagatcccatcttttcttcttcttcgtcgttcccagcattaatacccttctgataaaatcgttgaccagacaattctacagtttgtttaagtaaaggacatctctttacatgccattcgagattctcctgcaacacagagctaacaaaattcgaatcaaacagttgctacaatagcagaaaaattgcaaactataacctttgaaaaaaaaaacaaagtatttgactcactgagaaggatcaatagggcatggaatccattgaccttccaatctctggctatggtttccacaaaacctgtttgataactttgaaaaattagctcctcactaatttgaacagaagaaaaaaacgaaactttactctttcacttacatagaactctcgattcgagtattcgcgcatgatcttttcttcttcggaagccagaaactgcatcgattgctacttttcgcctccattctctcagccagagttttgctcttgagacaaaggagacggaggtcttcaacgggtcctaaaaagggctttttttggcccattaagagcccatttaagtttaaaatcgaatcaatctaagcaaccatttgaaaaatg

SEQ ID NO: 22408 - DNA, 3000 bp, Unknown; identical to SEQ ID NO: 5608
  misc_feature (1)..( 3000): 2750-1469P.txt file - cDNA_ID_2053503; gDNA_ID_1620806; Annot_ID_168847

SEQ ID NO: 22409 - DNA, 3000 bp, Unknown; identical to SEQ ID NO: 5608
  misc_feature (1)..( 3000): 2750-1469P.txt file - cDNA_ID_2053503; gDNA_ID_2926172; Annot_ID_199564

SEQ ID NO: 22410 - DNA, 3003 bp, Unknown
  misc_feature (1)..( 3003): 2750-1469P.txt file - cDNA_ID_2053559; gDNA_ID_1620810; Annot_ID_169012
agggaggtcaggatctttacgttagactagccgctgctgaactcggttagtttctttcttatttgcatttactaaagtggttcttactttttgttttgattaaaaagttatgacccaaagtcaatatatcttcccaatctgcggaccaagtcatgtaatattgtccctctcgaagcaaagttcaaactccctaatctatagaggctttggtcaacaaagtacattcttgatgtttggtcaatttgtttagttttttttttttgtcatctgtttttaattagagatcaaaagattaataagagtttagctagatccaataccattataccaaaaagaatttttgtttaagttaaattaattattttgtttatttttcgtattaattttttttaatcaaacgtacaacaaaggatatttttcgtatagaagtaaatatatgcctcgtttttattgcagaggacaagagaatcaaaaatgaaaaaattataggttcgagtattggagtgagcattttgcttcttttaagttttgtcatcttccatttttggaaaaggaagcagaagcgatcaataacaattcaaacacctaatggtaaaataaatcattagctttcatttcctttatttttgtcaataaattttgataatcaaatgtcttgattgttttttttttttttaacgcctgaatgaaacagttgatcaagtgagaagccaagactcgctaatcaacgatgtggtagtatctaggaggggttacacatccaaagaaaaaaaaagtgagtacctagagcttccattgttggagttggaagctcttgccacggcaacaaacaatttttctaacgacaacaagcttggacaaggtggattcggaattgtttacaaggtaaaagtgattcaaaacatattgaaaatctaccacagcacatggtttcattgtataatcacatgtgtggtaatagggaagattacttgacggaaaagaaattgcggtaaagagactatcgaaaatgtcctcacaagggaccgatgagttcatgaacgaggttagattaattgcaaagcttcagcacataaaccttgtccggcttctaggttgttgcgtcgataagggtgagaagatgttgatctatgagtacttggagaatttaagccttgactcgcatctctttggttagtgactcaaacagcttctgttctaataattgaacatttttgtgaaaacgttaacttgttgttggttgtgttggatgtgtagaccaaacacgaagctctaacttaaattggcaaaagagatttgatattatcaatggtattgctagaggacttctatatcttcaccaagattcacggtgtaggattatccatagagacttgaaagcaagtaacgtattgcttgataaaaatatgactccaaagatctcggatttcggtatggcgaggatctttggacgggaggagacagaggctaatacaaggagggtggtcggaacttagtaagcaatcattcttcaacaaaacaaaaaaagagcttttatctcaagtccaaatattttcttaaaaacctcataacatatgagtttatattttgttatgcagcggctacatgtctccagaatatgcaatggacgggatattctcgatgaagtcggatgttttcagctttggggtcttgcttctagagattataagtggaaaaagaaacaaaggattctacaactcaaaccgtgatcttaatctcctcggttttgtaagctaaaaacctcttcaattcgatattgttttgcattcataatctgattataacactaaagaaatattacatcctttatgcacaggtgtggaggcattggaaggaaggaaacgagctagagattgtagatccgatcaacatcgattctttgtcatcaaagttcccgacacatgaaatcttaagatgtatacaaattggtctcttgtgtgttcaagaacgagccgaagacagaccagtgatgtcctcggtaatggtgatgcttggaagcgaaactaccgctattcctcagcctaaacgtcctggattttgcattggtagaagtcctcttgaggctgattcttcttcaagtacacagcgcgacgatgaatgtacagtgaaccaaatcactctctcggtcattgacgctcggtaatttgtaacttacggcccaatctgtttacatgcatatcattttataggtaagtctaaatagattttattactacatatatgattcgatatcttgctctatctaatttaatttagacaaaagattcaccacatgtttcacatgattttgatttagagcgagaattataaaaaaaaaacatttagacaaagacaaaaaaatgcaagatttggagttgtcactccaagatttgaagtttgagaccgaaactcaattaagtgggaattcagtaatgattaatattcactttttgtacatactactgataatagaccaatactggaagcgaacataggactttatggctattacaacagaggactttatgaaacaaatcgaatatataccttaaacttttatgaattcatcggtgaagcattctcttgcatataacatttagtatgtcgccagcaacattgaaattttgtctattctcgtacacacacacacaaatggttgaggatattatttttttggagtaaacgaagaaaagtcagttactaggaaattacaaaaccataattatcaatttaacgacttttaaggtcattgactcaattctatagtgacatagtctatagatatttcaaaagcgaacaagaagaccaagaaaatgtagctgaaaatgaaatattatcaacaatagagagaaatcgtgtaaatgacgttcacacatttcaacaccaaacatgtcgtaatctccgaagataaaaattctcaattatatgtacataaaattttcataagaagaaaataaaacagaacacaagaaagtgtcctagctagagagagagagagagatg

SEQ ID NO: 22411 - DNA, 3003 bp, Unknown
  misc_feature (1)..( 3003): 2750-1469P.txt file - cDNA_ID_2053565; gDNA_ID_1620810; Annot_ID_169011
ataagtctgacggtattcgcgtggtagcatcttctaacatccaaacaattcagtattgcatcttcttgtgaaggattcagcttgagaaaacgacgaggagcaagaccatcacttccttcttgtaaacactgaatgcaaaatccttcatcctacacaagcagaagccaaaaatgatatgactacaaacatcgaaagctattacagagtttatcaatatcttttacctcactgtttcttcgaaggactcttgagataagattcaagttcacaccttcatcaccaggatgcaatgcattccagatacggatattagtagttaaattgacgagatgaataccgaaaaggcgttctttcttctcattcttcttcctccttccatcctcaacgaaaagaggttttgaagccaagatagttacatcattaggcctatctggatctaccttacacactaaagcaactatataaggttcactggaaatattgaagccatcaacatggtttggtctttgatctgttagcgagataagatctctaggcatcaactttgtactagcctcattacttattccactcaaacgcactttatagaacaagtcattaggaagcttatattccgcagtttgcataatgtagcttatttcaaccacaggtgcttgccacaacttcctcatactcgacaataaagcggcatgtgtttcttcgataagcggaggaataaaggtcttgaagtagtctccggttgattcaaactccataggtatcttctccacctgttataagcaatcaaacacacaaaattactctctaggaagcttctctttactcaaatgggacagagaacacaagaaagtaaaacagaacctgtcctttataaagatcaacattgagaacttcgtcaagagaccatgagagcaccagatcgactaaatctcttccttcaatacgcattctcggcatttatattaaagttaccaaactcgatttcgtactctgaaagattaacgcaacaaaacccattaaacaagtgaaccctcaaaggtacgaactttacacttttggctataacagagaagcaaaaggaactatttttacgagaaccattgatcattgaaaggtaaagtaaggttttttcttctttgttctttttggtaaacaacgtcttaggattttgagattcgcaatgaaaaaccctaaattctaacgttggcttgaacattagagcgtgtggcaacgaaatttgaagatgatgcaatgaaattttagccgcttactttgaattcgagttgttgttgtcagagtttgattacttcgagacgaagaagggtttggttttgggagacaggaacagaggtttcttttagaaggacatggatgagtaaggatttggagggaaaggaggagaagaagtaattaactaaaatggtaaaattttggggctttcttgagttatttgtttacttacgggtctactatgtaaagtaattacgtttcgtatttaaccggtttacacgctttcgcaatctagcctatctacgccataagctaaacatgactagatagtcctataaggctatgacaataatgttaatttaaaaaaagaggatgtgttcgtggatgttttagagagaagctagagaagaagaaagcaatagaatttagtatattctaaaatctatttctatttttttttgcatttgcatagtcttcaacattaataataattatttgtattgacaaaattttcataaaataaaatctatgtcaaataatattataaagacaaaattttacacaataatacaaaattatatatgaattagaaaaaaatgttgaaggtaatatagcagttaacaatttcttgattcatttaaagagagagtgcatcaattaagagcaaatgttatgagatggctcaattctatgcaaaaataaaaagataaagttctaaaaatataaagcatggaaataaaatattgataactccttcaagtggtattgatgagtttatacgatctgaacaagtaagaatcatacaaaacaaatcaagaataacaacaacctatgattgcacctaatatttattgacaatattttggtgactttaaaggaattgtacgttgtaaaatcgtttatgtaacaagtctcattatttgtaataaataataaattttataactaaattttataaataataaaacagaagggcccataaatattttgtgtattgcttttgtttttaataactaaattttattagaactgtcatacaattttttttaaataatgtaaaatctttaaaagaaatttataagggcagccaaaaaacaattttgttctagaacccatgatagaattgaaccggtcatgatgcgatggccagtacacacagcactacgaatacgaagctctgccaaacaaatgtcattttgtagtctaaggttaatgatttacttgtctagcgaatgaaatagttgaagcttggtggtgtaagttaatttctttcatgaattgatattcgtaggaaaggaaagaaaaccaaaaaaaaaagattatttataacgagaaaaacacaaattagttttatatctctctgagacacgcataggcctggccacacacacacacaaataaggagtgttgacgagatttgtttcttttttgcgtaaacgaagaaaggtcagttactaagaaaattacaaaaacactgataagtaaatgtctatctaacgagttattttcttgtcatttgctaggtcaactctatagtgacagagtctatagatatttcaaatgcgaacaagaagaccaagaaaaccaagaaaaccaagaaaagacagccgaaaatgaaatatcatcaacaatgtaatatacagagtaatcgtgtaaataacggcacacatcaacaataatatgaatctccgaagataaaaattctcaaattctcataaaattccctcaagaagaaagaaaacagaacacgagaaactgtcctagagagagatg

SEQ ID NO: 22412 - DNA, 3000 bp, Unknown; identical to SEQ ID NO: 5680
  misc_feature (1)..( 3000): 2750-1469P.txt file - cDNA_ID_2053621; gDNA_ID_1620810; Annot_ID_168995

SEQ ID NO: 22413 - DNA, 3000 bp, Unknown; identical to SEQ ID NO: 5671
  misc_feature (1)..( 3000): 2750-1469P.txt file - cDNA_ID_2053625; gDNA_ID_1620810; Annot_ID_168994

SEQ ID NO: 22414 - DNA, 1282 bp, Unknown; identical to SEQ ID NO: 8020
  misc_feature (1)..( 1282): 2750-1469P.txt file - cDNA_ID_2053649; gDNA_ID_1621183; Annot_ID_174325

SEQ ID NO: 22415 - DNA, 3003 bp, Unknown
  misc_feature (1)..( 3003): 2750-1469P.txt file - cDNA_ID_2053649; gDNA_ID_1620811; Annot_ID_169078
aacaccgtccgtttcaacactattggttcgggtggaggagacgcagcagttccaagagctagaaccggcatcaagtgatgaacggatccgatagggaacgtaagagctgacattggtgaaaagaagcgccaaaaagtcaaagaaagtttgctacgagaaaatcgtttctcattggctcaatttatactcactacttcgtggccactagccaccatggccatcaaaaacaagtaaagaaaaaaaaacatgtcacgagtggccatcaaaaaaacaaaacaaaaataaaaggaggatgccacgtgtaacccataacctgctacaagaggtgaaccgcacctccaatcatttgtctaatttcggtgtcgtgtccaagttccccggtggctttgaatttatccatcggtattggactaggttttggatggattcaaccctttgtcattttcattgagttactttctaatagtgtgtacttgttaaaaatctcaattattagtgttttatggctttgttcggaacttcgttgatatggacaatagagcaacatgttccttggaacacaagatagtagaaagcgaggtgttgaaatttctcccctctcccgctgttaaatatttttggtggtttgtgtattgtgattgtaatttaaaaatgattaataaggagcaaatgcccttagctttctcccatttcaaatttagggtttagacccataacctaaaatgtattattagaatcctggtcgtgaatccaatcttattagccaagttctactccacttccgtactacgctgtgtctaaatgacaaatcgtttatgttggagatagtccttattcattattcattatttcattattagagagaatgacaagaaaatcattgtgacgaatgataattgtgccgttttcaataggctattttcacacaaagtgatcagatctccccgtcccacatctcggcgacagatttgatgggacctttcttagaggtataaacctctccgtggacgtttctgaactgaggaatctcagttgaaattctctgtgtctcatcctctgtcaaagaccaatcaaatatctttagattctcttctaatctctctttggtaaagctcttcactaccatgctcactccttgttcataagcccatctcatactcacctgtaattacaactccaaatatgagctttgaactccatggatatagctgatgaatacatctcaaatttttctgttgagattcatgttaccaagatagtgactgactattgatggtgataaattgataataactgataaacgtccccactttttttttttgttgttgtaaaagttcatataaatgtcaccaattgttttttgtatttttcttgtttgatagtatcgtttaagaaaacttttgaaagtacctgggccactgttttttcctttgcttctgctatttctttgagaacatcagattccataattttgggagttccccaaaaagctcctctagatcccaacaccgagtacgctgtgacaacaatgtcgttcgatctacaaagctcccttagctttctttgttgccatattggactcatctcaaccttgttttcatccataaaaaaaaaagaagggtgaattggaattgtttgctgaaaaagaaatcaaagagtaaaaaagtagtgtttacttgattgacgctaggcgggattgtcgcgatagagagtatgtgttgaagcttcttacatgaaaaattgcttactcctatgcattttgcgagcccaagtctctgacactcctccatttcagaccacactacttcgaaatccattggcataaaatcatcttcatcaataggaaacttgtatttaccaggtttcgagctaaccggccaatgaattatataaagatcaagatagtccagtttaaggtttctgcaaaaccatatttgttacacaggtggtttacattaagttatgtcactcccaaaataatattcaatcatgaaacataattgacacggtgactgatagagaacctgatccatagagatatgtgaaatagttttctgtatttctcaatcggaaaagtgtttacaagtatgtttgtatacatctacactaaaccaactaaaccatatacaatcacaatttaacttaaccggaatcactaaaccggactatcatatatacagttcgaatagtgacacctactctcagtgattgaaaccgtgcattctaatttcatgtgaaaatcattaaggaatctaaatcttacttcaaactccgtttgatcgccggtacgacgagaccaccatgagcatcagcacaccaaagtttggtagtgacaaagaattcagatcgagatcgaactaagccgagtgaaaccgcctccgctaaagcttcgccgatcggctcctccgtttggtaccttggagaggtgtcgaaatggcgataaccaagcttaatagcctcaatcaccgtctctttcagcatcgttggttccggtagcggagaagcggcggttccaaaaccaagaaccggcatcgagtgatgaccggatggtccggatctgatggcgagcgtagggactgtggttaaagacattggttaaagagaagtcaacgaaagtgtgctctcagaaaatggtttctctcggtggcccaaagctttactcagtagccactgactaatgctagtgcctgataatattatattaatatactctctttgattagaaaagtacgtaagtcttcatattataagtttataacgctatataatttgactataaattgttaatagaaagtagtcatgatattatatacgaaaaatatttgaattagtattctttaatattgtttatttggaaaacttttaaagaataatatgttatgtaatttgtgctaaaatttcaaaattttaatatgtaaatcaataatgaattaatataagttgttttcagctttttctcaaaagcatgtcacgtatgagcattaacacccgtgtggaaaaatg

SEQ ID NO: 22416 - DNA, 3003 bp, Unknown; identical to SEQ ID NO: 20806
  misc_feature (1)..( 3003): 2750-1469P.txt file - cDNA_ID_2053674; gDNA_ID_1620811; Annot_ID_169067

SEQ ID NO: 22417 - DNA, 2305 bp, Unknown; identical to SEQ ID NO: 5681
  misc_feature (1)..( 2305): 2750-1469P.txt file - cDNA_ID_2053753; gDNA_ID_1620811; Annot_ID_50583

SEQ ID NO: 22418 - DNA, 3003 bp, Unknown
  misc_feature (1)..( 3003): 2750-1469P.txt file - cDNA_ID_2053753; gDNA_ID_1971909; Annot_ID_177047
tatttggggcaaatcagatggattcgagccagaaaacaattcggctaatctaacatgtttagtctgggatacaacaacagtaatcgtaaccacaaaatcatgaagtttcttatgtttatgacaaaacagcatgtccacaatactcagaaatctatgattttaactccagttcatggaggctggttgagatcaatcccgtctggtttttacatagcgaccgcgtgtctttgaagggaaatacttacttttttgctcaagatttactaaaggatgcaaagattgagaattatttactctgttttgattttacagcagaaagatttggaccgcatcttcctctgccggttcactcttatgatgacgtgactctatcttgtgtcagacaagagcagcttgctttgttatatgggaacaacgagacagatgattcattagagatttggattacaaatcagattgatcccaatgcagtgtcgtggagcatatttttgaaagtggatatcaaaccgcttattggttttccaaaagacttcgatcctgggagcttcttcattgacgaagagaagaaagtcgttgtggtttacgatttggacggacatttatatagtaccaagaagaactgtgcctaccaaaggctttacatcattggagaagatggatacttcacatctgtaaaaatcaaatgctctgactcacctgaattctctgcttatgctccaagtttagtgacatacaaaccaaccaactacgcaaaatgaaaagaaaaaggaagaataaaagaagaaagatgcagattacttcttagttccatttgcaatactttttttgttacgtatttttttgcatcgtctcctgttttcattcattgtctttcatttccttttgaacatttattaatttgttttttgctatttatcatctaactaagtatttagatttatcatgatattttaggctttttttcaattgttagtatcaaatttttcaatataaaacaaattatatctaccacaatgcagattcgtcttgatgttctttgtgattgtcttggcattctctatatgtttttgtggaagcatcggagttttagattagatatgattaacgtaggagttcatgtagaagtagagagatgtgttgtaatttataaaagaggcttcatgataagatagcttttgttgtttgtcttcacttccatggttcattgtcttccttttccattgatgtgctggtgaatcacaaagatactcatgcatttttcaatcctaattttggcatatgtaagtttttttcaattttgtttgctttttaatccaggcattggatgaaaacagagagaattcagggctaaagaaagcctttgatttttttttttttgtgtgtgtgtcaaaacagataataaccttttgtttttgggtcgtttaattgctatatgatgcatcaaatcttgtaaacaagagtgattccaagaaggtggaagtatttccgcatgattacggttgttgcttcacaaaataggagacggcttgtttcctctgccgaaccattgacatgtaaaggtaaatgttcatgttttgagtgattgattgattcaagccttaattagcatgtttatattctcttttccatatcatcaactaacattcataccagttgtttctaagagatttagtcgctggcatgaactaatatatatgcaatagtatagaggcacacaaataaaagatttgatcggataaagatcataagaaaaatcagagacataaagaacatgcatcatataaaataaatgtaattgaaagggataacaaagaaaacatttgataagcattgacctatgaaggcgctacttcacaaaaacacgagactcttgatgtgatttgggtaaaccttcatgttgtacatatagtctttaacaaatccatagcggcttctaaattcatcacccacaattccttcaaccgagacttctctaatactgtttctcctcggatcaaaatatagtagataaaacgattcaaacaatatcgatggtgcaaaaacaatctcaccagcatcactaacaccataaaagcttggcttttctttccgtattaggtccatttcagaaagagtcaaaaacgcgattatgcgtccattcgtgtctatctccattcgtcaaaatccatatatcaatagacgggaatttaaaagtcttaactagggctaaccttcccacataaggtaccatataacaacttttcctataataaccctctggaagtttgatctggttgaacttttcagatctaacgtctaagctcattagtttgcgttccacttcaataccatcaccaacataaacagttgctccatagtacatgactccattaattagtatatgcatcccccacaacgtatagtagatcgatgcctagggacaccgttggttattattctccatgatcttagtccttaagctcccagtgtacgaatgcaaatcttcgagtctctctagtaacatgtagtagtacaatgattcaagttttcaatcaatctgatcatatttacgctaccattcttgattagatgcttatcctgctcaaaaatgtattcagatatatattaacaattacttttgaatggtatcaaatatttattaactaattctttttaataatttaatccaattaaattttaactttttaatggattcaaatatatactcattctttatttagtgttaaaaaaaaaaaagtagctcaactggaaatgtatgtaaattatatattaaaagctgacccgggtctagaggatgtatggaaagccaatagcatcgtttcgaacattgcaataatattgtgtggtgacaagcaacacatgatatgtccgtttagaaacagacaaaataagaagaagaagaaagagtcgtggaggattcttcattcttcctcatcctcttcttcaccgattcattagaaaccaaattacaaaaaaaaacgtctatacacaaaaaaacaaatg

SEQ ID NO: 22419 - DNA, 2305 bp, Unknown; identical to SEQ ID NO: 5681
  misc_feature (1)..( 2305): 2750-1469P.txt file - cDNA_ID_2053753; gDNA_ID_1620811; Annot_ID_169029

SEQ ID NO: 22420 - DNA, 3000 bp, Unknown; identical to SEQ ID NO: 5775
  misc_feature (1)..( 3000): 2750-1469P.txt file - cDNA_ID_2053819; gDNA_ID_1620816; Annot_ID_169253

SEQ ID NO: 22421 - DNA, 2702 bp, Unknown; identical to SEQ ID NO: 5767
  misc_feature (1)..( 2702): 2750-1469P.txt file - cDNA_ID_2053825; gDNA_ID_1620816; Annot_ID_169250

SEQ ID NO: 22422 - DNA, 3003 bp, Unknown
  misc_feature (1)..( 3003): 2750-1469P.txt file - cDNA_ID_2053840; gDNA_ID_1620819; Annot_ID_169408
aaataaatgttgatatattaaaatagccatactagattatgatttgcagtggaacccaagcaagtataaatcatggtagataatccgtaactagctcgtaaataacctgcaaataacttatcactcatgaataacatgaaaataatctgtagatattttctagaggttggttagaacttagaagtccacctacccatcttaaaacgatacaaatacaaaattttctagtccataaaaagttttgtagtcttggcccaccattatttataaggcaacaacaaaatcattgagacatatactcaccagtcctttcttttgttgtttacgaaaaaacgaaacaagatgttttgtaaaataatataacattctaaaagccgaaagataaaaatttcaccgcggacttctcgtatggcgtcactagattctctagtgagcttctttttatctaccctttttgtcacaatcgtgagctcacaaacgcagtgccggaatctcgagtcgattatcagtttcggtgattcgattaccgacacaggaaacttggttggtctctcggatcgtaaccatcttcctgtgaccgcgtttctgccgtatggagaaaccttcttccaccacccaactggccgttcctgcaacggccgtatcatcatcgactttatcggtacttctctttctatgtaacttgacatgtaagtaagtgactaggaatgtaaatctgatgaagtatcgaatcatgatcttataattggtctcagttggagtgttttagacgtcttcaatctctgagaagaatccaaaaacacaaaaaaaaactgatagttgcgtttgaacctctgttttcttgtgtgggcacagcttttccgatttataaaaatctggattttcttgattagggtttcttatgtagactctttctctgatttggtttttcttgatctgcaagttaacagtagtatgagaccttaagtgattctccaattttctatttacagctgaattcttagggttaccgcatgtgcctcctttttatggatctaaaaatggaaactttgagaaaggagttaatttcgctgttgcgggagcaacggcactagaaacttccattcttgagaagagaggaatttattatcctcacagcaacatcagtttgggaattcagcttaagaccttcaaggagagcttaccaaatctatgtggttcacctacaggtactgaagatcaacttttcccttttctagctagtggagtcatgattattacgttattgcagtgaattgacctcacttgtaatgggtttaattctttgcttttagattgtagagatatgattggaaatgcttttattatcatgggagagattggagggaatgattttaatttcgcattctttgtgaacaaaaccagtgaggtcaaagagttggttccgttggtgatcactaaaatttcttctgcaattgtggtaaacattcttgatcagcgagtccctagaacgagtaattttttcaaaaaactgttatgttttttgttttgtttttgtgttttggtactgaatgttgaatctaggagttggtcgatatgggaggaagaacattcctagttcctggaaacttcccgctcggatgctcagcaacgtatttaacattataccaaacatcaaacaaggaagagtatgatcctctaacaggatgtttgacatggctgaacgatttttcagaatactacaacgagaagcttcaggcagaactcaacagactcagtaaactttaccctcatgtcaacatcatatatggtgactactttaatgctctgttgcgcctttaccaagaaccatccaaatttggttagctttcttgatccttagtttaattacctaaaaacccaagttcattgattcaatttgataattgagttaatcattcaattcattgtacaactagggttcatggacagacccttacctgcttgttgcggtttaggaggaccgtacaacttcaccttaagtaaaaaatgtgggagtgtaggagtaaaatattgtagtgatccttcaaagtatgtgaattgggacggcgttcatatgactgaagctgcatacaaatggatagctgatggattactcaagggtccgtatacgattccttcgttccattggttatgcctcggctcaaaaattaagagcaaggagtcattagacacgtagtgttcttttgacaaacagctgaaacaagcttgttggagctctgagagataataagaaaacaaatacgttcttaagtgctttccatggatattttatatcattgtgtattgttgtttgagagagagagagagagtggttaagtgttagtagctaactcatgtgatatcttcagagagatcttagattagaccggtcggagatgcactgttccaaaaatggaccacttcatgagtggtagaaataacagaataggagatgataaaatgggcaaggagttgaacggatcaatttgacttctagtcttcaatacaaaaccaaactactctttacaaatcaatatattaatacgatttttataataattttaattataagactaagatttgtaatttagtggtttttgttattatcgtagttatgttattatccggtttcaaatcagcgtaatacgtgttattgacaaataaatgaagtgaaattcaacatcaaattaaaatatgggaaagaacaaataacctacaaaataactcgtaaatagcttgcaaataagccgcaagtacatattttgtagatggtggttagaagtccaagtacgcgttttatagattggtggtcacgcctaccaatacaaagtcttgttgttattagaaagttaattgctttatttattacaactagaaatcctcgtttagtcatgagtcatcggtccatccctccacaattggcctctatataactttcccaaaacgaatcatttgtaaaataaaaaaaaataagatagaaactcactcctgacctctcgcatg

SEQ ID NO: 22423 - DNA, 3000 bp, Unknown; identical to SEQ ID NO: 5807
  misc_feature (1)..( 3000): 2750-1469P.txt file - cDNA_ID_2053844; gDNA_ID_1620819; Annot_ID_169397

SEQ ID NO: 22424 - DNA, 3003 bp, Unknown
  misc_feature (1)..( 3003): 2750-1469P.txt file - cDNA_ID_2054192; gDNA_ID_1620831; Annot_ID_169683
tcttaaattaagagatgctatatcagaaactaatattatattttagttaaaatctatttaaattttaaagtaaactatatattggatacaatataaggtggtgctaaagtcaatattaattaattttaagtttttaccaaaaacataacacataatcattgtaatatctattatgaatattgaataatcatactctagaaacttcacttaaattttatttataattaaataacaaaattcctatatataaaagataagatatttaaattaaaatttcattataaagcctgaaggatcctaatcatgattatcataaaagtgtatatatgattaaaaaagtttagttctcctaacagatatcagattattatatggtatgtatatacttttttttttcccctaattcgaagatgcaccaagttctatcttaattagatactaggcatcttatattttatatatatatttgtgtgctcagaacaaaaattaaaaggaagaaccaaaaacttagcacatcagaaatcgcagagcccttctctagcactcaacacgaagaaaaagcaaaagatggattctttgcaagaacttcttgacaagaagcaatacgacgaagaagcaaaacgtccatgtcaagaagcgatgaagaagcaaaacgacgttgctcttttccttgcgggggaagtaatctctgccgcagacaaaaactctaacgtcgtcttctctcctgcatctatcaactccgttctcaccatggccgctgctacctccgacagtgaagcactaaaatcttgcatcctctccttccttaggtcttcttccaccgacgagctcaacgacatcttccgcgaaatagcttccgtcgtcctcgtcgacggaagcaaaacaggtggccccaaaatcacggtggttaatggagtgtggagagagcaatcacttccgtgtagtcccgagtcgaaagatctctttgagaatttctacaagtctgctttcgctcaagttgatttccgatccaaggtcagtttctgatttcgaatttgctttgattaaattagggcaagagattgtgtgaaacgagtgcttagagaaactacatatcgtattcaatgttttggtttgttgttttgaagtttgaagaagtgcgtgaggaggtgaattcttgggcattacgtcacaccaatggtatcatcaaagatcttctacctcctggatccgttacaagcgaaaccttgtggatttatggaaacgcattgtacttcaaaggagcctgggaagacaaattctataagtcaatgacgaaacacaaacctttctaccttgtcaatggcaaacaagtacatgtgccattcatgcaaagctcacaaagtcaatatgttaaggcttacgatggtttcaaggtccttagacaaccataccgacaaggcgttaatgatacaagtcgccaattctcaatgtgtacctatctcccggacgagaaagatggattggataatcttgtggagaaaatgacatctactgatggattcttggacagtcacattccgagttggagagttgaagttggtgaattcagaattccaaagtttaagattgaattcggttttgaagcttcaagcgttttcaatgactttgcgcttgatgtatcattataccaaaaagctatgattgagattgatgaagaaggtactgaagctgcggctgctactgctctagttggtgcttgtggctgcagcctttataggcctcctcctcccatagattttgtggcagatcatccattttttttctttattagagaagacaaaaccggaactgttttgttcgctggtcaaatcttcgatccttccttatcttcttctgcttaagatcggcctaaataggagtttgggattttaagatttggtttttcatatgatttttgagttttgtttttggttttgctaaatctctatttgctttatcttattatataaagtattaaagttagtaactcaccacagtgttaattttaacggtctcagattttcaacatgtgaaacaaaaaactcatttatttattttaaaagaggaaatttatttatttaaaaaaattaaagaagattcttttttttggtgaagaaaaattaaagaagataattataagaaaactataaatatcttattaaataaaaataaaaaatattttataattctaattaatagctactaattcttgaaaacatgcaaagggaaatttactaattcttaaaaaaaggaaattttcctttaatttattccaaaaaagtatttctaaaaagtcaagagattgaaaatatgaaaactatatctcttattaaataaaaataaaaatggataaataaaaattttaaaaaggattttaaaagttatataatgttcatataaaataatataactaagaaaaatttacattcaattattaattctaaaaggaaaagaattgtgaatctcaccaaatcaccagttatttattattttaaaacaaataatcgaacaaatcaacccaatatcctaaaactttcctcaaatctctcaaaaacttcaaataaacaaattccacaaaatattctaaatttcttgttccaactggaaaaattaagaagaattttaactattttttgttttgggatttatctttatacaataaaaaataattacatttatttcaacgtaaatttacttttgttgactctttttagttttacctacctatttgaaaaaaaaaaaaagaagaagaaatattaactcttttttccagtgagtgtattgaaatatgaagtttatctaaattaaacctttccggattccatcattcaactaattaataaagaaatctacattttaataataatttgaaatttcctaaaatatcatcaatatgttcaatacaaaaagcacatccaccccttaactggtttacatcatgtaaattacatgtctgagtcctctatcttttctcttccgttatagtcttatagatcaaaaatg

SEQ ID NO: 22425 - DNA, 3003 bp, Unknown
  misc_feature (1)..( 3003): 2750-1469P.txt file - cDNA_ID_2054208; gDNA_ID_1620831; Annot_ID_169669
gaacatggatacaatgaaagcgagaagtgctaccggatctccagagactgatgttgatctcaatgagtatgaagcaggattggggttagctccggaaggaagagtccatggtggaagtttgatgatggcgatgttgggtagagatggtggctctggctctaccggtgggccaaagaggtggatgtaagttgtcttcagtttggttccagtcttgaattcaatgcgtgtgggcaagtgagagtgaaagagtctgtggttgttctagttttaggtttgcttagagtaaaaaaaagggtccaaagtctgtgtcttattggtctttgtagatattgaattaaagggtcgaagcataggttattgtgatgttgtgaattatacaggtaaaagcccacctgtggaaattgtcaaaaacagtcttatgatgatgatgataataataataaaactcatgtcttttgtttgcaaattgcaattttatcggtagggcaggtttgttgggatcatgctgagtcgatgccagtgtgtttttactttttagcagttacgttgaaacattcacaagtaggtacttaatatgtagctatatattaaaggactggatagtacaacaactcatgggaggttctatatctattttatcttcttagagatccctttattgtatagacgcgaggaacacttgtcatatatagtttggatcgattttacgtcccacgggaccattacttaagacgtcgtaggagctgaccaccagtacgaagaaccaactcattgatatagtccacaaggaattggacttggtcaaggtctttgatctcagggccagtcttatcgtactccacactgatatcgacgaggctatacaagccaatggcggaatcattaacttttgtagttgatgtaatcatcttatagccttcaaagaattcaggtacggtaaaccgttgcgtcatgcttctcgtttcgtgatccactgactcaatggtcatgtgttctcgttgccaaggccttatctctaataaccaacataaacaattacgaattatgaacaaaacatatgaataaggtgagagttattataaatagatacctgaagggttctaattagatatatgagtcatatggtagaaaaaactatcccagaatagttttggtggaagcgaaaacagaaactgcatctcacaaagtcgtctcaatgccatttctctagctacttgatgtttgccttttgtgagttttataaataattatggtcttgatctcaatgtaacatgcatgtttatatagccaaatgtttatgaaaaacatgttgcattaatttttcttcagcagattacccattcaacttttcattagatatgccatttttctacatttaacaaaattcgttggccatttgcataattgcattctctgcttcacttaatcaaggcaacaacacttggatggaagaataacttgagcggaccaaatttatcaatgaacttgaaccgatcaaattaacattgctaatttttcttcattaacttattttcttagcaataatatataacccaaaaacttatctctgaacaaattaattaggaagtaacgcacaaaaagaaatgcacaaaaataaatgtcagaagtgggatttgaacccacgccctctttcgaagaccagaacttgagtctggcgccttagaccactcggccatcctgactttttgttaaacttatacgtatatagtgtaaataatcgtataattttcaatatccataccaatcttcagactcttttttttggtgacaaagtgtatgtattattttcagaagctatatgtttttcctataaaacatccaagactggcccatacatatttttaagaaaccctatagtgtgtatatgacttcaaaatttcgaatggttagtttttctttcgaggaccaaaacaaaaagcccattcaatcactagaaaaatatcactagtcaatcaatagaccaaaagattgaaagtaggatatatttgtttaataatgcctacgattctgcgaagacaggagaagccatacctttcaatctaagccgtcaacttgttcccttacgtgggatcctattatacaatccaacggttctaaatgagccacgccttccagatctaacacagtcatgctttctacagtctgcaccccttttttttttagtgttttatctacattttttcctttgtgtttaattttgtgccaacatctataacttacccctataaaaatattcaattatcacagaatacccacaatcgaaaacaaaatttaccggaataatttaattaaagctggactataatgacaattccgaaactatcaaggaataaattaaagaaactaaaaaactaaagggcattagagtaaagaagcggcaacatcagaattaaaaaactgccgaaaaaccaacctagtagccgtttatatgacaacacgtacgcaaagtctcggtaatgactcatcagttttcatgtgcaaacatattacccccatgaaataaaaaagcagagaagcgatcaaaaaaatcttcattaaaagaaccctaaatctctcatatccgccgccgtctttgcctcattttcaacaccggtgatgacgtgtaaatagatctggttttcacggttctcactactctctgtgatttttcagactattgaatcgttaggaccaaaacaagtacaaagaaactgcagaagaaaagatttgagagagatatcttacgaaacaaggtatatatttctcttgttaaatctttgaaaatactttcaaagtttcggttggattctcgaataagttaggttaaatagtcaatatagaattatagataaatcgataccttttgtttgttatcattcaatttttattgttgttacgattagtaacaacgttttagatcttgatctatatattaataatactaatactttgtttttttttgttttttttttaatacatattttgcttttggaagatcaaatg

SEQ ID NO: 22426 - DNA, 3000 bp, Unknown; identical to SEQ ID NO: 5914
  misc_feature (1)..( 3000): 2750-1469P.txt file - cDNA_ID_2054212; gDNA_ID_1620831; Annot_ID_169668

SEQ ID NO: 22427 - DNA, 3000 bp, Unknown; identical to SEQ ID NO: 5909
  misc_feature (1)..( 3000): 2750-1469P.txt file - cDNA_ID_2054231; gDNA_ID_1620831; Annot_ID_169652

SEQ ID NO: 22428 - DNA, 617 bp, Unknown; identical to SEQ ID NO: 6084
  misc_feature (1)..( 617): 2750-1469P.txt file - cDNA_ID_2054329; gDNA_ID_1620843; Annot_ID_170127

SEQ ID NO: 22429 - DNA, 3003 bp, Unknown
  misc_feature (1)..( 3003): 2750-1469P.txt file - cDNA_ID_2054333; gDNA_ID_1620843; Annot_ID_170126
gtgacttagtgataattggcaaattgaccattataaatgttttaatggtaagaatacaacttctgatctcgggtaagacacaagtcgagatccatggttatattgtttacttgtccggtaaatatttctgaaaagtgtcaacttcgaatttttgaaaatttgctattttaatttgtgccagtttattaagttgcaatgctctacgtcgcaagttggaataacaaaataaacatgaacattatcatgtatgataatgtctacaaatatttataacaattatttggataataaaaagactaattaaaactcaaaaagtttactacataccatctacgaaatcggccaaacaatccctttgttgaaaggcaagcatcctctgtgaagtgtcatacccaactgcatgatcaacaaaagctgatgctccaagcacattaatcctttcctcatctttcatcgatgatctgaccaaagccgtgcagagagaagatgggctgtcttggagataaagtcctttgtttgagatagtgtaatctaatccttggaaatgaagagtgagtttaggcaatgaatctatctctaacccaacctcggttgtgaaacacattagttcgttcacttcgtatgcgaccgctggtccaatctgcgccgttagctcttccttcacctcctcgtagagtgatggctctagactcgtgtagtaagtcccaacgtctattgctattccactactctcattgcttctcattctaataaaaaaaaagatcatgagaaacaatataatggatatttacatttagagaaaaaagagcttgattgttttaaatactaacttgcacgtttgtggttttatcttttatgtgaaacgttagaaaaccattttcttaaaatacaaaatatttttcttgtttaaaagtattattcaaataattaataaaatggtgttcaatatgtaggttttatttggaaaaaaaaaaacaccttttaacgcaaactattaatcgaaatccaaatatcaaatgtttgagtctatgaaatttgttgttaaaacgtatattatatcaaatgtttacgtagctatgttagctagggtttaaagtttaaacaaattaaccccaacaaaatgttagagcatctacattgcataacctctcattgatgtctccaagatcaaccatggtaaaaatagactaatcaagattaaaattaaagacattttcctttttaagtgtctaaattgtcttaatgtcttagagaagatatttttgacatccaaaaaggaaaatgtctttaattataactatggttagtttttaagacactcatgagagattatgcaaaggggatagtcgtagctaggtttaatggagtaaattaaaaatataatcaaaacatcaaacgagtgatatgtttatacctctgttggccaagactgatcccgaagagagcaacgtgatacgagtaagcttccgtccccgtcatgtttaacatcggaaccaacaccatatcgccgccgtacgaagccgctgatccgagacggatgtagttacgcgacccggctgcggaaggccaaagacagtgtgaaaatcttgtgagacgtagctgagagaggagcgagaaacggtgagtcgttagactaagtctcccgtcgacgccaccaccgtcttcctccggcgtcgcacggtttctagccccgcagccaaagacaaaccctcgcactatagagagagagttttcttggtcggtgattgaggaagttaactgaagtgtgtcggagacaaggtagccggagctagagggagaggcctcgtagcggcagaaatcggaaggagtgcagagaagagagacagaagttgttgtgtttgttgttgttgcgttgaaatagttagtgtaattggtggagacatgaggacaaagagaagagttattgcaagagattgtagagaaagtgttggaagatttgtctgagagggagcattggtggtcatcatcattatcgaggcatgtgagatgtgtagaagagtctagcttgaggttaaaggttcgtgttggggttccaatggtgatctcaacgtaaagattagattcgaaaggtaagaaaaagccgttcggtatatcattcgggagatcatcttcaaggctagagttatgagttagtacagtgaagaggagcagaagaagaacaagaagaaagagtgagtttgatgaaaccatgtttctttggttttgtatagcttaatgctcccaaaacattcttaagttattagctactttttatatgaggtattgtatttaaattatccttgttttttacgatagtgttgcaccttggcttgcatgaaataatgttttacgctgtcagaaaaaataaaacaataataataacgttttaaatgtttattagtatgaaaattgcctaacatttttataagttataacatttttataagttataacgtatataatcgacactaatttttatatgtatgactaatactatatcttagaactaaatataaagtagtttgtacttacacgttacaactataatttttaaataatttagttacagtagtatatgtttttgttatttctacatgtggcatgtgtggtttatatatgcaggtgggttggttactaaacgcatctaccgtgacaactgacaagcatatattagatgacgtggcccattgacgatcacagtaacttgggcttattgggcccataacgcgtaaaataaaaagcccaacagaatcagaaaaagagatgtgtgggtcccataggaatctgcggtatagaatcaattgcttcgcgggggttttacttttcgtctcatcgcaaaaacgcatgacgcgttttttctccgtagatctttgtcttcgtcttcgtctttgtctttgtaattcttacgttaagctctctcacctacccgaaagctgcgaacttttcctagaaagctaattcaaacgtagaatattctaatcccaccacttaattttataaatg

SEQ ID NO: 22430 - DNA, 3000 bp, Unknown; identical to SEQ ID NO: 6083
  misc_feature (1)..( 3000): 2750-1469P.txt file - cDNA_ID_2054341; gDNA_ID_1620843; Annot_ID_170124

SEQ ID NO: 22431 - DNA, 3000 bp, Unknown; identical to SEQ ID NO: 7046
  misc_feature (1)..( 3000): 2750-1469P.txt file - cDNA_ID_2056932; gDNA_ID_1621124; Annot_ID_56346

SEQ ID NO: 22432 - DNA, 3003 bp, Unknown
  misc_feature (1)..( 3003): 2750-1469P.txt file - cDNA_ID_2056946; gDNA_ID_1620748; Annot_ID_49749
tcttcctaatgccgcttttcgaatacactcccaatgtggtcctcggtgccatcattgtgaccgcggtcattggtctcatcgaccttcccgcggcctgtcacatatggaagatcgataaatttgatttcttggtgatgctttgcgcgttctttggtgtcattttcctatccgttcaaaacggtctagccattgcggtggggctatcgttgttcaagatattgatgcaagtaacaaggccgaaaatggttataatgggtaatattcctggaacggatatataccgagatcttcatcattacaaagaagcacaaaggatcccgggatttcttgttttaagcatcgaatctcctgtcaatttcgccaattctaactacctcactgaaaggttagctatgaaactacgatcctttctatatagattttggaagttcggatacattagactttgatctcttaaatgtttatgaaccctgatgtttattagattgtaaccacatttcttaatacattttttttgtcaacaccacatttcttaatagctatgtttcatttactaacattctctgcttttgtgttgcataaattttttgtagaacatctcgttggattgaagaatgcgaagaagaggaagctcaagagaagcattctagcctacagttcttgattcttgaaatgtcaggttagtcttgatagaatctattagaaacccgtataggaaatgtgattagacttaaaggcaaattcactcattgctaattagttttaattttctaatgcaaaaccataaaactcaagaaaaccaatatatttcaactagctaactttgcttttatatatgttaaagccgtgagcggtgtagacacaaacggagtgtccttttttaaggaacttaagaaaacaaccgccaagaaggacatcgaggtaaaaatagttgttttcacaatccgattttgtcacttatccaaggaaactaattagattttgatctaaactggatatttattttatgtgtgaagcttgtgtttgtgaaccctctaagcgaagtggtggagaagcttcaaagagctgacgaacaaaaagagttcatgaggcccgagtttctcttcttaaccgtcgctgaggccgttgcgtcgctctctcttaaagggccatctctcagtaacgtttaactataattttttgtatcggtccaatattgatatttaaccgatggttaaatttttctttttgtctctttttcatcttttaatttcagtacagatgtaatattacgttcttctctctctttcttcagtgatgattttggtcaagatatgtttgtatgatttcgccattttgtagtttactaggccatgtttagtctccgagaataaaattgatctagaatcgaattgatatcttagctagatcaaacggatgtatatccaaattatttatgaaataaactgattaaataaaaaaataaaaataatatttttatttaagataattatgttttataatattagaaaatatgaccaaaccatgagcagaattgtgttaagaactttgccaagttagagcttacattatatatcaaaagtcaatgtgtaattgtcaagagggataaaccgacgcggatgaatcgaagaagcaattgctttcaagaagacttcaaatcagctatgtgtctgcgattataattgtgtaaacgttataagcaagaaatttatctcaaaataaaactggtctataaatcaaatcgaattgaaaatttagctagattaaaagatgaaatgaactgataacataaactaatagatatttttaataagatgttactacttttgtgaaatgataaaatatttctgaagttaatcgaattcattcaaagctatgataacattgtgacttctaggaaaaaacaattcttgatacggtcgcggaaagatcttgataacattgtgacttccagtcttccatatggcataaggtattcttttacactaatactttcccgacaacaacaacgaaaaactccaacctttttttaaaaggccacatagaatgcatgatagaccatctgaaagaaaatggacagggtggcttaaaagtgagatttcttgggattgcataggatgttataattaaccctagcttgaaaaaaaaaagacgattagacaataagaaatagaatttaggtcaacttagttcggcgaatatgatcttgcattgcaccttctttaccaatttatagtgatcttttgctccttataagcacatgtttaaatcaccactacgacattgtttctgtttgggccaaatgcacacttgtattttatctcacaacgagcttatgagaaatcaatcctagtaatacgttaagtggcccaagaagttttggaccggcatttacgtgtatataaaaaaatattatgattacttttagatgaaaccacacttaatttcttcttttttcttggtaaaccacaatatctctttattgtttttatcaaggattcacaaaattcattgaatggaaattttcatttatgtgtgacatgtagacagtcagtccactctaaaaaatctcagtcaatttcgtaacaaattcataacctatttcaaacacaattcataaccataacttataaatactacataaatgatatttctttatatcatcttaaatggtacataaattaggggaaagctaagatatatatagtattaaaaagtacaaaaatagataaggtttataaatgtttaaagaagtaataaaatagaaataagaactaattaggtcgtcatgtgtttgctgtataaaaagctgtaaagggacatctctcgtaaatctaaaaatcatcaaatcttctccttctctctctctctctcacacactcactagcttctctgttaaaagcttccgtcatcacatagagaacagagactgacactaactcacttcctaacggtttccacactcaaaattacacttttgccactccggcgaacaacaatatg

SEQ ID NO: 22433 - DNA, 3000 bp, Unknown; identical to SEQ ID NO: 1340
  misc_feature (1)..( 3000): 2750-1469P.txt file - cDNA_ID_2104863; gDNA_ID_1620388; Annot_ID_155514

SEQ ID NO: 22434 - DNA, 3003 bp, Unknown
  misc_feature (1)..( 3003): 2750-1469P.txt file - cDNA_ID_2104905; gDNA_ID_1620528; Annot_ID_159626
taggggtgagttgtgtgatgacatacatacgtgggatccaaacaatgaggcgtttggtaataacatggattgtgagacttttcattcaaccaaccaaaattagagtacatccacaacaacgatggtaccccctcatgtgatcctagaaaaaacgaatacattttctttaatttcgaaatattcaatttggttttacgtatcatatctggtttcatgtgtttctctggcctgttcattttcacgtttaccatataaatggttattaatgactagcgaacaaaataaatatcgtcatgtggctacttgctcataattattaaggtaagtcgtttttctacacttgcggcatagaatcaacaccggcctttcatgcctttatcctttaccaacttctcattacatttggccttctcacattaaaataaaaccaggttcagtattagtatcaacggttggattttactgaatccgcagagccttgttacttctttttttcttcctgataaagccctgttacttgttagctagtgtatgatttatttaaacaccgaaaagacccgtgattaaaccaaataatgcctccctgtattattcaactctgtcgagttattatgacaattattatatataaaaaatagtagaacgccgccatgtaacaacatattgctgtttgaatcacagtgcacaatttacattggtaataaaataggggtcgaggtggaccatgctaattacataattataggttattttctcacttttttgcaattgctatattaatgaatcaagacaatgtaagaaaaattttgtaaggctgtccatgaagtcctttagggttgttataatattttttttgtcgtcacgttgagattgttataatcatataactaaaattattgggtgcaaactggcagtttgaattaatctcctttcctcctcctatgtctttgtcgttcgttacatatttctcgagcagttaggattttctactagatattacttttacttttatagtcttaatttagaagttcggtgataccgactaaattagcaactatattacaaaggaataaaataacaaacatatcactgattgttcaatatatacacacgcgtagacgaagtgatgggagatggtgttaatccgtgacactacgagtacacgacagtgttacggatatgatttaatgagataaatttgtttataaatttgagtttaaagaagacaagagacactttgtagcttggattggaattcaacgcaacacagtgtacacgcatctctttcgatttggctaatccaagttatatatatttgtcatgttttgtgtctctctatcttctaaaatacagttttttaagtttttaatttgaaccgacgattataaaatctaagaaattttagaagaatccaaggacgcaaatgacagccaataagattatgacagctatacatcttactctcgccattgtgactttgactctctgcccctcttgtcctcaccacgtataatccatccaaccatatagtattatacctaccctcaatcatatcaaacgtattttggtcgttaatttgtctgtttcttataattaattattgccgtaagtgttacccttaattacgtttgcataacgcgcaaaaaaaatacgtttgcataccttcggtttcttcctagttgtcttaaatgagtaaaataaaaaccgacttaatttgttggatgcaaactctagttttgttactacttagtctatgatgtcaaacaaaaaaaagtctacgtactagttactactactaacccttaattaggggggcttttcatttttattaatcttaaattaaacaaaaagaacaacgaaataacattgaatgcaatttcagtttttgagttgtaaaacaaataactcgaggaggattcaacagtaaaaattctattgaaatgaagtgagaaattcaataatttgagaacagatctttctcagtatatctgtcattgttgaccattagctacatttcaaaggtttacttttgttttcttgttgaatgaactaactaaaaagacgaaagaaaaaagtgaaatcatccgggagtatctgttctttaaacattacgtgttgaatatataatttagacgaagaacagtagtactttttattttagaatattagaggaaataaacaaatttaagagaatgttttggtttaatactgtgttctgtttagccgttttatgaataatcgccataatgcatgtggaattcaaacgtgggcgtgtttcttttcgtcttaagtaacactttaagcgtctcgtaaatggttagtatttacgattaaattagaacaaagttaactaagtatttgtcgttaatttactagataatgatttttaaaatataagtttcgagttaatacaaagggaagtaaataatatggcttatacatttagattacgttattttagttttggatctaaatttgtaaagaaattagctaaattaaaggggaaaagggatatgttttttttttttttgttaaagggatatgtaatatttagtcaacgagaattggttaattgggaaacaaaagttattggaagagatcaaaaattttaaatattaatttttgagtttatacaaagggaaagaaatcttatgatttaaacatttagattacattattttaattttcggatttaaatttgtaaagaaattagctacattaaaggggaaaattggagagattaattgccccccataaccagaattggttaattgggaaacaaacaattttagagggggcaagagagaatctttttatggggtgcaattaatttaattccttaaaatgcttaagaaaattcaaaaatttagggagggacaactgccccatattaattaacaaagatcatccccatgagagaaaggcgtttcatcaatgtatataaatactctgttttggaaacagaacccaacaggggacaaaaaaaatcaagaagaaaaaatg

SEQ ID NO: 22435 - DNA, 3003 bp, Unknown
  misc_feature (1)..( 3003): 2750-1469P.txt file - cDNA_ID_2104909; gDNA_ID_1621089; Annot_ID_55467
gagtcatgcacttacttattggtaccaccaccaacgtctcttatactctttcatgattctagatcaatttggatgattcttatttcttaacaacaattaaactgcagacgaagctgaagcttccattgttggaggacatagaagacgacatggatttctgtatgaagctagccaaagaagaaaacctcgtcttactaccaggagtggctttgggattgaagaactggataaggataacaattggagtagaagctcagatgctggaagatgcacttgagaggctcaatggcttctgcaaacgccatctcaagaaaacagaatcttcttttcaagctctgagcaatggcaaaatctaaaccactcatctatagagagactatacacaaccaaataaaaaatctgcaatttttgtggtgtaaaaaacaataatcatgtcattttcatataagaaactctatgtttcttaatcttatttctttgtttgagtcaagtagaaaaagacatgaataatgttgaatcaagactttatctttaccgttaaaagagacggacccactttgccgccgtcaaatttaaaaaatgcaaaagatttgtcttttactttctttcttcatcaacggctctctgatccacagtagccggagaaaaagcagagagctcaaattgtcggaattaagaatccccaaatcacatcttcaagaaccctaataaattcccagagattcctctcatttaatcacttcagattcgaaaaaagttctctctttttcccaaaaaaaactttctcatacaatggactctactaccacacctccttctctccgttcgaatactagatccgctttgcgtctagctcgaaacaacaaaactctcgtaaaatctcacattccatctctcgatttggttttattgtctccgaagaacaacaacggtactccttacccatcacctgtttctctcagttcaccatcttctcctgttactcttcgtgagattctccttttatctccttcccctcttcgtaaatcgagaacccgtttaagcaatcggttcgatatggaagctgcggaggctgctgtgacggcacgacggagtaagacgaagggagggcaaaatggtcttttggcctcgccgtcgccgaggaatttccggaggtcgagactaaggtcggaggcgatggtagatacaaaggaaaatacggagccaattgttgtcgtgaccgatgaaaagaaacaaaaccagaggaaacagaagaagttgggtcgatctaagaaggagaagcacagttctgttcctctgttagcttctcctagtccatcttcagatcaacgtatgtccttcctctgtctattagctcattcgatttcactttcgtgctctaataattgctcaatgatttgtgtaattcagctcaagatgtttgtcaaggtgatttagagcggattagagagaatataagcgatttgattatgtggagagatgttgcgaaatcaacactttggtttggttttggctgtatatgtttcctatctacttgctttgctgctaaaggatttaactttaggtaacattgatttctctgtcaaggtttatctttctagctttaatcatttttcacattcatgagttgataatgaaactttgtgtggtttgaagtgttttctcagcgatctcctatcttggacttttgtttcttggggtatcgttcttgtcaaatactcttcgccaaaggtacaaacttttaaggtcccagtacataaatatcagcttgaactgcagttgactgaagttttgatccatttgttaccataaagggttactgaagaagcgcggagagagcttaaattgagtgaagatgatgtattacgaatagctagacgaatgcttcccatcaccaatttagcaatttcaaagacgagtgagcttttctctggtgaaccagcaatgacactcaaagtagaatttacaaaactttgccattctcataaaacttctctccaatgaatgtgactctcacgttgattttgtccttcttacactgtttttactttgatttcaggtggcaccttttgttctaatgggagctgagtatggttacctcataacattgtggagattatgtgcttttggtatgattgttgaaacactatatgtcaacattactccaaagaaagctaaactgttttctttagttgtatctagtagaattgacacagagtatgcattgtttctttaaacaggtttcttccttagcttcactattccaaagctatattcatgttacgcaagtcagcttaaccaaaaaggtaaactctattaacagactgcgtagctctttgatggttccaatgattgacactaaggattctttgatctttgcttatgtgtagttgagtgtgcacaaaggagatttgttgaagcttggggagtttgcacacacaagaaattcgtagcaggctctgcagttactgcattctggaatctaacttctctcaagacccgttttattgcagtgtttatcatagtagtagtaatcagatacagacgacagaatctacagttagattccgaggatgaggaggagaagaagcaacaagaaaaaactcacccggagcaacaaaaatcgccggaggataagtcaacttcaccgcggtcagcagaagaagagcaagcgttggtgctagttgcagaaaccaaagcaccaaagaagctttattagtctagtcactagtgtcttttcagtatccacctgtgtaataatatttcacatttacgtaataataaataaagagcagtcattaatatcaaataataaattgacacgtgacaagctcatgaaactgtgagaagcaggtgataaaaactctcgtccgtcttgggagagagcacatcgtcgtcttttctttataaaccctaaattcccatttctcttctccaaaagttttatcgattccaccaaattagggcgaacgcgaaatctgggtattgtaatttgaagcgatg

SEQ ID NO: 22436 - DNA, 3003 bp, Unknown; identical to SEQ ID NO: 22435
  misc_feature (1)..( 3003): 2750-1469P.txt file - cDNA_ID_2104909; gDNA_ID_1621089; Annot_ID_170631

SEQ ID NO: 22437 - DNA, 3003 bp, Unknown; identical to SEQ ID NO: 22435
  misc_feature (1)..( 3003): 2750-1469P.txt file - cDNA_ID_2104909; gDNA_ID_2926192; Annot_ID_141123

SEQ ID NO: 22438 - DNA, 3003 bp, Unknown; identical to SEQ ID NO: 22435
  misc_feature (1)..( 3003): 2750-1469P.txt file - cDNA_ID_2104909; gDNA_ID_2926192; Annot_ID_201172

SEQ ID NO: 22439 - DNA, 2055 bp, Unknown; identical to SEQ ID NO: 9667
  misc_feature (1)..( 2055): 2750-1469P.txt file - cDNA_ID_2104915; gDNA_ID_1972165; Annot_ID_179729

SEQ ID NO: 22440 - DNA, 3000 bp, Unknown; identical to SEQ ID NO: 8272
  misc_feature (1)..( 3000): 2750-1469P.txt file - cDNA_ID_2104927; gDNA_ID_1621202; Annot_ID_174989

SEQ ID NO: 22441 - DNA, 3000 bp, Unknown; identical to SEQ ID NO: 1054
  misc_feature (1)..( 3000): 2750-1469P.txt file - cDNA_ID_2104946; gDNA_ID_1620352; Annot_ID_154351

SEQ ID NO: 22442 - DNA, 3003 bp, Unknown
  misc_feature (1)..( 3003): 2750-1469P.txt file - cDNA_ID_2104953; gDNA_ID_1620364; Annot_ID_154772
ttctagcgtgaatcttcaagttaagagcacgacgatccaccattgcagcttcttctttcatcttcataggtttgaaaacctctgtgacagatggatcaagcaaactaatggagcaactaagtgtaacatcaattgacaatgcctcttcccaaagctctcttcctttctcaaagtttcctcctttacatagttttggtatgagcagatcataaacctgaccataaccacccactgagcttctcttcatcttctcaaacaattgaagagcaaagttaacccgctcgaccccacaaagaaccccgatcagatcataatagaatttgcgttcgggtctaaatcctctctcgatcatctcatccacaatttggttgcctttaccaaaccttcctgtcaaatacaggaccctcacaacgaagtaatagctccctgtatccggatcacatcccgatcttttcatctgttctaaaatctggcaggactctctcaccctcctagtccttcccaaacaagagagcaaaatgttgtaactcatagacgtaggttggattttgtaagacctcatctccaacataatattcaaagcttcaggaacaagcccagacgggtttcgattcacgtttctttcgcaaaggcaggtcagcaacgagttgaaacagaacaaatccggtgtaatccctgctgatttcatatcttgtataactcttcttgcttccttcacgtttctttgtaccgaccacccgaataaaagacttctatacacagacaattcattcccggatattacatccttgtgatgatgcataactcccaatgctctcttcacatgtcctctggaacaaagagcgcttataatagccgtcacagtgaaaccatcttgtgggcaagaaaatttgtccaagatcttgaagatacctattgcatcttcttccttaccaaccttaaccagagtttcagcgacaatgctaaacgtttgcttgtccatcgcccgattctccttcctgagatctgataagagtatctgcatagctgtgtgatccttcttctcagccaaaactcttaggacatagttgaattccttgtcgtgtaaactagatcccaagcttttacacgaccaggagaaaaacctcaacagccttctcggtgaagtctcgttcttgcaagactcaatcacttgggtaacaaggtttgatgatggagaaacagaaacctggttcaagttttcttcaaggtcatctagaccaccaactggagaagaaactatccgaataacttcatgcaacgccgtttccgatcggtcaactaaatggtgagagcaaaagtaacgtgtcagttttgcagtactcgttagatacgtaaacctgtttaatctgactgtggtggacatcatcttctctgaggaatttcatcaaacacttgatatgcgtatgcttcttaaaagccgccaaatataaaccatagaagggactctctcctgacttacatgtttctcagagtatttacaacttcgttgtaaattctttcagcaacatgaaattcagatttctattaaaagacctaaatttgcagatttcatgagatcgctcggctcaacaacaatatatattcatttgttggaaacattgcccgcgtgtctgaaaagggcattttagtcttttacattccatcacgcttcaaattcagaaccggataaaaccgataatcgtgagatacgatggttataacttataagtcactaaccggaatgattactctcgaaggccgccgatgcatattggaaaatcgaactcccgataaaatagttctgaaattacacgaataattaacatcataaagtcataaacaagttattggtcaatggtcgatggcaaaacgtaataaaagttggaccgggacaaaacgtgtcttacggtggatgaagttgagaatatatcatgcattattggtccacttgtactaacgatattcgcagctactaatatgagccaatcggtaatacgaaatattttagcttgtcgactacttactttctatataaaagtttagcctactaattatctctttttatgattatgacaacttgattatttgtttcccaaccactgatgatgagattaaccatcttttttgctaagaaggtaaatatttcatcttgctaatgtcctgtttacaagacaatttgcacacatacacttataacattagaaaaaaacacttgaaactttgttacaacatatcatttagcttgatttttcaatcactttaagaagttaatgaatcataatgcctaaataagtcctctataacaaccatgaaaggagtgttatatctataaccctgtgcttttagaaagaatcataatttttaggagtcttttgtgatgagaaattgagatgtaataaaagtaaaattttctatatctgtatctttcgttttttatttttattttgtttgtatctttaattcttcagtacctaaagataacagaaaaataaaattctgataatagattttcttgttgttataaatatattttaataaacgaaacgaagccgaatcctaaaatttggtttctgatggtttggtctgatctggtcatatattttaaaagaatttgcaattttttctttctgtcgaccttttgatatgtttgttgattttgatatggagatgcatcttcttatcttgtatcttaccacaataatatcaaaaacaaaaataaatatcatgagatattttctccaagatgacgtggccttttctctatctcaaccaaactatccaacacaacctttttttttatggcctgcactttttattgtccacgtcatctccttggcctaaaatatcccaagtcccaccattaagctacacaacaacgcgtaagaaaaagacttaatctccaccgtccaattctatcctctttcaacggtctctgatttaccatctctctctctctttttcgcgtctcataatttgaccattgattgacaaaacaaaacaatg

SEQ ID NO: 22443 - DNA, 3003 bp, Unknown
  misc_feature (1)..( 3003): 2750-1469P.txt file - cDNA_ID_2104994; gDNA_ID_1620373; Annot_ID_155052
ggtagtcaacgttttgcattgtgggacggttcaggaagttgagttcattggatttgagaatctcattcgccatctcggctgatgagacaataagattaggaatagagccaatgaagagatacatcaaaggtccgtagcggattgagagcttgtgaagtgcttggtgagctatgggaccaaggaggtgaatgtgaccgatgatcggtaaagctgttgggcttggtgggagtggaagtctgtcacgtaatctgttagtaatagcttggatcaagactgtgattccaagacatacaaggatgattacggagaagtattgtaaatccaccattttcgtttgtgttttgtttttaggagagatattatcatgttttgattttataggataggtttatagtcatgactcctaatggtatcaaatgtcaatcccaacttcaagattctttcttttctcatgttgtctttgttctgtttttgtctcttttgtgaaggtataatctctgtttctgatcctgtttcatgtttatttatggcttgtctgtttataaacaaataaaaatttaagaatttacttgactgttgttaagctttcattatcagttgacaaaagaaaaatgttttcattgtctaggcttacacgtcattttcaggtgtagttagattagtaatcaaggttggtaacaacagactgtaagatttagagcttatggaaataactgaaacattttttttccatcaatagtggtaactggtaagcttatgaaaacagaacataaaacagagcataaaacagagcacagtacatatgattccaaattcctaatgatgtttatctgcagaaattcacttagtttggtatccaaatggatcaaaacataattcaggagaacacataagtgagcttcctccagcagtccctgaagccgaaaagccggtaggtaacttgatcttgattttgtcttcatctcccttcaccgtccaattaaaacactgcacgagtgacccaattgtgagactcaacaccagagaagcgtgagaagctccaagacatcctcgtcttccgctcccaaacgcaagataattcacatcttggccttttaattccaacatatattgctggtagtaacccatctttctctctgtatcttgttccaccacaagaaacctctctggcataaacttgtcagggtctttgtatgtggtcggatcacgcattatcccgtaagcattgatgaagatctttgtcccggattttacatcgtacccgttgatcttcatgtctgtgttgctttctctgcgtagtaatggtcctactggatgaagtctcaatgtctccttgatagctgcttgtaggtaaggaagcttctgcaaatctgattctttgattaaccggttcgttgttcctacaaccgatttgatctcgtctctgatcttcgcgaagatatccggatggttgattagctcagtcattgtccattgtaaagctgcagaagtcgtgtctaagctcgccatgaacaactcctgcaaacgagagaccaaatattcttattaaggctaatttaacgaagctaaagaaaagtaatgcaaatagcttacaagaatgaagaacttgatctgattcatagtcaatctgagttcggcttttgggtcattatacgtgtccaacaagatatcgacgatatctttatctttctcttcttcctcattgctcttatcgttttcatattccttcagtatcttctcaaccaactcatcataccgccaaatagaggatctaagcttcttaccattcccaaacaaatccagatcccgcaatggtccaaatagctccatgaatccaaaccttgtggcgcaagccataatatcactcactatcttcctgatctctttgggaatattcgagttttggcggcaccttttccccataaccatctttgataagatctttgtggtcaaagcagtgaactccaaaccgagatcgcaagcctctccgtttcgcgacctctcaaccagcgtgctcagtaaagctaacgtttcctcttctcttatgtcgacaaatcgatcaagctgataacccgcgaatagcttagtcatgcatagcttcttcatgaacctccagtaagatccataaggtgcattaaagaactctgatcctttataaacattgaactgtctcggaccaaacacaaacttggaagcgaaatcagggtcgtgagtcttgaggattagcttagctgtgtcggaatctgagacaacgaggactcgtaatgatccgatgcgtatggtcatgagaggaccgtaagtatgagccaaggcttgaagagatcgtggtaggctagaccggaggagatgcatatgaccaagaacgggaagtcctcgaggacctggaggaagacctctgcggctagaggagctgaagagtctatggagaaggaagatggttacaagtgtgaagaagagatatgaacaagaagtataattcatatccaaattcaatgtaaacatatttgtttgtgctgattattgtgactgggatcaaacaagtataagacgatgttagtatataacaaaagctttatgtttgtttgaaaatactataaaaacttgtcttgttgccatgaaggatctaaaaatacatgattctttgatgatagtgaccttgacttaaaattgttaaattatgcattatgttcaattatgtgttagaatttattgaaaatcatataataaaacattacatttttcatcaaaaagataataactaggcctcataataatatgttattaatataatattattttattttttataaatgtaaaaatcgaataaataaggattacaagcaaaaaagtctctgaaaggaatccataaacctacaatggcggggaacacggaaatattggcgcccagataatcttcttctgtgaagcattttaagtcgccgactccaatcaacagagcccagttattccatattatcgaattaattagggttcagagagatg

SEQ ID NO: 22444 - DNA, 3003 bp, Unknown
  misc_feature (1)..( 3003): 2750-1469P.txt file - cDNA_ID_2105010; gDNA_ID_1620422; Annot_ID_156618
gctgaagttgaatcacaccgtgttcatacactctatagaaattcaattgactctaccatctatatactaccatgaaagagacaacaatggattacaaatgcttttattttccttttacttaaatgataaatacagaatattttgaattcttgatcatagtttaacagttgatgtaatcatgagcggatctagagttatatttttactggatgcatataatttcttttcgaaatagatcggagacatttaaaagagcttacattattttattttatctgttttgtttataattagacaggacatgtggtacactggtatttatgttcatcttagagctcctcaagatcacgagttcgattttaacttttaagagtagattagactagtttaacttcttcttatctacgatccaaaaactaatgaatccttgttaaagtccaaggcttcttgattaaaaaacaaaatgtcttctttaacaatattttagttatatatacgagtcaattttctagtaagaaatcgtattacccgttagtctaaaatcgattaatttaagtatcaattgatgtgaagatggtgatacgtcgtattcattatggtttatttgtgtgaaatgttaaagtgtacaagtcttatcttatggaaaaacattctccttttgtataaatgtgatgttattcctgaaatatgatcagtctcaatttgcatagttaattaatcgtcttattagcttgtggttgtgcctattaatgaaacccaattgctaacaattcatcttctttcttcttttggctcctactgaccaaacttacccacatataaaactataggtaatcaatctatctcaaagcattgggccctttgactactttcaacgtgtatatctaaatgttctaaaacttatcaatgaagcaaaacgttccacaattttacatatttgaaataaatcggtttttcaaatgaaaatacttaatgtttttttgggatttatactcaaactaagcatcgctaagccaatatatatagactaataatttttaagaaaatgacaaacatatatttactaaaaagttatttctcaaaactaattaacatattttcataatattcttttattcttttattgtagtacattgacagcgttttaaatattagtactgacaacttggagattctttaaaaatctaaagaatttgtttggcaaattagtcatttccggagaatatttttttttctttgactaaaatatatactttatattcaagattttaaccagatatacaaaaagttaggatcaaagacaatcattctagatcaaccacattaagtattacactaagcaatactactttctttctcaaaaagatgtttcagccaaaaaggaaacccgattgctacatacgattggcggcgatcctccattgtcacgctcttggcaataagatgagctccaagattagagcttcttatttcaccacacaatctctggagaatgttctaaatgagataatttttgtggacgttgtgcaaatatcacacatgacaaaaaaaataaaaattggtataatcgtatgaatgatctttcaaactgtcttttattcgaaagatgattgtatatgtggatagatgtcaacacaccaacaaacattttgatcctatctgtatagcgaacaaaatatttgtgagaatattgaaccaagtcttaacaatgggaagattcatatcttagagatcagtgcaaaatttgagggatcaaaagattaacgtcaagtgtgtcatcagacgaactcctacttttatgatacccataatctttcaatctgttccgatttaaaaattttaaatgtaattactgattgtttgtaattgataataaaaaaaaactatttcatattttcaatttctaacattattgtttattgtttgtaattaataaaagaaaaaaacatttaatagtttttcatttttgacattatactttcttcaaatctaaaactaccaacgatgatatttatattttattaatccatttattctttgatattttcaaaaatgtccattaatgttttcattgttactattactaagtaataaataatataaataaacactgacaaactgaagttacagactataaataatttaccatactaaatgtaacatcaaagctttcatagctcagttggttagagcacccgtttagtaagcgggaggtcttgagttcaactctcaatgaaagcatttttctccttcttcttttttattgaacccataccctcgaaagctttttcttttgttattttttgaagtctatttctcttttcactgtctctcgcaatctccgactctctccttcttatttcgtcgccgtcgctactctttctcgtcggtaagttcccctctgtcatttccttcttctccaacatctaatcttattgtcgattgtgtaaattgctatgttttccagttatttactcgggcacgaaacatgttcgatgaaatgtctcaaagagtatttttttagactcataacgaaactgcttatctctttgcttttgttcgtgattttgtattgcggttctaacgttaatatgaactgggttagctttcaaattgtaaaaaaagtttaccagattcgtctggatctaatgctcatgttttagttttggaataaaaaatgtccagtctttagaaactattgttaaggaaacggaacctagttttggagaatcgttagttagagttgatcgcattgacatagcaaccttaattttatggtctcatagtttgcagattctcgtatttcagaagctactgtatttcaacatcaaagtttgtacctttctatgatgcatttaccattttggctttgaagaagatatatctgaattttgattgaaatgtttacgtttttttgttaaatctatcagactataatgagtgattttgtttcattgtgttgcttacgttaaggtggtatagtgtcaactttcaaggaagatg

SEQ ID NO: 22445 - DNA, 3000 bp, Unknown; identical to SEQ ID NO: 1156
  misc_feature (1)..( 3000): 2750-1469P.txt file - cDNA_ID_2105020; gDNA_ID_1620364; Annot_ID_154775

SEQ ID NO: 22446 - DNA, 3003 bp, Unknown
  misc_feature (1)..( 3003): 2750-1469P.txt file - cDNA_ID_2105036; gDNA_ID_1620463; Annot_ID_157825
acctcaaaagaaaaaaacaatcatatgaaatacagctttaaagtgtcttacttgcattctagtgaagttgtttgcagattgtgaagctccattaccagaagtgtgaagatcccgctctgacgacgcactgggaagatcataaacaagaattcgttctagcctctaggaagaaacattctaaacagaaaaagctctaaaacagacttctttgcataacagtctctatctacgtcgttttcatcatagagacgtttaagcaaacattggtgtgcaagaaacatcgagagataatctcaaaaacccattaatggatttaagataaagattcaatattagtgaaaagattgagcttaaactattgaagcgagagtaccttttagagcggccatgtttatgagaatccaggcaatgccaagaatctccgtttcttctctgcttgttaccgtctttattcaaatcaaaaccacccatatatctcagccaaaaccttaaactcagatgatgaaagtaatcaaagtctccaaaagaatctcagtaaaagaagaaattgataaaggagtgaattcaaatgcagcaaaggagaagaaagaatgaagaagtaaatgcagagacgaaaactgaaactgtagcttagcccataagaaaggggaccaggttagtagtatcagagtgcctgccaaaattcaattacatttcactttatggttgttgtattgcatttaattcgattttttttttgtctcattttaaattcatagttccatttccctccttttttcgagaaatacaacacttctaggttaggaaaattcgcataaatagttatactcttaattttctctggtcaaataatattaagaacacgctacagtaggacagtgcagtagttaatgttgtcatgtcggtccgagtacattgagaatttaatgttccgatataaatttccttgttttttcccaattttgaaaagtccgttaaattttcatatttattcaacgagacactgtactttcagtttccaccgaaaaataattcattactcatcatttattcaatgttcgataatttcttggaagcagacagcatttgggcctcgagatttaaattggcccaaggtccacgtttacttgggtcaatcacagtcaaaacgttttcccggggtttctctcaatttttttgtcaaagtctctcaacttttaaaaatacaaacactgggatcctccacggcatgcaaaaggatattataatgaagatgaaatcaaattggtataaaaagttggagaaaggtataaacactatgtatgtggctaaaaatagctagaaacttataatttaggtgaaagaagatttgagtaacgttgttgttgttatataataagatgaaataatgacaagaaatctgaaataatatgcgaatatgccaccgacgggagaaatacacgtggacggctgataaagctttgtgaaggaatcccacaataatataagaagatctgaccaaaggttcctttctggataagccgctctcctcgtgtccacgtggcattttcaaacgtgggacctcctaatctatatcactaaacccatccactcatattatctctctttctatcatctaaaatccaaaatgttcgtccatttttttttttctgttcataaacaaaaactgcattgccttttaatttattcttcttctaatccatacaaatgattatggaactataaatctataataataatacaattaaccacaaaataaaatatatcttagtattataagatatgacttttggagttagggggtgtctaatacaaatattatggtatttgtaatcttagcaagaaatgaaatcacaatcatgtttatctttcttaagataacatattttactcagtcatgggtctacttttattttcagtttagattattaaataaataacaatagttttgtcgccttactatatgaccaaaaattagattttctctatgtgtaggatgttggcatttgtttaccatttttcttatgataacttattaaacagatgtcatattttacttatttgtgtttataactgttaaaatctagtcaagctttctgtatggaacgcgtgaagggctattaagatattttaaaatgttgaatagtgtaattaatcttgtggctaataatattcatgccaattgttaatttctggtggagggttaacacttgtacataaatacttaatttttctttttgcagtttttgtatagatatccatccttatataaatagaaaaatataaggaaattgtaatgatttagcataagacaattggataatcacaaatgcattaaacctattaactagtctatatagaaagagttattagttacagctatactatttgtggtggcattaatatatagtaacttatttaagatatatgtcataatgttaaaaagaaatcacagagaaagctgttattttttttaatcctaaatttaaaactttggatattgagattagcctgtaatacatctttttccaaaaaatttatacaaaaatggccattaataattaatagtaatagctagttggacttcttagttcaaagtaattcaacattttttctaaaataaatcttctaataatagaacacgttggattgactaattaagtcaaatatgaaatatggaaaaggaaaaaaatccaccaacgatacaccaaataatttccgatttttatatatataaataaacatactaagagcaaaagaaaaacaaactgaaaataaaaaaaataaataaataaaaaaaaaaatccggccagataaatcgaatttatgtaataaatccgaccagataaactgatattattgtctttcttccgctcctttgtctctctatctctttctcacaattagattctgtgcttcttctgcgatcaactaagatccgatccgcgagcgtttcagacttcgatcagatccgattaagagaagcaaatcgggtcgggtatg

SEQ ID NO: 22447 - DNA, 3003 bp, Unknown
  misc_feature (1)..( 3003): 2750-1469P.txt file - cDNA_ID_2105044; gDNA_ID_1620417; Annot_ID_156480
atagggattttggaatatggtcacttaccaatgtaaagccttggccttatgatataagtttgttttgtgcttgtaaacatgtagatgacaaagattgacaagaagtagatgacaaaggcttttatcactcgcgactcgagaagcatcgcattgtgcaaagcaaacagcttatccaaagctacaaacatgtttgcttgtttagcctcaaacgctacctgcaaaaacagattgttatatattgattttatgtgacatttgcttgtacagcttttgaatatttgttaagatttgggaggactgacctgggcttccaacattgattttgaattttcaaacaagtgatcatgaacctcctgaagcttttcttgccgctttgcaagatcttcttgttgctcctgactaaattctttcaaacgttgcaatgtattcctacaaagttgcagggaaaacagaacacaattagctcttggagaaaagtgtcttgcctttgaatttaaactgataaaatgtgtatttgaaacttacctactctcttgcagtgcctcagactgaaaccgggtaagaaactgaataccgtcaagagccacggtttggccgtctaaaagcttctgttgtttatccaacgaactacgagtctttgttccgatgtcatcggttgtactctgcaaatctatcattttggttgataggttatttccaagtacacttatttccacctcaatctgctctgtatcactcttcaacttatctactccttcttggatgttagtatacgcatcgaggaacatgtccattccatctttcaacgtttctttcatctttacttgaccgtccctgagagctagctgtgattctgcaatgttcttctgttcttgagagatttctactgtttgttgagataatccactcacactagtttctaaggtgtttgtcacactagccacgttttgaacccgaacatctagtgaccctaaagaatcatgaatcatgcttgaggtctgtattaaagcatcagatttactctccaagatatccaatttatcttctgtatactgagctgtattcttgagctcattcacaagcctctctatctcatttttgaacgcattactcctgccataccaaaaagaagcaaattgagaatccattttggcaaacaaaagtaataacagctagaaaaatattcatggtaaattgtttttcttactgtaattgttggcagatggtgttggtttcaagcaagaaatcgagatagatcttatgctcatgatcatcaagcttcttgaggcaactcatcattactgattcatctttacaggttggaaacgccggtcttcccgagtctttgatgaagcaatcgctcaaataccaagcaaatctctttctcttttcttctgtagcaatcgtttctttgcagccagccaagaggtaactataagcattttgccagcaactggttagaccaacaagcttgttttcaaggacttgaaccgccttctgatcactgaaaacttccatggagaagtcggggttggatttgcgagaccgagaaaaagaagaagagtatggatcttctgctgaggaagaagaagaagagaaccatccccaactgtggcatgttaatggagaatctaaaagtatgatcaatagaagaaacagaagacattttctgctgaaacgatccatttaatcggatttgagatcttcttcttctcgaggagccttgtgattgatcacctacgaacaaacaaaagagacagaacattacattctgagaatgttgttgtttatataacagaaaacttggagcgcaagaaaaggaagccccttgaacttccaattagataaatggaagttttttctttttttggtatcatcgtcataaataaagttcataaagtttataaaaaaaaagattattggcaaatcaagttgcagatttaaaaagaagaaaataaatctcattaaaatcttcagaaaacaatctttctaaaataaggaagaatctgtatccactttgtttttcgttttctgagattaatacatgcatttgaagtcgtatcaataaagataaaccaaaaaccattattactaagaaacaatatcgaaaaatagtctgaaaaaatcacagaaaaaagtacaatccaaattttatcgtaaaagagaacaagaaaattacacgacaaggttaacttcaagatcgatattgggagaaaaacatataagaacaaaaaaaaaactaaaaatagttatatgacttcgaatcagagaagaatctctacgtttttgtcagtcaatttcataacagagaggcaaaacaaactaaagtaccaaaaataaacacgaaaaacaatttcaattctaaagaataattttctcaaaaaaatatttgcatgaatgaatgatgaatctaaacaaaacacttactttaacataagtttcaaaccaataaattaaagaatgagaatacagtgatacaaaaaaaaaacacaaagcttaccagaaaacagaagaattggagattgtttttgagtcggtgattatgaggaaagtgagaaatgcaaattataaagtaacgaacgtgtttgacaaaaagatggaaacgtttcgggaacgtttggtttacttcccggtttaatttgattttggttatgtgattaatttattttcggttcggtttaattgtatttggttcattggtataagaattttttagtcaaaagcaaaatgccaaacaatacacagagaggaatgatggaatcttcagctttaataaatctgcagactctcaaaattccgattcatcttattgaagaacaattttccggcgaaacagccgatgaagtctcgcctgaatcttctgtacctttcaccggcgattgacttcacttcagaatcgagagagaagaaatcgatggaaaactaaaaatagaaagagtttcaaattctcgctctctcttcaaaaccgcaaatcaagggaacgagagacgagagagagagatg

SEQ ID NO: 22448 - DNA, 3003 bp, Unknown
  misc_feature (1)..( 3003): 2750-1469P.txt file - cDNA_ID_2105048; gDNA_ID_1971795; Annot_ID_175616
catactttgatctccttgtttcattgtgtgttttatttatcttctttagggcttcttcgttgtggcgcactatattagcctgaaaatgaaatgcttgtaagaaatacaaaccgaaaaatcaaattcgagtatggtttgacagatttcccatgcgcaacacatctaaagacagatttataaagacaactgaaaatagagtgatgactctctcaagaaccaaaagggacaaagtaaaagaaggtgtaacctttgtcaagtgaactgcatcctgaagttcttcaagggtatcctttatttgatcaccttgaactattaagtcttccacaatatcatgtgaaatctacaatgtacaaaaacccaagtcagtccgataactgcaagactcagggagaataacatttccggctacaaatgctaattgcaaggacctgatttctcttagtgtgagttgaaagcattttacttaaagtcctcatggtagagagcggaccacggatctgccaatacgcaagaaagaaaaatgcgtaatataaactaaaaggagacattaattaacataagatctatgtgtactaagttaacaagtgcgtggcttgtacctgctccactagcttactcatcctcacattgttttgccaagatgactgttgaagtaacattgttttctatacatacccaataataaaaaaaaagatcaataaggattaaagccaacaaagacggtcaagcaaaaacataagaacaaaggaaaagacaggatataagaacaacctgatccatgacataagccatagcgagagtccgagaaatattaatcgcatacgatctctgctcttcagtgaaaaccttaacagaaggaagtttaactctaggtgattttgtattagctgaagcaggcaaagcataagcttcctcaggggaaagaaactgatttacaccatgcggtttttcctcttcctcctcctcctcctcctcctcggcttctactggtaactcagcaaccaagaaaccgacaacaaacgggtgtttcaccattggaaacacagcagctctatgtttactcacaagttctacctatcatccacatattatgtcaacaaaaaaaccataagtaaacttgagtttaacgcagaggaagaagaacacatacttgttgactagaaagtgatgcttcagctgctcgtagacccgcagggataccaaagtttccaactaagatcacaacgtctccagcattaacacttggataacaagtgacacgacgcaactctaatcgatccatcacatagctaccagctggtcttacatatatctaaaccaaaaccaacataaaaattcaacctttaatctaacaacactctattttcaagcaacaatgatgtaaaaaagcagagacgcaccgagagtactgcgtttggatcaacgatttgacgaaagagatctaattgctcaagacaaagccgttgaaaatcaggacttggcaagataatcttagtcttgagatggtctttctcaatcatctgtgtgaactctacaggagttgttgaagctccacgaatcgcggaagctatagcggaagcagaagcaaccatggtctctcctcctccgggttctgattcttcattagatacagtgtggtttacgtaacggagaccgcgtgtaaatatagaagacgacgacgaggaggaggaagaagaagaggcattgaggagcttaagggagggattagaaggtctagggtttggaatagaattggagaagtgtagattagggtttgatgagagaagggtctgagaagcgattgcagaaagaagcatcactacggaagacgacagtggagtctttactttgtggctgagactgaaactctcgcgaggaagacgatcgatatacgattatagtttacacacaaaacaactacaactaaacggcatcgtattaacagacttgtaattatagtttacacaaaaaacaactacaattaaacggcaccgtattaacagacttgtaacagtttcagatgagaggaatgtaaaacggcgacgttttgccatctgatacattaacctctaagaagaacattcagttgtttttaaattattgtaaagtttttacgacgtttaaacattttcacaaagtttcgataatttatgttaagcatcacttcgaaagttgtgatgactggtgaacagaattcactgggaaaaaaatattagtagggcattaacaatacatttctattaacaactaggggtatttttcttaaattttcatgtttctactaatgtttaaacacacgttcttccaaacttgtagaatggtaacacatctattaaagtaagaaaacactatgttgttccccatagctaaaagaggccaagaaaatgttagatggtcaatcagtgagcttactattaatcatatttatgtagccatagccaatcaaacgaagcaaagcccttttcaaccagttgaacaaatccaaacaagcatgtttcaaccattttggaatccaaacaatcatctctacgaacgaaaccacacaacaatctcacaaccctgtttcattaatgttgcgataatcgtgagagtgtatacacgacaactcatgcaaaaaaagataaaagaagatttgagaaaaaaaacgtgatagaaaatagagacaacaaattaaaaaaactagatatctacaacgaaaataaaataaaatatgaaaatggaaagctaccatataaacttaaaaagaaagaaataagaagagaatcctccaaagaaagaaagcatatttgtatgatggtaaacttacaagtattttcgtaaacatattcaaaatgtattgatttataactaaccctatctcaataaaaacatatcacaaatctctgatttttgtgttttgccaaccttctttctttttctggtaggggtaacgtttctcttcttttgaggataaaagtcccgtgattgagttttggtctctttacatctttagctttaccaatg

SEQ ID NO: 22449 - DNA, 3000 bp, Unknown; identical to SEQ ID NO: 1465
  misc_feature (1)..( 3000): 2750-1469P.txt file - cDNA_ID_2105052; gDNA_ID_1620406; Annot_ID_156104

SEQ ID NO: 22450 - DNA, 3000 bp, Unknown; identical to SEQ ID NO: 9971
  misc_feature (1)..( 3000): 2750-1469P.txt file - cDNA_ID_2105059; gDNA_ID_2096296; Annot_ID_195562

SEQ ID NO: 22451 - DNA, 3000 bp, Unknown
  misc_feature (1)..( 3000): 2750-1469P.txt file - cDNA_ID_2105063; gDNA_ID_1620769; Annot_ID_50182
aacaaatagcgacgtctctcctagtttctcctttccctacaaaaccattgcagcccacatatctctttataagcaaatcagtgtaagagattggaagcagatagtaaaacagagataaataagctaaaccttaagctctggtaactcaattacgcaagcacattcaacaatcttcactcctactcgttctgcaaaaccaaccaattgtgggagtgagaaatagtcaagtttaactgaactgcatatgctgcattatcaaatcttggacttaccaagtagtcggattgcagcagcgagagtcccacccgtggcaatgaggtcatcaataataatagcacgctcaccaggctctactgcacctacgtgcatctcaatcgtatctgttccatactccaacgaatactcctccgaaataaccttccctgttaaaggaaccaaatgcagaggcagtttagaaattaacgtccatggataaacaaggaatgcgacaattatttgacactgctcataagtttccaaatggcttaatacatttcttgtaactggtcaagatacacaactaagtccattgatatgtaacagaaaaaataacaaccacttaagttactgcaagttaccacaaagaaaaatgatctagcaaatgagtagcatcatattgatcaaagacactgcaagataaaagtcaccttgctaatgttcgagataatgataaagtgtagacttggagcaagaagccatttaaactaacaacttcctaattgagacctttcatgtaacttaatgtcaaaatcacaagcaactagaggaagaaataaaaatgtaccaggtagcttcttgggcttcctcatgggaacaaatttggcaccaatagccaacgcaataggagggccaaaaatgaaacctctagcttcaacacctgcatttaccacaacatcaatttaggcagaaccaaaaatcatccaccaattcatttcaacttttcagtttaagctaaagcactcagtatctaaaaaggccaaaagaaactaaatccacaagctgttaatcgattggagtaccaaacagaaccatacgagttgttacctgcaacaacagatatgcctttatctttgtatctatcaacaaacaaagcaatagtatccttaaaggcctcagtgtcgagaagaagcgtcgttatgtcctgaaacatgattcctgccaagtatccaaattaaaaccttaagatcccaacgcagatcaagactagagacgatattaatcggtataaatggaaaaaatggagacctggtttagggaagtcggggatgactctaatggaagaggcaatcttagcgattctgggatcttgcacatcttcagtcgccatttcactgtcccgactggctgctgctttagcaaaatactcggcgtcagatttgcaaacacagagagaccctaaagactcaatagagagacacagtgatgaaaaaatgaccaatttatcccgaatggtaacgctttgacggaattgccccacgcaagcaaaatatctttttcaaaaggaaacaaaaagtttaaaagggaaatagaaggtggtggggtctaccggcggaggagaagaggcggagtgaggtggttgaacggtggtttgagaggcggatcgaaggaggagcacggtggtggttgttgagaagacggttgcaaggaacagcacgagcaagacagagacgatgagaaacaagtggagaaattattattgtttgcattgtctttggactgagagatcttaaaagagaatgtaaattactttaaacacggaataatggacaaaagccgtgatcaatgacttttcaagtcttaaccaaacctataactcatccattgtttgttttttctacatatttcttcacataaaattggatgatttagaatctttcagagtgttcacactccaacagattattatccacaatgttatggttacatttagagatatataacaatgttcatttcatcgttgctaatgacataaaacgatcaaaaactgaatcatagtacttcttttacagtgatctcaaatatattaatcgctaatcaatgaattatgtcacctataattgtcgtattaccaacaactataaaacatatatataaaaaattgttgtcgttaactagttgttgatagtggccactctaaaacgatcatgacctactacggaagttataactagtcaacgttggacgttagcaaggcccaatggacattaactcagcccataatagcacgcgccttgtgatgtgcaccagtttccgtctttggtcgttgaattcaaggaaaaaaaaagtacatcacaagcaatttcttacttatctgtgacttgaagctatttctccaatttcgttttccatcgacactctatttcattttcaccattcacgtcttccttctgaataaaataaaccctaaaacctaataccgaagtaaactcgtcaaccactgcgcccatgacctcccaacgatactcttcccttatattcttcctcttccttcttcctttctgcgatccaaaccttcaaacacatctccggtagatatgaaaatccactcttgcctctccgccattcttctgttcctcttcttctctgcttcttccgctaaacaaaatgttcggacagagcgaatttcaggtacttgttcttcttgctccagcagattggaatgtagagttgaattgattaatccttgagggtcgctcaaataagtttgaaatctgtcgtttctccagcatttggtttatagacatataatttgatttgcttaagaagtcaatgctattgattgaggaactatgtaacagctgtgtaagagagctcaaaaaggtgtgtttttgaaatgcaggaagtgctggtgatgttttggaggatgatccagtgggaaagcttaaggtttatgtatatgagcttccaagcaagtacaacaagaaattactgcaaaaggatcctcgatgtcttacacacatg

SEQ ID NO: 22452 - DNA, 3000 bp, Unknown
  misc_feature (1)..( 3000): 2750-1469P.txt file - cDNA_ID_2105063; gDNA_ID_1620769; Annot_ID_167438
tatagatttgttaccttcctaagcttattgtcaaattatactcatcagcatgggacatggacgagcattgtgatttgtgtccttacgagttgagaagagaagtaacgagcaaggtgctgcgaaacttaaaagaagaattgcgttaccaagactttagcccctgttggagtctactattacaacttgattctataaataaaacccataacaccttattaatcggggattttaagtggaacaataggaaactgcaatcgaatcctgacattcaaatgccattttctagtctgaaccaattatgataagttgaaacaacaaggatcaaatcccacgcaaaatgtctcaccatacatgaaaaatagcatcaacactcgatccaataaccttctcttccagtttcttgttaagcagccgactttacaagaacaaatagcgacgtctctcctagtttctcctttccctacaaaaccattgcagcccacatatctctttataagcaaatcagtgtaagagattggaagcagatagtaaaacagagataaataagctaaaccttaagctctggtaactcaattacgcaagcacattcaacaatcttcactcctactcgttctgcaaaaccaaccaattgtgggagtgagaaatagtcaagtttaactgaactgcatatgctgcattatcaaatcttggacttaccaagtagtcggattgcagcagcgagagtcccacccgtggcaatgaggtcatcaataataatagcacgctcaccaggctctactgcacctacgtgcatctcaatcgtatctgttccatactccaacgaatactcctccgaaataaccttccctgttaaaggaaccaaatgcagaggcagtttagaaattaacgtccatggataaacaaggaatgcgacaattatttgacactgctcataagtttccaaatggcttaatacatttcttgtaactggtcaagatacacaactaagtccattgatatgtaacagaaaaaataacaaccacttaagttactgcaagttaccacaaagaaaaatgatctagcaaatgagtagcatcatattgatcaaagacactgcaagataaaagtcaccttgctaatgttcgagataatgataaagtgtagacttggagcaagaagccatttaaactaacaacttcctaattgagacctttcatgtaacttaatgtcaaaatcacaagcaactagaggaagaaataaaaatgtaccaggtagcttcttgggcttcctcatgggaacaaatttggcaccaatagccaacgcaataggagggccaaaaatgaaacctctagcttcaacacctgcatttaccacaacatcaatttaggcagaaccaaaaatcatccaccaattcatttcaacttttcagtttaagctaaagcactcagtatctaaaaaggccaaaagaaactaaatccacaagctgttaatcgattggagtaccaaacagaaccatacgagttgttacctgcaacaacagatatgcctttatctttgtatctatcaacaaacaaagcaatagtatccttaaaggcctcagtgtcgagaagaagcgtcgttatgtcctgaaacatgattcctgccaagtatccaaattaaaaccttaagatcccaacgcagatcaagactagagacgatattaatcggtataaatggaaaaaatggagacctggtttagggaagtcggggatgactctaatggaagaggcaatcttagcgattctgggatcttgcacatcttcagtcgccatttcactgtcccgactggctgctgctttagcaaaatactcggcgtcagatttgcaaacacagagagaccctaaagactcaatagagagacacagtgatgaaaaaatgaccaatttatcccgaatggtaacgctttgacggaattgccccacgcaagcaaaatatctttttcaaaaggaaacaaaaagtttaaaagggaaatagaaggtggtggggtctaccggcggaggagaagaggcggagtgaggtggttgaacggtggtttgagaggcggatcgaaggaggagcacggtggtggttgttgagaagacggttgcaaggaacagcacgagcaagacagagacgatgagaaacaagtggagaaattattattgtttgcattgtctttggactgagagatcttaaaagagaatgtaaattactttaaacacggaataatggacaaaagccgtgatcaatgacttttcaagtcttaaccaaacctataactcatccattgtttgttttttctacatatttcttcacataaaattggatgatttagaatctttcagagtgttcacactccaacagattattatccacaatgttatggttacatttagagatatataacaatgttcatttcatcgttgctaatgacataaaacgatcaaaaactgaatcatagtacttcttttacagtgatctcaaatatattaatcgctaatcaatgaattatgtcacctataattgtcgtattaccaacaactataaaacatatatataaaaaattgttgtcgttaactagttgttgatagtggccactctaaaacgatcatgacctactacggaagttataactagtcaacgttggacgttagcaaggcccaatggacattaactcagcccataatagcacgcgccttgtgatgtgcaccagtttccgtctttggtcgttgaattcaaggaaaaaaaaagtacatcacaagcaatttcttacttatctgtgacttgaagctatttctccaatttcgttttccatcgacactctatttcattttcaccattcacgtcttccttctgaataaaataaaccctaaaacctaataccgaagtaaactcgtcaaccactgcgcccatgacctcccaacgatactcttcccttatattcttcctcttccttcttcctttctgcgatccaaaccttcaaacacatctccggtagatatg

SEQ ID NO: 22453 - DNA, 3000 bp, Unknown; identical to SEQ ID NO: 9231
  misc_feature (1)..( 3000): 2750-1469P.txt file - cDNA_ID_2105067; gDNA_ID_1972023; Annot_ID_178125

SEQ ID NO: 22454 - DNA, 3000 bp, Unknown; identical to SEQ ID NO: 4412
  misc_feature (1)..( 3000): 2750-1469P.txt file - cDNA_ID_2105071; gDNA_ID_1620704; Annot_ID_165195

SEQ ID NO: 22455 - DNA, 3000 bp, Unknown; identical to SEQ ID NO: 4412
  misc_feature (1)..( 3000): 2750-1469P.txt file - cDNA_ID_2105071; gDNA_ID_2926204; Annot_ID_202087

SEQ ID NO: 22456 - DNA, 3000 bp, Unknown; identical to SEQ ID NO: 4412
  misc_feature (1)..( 3000): 2750-1469P.txt file - cDNA_ID_2105071; gDNA_ID_2926206; Annot_ID_202183

SEQ ID NO: 22457 - DNA, 3000 bp, Unknown; identical to SEQ ID NO: 6051
  misc_feature (1)..( 3000): 2750-1469P.txt file - cDNA_ID_2105085; gDNA_ID_1620839; Annot_ID_170024

SEQ ID NO: 22458 - DNA, 3000 bp, Unknown; identical to SEQ ID NO: 6409
  misc_feature (1)..( 3000): 2750-1469P.txt file - cDNA_ID_2105089; gDNA_ID_1621093; Annot_ID_170811

SEQ ID NO: 22459 - DNA, 3000 bp, Unknown; identical to SEQ ID NO: 6409
  misc_feature (1)..( 3000): 2750-1469P.txt file - cDNA_ID_2105089; gDNA_ID_2926160; Annot_ID_198718

SEQ ID NO: 22460 - DNA, 3000 bp, Unknown; identical to SEQ ID NO: 6282
  misc_feature (1)..( 3000): 2750-1469P.txt file - cDNA_ID_2105093; gDNA_ID_1621088; Annot_ID_170553

SEQ ID NO: 22461 - DNA, 3003 bp, Unknown
  misc_feature (1)..( 3003): 2750-1469P.txt file - cDNA_ID_2105093; gDNA_ID_2926213; Annot_ID_202744
agtggggagccatgggatcagatgtggttagggcctggggatttgggagagaagaattgcaggaaatgagggagaatctgtcaaaaatggtatctgagctgaatcctcagtttttcgaatcttcggattcagattagttatgtcttaaaacgaatatgttgtatcatctttaaagattttttctggtttggtttgaaactttatggtcaaacccgttgttgattgacttatcttctttgtgtaagtcgcttgagagagttgatattggaggcataggagagaagcattgtcaaacaagaacaaaccgatatcaacatttatagttccaatgggattcttttgatcaatttgaaacattgctactttccgactttcctttcctgtctactttttttgtgcactatagagttagaaacaacttctatcatctgccagaagcatgatagtgatgccactctctttatccatggcttaagggatcagtaacctgatgcaccttacgagactctgagcttgagtactgtcccacggctcgggcataaggaattgattgtttcccggctgcaagcgcattcacattttcaactaaatactgtcttgggagcctcccgaccacattaccttcttcgttcccttctctatcgaggaaggcgaaatgaggaataccctcaacaccaaactcatccaactcttgctcccatttcgtgttgtccacatttagcatcacaaagttaactttgtccctgcgaaatcacaacaccacaagtaaacatcaactttagcctacaaaacgtcaaattagtgtctaaaaagctccatgttccattaaactaacatgagattaatggtttgcctctgcaactaaaatctcaaagctctacctttttcattagcgtctatctacatagccaacaatccaatcctaaagatagttccctaatccattaaaccaacacaaaataagaactcttctgcaactagaatctttaaagctctagctagttcattagctaaatccattccaagacaagattccttaatccatgtttttcgaagctctagcaatgctcatcttaatctccagacaagttccctaatccgttctgcaactagaaagctctagcttgtctttcatctatatataaaggcttcattttgaaaggagattgattttgatcaaaaatcacataaaagacgattcattacttgtattgctgctcgattttataaacatcaggagctagttctcgacaaacttcacaccaatctgcatagaactcaacaacagtcggcttcccattcgataacgcctaaatatccattcacaaaactcattaagcattctatgagaatagaaacacagatgaagaatccaaaaacaaacctcctcgtaaggcaacgcagaagcggttaaatccttcaaagaaatcccaaaatcgagccttgtcgatacaaataacgacaaagccgcgattacagtaacagccgcaactcttctattgatatccttattgggagattcagggaatcccgaagaagaagaagaagaagagtcagcaacagatgatgatgattccacttccttcgatgcagatgaagtttcaccattatctattaccaatttctcctgaatcaggtaaaggctaaaactttagctaatttgccttcgacccatttcaaaaagaatcgaaattttcacctgtttggtttcggaagattctgggtttggtttgcaacgaacagcgcgaaatcgtggagctcctgtttgggtaacgaagaaagattgaagatttcgaggactgagattgaatccatgactagatggaaggtttaaagaaaatactaagcgagccatcgtcgggagagagtgagagagatgacaaaactgctactcatcagatcgttattatcgaaggagtagtagcttcttcgtctaaccaagctattagagccacacgctttttgttacaaagatttaaactttgttacaaaataatatgaaatgagtcactctttatattccacatacacttaaagtgtttttttttaccttgataaactttaatatttataaagctaagtggtaattttttctaaggacagaatatcaagtttagtttgtacatctttgaaatttaacatttaagttttgaataaaaagaatatatataattaaaatttgcgtttaatcaacggattacttgacgaaaaaaaaaaatcaacggattacttacaatattattcttaaaaaagccttaaaactaaatttaaatatgtgaaaatatgttgaacttataatacgcaggagttacagactaaaagaacaggatgctaaacgctttcaagtatttaaatttcaacatttaagtttgaaaacattttgttaataaacttttagctttaaaatatcaaaacagattatttttgaaaaaatcttaaaattaaatttaaatatgagaaaacatgttgaacttatgataacgcacgagttacatacctaaaagacgggatgttaaatctaaccgttccagtatttaaatttaacatttaagtttaaaaacatttttgtaataaaaatattttatataatagaaaaacttttagctaacaattttcccttttcggtaagacaacttcggtaagacaaaattacccttttccgttacaacggtcatatatttttttacagcgtaacaattttcctatggcctatgtgcgtcatgagtcaaatagcttgaacaaaagcggagcagtttagctagactaaccgttagtgggataacatacgcattttttattcgtatattttagtgtttaccgtgaatattttaattaaaacataaaaatattttttcccctaattctttaattttggttttcattttcaagtccgccaaaaaaagcgaagagagggttttaatacgattccactcttctcaacaaatttgacgtttttgttcttcgaaattcaaattcacccagaaaaaatctcaatccgcgatg

SEQ ID NO: 22462 - DNA, 3003 bp, Unknown
  misc_feature (1)..( 3003): 2750-1469P.txt file - cDNA_ID_2105097; gDNA_ID_1620815; Annot_ID_169222
agatagattatccagttgcacaaaatgcgaaggaaaaagtctaaatggctttttcagaagaaaataaaataaaattaattgtttagatgagaaccaaatctacacgttattaatagacaaaatctggattttcggtactaactagtactattaaccaacgaaaagacaaatttgtagtttaattttaatatttggagaacgtgtctatgttatctctatgtttacttattagttaataaagattaatattttataccaatatttagtaaagtattttatacagaatttcgcgaaaattttatgatcaaaaataataattgtcaaacttcaacaagaaactgagatctatgttttcttaggagaaaagaaaagtaatgtctctttgaattttagttaccatataattgttgtaaccatccataattacaaaataaaatattgttgggagtcttgacccaacaaacgtgagaagcatttaagtttgttttgtggcacaatccaaaacttgaaacaatgtaagactaatagcataactaattaacgatgtaatgatgacataatcaagtaaaatttccattaattctgtattaatgatctgaaaaataatgtaccttttgtcgaggtaatatattcggctgtgaatcagcggaaatgtattaacaaagctttctcacatgatcacacttcctctcacgtcgttaacacaaagacagatggaggattcgtttggttcactactactaaaacaaaagtaggccacagttttaagatatggataatttggtataaaagtaataattttatttaaataaataccaaaatcgggtttaacaataaatgtatttttcaaaatattttattttatcacattaatatagtgtagagctcaaactcaaagcaatagattcattatacgtaacatgtaaattttaattttattgccatgtattacaatttctgtttaataaatctgggctggccaacttttatatggatcactttcctttattacaaatttacaatgagcaacatacaggttttgagaaagtctatacattacagatagtattataccatgacaattgacacagcaaaagcacttaaaatcttcaaaggaagggaatgaagttatcttccatctcatgtgcttgaaccagaggatcaatgattttcttccatcctccaaaatttgaaggggaagcagcatcagacaatacaaacccgttaacgtagaaggttggtgtaccataaacccctcttgaagcgctatactgcaacacacaacgccacgaaagcaaaagatgaactaaaagtcactattgttcgttttcagaaaacaacgagaacagcctcagggtactatcgacaaataggtcacaaaattatacttgataggtaaagattcaggccattaaactctgtattcttctattgccctgacatcactcattttcttgtgtgtgatatagatgcaaggcagtataataagatgatgactatgcagccaatgaccttcctgtaagaaatttaagttcctaaaggaattaccttgaaggaaactctggttgcacgatccgattttttgtcgctgaagccggatttaagaaccgattgatatgagttccccaacgagactgttccaagttcgactattttctccacaactgcaggtcttgaaaggagttgtgtttgcgcgttgtaaaacaatgactgccaaaaaaaaaaacagtttcagtgaaccagataaacattattgaatacatgcaaacaataaccagcaactgcagataaataaacatatatacctaagtttttagtattaacattgaacaaacctgatgcttgaagaacccttccagcaaactgaaggtagcattggcgtgtacggtattcacaatgtgtaaggcccgtgatgttacataggcattgtcatggtagctgcaatttccaaaatccaagaaaaaagattcaatacaagaacgaataatccgacataacacaaaggaatcattcacatttccatggaacaaatcataaaacagacagtgaaacatattttaaagtccagacctttcttaagccacttgtcgattgatcaatacatgaattaagctcagagcaaagaatgaaggcaaagagagaattttagatcactgacggtaaaggaaggagatggaggagaagggcaacgcgagatccatagtgatgaagagcttgcttcagtggcggccaagagtctctactgtccgggcaaaccgggtcaaaatacgcctcaattagtatagtatccgggtcgaaacgatgacccggtgggtaaacgaaaccatcttgcctcaccggcggcactagctgcgcttgtactctcgtctcaacgacgaagacaaggaacaggagaaccgctcgaatcattattctctgactcacactttttctctcttcccagaatcgccggagatgattaaaacagagggacggtgtcggtgagtatacgcaacggctacgattactcggaagctaagcgagacagttacctctcctttcatctctaaccgttgatttcaattatggtgacgtggcagaaaacacaatctggtaatgggccatatttgtaatgttatagagtttggtatttaaactgtaattacacgtaaataagagccctccctctacaaaaacgatagatttgagatatggtccaactacgttcacagagagactcataaaccataactctctctccctctctccctctctccctctctctctgctcgaatcgaaccgttcccaggtatgtgctttgttgatttagatcatcagaaaattctattgcgtctctttccttgtaccaagttgtttcactttcaccggattttctactttctgcatccgagtttctatgattggatcgaaatttgaatttccattgattttgaattgcggactgcgtcgttgattgatttcaggagctgctttgatttggtttatcgttgatctgtgaaaatg

SEQ ID NO: 22463 - DNA, 572 bp, Unknown; identical to SEQ ID NO: 15284
  misc_feature (1)..( 572): 2750-1469P.txt file - cDNA_ID_2105101; gDNA_ID_2926123; Annot_ID_196698

SEQ ID NO: 22464 - DNA, 3000 bp, Unknown
  misc_feature (1)..( 3000): 2750-1469P.txt file - cDNA_ID_2105101; gDNA_ID_1620815; Annot_ID_169195
aaactaattttgtagatcataatcattttggttattgagttttatcttgcccatttattgaatgtgttattagtttcattgtaaaagatgttttgcttgatttgcataattaacacttggtttccaaattttggtgtaaggttatgagagcttcacttgacgctggtcacagtttgccaaatcctgatggtattctttttaacgggcgtggccctgaagagaccttctttgcatttgaaccaggtgagtttttttcttcttttaaaaatattacattatatctttaataatgtagtttacacacaaatgttctttttatgttgtctatatataatcacaggcaaaacatataggctaagaatatcaaacgtgggtctcaaaacatgcttaaacttcagaatccaagaccacgatatgcttctagttgagacagagggtacgtatgttcaaaaacgtgtttactcgagcctggacatccacgtaggccaatcatactctattcttgtcactgccaaaaccgacccggttggaatttaccggtcttactacatattcgccacagctcggttcactgattcctaccttggcggtatagctttaattcgatatcccggttccccacttgacccagtcggacaaggtccactcgcacctgctttgcaagattttggttcctcagttgaacaagccctttccattaggtaaagaaatactctttttttataccaaagaataaaaacttttatatgaaatatttcgtttagtatttgttcttgactaataaacgttaagtgtacgacacagaatggacctgaacgttggagcagcaagatcgaaccctcaaggttcgtaccactatggacgaataaacgtaaccagaacgataatattacataacgacgttatgttatcgtcgggcaaactacggtatacgattaacggcgtttcgtttgtctaccccgagactccgttaaagctcgttgatcattttcagctaaatgacacgataatccctggcatgttcccggtttatccatccaacaaaacaccgactcttggaacttcagtggtcgatattcattacaaagatttcatccacatcgtgttccagaaccctctatttggattggagagttatcacatcgatggttacaatttcttcgttgtcgggtaaaaattacaatatttaaatcataattatgtgtatgatgattaaattaggtgtactaattttatttgagtttaatgttagatatggatttggagcttggtctgaaagcaaaaaagctggatataacttagtagatgctgtttcacggtcaacagttcaggttaagccatatctaatctcgtaatttaaagtattaaaccagtgattagttttggttaattgattctgtgtgtgtttaggtttatccatattcgtggacagcaatattgatagctatggataatcaaggaatgtggaacgtgagatcacagaaagcagagcaatggtatcttggtcaagagctttatatgagagttaaaggtgaaggagaagaagatccttcgactattccggttagagatgaaaatccgataccgggaaatgtcatccgttgtggcaaagttcgataataattaattgtctgaaataataaaacctagaaaagtctattttaattagcaaaactaaagaacggtttaaaggaatgatcagagagtattaggatctgtgttgatcttagggtttgtggtttgattgcgattcgaatcacttgtgtaattgcagaagacggatggtaatttaaagagatgatcttagggtttgtggtttgattgcgactaaagactactagacgatgccgttttagattttaatgggctcacacagttgttatctgcaaaccggcccaggtctgttttgacttggtgagtgctaacgtgctctataagaagatattgtagccacatacgaacagctaacgtgctcccatttcctctatgttcccttgagtgacatacgttttcacaataagttgggagcaagtaatttaccaagaacaaatatatattttaaaaaatataggatccttttacaagttcaattattgattttgacgttacgtataaacagtagatcgaccatgacataaataaaaatgaaaaaataattggatcaaatctcagatcttactacagtctacatctacctagctacatgtgctatggcattatttgtttttcatgttatcatcaatattgtataaaagatccaaacacaatcagtgtgatgatatttttctatacttttgatcattcaaccgatttcaattattgtgtttgatcgtttacatagaaataggtacatatgcattcaagatctccagatcgtttattacgtcttgctacatgtgctatgtcactaaaacaactaagatactacatgcaaagttactgtattcattacgcattgatcgtcttcttctacgcactattattgaatttttgtttctcgatgttttcagaagtcataacatataatcaagggtggttgtagctagtcgtgatgaaattcgaatagtaaaagattcatcaaatggatcaagatttgaaactagaatgaatgatcgatacttgaaagctatcacacttaaatagttaaatggacgatataattcaacaatatcttaaataacattaatcattcactttgtagaaatttcaatttgacggtgctaacaacaatatgtgacatttttgtttgcagcaaaaaagtcaaatggtaaaaaaaaacatttttttaaaaagagagtatagtaaaaaaaacagaggataaaaaacgaacaaacggttaaagctggcaaagatcccatcttccccacgctgtcaaattttgtcactacttcccaaaaaaaactctcccgcctctctctctccctctcccttcttattctcctccttcttctccttcaccatctccagatcccaaaatcttcatcgatcatcatcatcatg

SEQ ID NO: 22465 - DNA, 3003 bp, Unknown
  misc_feature (1)..( 3003): 2750-1469P.txt file - cDNA_ID_2105101; gDNA_ID_1620797; Annot_ID_168506
aaaaaactaattttgtagatcataatcattttggttattgagttttatcttgcccatttattgaatgtgttattagtttcattgtaaaagatgttttgcttgatttgcataattaacacttggtttccaaattttggtgtaaggttatgagagcttcacttgacgctggtcacagtttgccaaatcctgatggtattctttttaacgggcgtggccctgaagagaccttctttgcatttgaaccaggtgagtttttttcttcttttaaaaatattacattatatctttaataatgtagtttacacacaaatgttctttttatgttgtctatatataatcacaggcaaaacatataggctaagaatatcaaacgtgggtctcaaaacatgcttaaacttcagaatccaagaccacgatatgcttctagttgagacagagggtacgtatgttcaaaaacgtgtttactcgagcctggacatccacgtaggccaatcatactctattcttgtcactgccaaaaccgacccggttggaatttaccggtcttactacatattcgccacagctcggttcactgattcctaccttggcggtatagctttaattcgatatcccggttccccacttgacccagtcggacaaggtccactcgcacctgctttgcaagattttggttcctcagttgaacaagccctttccattaggtaaagaaatactctttttttataccaaagaataaaaacttttatatgaaatatttcgtttagtatttgttcttgactaataaacgttaagtgtacgacacagaatggacctgaacgttggagcagcaagatcgaaccctcaaggttcgtaccactatggacgaataaacgtaaccagaacgataatattacataacgacgttatgttatcgtcgggcaaactacggtatacgattaacggcgtttcgtttgtctaccccgagactccgttaaagctcgttgatcattttcagctaaatgacacgataatccctggcatgttcccggtttatccatccaacaaaacaccgactcttggaacttcagtggtcgatattcattacaaagatttcatccacatcgtgttccagaaccctctatttggattggagagttatcacatcgatggttacaatttcttcgttgtcgggtaaaaattacaatatttaaatcataattatgtgtatgatgattaaattaggtgtactaattttatttgagtttaatgttagatatggatttggagcttggtctgaaagcaaaaaagctggatataacttagtagatgctgtttcacggtcaacagttcaggttaagccatatctaatctcgtaatttaaagtattaaaccagtgattagttttggttaattgattctgtgtgtgtttaggtttatccatattcgtggacagcaatattgatagctatggataatcaaggaatgtggaacgtgagatcacagaaagcagagcaatggtatcttggtcaagagctttatatgagagttaaaggtgaaggagaagaagatccttcgactattccggttagagatgaaaatccgataccgggaaatgtcatccgttgtggcaaagttcgataataattaattgtctgaaataataaaacctagaaaagtctattttaattagcaaaactaaagaacggtttaaaggaatgatcagagagtattaggatctgtgttgatcttagggtttgtggtttgattgcgattcgaatcacttgtgtaattgcagaagacggatggtaatttaaagagatgatcttagggtttgtggtttgattgcgactaaagactactagacgatgccgttttagattttaatgggctcacacagttgttatctgcaaaccggcccaggtctgttttgacttggtgagtgctaacgtgctctataagaagatattgtagccacatacgaacagctaacgtgctcccatttcctctatgttcccttgagtgacatacgttttcacaataagttgggagcaagtaatttaccaagaacaaatatatattttaaaaaatataggatccttttacaagttcaattattgattttgacgttacgtataaacagtagatcgaccatgacataaataaaaatgaaaaaataattggatcaaatctcagatcttactacagtctacatctacctagctacatgtgctatggcattatttgtttttcatgttatcatcaatattgtataaaagatccaaacacaatcagtgtgatgatatttttctatacttttgatcattcaaccgatttcaattattgtgtttgatcgtttacatagaaataggtacatatgcattcaagatctccagatcgtttattacgtcttgctacatgtgctatgtcactaaaacaactaagatactacatgcaaagttactgtattcattacgcattgatcgtcttcttctacgcactattattgaatttttgtttctcgatgttttcagaagtcataacatataatcaagggtggttgtagctagtcgtgatgaaattcgaatagtaaaagattcatcaaatggatcaagatttgaaactagaatgaatgatcgatacttgaaagctatcacacttaaatagttaaatggacgatataattcaacaatatcttaaataacattaatcattcactttgtagaaatttcaatttgacggtgctaacaacaatatgtgacatttttgtttgcagcaaaaaagtcaaatggtaaaaaaaaacatttttttaaaaagagagtatagtaaaaaaaacagaggataaaaaacgaacaaacggttaaagctggcaaagatcccatcttccccacgctgtcaaattttgtcactacttcccaaaaaaaactctcccgcctctctctctccctctcccttcttattctcctccttcttctccttcaccatctccagatcccaaaatcttcatcgatcatcatcatcatg

SEQ ID NO: 22466 - DNA, 3000 bp, Unknown; identical to SEQ ID NO: 2110
  misc_feature (1)..( 3000): 2750-1469P.txt file - cDNA_ID_2105144; gDNA_ID_1620489; Annot_ID_158558

SEQ ID NO: 22467 - DNA, 3000 bp, Unknown; identical to SEQ ID NO: 959
  misc_feature (1)..( 3000): 2750-1469P.txt file - cDNA_ID_2105148; gDNA_ID_1620341; Annot_ID_153976

SEQ ID NO: 22468 - DNA, 3000 bp, Unknown; identical to SEQ ID NO: 1789
  misc_feature (1)..( 3000): 2750-1469P.txt file - cDNA_ID_2105165; gDNA_ID_1620448; Annot_ID_157363

SEQ ID NO: 22469 - DNA, 3003 bp, Unknown
  misc_feature (1)..( 3003): 2750-1469P.txt file - cDNA_ID_2105173; gDNA_ID_1620377; Annot_ID_155176
aatacatctctctagctagagaaaaagaaagcggaaataaagatataaaaatatttggaaagaaagatactgggagcaatttagctacagcatgacgatgagtcttactttgattctgtcaacattattaacctgagacaatcccaaaagtctttcgtcccaatattgaatcttctaattttgatatctatgtgattttgcatatgcactacctgagagaccaacagtacctagaggccaacttgtcctttttattcacctttcttgcatgacttttcctatgttgaaaagttagactcctcttttacacttcatgtaccccactcctatacgtatttaatctaaatatatatacccaccaatcctctccatctacacaaacagcccaaatatcaaacctttcatctctatatctttaaccttgactgcttctcttcttctacaagaaaccagaaaaaaagaaaagaaaagaaaaagaagagattagggatgggtttcttagagttgttggaggtggcttcaatgccaatcgttcaagttcttcttatcagcgtccttggcgctttcttggcaaccgattactgctctcttctctctgctgacacccgaagatccgtgaacaaggtcaacctccgtctctgcttttcttttttctgtttggtgtcaactatgcatgcattcatatatcatcactaacaaacattttccctcgcagctcgtcttcgtggtattcaccccctgcatcatgtttgccaaccttgccgagactgtcacattgcaggacattatttcatggtatgcactaccagtctcctatcatccctctgagaatacatacgtgtggctttgatttgaccaaaattagttttgtaggtggtttatgcccataaatgttggaatcacctttctagtaggaggcattcttggatggttggtggtcaagctactgaaccccaaacctcaacttcatggcctcataattgctacttgtgcctcaggtaacattaaaacctcaaaatttaatctcaaggaggagagatatatccctgaattctcacatgaatcatatttactgtcctgtctacgtaggcaatatggggaaccttatgcttatactggtccctgccatctgtgacgaggaaggcagtccttttgggaatcgtagtgtctgcagatccattgggctctcctacgcatctttctctatggccgtaagtcaaacatacatacatatgatcttctgatctctgctcagacttaattgttgagttgatcgtgtgattaatttttgtcaagggcagctcgggggtttctacatatggacgtacagttaccaactggtaagaagctctgctacacagtttagagctcttgaagccgccgggttggtcaagtctcccaacaaggacatcgactctgatccccacgctcttctcctcaagccgcaccaaaaccaagaccttgaaatccaaggcaaacaaaaagtgtctaccaggacatacatcaaggacttgctccatcagattcttgaggaactcttcgcaccacccaccattggtgccgtaagtctttttaaaaaaagaagacatgattacgtttccaaccaacaactaataaatccactgctctgatgcgttgttatatgttccattcagattcttggcttcgtcttcggagcaaccaattggctaaggaatcttataattggggagaatgccccgttgcgagtgatccaagactcagtaaagctacttgggtatgaactcatcttttttgaatatggaaattacaattacatcacgactttgcgcctaatagttgacttggcagggagggcacaattccttgcatcacactcatactggggggaaacctgattcagggtctgcgttcatcagctgtgaagaaatcagtgattgtgggagtgataattgtgcgctatatcctccttcccgtggtgggagtcggggtggtccaattagcaggaaatctaggctatcttcctccagaccctctctttcgatacgttctcatgcttcagttcgcactaccgcctgccatgaatattagtaattactcaagccatcccccttcacttcattgttagctagatacggatgattaatcatacactatatatatatggattgcaggcacaatggcacaactgttcgacgtggctcaagatgagtgctcggtcatcttcttgtggacctacctggttgcatctttagccctcaccgtctggtcaaccatcttcctctccatcctctcctgagtctgatttgaaaagaaaatggagtttgtttggtctcttgtatggatttttttgatttgttaatactctcatagtatttttgttcattcacatgttgccaaataaaacagagaaagacaaaagtatgtatgtttcacagtgttgtgggcttttactcagaaaaaaggaagtgaggtatgggctcatagagaaagagagagcccaaaattggagaggcgtgttcaagttggccacagaagaaggggagacgtgcgatgcatcctccacgttgctttgcttcgattggttaaaacctcttcaatcatttctgaaacttctacatttcttcacacctgtcctctcctccttacctgtccgttttttgtttattgttctgctttttgatatactgtatcaaagatcgattaattaatttccgaattcaacagctcattcattagttgattagaaaatttagtttggttaagcacataagtaacacgagtcaaatgtcagagttttgtttattgcttaagcaaatactactatttcttaaattgagaaaccccaaacaagagccaatgaaagttttgtatctttttcttaatgacttaaaaaagggaaaaagataaaacagatatcatttgaccacacaaacatatacaacacacccaatcagagatcgatcgccattaacgtagactgtgactctcggctcttcttcactctcaatttcgatcggcatg

SEQ ID NO: 22470 - DNA, 3003 bp, Unknown
  misc_feature (1)..( 3003): 2750-1469P.txt file - cDNA_ID_2105183; gDNA_ID_1620512; Annot_ID_159137
tatgtttgtatctgattcgtgaaatcgaggactctgatgccataagattgaagaagtttccatctcacaaacatgcctcgtttatttcattgatctgattctgtttttttggaagagagtttgtttacaatttttatctgattctacagctcatctccagtactaggatccaattctagtcagattcatggttactcatcttcttgtttttttctgaaccatggttacttatcaactagaaccaacaaagacagataattatctgaaatatcaatacaagaatccatatttagaaaaaaaaattatttttaatcatcaaattaataattaaacagaagctggtgaaactaacaactatctgttaaacattagttgagaattgctaattttgtcaaggttttatgatttactaagaggtcgatttttcaaaaaacaaaaaaaatcgtaatgcagatgaattttaaagtagagctaattcattagtcatagagaaaaatcaatttagaaagatttatatagctgaatttggggatgtctttatttcaatatcaacaacataaataggcttaaggtccaaaggaacattaagatatttctagaacgtcttaagtttaactcaaactgatgtttctcagactgaaacgaaacagagaacactagccacaaacatgacaaagcaacataaattaaagaagatactactagttacatttattatttaaagagtactagacatgattttgggtctccgctggttatgtgcaaaccaaagcttagaccgtttcaagttctcacttgagatagtcgatgagccaagcgagcatgtccttgtgagcttccattgcagcttcaacttctgatggatcattttcattgtatctaacagtccaaccgtgtttgcatcttgggaatatcttcacaaaactcttcacctgaaacatatcactttgctcacaattatctacttgaagaagatatctacttccaaaaacacatcaactactagttgtgtttttgtaagtaatgaaaatattaccttgcataaagacatagagctaagcaaagtacctgaggtttagaagctaaaatatcttcgaactgcctcacaagttctggaggagacacttgatcgatttcagctcctaatacagcaattggaaggttgacctctgcttcaatcatatagtgagagtcataatcacaacaaatgagagagaactatcaagtaaggagtggccatatcaaagatctaaatacccttgatatcatccaccgtaacgcgagcaggatgtaacaaaacagtagcgtcaacaagcttttccttagctagttccaccgcaacttttgctaaagaataagaaacaaaaagtcttgtgttaactaatatacatggttgacttattatacagatcatggaaaacattttcataaaactgtggtgatgatgggaacaagaaaaccgaactcaccaccccaacagaaccctgctgctcctatactagttatgcctttgttcttcaaggcctccactattggctttgactcctcaaaccctttctcctacaaaatccatagtctggtttcagatacattgacacagaacagtacaaaaacactgacttaatcttagctttgcaatcaacaataagtagtgatagcattttggcactaataataagggattattgggatacttggactatttcatgctgggaaacaaagactcatttatgtttttgagaaaaattgaggattgaacatttaataaggaaaagaaactaactagttcatgatctttcatccaaataggaaacggacgatcctggttctcgggattataaggatctccatggaagaaatcaggaaccaccgcgtagaatccagcttctgcaaccttgtcagcaagtttcctatcaagggaagaacaatatccatgacaagttacagcaagaatgaaacatctttcgagtgactataaaaggtgatataaactataactcattataacaaagaatctgaagtaaaagactgtctaacaatcaacaaaagacaagctgattcagtagggattctctgttacagcacctcaggtttggagtttcatatcctgcagaagaaaacgttttagattctcaaatcaaaccaacaaattcagaaagaacatcaaacgtaattgggacaggtaaaaaggtttttttaccgaaaacatgagggacaagaagaacagcaagctttgaatgagtggaaccacagacgtaggtgtcaaggttaccgagtttctcgacatgacccgacccgctagttggatccagatcaggcgggttctcggtgcactgatgacctgacattcttgttttcgccgaaccaaaaaacaagacgactcctctctcgcgctttgggacctctgttttaaaaagtaaagccaccaaaccacctttgacctttcacaccagttatctacactacgtgtgcgtatctactcttccacctaaaaaaactcacgtgcgttaaataaaaactaacttttgcaatgttaatttttcttagaataaatttgctaaatggggtaataccttaccttgaatgattgaatgattctatgcacttatgcagagtaaaaaacaaaacccaacaatcaaagattattctaattcaattatcaattttatcataacaaacaaaaactcttttgacaaattatttatgtggcttcctctaattatctttaacttttttttgtttaattcacaatttatgtggtcagatattttttcttccttccacaaggtgttgccttgaaaatcacgtcggaagatcacgaggaatcgttttgcgtgcgccacccaaacagacaaaacaaaaacacttcttttgttggttccttgtcggtttccaagggtttttgtttagggttttcattttctttttccttatctatctaatcctctgtttctctccacatcaaaaaaaacctcaaaattaagagacgaattcgagataatg

SEQ ID NO: 22471 - DNA, 1197 bp, Unknown; identical to SEQ ID NO: 9630
  misc_feature (1)..( 1197): 2750-1469P.txt file - cDNA_ID_2105187; gDNA_ID_1972164; Annot_ID_179664

SEQ ID NO: 22472 - DNA, 3000 bp, Unknown; identical to SEQ ID NO: 2859
  misc_feature (1)..( 3000): 2750-1469P.txt file - cDNA_ID_2105199; gDNA_ID_1620610; Annot_ID_161887

SEQ ID NO: 22473 - DNA, 3000 bp, Unknown; identical to SEQ ID NO: 2856
  misc_feature (1)..( 3000): 2750-1469P.txt file - cDNA_ID_2105221; gDNA_ID_1620610; Annot_ID_161871

SEQ ID NO: 22474 - DNA, 2147 bp, Unknown; identical to SEQ ID NO: 9257
  misc_feature (1)..( 2147): 2750-1469P.txt file - cDNA_ID_2105228; gDNA_ID_1972029; Annot_ID_178198

SEQ ID NO: 22475 - DNA, 3003 bp, Unknown
  misc_feature (1)..( 3003): 2750-1469P.txt file - cDNA_ID_2105242; gDNA_ID_1620444; Annot_ID_157248
ctaaggtgactcatttgatgtagtcactaaattgcaatattttaagatgatacttgctctgacctaaatggtgtcagggaacactcttgacctcagttcaatgtggtactatttatatttgggagttgctttgtaaatgttgcaattttacatttaaggaacatcttctgacctttgacgtcattttgttatttaatccaaaattcatatactctattttctctgcagtcttaacattttaaatttatctcatcttattcggttttggacagtccttcgagtttaaagatatagtgaaaatcggaagaactcatactcaagatgctacacctttgacattaggacaagaatttggtggctatgctactcaagtaaattatttgttctgttttctatccttatataacaaaagtgaaaattacatgtcattaagaaataacttataaatttttggatttcatgattgtaggttgagtatggacttaatagagtcgcatgtactctaccccgcatctatcaggtttggaaatgatatctcttgaggatctgatttcatattattctcaaagtttcattgagctctgacttgttagaaatgtttgtctagcttgcacaaggtggaactgctgttgggaccggattaaacactaagaaagggtatatctcgtttctagttttatatccattccgatttcatcctactggtaacactagtactatatgcataggtttgatgtaaagatcgctgctgcagtagctgaagaaacaaacttgccattcgtcaccgcagaaaacaagtttgaagctctggttagcctctaaataactttcatcatcatcaatgtccaaatttagtcttagcgtcttccactgggttctaaatcaaacaagatgcttctgaatggttgatgtatatgaaataagttgttgagttattacgcctttgtaggctgcacacgatgcttgtgttgaaacaagtggatctcttaacacaatcgccacatcattgatgaagattgccaatgatatacgttttcttggaaggtacgttatctaatattttttaatctttcttcaagatgtacatgttcttatgataatttaacatgtctttatatatactttatatagtggtccaagatgtattcttatgatattttaacatgtctttatatatactttatatagtggtccaagatgtggtcttggtgaactttctctgcctgagaatgaaccaggaagcagtattatgcctgtatgaatgcaattttttcctatggttcttatgtcctttccctctgcggctctgcctataccttttatttttcatagattttgattcaattgaattttaatctatctctcagggaaaggtaaatcctacacagtgtgaggccttgactatggtttgtgctcaagtaagttccattcaccaatacatattttactaacatatgaatttaaattgctaaggtagtcttgttcatgactcttttggttgcatcaaacaaaattgtaggttatgggaaaccatgtagccgtgacaattggtgggtcgaatggtcattttgaattgaatgtattcaagccggttatcgcaagcgctctcttacatgtacattaatctctttacttgtgatttttttgtcatttatactctattaaaatttaatcttaactatttgatctcatgtctttactagtccattagactaatagcagatgcttcagcttcatttgagaaaaactgtgttagaggcattgaggccaacagagaaaggatctcaaagctattgcacgaggtaggcttcttctcgttgattggccttaaaattattcatgtgtggaaatgatttatatataggaactaagtctttgttttatgtatttctctctagtctcttatgcttgtgacatcattgaatcctgtaagtctctaaatattaaacttctttgtcaagtcatccatattctcattatgattacaaatgaatttacctcaatgctaattcctcctttaccagaaaattggctatgacaatgctgcagcagtagccaaaagagctcacaaagaaggatgcacattaaaggtaaacaataaactattaacgttttcatcactaaataaatcggaatttaaacccatttttagcaagagaaaacatgttcatgtttgttacaatatatttgttgttctattttggatttaaaccttctccagtgaaaattatataatacaatacctttgagatccctaaatctttgctttaatttattctatagcacgcagctatgaagttaggtgttcttacttcggaagagtttgatactcttgttgttcccgagaagatgattggtccatctgattaagtactttataatggagccaaaagcttcaaatacaaagtggatgtttgggggcttttgcatcaagttgtgtttattcttttgtaataaattgctgcatgcatgtatgcttgtgttcaaaattttggatttgttttagagtcatgtgattatagtattctaagtaatttatcataaagtttgtcatatatacttaagtttaataaaaaataaatgtgtgtgaaaatgtcacatattggtgtttttgttataaaatgtcaaatattctaagtacatgtcaaatacttaagtcatgtataacatgttttctattatttatatttatgtccaccaataaagcacttatatatcaaaaacagattgggattaaatgatagactttgatttatatgagacttttgcgacattttatcaaaatatgagaatagacaaacaatatcatcacgacatgaattggtcgataaggcccatgaaggtccagtaatcttaatgggctttatacagataaattataccgaccaaatcgattatatacgcgccgtcgtcttctcaaccatcgcatattcgccgccataagcagagagtttcacatataaacgaaaaattcccttcgagaagtctcaagtcgacgatatg

SEQ ID NO: 22476 - DNA, 3003 bp, Unknown
  misc_feature (1)..( 3003): 2750-1469P.txt file - cDNA_ID_2105259; gDNA_ID_2926150; Annot_ID_198004
aaacctagttcagagcagagaggacgagtccataccccagttgtattaccatcactaccattgctagagccatcattctcggagctagttgatatcaaaaccacgttagattctatatatctaagtatctattgaataagaaagagttgaggctagtttgacaaacctctgagaactcctatgttcactgctgctatgttcagcactcccaactttgttattgcttattgacattgcaagtccatcgaactctttcagctttttcatgaacccatgatctgagtttccagctgaattagctggtgcatcaatggtcaaaggggttgtaacctgcaaacattctcatacattcatatccaatatccatcatactgcacatttcacacagaaacatcacaagacaattgacttactccagatgctgattgagaaacaggaccttgtggttgtgagccctggtaaagtaaagtaggaaaacacaaatcagtaaatctggtcttttcaactatttgttgatataaagtaaccactaaaaggaagggaggattaccatttgaacaccaggatgagcataaactccaccaggagggcaaaatggtggatatggtgctccataaggagccatcattggctacaacaacaaagaaagatcaaactcaatccaaagtaacagatatacattcaacaagtttaatataagtaccgatggagacgcccacatataaggcggtggagcatgaccaggcgccaaatttgagttgtaatattgaggtataccaactctaggcccataatatgcctacaaatatcatgagaaacaagctaaaatcactcaggctaataaaacacaattcacacagcagaaacaaaacaaggtcaaagaaaaatcacctgcatagcagcccagtcatgatgatacacatgaacattactctgctcctgtatatatacaaagtaaaacaacaacaacaatcaaactttgactaaacacaaatctgttactaaaccaatcagtttccattgattccattacttacaggagcagcagcttgcgatggcttatcagagttgttagtggggtttccttcttcgttgctacccattgctcaatgcagagtaatgacacagtaactttataaacaaaaaaatgatcagatcttttagcagttcctctgtaaagcataaatctaaaagaacagtattcaattacacctagatctcgcaattgtggacatcaaactataaatataacagagatccgagtaactataaagtatagcaccactgaatctaccagtaaaagattcaaagtcgagttttttcctctgtcaaaagttcaaaactatcaccaactagtagagttacacaattcaatctacctttaactttcctagtaattttcttcactcaatacacactttctcgagaaaacagagcgttcatatataatcactcagatattcattgaagaaaataacgaaaaccaaaatccaaaaacgtaccttgagtctcagggaaaacaattcgaattgaacccacaaaagaaaaaaaaacaaattcgcttctctctcttagtcggagagaatggtttctctctctagaaccagagttcggtaaaagaagagagaggaaggagaagagaagaaaaagaagagagacacaacggagcgccaagaggctgatgaacacgtcaccgtacacgtgtcatgatcttgaagggtttgcaaagggaacgcatatgctgagctggcaaccctagatctgcgctggacattttaaatatctgacttaaataatgattggtacacgtagtcataatcgccaccgttcatcttgagatctctacgtagacttgacgtgctgctgattttattccttttaaataatgaaaatacagaattaaactataatgtataattcatttgagatccacagatgacgaaacgtggactaccaaatcaagcatatttgtttttaccatttaatcgacggctaatattgatttcatctacggtaaaatatatctttttttaaccagaaaaaggttagagtggtccccactgtaggatctactgacttgtgtcggccgttagtggttttataaagctgacgtgtcccactgaataaggaataccgttgtggtccctacggacaacgtgggattcgacgccagctcattttttaattttttcttgaaatcttttttaaaattttagacgatgactcaatcttcgccacgtaggatccacccaataaaaaagggttaacaaaatcttatctttaatgctaaattagttgagattaatccatgttgtttaaatccgaaatgatgcatataatcttgtttcttataatcattaagatttagactgaagatctaattccaatttaagagagtcactaaaaaaagaatgaattcaatttcagacaaatccgacaaggtcaaggtgacgtgttcttgatgccaattctagtgggagccacttgacgcgtgcagttagactcccggtccaagacataaatttacgttaataccctcctttattgggttattattgggccgtagttgaattattagacccaacctttttatcctgttcttgattggcacatactttgcaaaaagttaacaaaataacttttattgcaaggcattacaagagaaatgtcaaatttggttgttgcatacatgacatcttattcatatccaatccataaattgatgtgttgttattcaaactggtcttttgatgtattgttagacatatctcatatatattgaacccttggaatcaatataatagattgggctttatttatcttttattgggcttaaagggaattgttggactaaaaaaaccattaaggctataacacactaattacacgtacaatgagagtgagagtcacggacgggatgattacaagaatcatatagcaccaaatatctcatcctcactctcacatacaaacacacattttgttcacacagagatagacatg

SEQ ID NO: 22477 - DNA, 3000 bp, Unknown; identical to SEQ ID NO: 7663
  misc_feature (1)..( 3000): 2750-1469P.txt file - cDNA_ID_2105259; gDNA_ID_1621155; Annot_ID_173477

SEQ ID NO: 22478 - DNA, 3003 bp, Unknown
  misc_feature (1)..( 3003): 2750-1469P.txt file - cDNA_ID_2105271; gDNA_ID_2936560; Annot_ID_194390
gaaacagagtggtttaacgttagcgtgttcataggttggtgatcctaacatggaccatgcttgttgggagagaccagaagacatggacacaccaagaagtgtgtttaaagtcgacaagaacaatcctggttctgatatcgccggtgaaatcgccgccgctcttgccgctgcttcaattgttttcagaaaatgtgatccttcttactccaatcacctcctccaacgagccattacggtactgtaaatgtgtcatttttcacaattaatattcttcatttagtaaacctatatttttcaagttttataattaggtgaaatattcttcatttaataatcatttggctattaattttttttttttaaatctatatgagcattaattaaaaagttgcatttgtgggtttttaaggtttttacatttgcggacaaatacagaggaccctacagtgcaggtctggccccagaagtttgtccattctactgttcttactctggatatcaggttcaacattttaaacttttgaagttggatctatattaatttaaagtgtaactgtaatctcggaaaaaaaaactgaaattgaagtcatgtttttggttttggtttgttcaggatgaattgttatggggagctgcttggttacaaaaagcaacaaataacccaacatatctcaattacatcaaagctaatggacaaatccttggagctgatgagtttgataacatgtttagttgggataataagcacgttggtgctagaatccttctctccaaggttatacaaatctttgaaactaatcaaagattccaaatttagaccattggttcttgaattcttatgaaacattttttgtgtgactttgttttgttttttcaaggagtttctgattcagaaagtgaagtcacttgaagaatacaaagagcatgctgatagtttcatttgctctgttctacctggagcatcctcttcccaatatacaccaggtttttgcatatataccactcatcttctcattgaaatttaaaaatcaaggaatttatgatatatgtgtatacatatttataggtgggctattgttcaagatgggtgagagcaacatgcaatacgtgacgtctacatcgttcttgctcttgacctacgccaaatacttaacctctgctcgcaccgtcgcttattgcggtggctccgtcgtcacccctgcccgcctccgctccatcgcaaagaaacaggtttgtttcaaaaccaatgtatattgactctggtatactttggatgtcaaaatcaaacttgactatcaagtaaattttcagttaatgcacataataaatgtgacaccatctgcaagactacagcataccaataaaagaattaagaatctatactttattataatgataattagcaaaaatgaaataaattttgtattttgctaaagcatgaattaattaatatcccaatataaaatggaaagagtagtatttgcttaattaattgattcatgtgatatatgcttcaggtggattatctacttggaggcaacccgttgaagatgtcatacatggttggttatggtctgaaatatccacgtcggattcaccaccgtggctcatctctcccctccgttgcagtccacccgaccaggatccagtgccacgacggcttctccttgtttacctctcaatctcctaatcctaacgacctagtcggtgcagtagtcggtggtccggaccagaacgatcaattccctgacgaacggtccgactacggacggtcagagccagcaacttacattaacgctccacttgttggagctttggcttatcttgctcgatcctaaggccaactttaactaagcttaaaccgcatttaattgttggtttacaatgttaattagtagtaatgattttataaatgaatggccaagattgtccgatccggctgaatgaatgttttagatgatgtggtatttgattttaattttctaataaaaaaaaaagtagcatttagaagtgggaatgggtctatgaaatgagattacgtcaatatgagtgaaattgataaattatccaatcccataaacgagatggtgaacaaatataaatttacatttactgctagtaaatacaactacaattactttttaccacgcaaaaggagagaggagagatttttttttttttttttacttcgtaaggataatatgtacttagaaaataatatacagtgacgaaggatgatgaatgctttcatgggaaacgagcaattgaccaggttgagagagatatgggccgattaaagctgtcactgtctctgttatgacagaactaagttcacgtttacgtgatttaaatttttattgatagaggagatgattgtgtttacaatcactgaattgttactgattttactgtgaattgcatatcaattggtaaacctgtaaaattgtcttatcattttgtggattaccaatcatatttatgagaaatctcaattccatttacataaatatttaaaagacaattacagaataatttagctatgacgctccgacataatcaacaaacaaaacaatattttgcatctgtatatatatatatacaaaattttgttacacatacacataattttgaggaagaaacaaaaattattatttggttgcaattttagactgttttataattaaccgagtaatattgatcattctcaaccacttaatcaattgattctttttttttttttttttttgcttgatataaaaaaagttacggtaaaattggaaatcgttactacctaagattggggtcaacaatccgtaaaagaagatggaatcacacactgtaataccaatacttttctataaggaatcaaatctataaatagcatactaactagcactataaaaacattatgaatcctcctatgagcaaatcacttttaaatttgttaacactcttttaaaagaacaaaaaaagcaaaaaaaaaataaagatattatcaccatg

SEQ ID NO: 22479 - DNA, 3003 bp, Unknown
  misc_feature (1)..( 3003): 2750-1469P.txt file - cDNA_ID_2105271; gDNA_ID_1971906; Annot_ID_177005
gggaaacagagtggtttaacgttagcgtgttcataggttggtgatcctaacatggaccatgcttgttgggagagaccagaagacatggacacaccaagaagtgtgtttaaagtcgacaagaacaatcctggttctgatatcgccggtgaaatcgccgccgctcttgccgctgcttcaattgttttcagaaaatgtgatccttcttactccaatcacctcctccaacgagccattacggtactgtaaatgtgtcatttttcacaattaatattcttcatttagtaaacctatatttttcaagttttataattaggtgaaatattcttcatttaataatcatttggctattaattttttttttttaaatctatatgagcattaattaaaaagttgcatttgtgggtttttaaggtttttacatttgcggacaaatacagaggaccctacagtgcaggtctggccccagaagtttgtccattctactgttcttactctggatatcaggttcaacattttaaacttttgaagttggatctatattaatttaaagtgtaactgtaatctcggaaaaaaaaactgaaattgaagtcatgtttttggttttggtttgttcaggatgaattgttatggggagctgcttggttacaaaaagcaacaaataacccaacatatctcaattacatcaaagctaatggacaaatccttggagctgatgagtttgataacatgtttagttgggataataagcacgttggtgctagaatccttctctccaaggttatacaaatctttgaaactaatcaaagattccaaatttagaccattggttcttgaattcttatgaaacattttttgtgtgactttgttttgttttttcaaggagtttctgattcagaaagtgaagtcacttgaagaatacaaagagcatgctgatagtttcatttgctctgttctacctggagcatcctcttcccaatatacaccaggtttttgcatatataccactcatcttctcattgaaatttaaaaatcaaggaatttatgatatatgtgtatacatatttataggtgggctattgttcaagatgggtgagagcaacatgcaatacgtgacgtctacatcgttcttgctcttgacctacgccaaatacttaacctctgctcgcaccgtcgcttattgcggtggctccgtcgtcacccctgcccgcctccgctccatcgcaaagaaacaggtttgtttcaaaaccaatgtatattgactctggtatactttggatgtcaaaatcaaacttgactatcaagtaaattttcagttaatgcacataataaatgtgacaccatctgcaagactacagcataccaataaaagaattaagaatctatactttattataatgataattagcaaaaatgaaataaattttgtattttgctaaagcatgaattaattaatatcccaatataaaatggaaagagtagtatttgcttaattaattgattcatgtgatatatgcttcaggtggattatctacttggaggcaacccgttgaagatgtcatacatggttggttatggtctgaaatatccacgtcggattcaccaccgtggctcatctctcccctccgttgcagtccacccgaccaggatccagtgccacgacggcttctccttgtttacctctcaatctcctaatcctaacgacctagtcggtgcagtagtcggtggtccggaccagaacgatcaattccctgacgaacggtccgactacggacggtcagagccagcaacttacattaacgctccacttgttggagctttggcttatcttgctcgatcctaaggccaactttaactaagcttaaaccgcatttaattgttggtttacaatgttaattagtagtaatgattttataaatgaatggccaagattgtccgatccggctgaatgaatgttttagatgatgtggtatttgattttaattttctaataaaaaaaaaagtagcatttagaagtgggaatgggtctatgaaatgagattacgtcaatatgagtgaaattgataaattatccaatcccataaacgagatggtgaacaaatataaatttacatttactgctagtaaatacaactacaattactttttaccacgcaaaaggagagaggagagattttttttttttttttacttcgtaaggataatatgtacttagaaaataatatacagtgacgaaggatgatgaatgctttcatgggaaacgagcaattgaccaggttgagagagatatgggccgattaaagctgtcactgtctctgttatgacagaactaagttcacgtttacgtgatttaaatttttattgatagaggagatgattgtgtttacaatcactgaattgttactgattttactgtgaattgcatatcaattggtaaacctgtaaaattgtcttatcattttgtggattaccaatcatatttatgagaaatctcaattccatttacataaatatttaaaagacaattacagaataatttagctatgacgctccgacataatcaacaaacaaaacaatattttgcatctgtatatatatatatacaaaattttgttacacatacacataattttgaggaagaaacaaaaattattatttggttgcaattttagactgttttataattaaccgagtaatattgatcattctcaaccacttaatcaattgattcttttttttttttttttttgcttgatataaaaaaagttacggtaaaattggaaatcgttactacctaagattggggtcaacaatccgtaaaagaagatggaatcacacactgtaataccaatacttttctataaggaatcaaatctataaatagcatactaactagcactataaaaacattatgaatcctcctatgagcaaatcacttttaaatttgttaacactcttttaaaagaacaaaaaaagcaaaaaaaaaataaagatattatcaccatg

SEQ ID NO: 22480 - DNA, 3003 bp, Unknown
  misc_feature (1)..( 3003): 2750-1469P.txt file - cDNA_ID_2105286; gDNA_ID_1620822; Annot_ID_169528
cttaccaagagcatgagcaacaataatacttggcaggttttgaagaaatatttccccctcaaggatatctaaggagcgaaaacgaaaatgtatgagaaataccccatgatgaaataagatactaagagtcataaattgtaagctgaagtacaaagaagaatcttactatgtaaagaaggcaatctgaaaactctatggttcaaatccaccgcaattccattaggaacacgaaacatcccagcccttgacaacatagctgttcccatgccgatatatagtccactgcgttcacgatagtaaggatctacaataacatttcaactgttaaagttaaaaacatttcacaagtttcgtagttggcacccctaaaacttatggataatataacactttcaagaaaaaatactggagagaaagcttatctaatacgactggattattgaggaaaactactctttaaaatttgaacgcattccaccgagtatactgtttgactcttttggctgccataatttattactcaaataatagcacctttgatcaataaacaacttaacacgtgaagcgcttaataaatcaaagacctattcttcgggtttcagttactgtgaaacaaagtaatggtcaatcatatgataggttcctgcacttattttatagagaagaaagcaaaagaaacatttctgattcttgcctgttggcagcccctggagagtggtcccacgagtcatattaacactccagtcaccttcatcaccaggttgttccatagcaacacagacagcaaccgcatctcctttctcaacatgggcagtgcaagccagtacacctggcacatagacctaccaaagacccataagagaaattagtacatatttgttcacttaaaagcccggagtttctcagctagattgtcaaaaactataacgaaatacaaccaagatagggattcatattccaacccaactcccagcagcatagtgacaggatagaagcttaagccctcccaatggaatactttaagatcgcataattttaagtatcaatgtgactagccactaaagtttcactgagagagcgtcaagattacctgggctcctctgagaactgcttcagcacacttcctgctcactagtacctcctttggagggttttcaagaccagaatcatattctatcttatgtgggcctgaaccattgacaaagacaacataatccaaaccaggtatctgacacttggtgacgggactacttccatctggttgtactagcttcaagccctcctccgagtcgtttaaaattttcgtaagcttttcgataaccgcatcactcgtcgttttaacagtgttcaccctaatgcaggagtatgaagatgggcgcctaatatggaacaaaaacaaaatatatatagagtcgagcaaaatgtagcaacaataactagagcagacgcaagaaaaatgtgagaaagtttgttaatttagttacgatggcagactacaactgaaacatgtgaaggagaagctaacattggggaaaatgcaattaaataataattcgatttaggagattagagaatgaataagcaataaggcaaagcgaatccagctaaatgcgcctaaaggagggcaatgttgcttcagaagtagatgagaatgatagaaaagtacgtgagagcctttgaaatgcgagcaaagtgatcgggtccataagctttagtgaagtagtcttcaacttcaggattccatcgcagtaccggatcataacagtaacgctccgaatcggaaggacccatctccatctgatgagagatagagcgtgactgagaaacagaggagaagaaggccttggctctggttaagcaagtggtgagggaagagggttttagcagaaccctcgctttactcattcaaggtggaaggagactggagagatagagagagcttcttcaagggaagaaacttcttgggtttttacctttttagagctttaatggtagatgggccatgggttgcaatgaataagcccatatcattcagagctttaatggtgtatgggccttgggttgcaatgaataagcccatatcattcagagctttaatagtagatgggccttgggttgcaatgaataagcccatctcattcagagctttaatggtagatgggccttgggttgcaaagaataagcccatatcattcagagctttaatgacagatgggccttgggttgcaatgaataagcccatcacattcagagctttaatggtatatgggccttaggttgcaaagaataagtccatcatattcatctgcttgtttatttactttgatgtaaggttttttatataaaggtcaaaaaaggttaggtagaagaagctaaaaggtttgatgagagtcttttcctaccaaaccccctctccttgtgatgatgattagcttcacctgccattttctcaatgactgtacccacaggttatataaatggcttctcacatttcgagctccattcctcaccagaccccttttgcaaggttatccctttttctctctctatttcatttgatttcactattagcttcttcatttttgtgagaggctcttggatttttttgatttttgcaacttgtaatggagtctgttcccattaaagtttcttcatttctgagtctttagccatctattcgttggttggaacttggaagagtaggattttagtttgaaatgctcattctccgatcataaagtttatatattttgaatagaatttgtgttcttgttctagtggatgaagtagagaataatctagggaggttgaaattagattgttgcaagttcgtgaatattaggatttgtctcattgggtctgaagttttgtggaatttcttgacagtgtagtttggcagtttgagagtgtttttcatatccgactctttcaaactgatggttttgacatttttgttgaccagattagtaagttattgttgtcgttttgagaaagctggatatg

SEQ ID NO: 22481 - DNA, 3000 bp, Unknown; identical to SEQ ID NO: 2565
  misc_feature (1)..( 3000): 2750-1469P.txt file - cDNA_ID_2105302; gDNA_ID_1620555; Annot_ID_160420

SEQ ID NO: 22482 - DNA, 3000 bp, Unknown; identical to SEQ ID NO: 1365
  misc_feature (1)..( 3000): 2750-1469P.txt file - cDNA_ID_2105310; gDNA_ID_1620392; Annot_ID_155639

SEQ ID NO: 22483 - DNA, 3000 bp, Unknown; identical to SEQ ID NO: 1407
  misc_feature (1)..( 3000): 2750-1469P.txt file - cDNA_ID_2105314; gDNA_ID_1620397; Annot_ID_155827

SEQ ID NO: 22484 - DNA, 3000 bp, Unknown; identical to SEQ ID NO: 9160
  misc_feature (1)..( 3000): 2750-1469P.txt file - cDNA_ID_2105344; gDNA_ID_1972015; Annot_ID_177892

SEQ ID NO: 22485 - DNA, 3000 bp, Unknown; identical to SEQ ID NO: 1418
  misc_feature (1)..( 3000): 2750-1469P.txt file - cDNA_ID_2105348; gDNA_ID_1620400; Annot_ID_155903

SEQ ID NO: 22486 - DNA, 3003 bp, Unknown
  misc_feature (1)..( 3003): 2750-1469P.txt file - cDNA_ID_2105352; gDNA_ID_1620439; Annot_ID_157109
aaaaaaaaaattcacaaatgcaaataagatcttaactaaaattcataaatagataataaaataattaagtcgagaaaaagttgcagtgcgtaaattttattcacggtcatactctcaaattttatttattttctgattataactctttgtttcttcggtcggggtttccgtcgatttggatgatgatgaggatttaaagactcatagttcttcaactgtaatatgttgtattagtggagaaaagaagctttagtctcacaccgacgataagagttctaccggcagtgtagtaatacatagtagaagacggagatctaagatgaaaataacagagacaagaatttgatcaagggaccgaagattcataagatttcatggaatctttgtcgataggggaggtagactccggttcggcgagctgagccaccatcgaaggtctattttttactccttagtatttctctctctcacgatcgaacaagtatctcctcgacaatgacaatatcatatatcttcttccttctcaaaacggctatatagtggtgggatgacagcggatcttggaaaatcatcatcattcagctcacgtcgcccaggttcattggatgtcctgttccgacgagaatctgctcacattggacggcgtcttcaattgtgttctatgatcagatattagaatttcaatatgtaaccggtttagttcagttttgtcatggacatatatctggaaatattctattgcacatttatttataaaaattgaaaatttttaacaaaaaaaaaaactaaaattcataaatgcatgcataatacatactctaacgcatgtttatatgcaattatgtacagtatattattattagtatataccaaactttgatttgtcttttcaaagtccaaaatttaataatactttgataagtcaagtcggcatgtgatgttcttttctttcacaaaacaaaaagttgggtgggttatgcaagtagacaacgatgtggggaagatgatggtttacaatttgtcttagtgctatcaacaaaaacaaaaatcctttttttgtcattatattacccaaaaaatccaatgatccttattattactaagaaaattatattactaactggtcgttttaactatattttctttttatcatctacaacttacataaacaaatcaaaattaattttgagagaagaataatacaaacaagtactattcatatgtcttgatcaaattattttgtcatcactctattatacactccattaagctatttctttcaacaaagtatgattccatctatttctttagatcattaattttgttggtcaaaataagtaaatatagaatttccacttaacatatgcatgggcagtgtaaattaggtcgattaaactgtaaagagagggattaaatttataattacaacttaagaccaaaattatgtggaacataatagataaagtgatagtgagtagacaatttttgacattctgtttgatagaaatcacaaatttgatgtacaataacttaagtatgaaaagaaaattaaaactcaataggatccatagaaaacatatgtatacaaaagactttattaagcatatgttttcatgatattcgacaaacaaagcaagcaaatcaaatgacaaatttcatgtatattaggcagatagctaaaaaaaacaacaaatataacacactaattatcagtatcatactttagccgaatatgagataattcagatgtatatcatcatataaatggtcaaaaaaatatgtggtatatgaattgttcaatgttagattttatgaaaactatgggtaaagtggggtttggcatgttagctttccctaatatgtcactggaatagaaagctagcacgtcattagaagaaaccaaatgttaaatgatccttgacctaaaccaacagaacaatttatctaaaactgttattatttaaatccattaaaacctggtaaataaactatttactattatggttacatttatcctaaaaatcaattggatgatataaacgcgcggatcatcttctaattaaaagaaaccacgtcactagaatatttgcatgaataggttagtgtaattatgcttcttggaagatgcgtttgctattctcaccaccacctggtatatagaaaatgatctgattcgttatgcagttgattaattgtataccctttaccaatattctaagctaacaccaatgcgggaggacatttattctgatgatgtcctttcaacggatcggatttgagtaccatgtgtcacattatggtacattttgattcttgaaatttctctattacattaatattttaagtgtatacataccacacaaacataatttgttttaattaaattaatttcataaagaatagctttaatggattaaaagtatataatgtaaaaaggccaatccaatcaaatttgaagtatctacccgaaaaatggatcatatgataatttgttttaatggatttaccttttatttatctaaaaaccaaatctgaatttgaacctaaccctaaaatataaaaagttattcaaaaattaaattattaaaaaggtatatattaataaaaaaggaaacaaataaatttaattctcattttgaaaaatcaatactattgaccagcttgcaaattcatagtaccatatttttctacaattttttgtcgacacaatacatgactctcttttatcatcctttcaaaaattattttttcaaaatatattactattatccttcttctctttattatccgagtcaaacgccgaattctcatattctacataagacatggctctctttattatccttcctgtatattttttccttcataatatattactatccttctcgtttattaatacaaacttgaattcttcttcttcttaactttgtctgtcaattcacatatatatagtaccaccatcacataagtatctcataacacatcatggtgaacgaagaaatg

SEQ ID NO: 22487 - DNA, 3000 bp, Unknown; identical to SEQ ID NO: 1998
  misc_feature (1)..( 3000): 2750-1469P.txt file - cDNA_ID_2105356; gDNA_ID_1620476; Annot_ID_158175

SEQ ID NO: 22488 - DNA, 3003 bp, Unknown
  misc_feature (1)..( 3003): 2750-1469P.txt file - cDNA_ID_2105368; gDNA_ID_1972154; Annot_ID_179420
cttatccaattcggaacgtccggtcaagtcgccggtttcattggcgaatcaatccaggcgagattaatttgtacttatttcttatatcaaaaaggtatttatgattatgataatgaatatgcatgtaatgtagtctatatcctgtaacagggtgttggaggaatcgtagagcttgctcccggatacttaccggcggcttacgacatcgtgaggaaagccggaggagtttgcatcgccgatgaagtccaatccggttttgctcgtaccggaacccatttctgggggtttcaatcccatggtgttatccctgacatcgtcaccatggccaaggttcatcattatcatgattcatgcatcgttatcaatttatcatcatcaattctaatttggattttgcaggggatcggtaacggtataccacttggagcggttgtgacgacaccggagattgccggcgttttaagccgtcggagttactttaatactttcggcggaaatccaatgtgcacggccgcaggacacgcagtacttagagtccttcacgaagagaagctccaagagaatgctaacctcgttggctcacatcttaaacgtagacttacgctactcaaaaacaaatacgaacgtgagttacttcttgtccaaattaaaatcaattttaaaatttttctttattgaatatcttatcctttctctaatttgtttagtcattggagacgtgagagggagaggattgatgctaggagttgagtttgtcaaagaccgcgacttaaaaactcctgcaaaagcagagacccttcatttaatggatcaaatgaaaggttagttgtgttcaatcctaaaccaagtgaaattgatcactctcatcatataaagttgatacttatgcatttaagatagtgtttaatacaaatcttttggtatcaagaaatgggagtgttggtggggaaaggtggattctatgggaatgtcttcagaatcactcctcctctctgcttcaccctctccgacgctggttagctccttagtttaacatatatatcttcaaattggtttctttttgtttcatttttttattcatgatttatgttgtttcaaatcttgtattttgtagatttcctcgtggatgtgatggatcacgccatgtccaagatgtgatttactatctttatccgttctctaatgatcactcacccttgtatgtgtatataaataacacaatacatcataaagtagaattacaattggtgtttaccgaaatatatcacagatgcaagtatatgtaactaaatgtacagtactgtatacacttgatagaatctacaaataaataaaaaactcgctgctaatgatattccacaaatacatatattgatccgaagtttcgagtttagagtaaaacttgaatgatacacctgtggggcaaaacagttggtcatcaaagacgaggaagtggtagaaatggcggcgccgcggcggagtaggaaaacgatgtccggagagctgtcctgatcgcggaaacgagactcgtcagcacgaatataagttcttcaagtatgcatagtgtctttcttatcatcgaatcttcttgttttctcgatgcgagattcccaagtgagagagagggagttgtgatatttttctgctgacttttagatatatatggcctttgataatgttattcagacaaacaaagtgtcagcttgatgtttgtgtccaaaattgataatataatggaataattgcaaaacggaacctgaagttttgattaacatggaatttgaacccaatattttttccctacaccaaatttttagtttttcggttttcatttttttaccaactacaataaaccctagatgaattcggtttagaagaccagacattgctatgtaagagtagaaaaaccgttggtgtttagattacactaatttaaacgttataacacaaaactgattaaaacataaatatacttatgaagcgtgtgcaatgatgatcccttcatgtaccccgttgtacggaatcctagaggtgattcgaagaatttatggtaactcacgtaacaaagtgtcagctaagtaatttatggttacgaaaatacaattgtctcgtttaaaaaaaaattaatatagttttaaaaaatctaatatcgtttttaaatttaatatcatttctctgttactagtttagtagcttgaatttttgttttcgtaattaaactagactgattttttaaatttagatttagaccgtgattagaataaaagtgagttttaagttgcattttaatcaaagaatcagattgaatttgcgattaacttctcagttaattagtcgatccattgatggtgttctttgaatttgtttctcaatgatgcatacaaaatttcaatttccacattttaaacataaattaattttaaaattatagatatttagtatacctctcaatcttataatattagtatttaataacattgcattaaagttagtaattaattagagtggatttttgatctgaagagggtaaaactaaaaacggaaaggagaaaaagaatgaaagagaagtggaaagaaaacgcaaatgcattgaagactttccctttgtctctctctttgacaaaatcccaattttcgcatcctcactttctcctctgccttttttttttctcttctgccgccaccaccaccaccactgttaattcgccgccgcttccacatcaatcgccgtcgtagccaatcatcatcgttcttcatcctccgcttctcctgattcttagggtttccgcttccgcttctctgtcgagggtttttcgagctggattctctgctcctgcgccgctggtgcagcggctttgttgattgatctggatttctccgtcttcctttctattttattttctgtatctcgcacaatccaaacaaaaaagctagggctgaggatttgatttgcgtgatttctgggggtgtgttaattcgggggtgtgttctccgatttggatg

SEQ ID NO: 22489 - DNA, 3003 bp, Unknown
  misc_feature (1)..( 3003): 2750-1469P.txt file - cDNA_ID_2105391; gDNA_ID_1620804; Annot_ID_168774
ggtaaaggagcgttggagtgtgcgatttgtttgaatgagtttgaagacgatgaaacgctgcgtctgttgcctaaatgtgatcacgtgtttcatcctcattgtatcggcgcgtggcttcaaggtcacgtgacttgtccggtttgtcggactaatcttgctgaacagacgcctgaaccggaagtggtggtggaaaccgatcttgaggcgcagcagcaatcggcggttcctgtaccggtggtggaacttccacgtgttaaattcccgaggtcgcatacgacagggcattcggtggttttaccgggagagagtaccgaccggtttacgcttagagtaccggaagaattaaggaagaagataatggcgaattggaaattgaaccggtcgaatagtgtttttgttttaccgagaggaggaagctcgaggagtggtaaacaggttgaccggtcgagggctaaatcggaccggtggttgttccgtaaaactccgtcgtttctatggaggaaccgggatgatggttcgattaggctaggtggtaccggtagtgttagaggaaattcagtaacaagtccgagcggtgactcggtacgagcagaccggtgggcttttcttagaaacccatcgtttctctggaggaatacgacgccggttccttcgccgagagttgaagtcaataataaggacggtgaaggaacatcgtcagttcaacatatcggtacagttggttcaactagcggttcccttaggctaccggtttagtgttcggtgatgttttgtgcattgttcataaacacgcaatagattttacgtaattctttaattttgtttgtctttttctgtaagatatttaaatcgacaatccaacggaaaaaggagattgttttacttaatttattttatactcttcaaaagtcaaacaaagaacgaactggagattggtcttgttcttaaaaaaaaaaaaagtcttgttcgtcgaccaaagaatacatggaactggaagatagagactacaacattattttatagcggtaatggaatgtattatctagttctgaattcatgtgtttatttctcgatgaatacgatgaacgactaaaaaaagagaggaactatataacaaacaaatttgttaccaattaatgattgttttttttttggggaaatacaacgttttttttttctcaagtagtattgttgtcggaccaaaacaaaaatttgtactaatatatgaatcaagtagataagaacaatgtatcaaattaaaatttcagataacagtttccacagttaatcatttgagcgtcaaaaaaagtaatatcatttgaacattgaagcacgaggtactttactttcagagctgagactaaagatagttcgagaagatcttattttaatacttggaagttggaaatacggaaatgaaatcatatacattaaaatataaaacatagttacttcatcagatagaccacgactaagtcgtttcgatacggattggaagattacttgttcaacaatttgaatagttacgtagaaagttgccatcattcaaattttattctagaaacataaaaatgtaaaaattaccaaacacacaatatagccgttgttgtctacaatatgatgatggtaccattgtttatttgtttttatataactgcatacgagatgttggaaaatgtttacatatattttagttagttagtttaaataataataaaataatttgtactttttatttaatttactctattttttaataattttatgttttttgtttattttatgtgacattcgatctacgtccgtaatcagattgagaatacaagaacgtctcatacctcagaaaaaatttatagttctgcattttgctttttttttgcgagagtcggcggcatctctgtcacactgaacagtaaagagaaaaatatatttaggatttattttaatcgtgtatttatactgtgttttttgggctgggtcttaaacaaatctgcccaaaaaatatatatatatatatattttattttatctcttgtgaaaatatgtaaacaatttattctttttgtgctgaatgattaataagtgaatgcaaggttccaagtttaagaaaatatatactcgatttgatccgacgaaatcatatggaattgcgagcaatacatttatcaaggttttaaaaattgagatttcaaaataacgcttttgttattataacgacaaacaaaataaaccatatttcttatagaaaaaaaatagttcgttctaaatttgtacatgactcaatatcttattttttaaatcccatatagtatcaaaaagtattaaattattaatgcacacaaagtcacaatcaatgatttatattaaataaaattgcattgactaactatttggaataaatcatggattatgtatactgtatagtatataattcgtatgcacacaatccatgatttatgttttaaaagacatatgaacacaatccatatctctgtgtacaatctaacttttcgaaataaatctaaacaaaaattgaatagtttataatttcaaagtttgcaattcaaatccaacataaaataatattaatcaaaataattaagtagaaacaattttgattggttttatgcttagttttactaactttgccattacgaccaacaatttttcactaacaatcggtttggtgacagaaccgattaataactttgccattacggccaacaatttttcactaacaatcggtttggagacagaaccgatcaataattttctaaaccgtactattgtaaaccggaatgttggtttatatgattaagatcacattggtataactctacgtgtctcgtccaatcacatttcacagcgtcaaggaaataaatattagataattaataaattttaataagaggaaaaaaaaacattcatcttcttcttcttcgtcggagtcggagcagagaaaggttttggagatcgagaccaaactccgattgaaagaggatg

SEQ ID NO: 22490 - DNA, 496 bp, Unknown; identical to SEQ ID NO: 352
  misc_feature (1)..( 496): 2750-1469P.txt file - cDNA_ID_2105398; gDNA_ID_1564227; Annot_ID_149074

SEQ ID NO: 22491 - DNA, 3003 bp, Unknown
  misc_feature (1)..( 3003): 2750-1469P.txt file - cDNA_ID_2105406; gDNA_ID_1620623; Annot_ID_162413
tttatctgaatgtttacgatcttaccccaatgaatgtttatggttactggctcggaattgggatctatcactctggtctcgaaggtaaatcgttttttttccttctcgattctgggtttgattgttgttctaagattgcggagaaagatgagacaatagtaggtcaattttgttggattgtaatattaattgttgaaaaaatccattgtctgtattgttgcttggctttgtttgattctaaagtctgctttgatcgatgaaaactatttattgttaaagagtagaattgacttttggtcatagaatcgatttagagactaaatgtgttttgatgataacaacttaggagggtagagttttgtggccgttgtttgaacaatgactcagtcacacacacgccatacgttgttgttaatcctatattgaatgttctctcgtggttttggctattccttgtttgtagttcatggggttgagtatggatacggggcacacgagaaatcgagctcggggatttttgaggtggagccaaagaagtgtcctggtttcacattcaggaaatcgattcttgttggtgaaacagagatgaaggctaaagaagttcgaagctttatggagaaattatcagaagagtatcagggtaacaagtaccatctcatcacaaggaactgcaaccatttctgcaaccatgtttctttgaaacttactcacaaatcaatccctagttgggtcaaccgtcttgctcgcttaggtaacccaaaacttcctctacaatagaatctttcaggggatcaaataagtaatgttgtacattggtttcttttgaaccttcttaaggtttcctctgcaactgtgtcttgccggcttgcttgaacgagactaaagtgaagcgggtaggaaaagacgggaagctgctcttggaaggagaaaatacgaagaagaagaagaggaagaagaaaatacgaagaagccgatcaggtcctttatcttcgtcttcttcaaatgcaagattagataatactcctacacataacagatcaatatcaacgggtaatcctcctctttctgcttctccatcttgtcctttgagacctcgacttccttctgttgcatctggagctgaagatcaaaatcctccaagcgtaagcgtcaagacatgattatttttcattgtttgaacagctgctagttatatacttgtttatgaatgcgaaggtggtgcttgtgctttgttctcaagttatatatcctccattcgtttggttatacttggtataatttacttataggagaatcatgaatctctctctgtagatactaactgtagagtgaattcaacatttgtttgttatgttttgatgtaaaattttgaaaattgtacgaattacttgtttgaatatcaacaaatcgaagtaaaatagctaaatattttggaaacaacaagtgttttattttaaatttctaattaattcttaagcaataagtcccaaattttcacaaatagagtttttattaaaagaaaaaaaattgatgagcgtaaaaataaaaaaataatgaattttattttattttattacagaaccaggaagtggcataaaccctagtttgaccttttcagaacacaactcactataaatacctatcaaaggacactcttccgcagctacaacgaattcccctggaaccctaattcaccgttcctgtgaaaagctcgcatacataagatctgttctatttctcgctttttgtttctagatttcagtctttgctatttcattatcgttctggtttttatatttgttgaaatctgttatgtaattgaaactgttggctctgccattttgattgaagtgggattccttaggctttgattttggttagttctcagatttaggtttaaaggttcttgttttttgatttgaagcgttatagcaatcccaatgatgacttattaagattaaaaatgttaaaagtagtgactgatatcttttgatgaaattttagctctgagggatttgatttgttctttgtttccttcttacattccgttgttggacatccattgtgggttaatttggtgagtttttgcttttgcttgcttgatgaagcatattgatgcacacgaccttagctgcatcccaatgatgaatgatatgaaaaaaatgttaaaagtagtgactgattataccttgattactagtcaattctgagggattctatcagctaagctaaattcaatccttttgcgccatctctttgtttacttaactctctatgtgcccttcgatgattaataatatattaatggttaaaagtagtctgatatcttattgatgaatatttcaaatccgagggcttaacttatttcttataaaagttgtgactgatagcttgtgcacaatcttgttttcattcttggtatcatctaagagatacctcaacgccagcttctgcagtgaagtgcaatgtcgtaagtacgattccacccggcagaagaaatctctctcgattgcacttcatctgcagaagctggcttttttaggcagtgggagtgatttttttggcagaatatctccattgtattatgctcttttgttttccctggtgtgcttgaccatgatgaattcgctagtggttcacaattttgatagaatagttggattaaatggataacacagcgacaccatctattaatgatacaaccaactaaaaatgttattgtccaacctcaccaccaaatcatctttcgaaagctttcctttgtcttgttaaaatcaactatttaaagatgaagtatacaaagcttagcagtacttgttggacccacgtttgatatttttggggttgagatgtctgcaagcgtctttcttaaagtccaaaagaatgtgtgtgaaacgttgactttctgcaaggtttaccactgtttgtgcgcttagcttcgtttggagaatcttcttcttctctttctttgtagaccggctttgctttgcatatgagaggatg

SEQ ID NO: 22492 - DNA, 3003 bp, Unknown; identical to SEQ ID NO: 22491
  misc_feature (1)..( 3003): 2750-1469P.txt file - cDNA_ID_2105406; gDNA_ID_2926201; Annot_ID_201849

SEQ ID NO: 22493 - DNA, 3003 bp, Unknown
  misc_feature (1)..( 3003): 2750-1469P.txt file - cDNA_ID_2105410; gDNA_ID_1621200; Annot_ID_174856
gttgaagtagcgatcctggagcttgacgcagccattagaccttctctcgatggagaacaagaaattgcgagccacattgagattgcgagctcgaccgaggaactctaacatgaggaagaaagactgctctttgtgagaaaaccccttgttggaaacccagtcaaagaaccggagaccatccgcagggaccttgatgagacgcagggtttggagaacggtggttctggagatggtttgggacggatgaagagatgatagtgaagactcgagttcgtccgaccacgggttagagttcacggcacgggccaaggacctggcgagttttgatttggtggacctttcttcattggtaactttggcggctcggagaactggttgagacttggagacaaacaaagcatggagtttaggtacagaagataccattgcagaagaaagttgccgcgaaatatggcggcacacgtccgccgctcctccaccccttccggcggaccaagagaacaaaccctttcttcttcattctataactctctaaggcccaatctaaatgggctcctctttgttctagataactttactttaggcccaattatagaggtggccccgacacaatattttgttttgttttaaactttaaaaaaaaaaggagaagaagcaacagcatataattaagtcctagctattaatcatcatccatagcatatcagtaagtttttgaagatagattgtttgattgcatacagattttaaaataatgttaaaccctgaagtaaacttgtaactgcaccaacacaagacgtggtgtatggatgatctactacattccgtttccctttcattgggaatcaatttgcggactagtttaaaacaatcgcatatgcataatacttgcgcagtaattagggaagaaaggaggtgggggtaatgagtgagaaagtgcaataagtgggtatctctcaaattaagagagagatgttgacaaggcaacaagtttggtgtaacattatcctcctccttttattttgcctttttctctatttttatatatatgcacagtcttttttactcttaataaaatacactgttaattcctcggataccaacggaatcggttgaataaattatggatgttacagtatacacactatgtagggacttcttaatttattttggtatagttagaaagatagcttatcgttagagcgattgagagcttttcattataattaggagttagtttactttaattgtgataactgccttagtagatacataagtacactatcaattgactactttgagtgaattaaaaaagcctcctaacagcgtactatatgtacatcagaataagttgtagtaggagcagcattcctattttcaatattgtacactgtattaaaacaaaaacaaaaaagtagaagacaggattatgcatataaatatatatcccagaaccaaatatgaaaatagaaaatttggttttcgggtttataatttgttttagaaaaaaaaaaaagagagagagagaggggcaaggataatagagacaggagtccgtacggtttcgggggtcaacgtcgatggcagcctttgagcacctaaaaataggggacccacgccattaccaattacaaaacctcactctctcgtctatgctcagctaaccctactctcttccctgtgctgccacgtgatcaccatccgattaatcgggaccgttcgattaagtagagatagcagcgcgtgaggtagagaaagaagagagagagagagttggcgaataatagtaatttgttgtttgggggtgagtgggtgtacgttagcaagatacgatcggtcattctgtcttccctaaaacgatcaacctccaacttgctacctatttacacttttgccatcctgtctttcgaaaccccaacaccgtttttgcctcttatctctctctcttttttggccttttcctccttttttttttgtggttaattgaaatagatattttatttctctctattcttaaaaaaaaccacgtataaacttgtaactgactacgatgatttatctcattctcatatcttatttatcgctagtaaaaaagaaaacaaatgtaagagagaggcccagcaggggaacagaagcgggtcccgacataattaaataagtgtagaacaaacgcgttttttactcttctttttccttaaccacacgatcaccaccaatactagctagacccttttctttctttttttttaaagtcctgcgggggctatatatgtatcatccatatatacaatacgctgttaaaaaataacatagtaagagtctgtctatacatacttgtgtgtttaatttgtttgtcaaacaaaagttcaattagaggctccatcaacagttgctaagtagtgagttacgttttttcgatattcaaattaatcctacgtaggtactactaagattacaaattagaaagctttgaaaaatactagtagtaaaaaggggcagatgattggtaaataataatttaaattgtttttagtaaaaaagggcacagacactcacacacacactgctttcacgacccatgtgagttttctttcttctccatcttcacttttttaagtagctagatgacaagacagacagctatctctcttttttttttacgaagaagaagatcaaaaaaaaaatgaattttaaaaagggacctttaagagagatggtgggagagagagcaatagagagagaaggaaatccacccccacaaatagaaagttagggtttattggaaaaaaagaaagagagtgtgtctctgtgtgtgattctaatagaggtgtagtacgtcgctttgctttcagtccattaaaaccattccataacctattccgcaccgacatgtctcctccccctttcctttattagcctctctctctctttttcactactccgtcttgattttataaacaaaagaaagaaagagagagagatcttcctcgggattgcaacatg

SEQ ID NO: 22494 - DNA, 3000 bp, Unknown; identical to SEQ ID NO: 5536
  misc_feature (1)..( 3000): 2750-1469P.txt file - cDNA_ID_2105426; gDNA_ID_1620800; Annot_ID_168614

SEQ ID NO: 22495 - DNA, 3000 bp, Unknown; identical to SEQ ID NO: 3204
  misc_feature (1)..( 3000): 2750-1469P.txt file - cDNA_ID_2105430; gDNA_ID_1620631; Annot_ID_162696

SEQ ID NO: 22496 - DNA, 3000 bp, Unknown; identical to SEQ ID NO: 3204
  misc_feature (1)..( 3000): 2750-1469P.txt file - cDNA_ID_2105430; gDNA_ID_2926182; Annot_ID_200340

SEQ ID NO: 22497 - DNA, 3000 bp, Unknown; identical to SEQ ID NO: 8745
  misc_feature (1)..( 3000): 2750-1469P.txt file - cDNA_ID_2105435; gDNA_ID_2685559; Annot_ID_193433

SEQ ID NO: 22498 - DNA, 3000 bp, Unknown; identical to SEQ ID NO: 8745
  misc_feature (1)..( 3000): 2750-1469P.txt file - cDNA_ID_2105435; gDNA_ID_2685559; Annot_ID_138161

SEQ ID NO: 22499 - DNA, 3000 bp, Unknown; identical to SEQ ID NO: 8745
  misc_feature (1)..( 3000): 2750-1469P.txt file - cDNA_ID_2105435; gDNA_ID_1971872; Annot_ID_176616

SEQ ID NO: 22500 - DNA, 3003 bp, Unknown
  misc_feature (1)..( 3003): 2750-1469P.txt file - cDNA_ID_2105496; gDNA_ID_1620489; Annot_ID_158556
tatataactatttttttcagcaattgtgcttcttcctcctttttattaatagcgatacaatcttccgtctttgtgcgttacgattcccaaagaaccacaccctcatttcctcagagtctggtctcttacagcgacttctctttttctttcttttttggatttcctctttctgcttccaccatggagaagaacaaacaaagaaaaactcagtgttgtttctttccaaatttgaacactttgtaatctagtgatatcactttatcttactccaatttcaccggttaggtttggtcattaaaaatgatcaaaccaaaaaagaaaatgtataagtaatcaccagttcaccacttggcttaattcatccaaaaataaaatttcaaattggctatatatcaagttaagaaaaataaagctagacgaaaaaggtaggatatatatgcgttattgtattgatttctataactacgagggtagattatgtgttataatattagtaatgatgctaagttttttaaaatggagtagcaaaaaaaaaaaacatgtttattttttctctttcgcgagaggatctaaaaagtctacaaaaaagtgattacaaggcatgggaagctgcagtgaagaaaagtgaagaagtctcttgtttggtccgaaagtgttagtgttatggaaaactctttaatgagtttttcactttatttttctttctcttttgtttttgaggggaagaatattacacatatgaaattgacttcgagggttttcattttcttggattattgcaggtacaaacgtatttccagtatccatgcatagacgcataatgccgtattgtagctacatacacgagaagtagacagtagactcatttaacaaaaaaccaaatagactcaatcaattatatgttttgatgaatattttaacattcaacgattaatatatccactaatgaacattcttttttttccaacatccactgatcaacattttgttcgacgataagcatttttctataaaaaggaattccttagctcaggtttatgagcatgcagggtaattgaatcatcgtgagtggggacagtgaaagaacagttttttttttttttcaagtaaagaacaatttagccaatttcagatgattttttttactagattaaattaatttaacacattttacttagaggcatgtgatcccactcgtcttaaattacagtacaagtcctagtaaaaccgaacatttttgaaatccaaagagtataagaattgggacagaataaaacatatatataaccaaaaacctgtaattagttggaacatcagtcatgttccctgctaggattgggtaaattttgtctgtaattagtaaaaataaatctccgttgccgggactcgaacccgggtctctcgggtgagagccgagtatcctgaccagctagactacaacggatttgtaataaataatattaattagtcaatatgttagtaacaccaaattttttgaaaaaaaaaagaaagaaaagaaaacattaaacaagagaagatataacatccaaatcgtaaaggaaaacaacattcttctcaaaatcggttgtctaaacttggggatttggactaattcatacctggccccgagcccccgacttacctgaggatggtaattgtgggtttggaaccttaaagccctaagttattttattgggtcattggcaaaggtgcagaatccatcttagtgggcttatacgagccaaaaatatgggccgctacaaacatctggttatgttattttagaccaaaaatatatacatataccaaacatgttggatataaaaacttatgagataaatgatttcagagattttagtatgtaattgcctatttggtattcattatgaaatcaaaaaaattaggttatttttgttgaaactagtttatttctaacatccttcagatttctttctagtttaacgtttgataatttacgttgagatttaaatgtaattatcaaattaactaaagatataacctccaatcaagttagattttaaaatttacaagtttagtatattataaacaaaaattcaaaattttaactacatttatatgtataaaatctgtaattgcagaatagacataagagtcttgaaactggtgatatagtgtttgctaataccaaacctaaccaaatcaacatatattctaatctccagattagtgtttggagccgattgcttactaaaattagactattaatcgtatactccctttgttccatgaaatttgatgttttagattttatttttgtttcataaagattgatgttgtaggttaataatattattatttttgttaataaccaatagagagaggagagaaataagacttatattattaaattaacagaaaataatataaataatataaaaattacttttctttgtgtgaaaaacccaaaacatcactcttttaggaacagagggagtataaaataagaatccaaaaacaaaataaacaataattcgatattaggaaaaatgaaaaaaaaagaaaaactaagaaaacaacaattaccaaccgcaagtcaagaatcaagatcaatagcgtgagacggacctaaacacattaaaccaatacataaccggggtcttaaccggacaatctattataatctccttatcttccctaatagaaccgtaattacgaaaaaggacagtcacaaaactccaatctctctctctcctctccgtctctgcgcgcatgatcccccccatagtgttccactacgcaccgcccgtgactctctaatggtctgtgacttgtaatccatctctccttatttttatttcaattttatttctttccaaaattttaattaatttccacacacacacacacctatacatatatatacacacacattcgtctctaatggcttcttcgaaactccatcatcatcctcaccgcagaaaatccccaatacgttgcttctgtctcttaatcataaccatg

SEQ ID NO: 22501 - DNA, 3000 bp, Unknown; identical to SEQ ID NO: 2851
  misc_feature (1)..( 3000): 2750-1469P.txt file - cDNA_ID_2105500; gDNA_ID_1620609; Annot_ID_161854

SEQ ID NO: 22502 - DNA, 3003 bp, Unknown
  misc_feature (1)..( 3003): 2750-1469P.txt file - cDNA_ID_2105518; gDNA_ID_1621091; Annot_ID_170722
gccattagaagccctgaagaaaatgaagaatacaaacaatttcgttttttccattgaaatattttgctattttcgtgctgagtcttatcatacattaaagtacgtatatgtttttcctctttcagtcactattttggaagaacgcaaaacaaactccacttttcttgcagttgtttcctctataaagtaagtaatttaccactgtactaatcttttcggggtcagtcatgatctaaactagatggatcaacacaacaaaaaattacctttgatatatcaaaattcgtagaacattgaccatattcattatgctatttatcaccacatcacatgataataaacaaacaaacatcctagatagtcttaagataaattttacatagtaaactaaacggaacacgtcaatgatttgacgtgacgcaggggtgattaacggagaaataaacggagttggtttaactatctacagtcaaacaaagactgaaagacattaatgccccttctttctctttcttttttggtatctttttttctttcttcttttgcttttaaagcagagaaggcataataaaggaccaaaacgcagcgttttcttccggagatcagtcggtcggaaagcggctacctttttgtctgcctagagaatttgttcgtttctttcttttactctcttcagacaaaacccacgagatacagaaaaagaggacaagagagaatcgtccatggaagaagacactggtatcgacgaagctaagacatacacggtggagaagagcgagaaagtggagccggagaaggacggactgagtcaattcagagacgaggaaaaatcacttggtgcggatatggaagatttacatgatgagactgtgcgagaaaccctaggcaaggatcaggttcaaggtaacggtttattctgcgcaaaattctttattggtttttatttatttattcgagactttattttttgacgaaatgatgtttgagtttaccaggtgttcgagaaaattcctctgtggaaccaaatgttgaagatgtattagaagtgaatgtgagtttgcttcagactcttctgctattcataaactttcttaacacttacaactttgattctctcattaacattgattgtgctagaacttgtaaagtttaactcatttcagtgtcttcgatgttactcgttcagtgattatacaataacatgggaataggattaatcgtaatggttttaacctttggccaagttcaatctgtatctgtatcagtttgatctgttacattttagtgtgtctgatttcttaggcaattctgaggacaagaatcactgttatcaaggcatgacatttaactgctttttgtatcacattggcaggagactgatagcgtcaaggaaactgttgtaagtgcgattgtgccggttgatgaagtggaagagaatcgtcaggtagaaacatctccttctctggctgcatcgtcagactcattgacagtgacgccatgtctatctttggatcctgcaactgcttcaaccgcacaagatttaccactggtttcagttccaactaaacaagagcaaagatcagattcgccggtggttaacagattgtcggttactcctgttcctaggacaccggctcgtgatggttataattggagaaaatatggacagaagcaggttaagagtcccaagggctcacggagttactacaggtgtacatacactgaatgttgtgctaaaaaaattgaatgctccaatgattcaggcaatgtggtagagattgttaacaaaggtttacatactcatgaacctccccggaagactagcttctccccgagagagattagagttacaacagctatccggcctgtttcagaggatgatacagtagtagaagagctatcaattgttcctagcggttcagatccgtctgcttctactaaagaatacatctgtgagtcgcaaacactcgttgaccggaaaagacactgtgagaacgaagctgtggaggaaccagagccaaaacgaaggcaagtttgtagaattttgcatttcggtgcttactcttcactttgaaagatgaaattaatagactttcttctctctatttttcagactgaaaaaagataactcacagagttcagattctgtctccaaacctggaaagaaaaacaaattcgtagtacacgcagctggtgatgttggtatctgtggtgatggatacaggtggcgtaaatacgggcagaaaatggtgaaaggaaatcctcatccaaggtctagaaaactaaacgcatgacccatctctttatccacatatgacatcttctaatacgcatggtgattgatttgttctgtttcaaacattcaggaactactaccgatgcacttcagcgggatgtccagttcgtaaacacattgagacagcagtcgagaacacaaaagcagtaataatcacatacaaaggagtacacaaccacgacatgccggtgcctaagaaacgccatggtcctccaagctcaatgctcgtagctgcagccgctccaacatcaatgagaaccaggacagacgatcaggtgaacattccgacttcaagccagtgctcggtggggcgagaaagtgagaagcagagtaaagaagcattggacgttggtggagagaaagtgatggaatcagctaggactttgttgagcattggattcgaaatcaagcaatgctgattatatgtagtttatgagttttatagagttcatcgactcaattttcgcctccttgttcttgttatataataataataaaaaaccccatgaagattaccaactaaatacgttaacattcgtctgtgtaatgatggtatatgtttattgtgatattaaatcgctaattttagtgaatagcctctggttcgtctagagggtcttctgaaacttgaaagggactaaaagacgagaacaaaaaccctttctctctactctgtgtaaaccctagtgtgttcgtgctctccgatg

SEQ ID NO: 22503 - DNA, 3000 bp, Unknown
  misc_feature (1)..( 3000): 2750-1469P.txt file - cDNA_ID_2105518; gDNA_ID_2926199; Annot_ID_201685
attagaagccctgaagaaaatgaagaatacaaacaatttcgttttttccattgaaatattttgctattttcgtgctgagtcttatcatacattaaagtacgtatatgtttttcctctttcagtcactattttggaagaacgcaaaacaaactccacttttcttgcagttgtttcctctataaagtaagtaatttaccactgtactaatcttttcggggtcagtcatgatctaaactagatggatcaacacaacaaaaaattacctttgatatatcaaaattcgtagaacattgaccatattcattatgctatttatcaccacatcacatgataataaacaaacaaacatcctagatagtcttaagataaattttacatagtaaactaaacggaacacgtcaatgatttgacgtgacgcaggggtgattaacggagaaataaacggagttggtttaactatctacagtcaaacaaagactgaaagacattaatgccccttctttctctttcttttttggtatctttttttctttcttcttttgcttttaaagcagagaaggcataataaaggaccaaaacgcagcgttttcttccggagatcagtcggtcggaaagcggctacctttttgtctgcctagagaatttgttcgtttctttcttttactctcttcagacaaaacccacgagatacagaaaaagaggacaagagagaatcgtccatggaagaagacactggtatcgacgaagctaagacatacacggtggagaagagcgagaaagtggagccggagaaggacggactgagtcaattcagagacgaggaaaaatcacttggtgcggatatggaagatttacatgatgagactgtgcgagaaaccctaggcaaggatcaggttcaaggtaacggtttattctgcgcaaaattctttattggtttttatttatttattcgagactttattttttgacgaaatgatgtttgagtttaccaggtgttcgagaaaattcctctgtggaaccaaatgttgaagatgtattagaagtgaatgtgagtttgcttcagactcttctgctattcataaactttcttaacacttacaactttgattctctcattaacattgattgtgctagaacttgtaaagtttaactcatttcagtgtcttcgatgttactcgttcagtgattatacaataacatgggaataggattaatcgtaatggttttaacctttggccaagttcaatctgtatctgtatcagtttgatctgttacattttagtgtgtctgatttcttaggcaattctgaggacaagaatcactgttatcaaggcatgacatttaactgctttttgtatcacattggcaggagactgatagcgtcaaggaaactgttgtaagtgcgattgtgccggttgatgaagtggaagagaatcgtcaggtagaaacatctccttctctggctgcatcgtcagactcattgacagtgacgccatgtctatctttggatcctgcaactgcttcaaccgcacaagatttaccactggtttcagttccaactaaacaagagcaaagatcagattcgccggtggttaacagattgtcggttactcctgttcctaggacaccggctcgtgatggttataattggagaaaatatggacagaagcaggttaagagtcccaagggctcacggagttactacaggtgtacatacactgaatgttgtgctaaaaaaattgaatgctccaatgattcaggcaatgtggtagagattgttaacaaaggtttacatactcatgaacctccccggaagactagcttctccccgagagagattagagttacaacagctatccggcctgtttcagaggatgatacagtagtagaagagctatcaattgttcctagcggttcagatccgtctgcttctactaaagaatacatctgtgagtcgcaaacactcgttgaccggaaaagacactgtgagaacgaagctgtggaggaaccagagccaaaacgaaggcaagtttgtagaattttgcatttcggtgcttactcttcactttgaaagatgaaattaatagactttcttctctctatttttcagactgaaaaaagataactcacagagttcagattctgtctccaaacctggaaagaaaaacaaattcgtagtacacgcagctggtgatgttggtatctgtggtgatggatacaggtggcgtaaatacgggcagaaaatggtgaaaggaaatcctcatccaaggtctagaaaactaaacgcatgacccatctctttatccacatatgacatcttctaatacgcatggtgattgatttgttctgtttcaaacattcaggaactactaccgatgcacttcagcgggatgtccagttcgtaaacacattgagacagcagtcgagaacacaaaagcagtaataatcacatacaaaggagtacacaaccacgacatgccggtgcctaagaaacgccatggtcctccaagctcaatgctcgtagctgcagccgctccaacatcaatgagaaccaggacagacgatcaggtgaacattccgacttcaagccagtgctcggtggggcgagaaagtgagaagcagagtaaagaagcattggacgttggtggagagaaagtgatggaatcagctaggactttgttgagcattggattcgaaatcaagcaatgctgattatatgtagtttatgagttttatagagttcatcgactcaattttcgcctccttgttcttgttatataataataataaaaaaccccatgaagattaccaactaaatacgttaacattcgtctgtgtaatgatggtatatgtttattgtgatattaaatcgctaattttagtgaatagcctctggttcgtctagagggtcttctgaaacttgaaagggactaaaagacgagaacaaaaaccctttctctctactctgtgtaaaccctagtgtgttcgtgctctccgatg

SEQ ID NO: 22504 - DNA, 3000 bp, Unknown; identical to SEQ ID NO: 8106
  misc_feature (1)..( 3000): 2750-1469P.txt file - cDNA_ID_2105522; gDNA_ID_1621193; Annot_ID_174646

SEQ ID NO: 22505 - DNA, 3000 bp, Unknown
  misc_feature (1)..( 3000): 2750-1469P.txt file - cDNA_ID_2105526; gDNA_ID_1621159; Annot_ID_173656
ttgagacagagctgtatagcgagcgagaacgactaaggggccgtgaacgcggggaaatggatctagcaggtgacacactgcattgcatttagaagtcagttaatttcataaataagttacaataaaaatcccttatatgtcttaggtttatgaaaaaaaaaaaaaaaaaaagacctcctgctcttgctactatagctacagcttggaccacggctccgactcctgcttctatagcttttagaatcatctgggcttcgactcacactcctcgactcatattccctcacctgaacagtaaattcagagatgactccatatccacttatgcttaacaaaatcaaagaaagcaatacaacatacccgtatataagcactagagaaagcatttcgaaattcagtggcatcaagtttccttatctgtcacatcaaaaattttaagggaacatcaaagatccaacactggcctccaggaagataaattcagctcggtatactatgaaacaaaagcagtctaaggcataagtccaggaacatttgcgttgcaaagatataaaacttactgcgtacttcatatcatcatagttgctataatccacaaccccagacatgcctacaaagaaatactgaatgtgagtttagcagttcagatgcttaacacctattctccttcacaaagactaatttactaacacatcaatcaaaagcttatccaaactatcgaatgtcaactcacctttacggtcagggaaaacttcagagaagcagacatctccagctttgcgcatgtgatcctaatcacccgtaaatagcaaataacatcatttcagaaaagagataaatccaaaacatgatatagagaaccaacattcagagaaaaagactatatagtgtcccttaccttaaggtcctgccacgaagcagaaggcggtaatccggtcacaagcactacatgtttaggtagtaaaaatgagttttcaaatataaaattttacacaacaccaaataacacaatcgagaagactctacaaaccgcggtagtcagagcgtcttgaaggtgcacggctcgcactgtagctgctgctgtacctatcaactgatggtgaaaatctacgaccaccatgtgcaatctcaacctaaaaacatcacacaaagataacacctttacaagaaattacagaaaattaagctagctttcatcatgcgtttactaacccgaagtcgacacccatcaaaatcataaccatcacgtccataaattgcatcgtctgcatcacgaggatcttcaaactgccaccaataacaaactatcttagtcattagcctatactattacaagaagaagaaaaaaacaaatttgtacttgatcaatatacctcgacaaaggcataaccaggaggtctcggtggaatcttcaaatcaatgtccacaattggtccatactgaaacaaatatacataagagtcgatttaaattgtctcagcaagacagaattgcaaatttatgaacccaaacaagtcataatgaattcaatttttatcgagagaaaagaggaattttcaaaccttgtagaagagatcttcaacctcacacttgcgaatatctccaggcaaattcccaacgtagatcgtacgattccatcggctactcatctgatacctcagagcagaaaattagttcctgtaaaaatctagaagagaagaaattgattactggaaaaataatttcgagaaagaagaagaagaagatgttcgagaaagcgttagattgttctggaaaggagacaaccaccgttcgtttggaaactagtatccttttataaaacggaactggattttaatcctgtgcggccgcatgtatcaacgatgaatagcccagttgatcaagatcggcccatatgttttaatgggcctgttaatatattgttctaaccggatcgaatgtgttttttcttatcattcaaaccggaatattgtatgttagttattacaattcgaaccaatttcgaatcggattcggaccatcgggtcattcattctcctaggtttcctaaacactgtcgtttttggacaaaagagacactagatcggaaacacttggggatttttttgagagaaacattctctcggttcctctactaccacctctcaaatctcaattcgccgattagtaactccgtccaagaccattttccgccgtgacaccgtccacggtctctctcagtccgtgagttcctgctctgttccgtttggtttttctgttttggaatttcagtatttttcctattgaatttgttgcgatatgatgtccaaatttttggtttgttgagtgatgttccgatatttccgttatcaatcatcttccactgttcgcttgcagggaagaagataccatagttagaagctggtgatcattttcaataaacctcgaacatgtttaagaagtaagcatctttgtctctttctagattctttctctacttttttatttagatagaaactgtttttcatacccggattgtagaatctaagaattagtggtttcaacatctcggcattgtttatactagttgataaagaatgtgatggtctctttatttagtatccacttactctaataactatcgagaactcactcccttctacttgttgtcgaccacattgttaatttgattgcttagagtagccttggtatgggcatattggttgttatattttcttcaaagtagaaggttttgagttctcaaaagctaacatcttgctattgtaaagttttggtttctatattgatagtgtcactatttgatttatcaaatctgtacaaagagtcgtgggtcatagaggaaagtttgtgtcttgatttgaccagtctaaactctctactatcatggagtttgtgtttatccatctcctgaaacatgcttatacattcatagtgaatcttgtataaagtttatttttccctactgctatcaactttagatctatttgatataccattatg

SEQ ID NO: 22506 - DNA, 3000 bp, Unknown; identical to SEQ ID NO: 1733
  misc_feature (1)..( 3000): 2750-1469P.txt file - cDNA_ID_2105558; gDNA_ID_1620441; Annot_ID_157180

SEQ ID NO: 22507 - DNA, 3003 bp, Unknown
  misc_feature (1)..( 3003): 2750-1469P.txt file - cDNA_ID_2105578; gDNA_ID_1620578; Annot_ID_161053
gcgacggcggttgtgtcttcttcatctttcttcttgttcttctctaaagtcaaagctctgcttaagtgtctctctagttgctcgtctaagctttttagatcaatctgatctgctcgaacaaacccatcctttccttctttcattgtcaagcaaaagatcctatgaatctttttttggtcttctataagttgttgttgattttgtttcaacaagtttcttctctctctctctcagataatcaaacgcagaggaaaatgggaaaagaaaatcataaaaagggaagatgagaagagaagagaagaccgcatgtgagtgagcacatggtcttgcctcgacgctaatgtatctgtatttacatttctttttttcctttcataaaataaatacttttttgttttgtatttccaaaaacaataatcatcacttattatcaaaataagtgttggtaccaaccattttattgacgagaatagtgagtgcaaaagtttggcccattactctggatgttcggcccatcaaagatttgagctccctcgtaaacctaaatacaaaaatattagtatgtgaatttcgacatctacatttttgacgtcgtatgtggagtttatcatacttctgattttggtctttccaacttggtttcacatactatggataaactactaatataaattgatgttacgaagttaaaagatattaggaagaactaagccgatctttctcatcttgatttgatattgacatgaagatatcggttgtggcatgtctaaacaattggacatgcttgttacaactcagtgtgtgtttgaagtacgctttgatgctatgaactcgaccaactcccgagttatactatgtaaaatattgttctattgtcagcatatagagtataatgataagtggatccaatcatgtctcttgacttttttattttttataaattgaaccaaatctattttcacatacgcttacacgtatgggatacatatgataatcaattgatttgaagattgaggaatggaacttagagtggtggttaagtgtattggttgctttaaattgcacgaagcgtggatgattttgttggcgtatccacgtaccaaatggctccatgcattgtctgttgtccctaccaaaaccttcactattcttcttgagatcaatattaaatatatatattctctcaaataaagcatatacacaatggtgctcttcttcttttctctttttttttttattttaaatgtattgtataatcgcatgttcgttacatattaaccaaatcaaattaaaaggtcaaatataaaacaaaagctagaatttctatgccgaaaatatgggaaatgaataccttttgaaatttgggagtggccattagaagctcctcaattttattttattttcgcctttaaggtgtacaaatttctttttaatttaaaatttaaaaataattaacatgatcagctcttcctcaactataactctaattccgtgtacttaaatagttaaattatactataaacccacttagttgctttatctaagaattaaagaatgtgaactcatctcccatgcgtgttttcctttactcagaaggaaattaaatttcaatattctctgaaacccattacaaaacacggtcatgctagaagacttgaagtcgtgatatgtagcatttttaatgcgttttgtgaatatatgtaaactatatagatgttatataagtactctcggtccaacattttggagcacattatactatgatcttgatattcagccagtttattatgtcatatttttcgagaacatttgttgaattgaagaacataaaagatagcaaatcaacatctcatatatgtgtctttatcaaaaaaaaacatctcatatatgtgtattttttttaaccacgcaaaatgagaagagtgttattttatgtgtataaaaatggtggacctaggatatgatgattgctttagagacacacagaaagagagaaacggtggagggtttgttttgggcccctgacaccattaaagccagtaaggattaagtgtatccacttttaattaatcctaatttatatactatacggattagtaatattatcctaatggtttttgtataacttaaatatttggcgtggtaatattaaatgttactctgcttgtatgattgtgagcaaccagatctctcttatctgtacatcaaagatttggttcaggttactaaatcatgggtcttctacatctatcactattgaatatagtttcagatgtctttgattgtcaatgaaaaatatcttgggtataattattactagtcagtgccattttctgacaagagagaacgtgtctgtttcttctgggggattaattaggtttagataattttggtatcaagttttatgattgataatatacgattaagtcattggctaactagctaaaaaaactttttttggctaacttggtaatttttggtgatgcaggttgttcatttgggtttctgtatagaaattatctccttttttgtccttcgaaacttatcttacagtatctaatattgaatttatattttcataatataaattattgtggattggtcataaattatgatctcaataataatgttcttatgttatcattatttgtttgtatttttataagtcagtgagtatgacttgtaccgttcctacttctatagtgaaaacggaagtcttataatgataatgaagcttgtttttttttcttaacactttagtatatatagaaaaatatacatattttggaagagattataataaagaaaagatgaagagcaatcaattgtcttgtaggattttcctttcttcttgttatatttatcgtcacatatttcatcgttttttcactataagtgcaatagatacattttccacgaaagtgttttggagatccatatgaaaatagaccaaccagaatgggaagacaaaacataatgtgaaacccaaagaagatggaaatg

SEQ ID NO: 22508 - DNA, 3000 bp, Unknown; identical to SEQ ID NO: 1978
  misc_feature (1)..( 3000): 2750-1469P.txt file - cDNA_ID_2105586; gDNA_ID_1620474; Annot_ID_158122

SEQ ID NO: 22509 - DNA, 3003 bp, Unknown
  misc_feature (1)..( 3003): 2750-1469P.txt file - cDNA_ID_2105598; gDNA_ID_1620471; Annot_ID_158007
catcaagagccattgaacactcctgtgtctctgctttcagcaacagaggacgtgactaggacgtttgctcctggtggtgaagatgactatctcggtggtcaacggaaagtcaacgtcgagacgccaaaacgtttggaggaagatccggctgctccaggaggaggatcggattatctcagtggtgtatctaattatcagtccaaagttactgatcccacgcataaaggtaatgactttggccgagactttttttagggtttatgaatctgtaataactcttgtctgttctgtttaaggtggagaagctggagtaccagagattgctgagtctcttggtagaatgaaagtgactgatgagtctcctgatcagaaatcaagacaaggacgcgaagaagactttccgacgagaagccatgagtttgatctgaagaaggaatctgatatcaacaagaattctccggcaagatttggaggggaatcaaaagctgggatggaggaagattttccgacaagaggtgatgtgaaagtagagagtggattgggaagagacttaccgacgggaactcatgatcagttctcaccagaactatctcgtcccaaagagagagatgattctgaggaaaccaaagatgagtcgacacatgagacaaaaccaagcacctacacagagcagttagcttcagctacatcagccataactaacaaagctatagccgcaaagaacgtcgttgcctcaaagctaggttacaccggagagaatggcggcgggcaaagcgagagccctgtaaaagatgaaactccgagatctgttactgcttacgggcagaaagtggcgggaactgttgctgagaagttgactccggtttacgaaaaagtcaaagaaacaggatcaacggtgatgacaaagctacctctctccggaggtggaagtggagtgaaggagacgcaacaaggggaagagaaaggtgtgacggctaaaaattatatatcagagaagctgaaacctggagaagaggacaaagctttatcggaaatgatagctgagaaacttcattttggaggaggaggagagaagaagacaacggctacaaaggaggtggaagtgacggttgagaagataccttccgaccagatagcggaggggaaaggacatggtgaggcggttgcagaggaaggaaaaggtggagaaggaatggtggggaaagttaaaggagcggtcacttcttggctcggtggtaaaccgaagtcgccacggtccgttgaagagtctccacaatcacttggcaccaccgttggtaaaactccctcgtccttgtgttacacgtaatgttaagattttgatgtgtgtattatttttgtaattttactcaaaatgttttggttgctatggtagggactatggggttttcggattccggtggaagtgagttgggaggcagtggcggaggtaagggagttcaagattctgggaactgaagatttggggttttgcttttgaatgtttgtgtttttgtatgatgcctctgtttgtgaactttgatgtattttatctttgtgtgaaaaagagattgggttaataaaatatttgcttttttggataagaaactcttttagcggcccattaataaaggttacaaatgcaaaatcatgttagcgtcagatatttaattattcgaagatgattgtgatagatttaaaattatcctagtcaaaaagaaagagtaggttgagcagaaacagtgacatctgttgtttgtaccatacaaattagtttagattattggttaacatgttaaatggctatgcatgtgacatttagaccttatcggaattaatttgtagaattattaattaagatgttgattagttcaaacaaaaattttatattaaaaaatgtaaacgaatattttgtatgttcagtgaaagtaaaacaaattaaattaacaagaaacttatagaagaaaatttttactatttaagagaaagaaaaaaatctatcatttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaaatg

SEQ ID NO: 22510 - DNA, 3000 bp, Unknown; identical to SEQ ID NO: 1871
  misc_feature (1)..( 3000): 2750-1469P.txt file - cDNA_ID_2105617; gDNA_ID_1620460; Annot_ID_157745

SEQ ID NO: 22511 - DNA, 3000 bp, Unknown; identical to SEQ ID NO: 7116
  misc_feature (1)..( 3000): 2750-1469P.txt file - cDNA_ID_2105637; gDNA_ID_1621128; Annot_ID_172384

SEQ ID NO: 22512 - DNA, 3003 bp, Unknown
  misc_feature (1)..( 3003): 2750-1469P.txt file - cDNA_ID_2105649; gDNA_ID_1620557; Annot_ID_160484
ctgagctactaactattgaacctcatgtgtcatctctccgctgaattcagaatcagtttactttccctcaccctttcccaatttgcatcctctaggcttcaaagagaaccccttgatcaattttgaggagaaaacgatttgattaatccctcttaatgtttatttctttttatacaatgctaattaactactaactattgagtccaataggggcttttgtacaatctcttctcaatcttaagtttgaaacccttcatcaaaaaaaaaaactgagctacatggttctggactaattactcttctcacctttttttttttttaggattacttctcactcccagaccattattgcaataagagaaaaaaaaaactaattaacaacacatgagtttgaaccaacaacaagatccaattaatgagctattgtttttgtttgggctaatctcaagccgcatgtccgagatttttagatataatagaatggaggtgggagacatatatatatatatataacggtaaatttcgaaacaagatcaaatgaagcttcgtttgcattagagacgattaatgatttcgagtgtttctggcgacatgtgtggtgtgattgcatctaaattaattcgaaataaaaataaaatttggaggagcaaaatatatcacgagcgagactccaacatactaacgatactttaagtctttaccactagaagaaaaggtttagtattttttgtcaaaacaaaagaagaagaagtagatatgtgattaaaaatatattatatcttcaaaagtagtcatagcagttcttcatatcatttcgtgtaaatataaatttctaatcatgtattatgtgtgttaattaactaagtatgacgagttatattattaaagattttgatgatataatatattcttaaccacatataatcttcttctttttttccccacaaaaaaaatccttattcatacttcaggtaattaacactcctgtatctacttatcatttttcttgtagtgaatttagttatatttgaaatggatataatatttatcattctgagtatcccagaaaaacggttagtccattgtcccaataagtatagatttatctaaattaaatggtgaacaatctcgtcgttatatacttgaaataatatttggatcgatgtccttttcatttataacttttactataaataagatcccacctaaaaaaatgaactctttgaaaaatgaaaatcatgtgaaacagcataataagttactaattaacctaaacttgtgcgttcaaataaccataaaagtctagaatagattaaaagttttacaaatgaagttcatgctattgttattttgtcttattagttatgaattattggagtttgttctttttcccaaatcaatccatcaatattattgttttaacaaaatcaagcgctttactattttcacctacttcattatcatattaattataaacattgatctactcttgaaaacgagtaaaattaactatttttgtatagacaatttaatacgtaacgcatgaaactacgaaagacggttcaacctactatcaaaattgtctttgaaaatgtaatagtttcaaataaaaaaatttagtaaatttctagggaaaaaaaaaattatgggtgagttctaaacccctcttctattttaattttatagcacactttccaaccgaactaattttttgaaaaaaaaacatatttgtattccctaagaataacaaccatatatatgtgagaattgaggtcctaaccttcatttaattgtccgtgcatgaccaatttttgtgtagttcatgttggagcctgtatataaacaacttacattttatagtctagtgtaaattatatcttgaagtttaaacttcatccgatatacaagaagtaatttgtcgaccaaatgttaaataaggagagcttatataccttagtttagttaacattcaagcactaattaaaatgttcactatatgaatctaatccgagcttaaccatatagaaaggaaaaaactcctaaaaactaaaaatattatccaaatattagttaagctgtctatttctctttccctcggtttatttttcctctttaaaaagtaagacaaaacgagaacattattagttcaatatatatattttagtgaaataaacgtaatttcaagtaaaattgaaataagcatctacaaattattaaacttgagaggacagtcgtacaaacaaatgttaatgattgagaaacgggcaaacggctaaaaagttttttttttttcttcttcttaaaattgtgaaacgtaaattcagaaagaaaagtggctaaaagtgaaaacggcaattatatttgcgtacaaacgtcgtcacatgaactaattgtctaattttcttggaaacgtaatataattaagcacggacctcgtaatttagtccagttttattgacaaatgaggatataaagtgtaaaacatagaaattaatattgtatatattaaatgtattcacatatataggtatatgtgaaataggtagaatctagacatagaacccttaaaagaaaagagttggcctaaaccgaaatcgacatgcattatttatgaaaaagttattatggtgttggaattgttctgtcaattattttttcgaagagacgaagagcatttttcatttctgtatagtagtacacctacaaagactaatacttttagaaattatattgttacttttctaaaaagattgaaaattcttatatgattcacacgaaacatttatctttattgcctttcccacacacttcccttgttcattctcaagacatcccctctataaatacttgaagtcatcagaatgctaaaaagtcgtgccattagcctttgatttcagaaaaaacacttacaaagctgatatctttcttactacttcgaagaaatcttcttctcccttccaaaaaaacaatccctaaacccggaaccaaagatcgacattcatg

SEQ ID NO: 22513 - DNA, 3000 bp, Unknown; identical to SEQ ID NO: 1768
  misc_feature (1)..( 3000): 2750-1469P.txt file - cDNA_ID_2105664; gDNA_ID_1620446; Annot_ID_157305

SEQ ID NO: 22514 - DNA, 3003 bp, Unknown
  misc_feature (1)..( 3003): 2750-1469P.txt file - cDNA_ID_2105676; gDNA_ID_1620488; Annot_ID_158532
tttccagcatcttccaagacccacaagtccaccaaacccgtttgtttcatcatggtataatcaaaaacagctggttttccaccatactctataaatcccacagactcagaaaatgcagacaccttaagaggtccttggatcatactgaactcttcagaccgaacgtcaaaactgacaacgatatcacgacgcttccaagtggaagccaaataatatataactccattgacgcacaatcctagtctcgtagggagatgaggttgatcgaattcaattcttttccacgaacctcctggttctagtacgaagacccaatgctctgaggttatcctcttaagcctttttgagaatagtgcaacagtgcaaactactttgtattgatcaagaacaggatcgtatccgaaaaagtagaggagactattccagtgggatttttgagcaaggatgttggatttgacagcaggtaaggttacactttgtctggtggtgggattatagatagacgccgttctgcaaacaacgtatagaatcaagccgcgaagaaccaccatgttgcgtcctcccatccctgcaattgtcaaattttgttccaaagactcagcactgctactagacgacagcagtacagactcacatgggtagtggcaaaccatcagtgaattacacaagaggtggtctaccaaactcatgtatagacgaggtggtcgccgtggagttttgaccgtaagataacagttgctaaaaaatcgggaacggataagagaagaccataactttgagacgcacttgaatctcataagagatttagcaggcaatttagtcagaatctcgatcagtagatcgagagggatctccggcgcgaccaaagcgtcttctattcttcttcttctttttcttcctcttctcaacatcacctttgaagacctcgtcttgcatcgaaaggatgaaaacatagctgcagacatacgcatagctacttacttatgtcttaattcgaccaaaatattttgttttctaaaaaggatctgagtaagagaacagaggaagacgatcaaggtagctcacgagtcgcgactatagggtttgaaaattggcgtatttcttcctttccaatctaagtagcccatgggctgattactactttactaaacctttgggctaaaaataattgagcctccattgggacatggacgaatttctgtttccaataagtttatcatgggcttttattttcaataacaagatgcattttatcaaagttgaataacaaatcaataatatgtcggtcacttttctcatcatgaaattttaatccttagaatgtctttttattttgtttttcagaagaagaaaaaaaaaggatgtctttttatagtttttttgattgactataattaattttcccaaatcgaaactaattgactaattgagcactagaagtttagtcaaatgtgaaccattggatatagaagggttgcaaaagctttcctctttctcctagcaagtagagtatttaccgacacttctcgaatttcagcagcggtttttgatgtcacgttgtgcaagaggttgttacattctttccaaagcataaagatcatagccatttggaagacagttcagaatctatagatataagaagggttttgatcatatatatgtaagataaagattaagtccactcaccatctattactccatattccctaacaggcaagatgggacacattttgactataaaggatagaacactaaaagcgatatatagatgtaatgtttaattacttcaaaaatcacaatgataaacgataaaagctaaaagaaaaatattcgttaacgttgccgagggaaaaagccaaaagaaaaataaaaaggagacttcactttgatataagatggatcatctcctagtcaaatttccattatccaaagaagaagttcaaaaagactgaatcaaactaataatacacaaagttgaaacgaaaaaaagtttataaagtcgaaagaagaaaaatgagagaaaaagttcatgagagtggtggaagcacactcgttctactacggacgggtaccgtacggaacatggtacctttattcatatttaaaaaaaaaaacgcatagaaaaagaaaaaaaagaaatagtacaaataagaacaaaaggtctgcgtcacgtgggttgtgttttggcgtgtgttgtaaaatgtgaactgtttatgtggttttcatggacacgtgtcaagtttccaagggagcatcatctcttcaagcatatggccaccactttgtgatgcacatggctgtttctttcttatgttgagagtgtctctgtgacctactcgcttttatttcccatgtattgtatttaattccaacggtcattcacgcctacaaggctattactttaacttacataagtttatactctctaatgacgactcactttcctaacttggatacattttcatgtgttttgagttaggaaaagatcattaacatctctagtttgtctgcaattagattttttgtcaagttaattaaataattaattccctattgtagtaaaagatatagatgatgaggtgtcatgaatcttgcttgacgcatgaagaaaaaatgttgaaaaaggcagtaagaaaaagatgcctaaacaagactgagaatttaatagattaaatatataaaggaaattaataaataaatgaaggatataattgtggtgcgagagagagaggtcggagtgtgttagcttcccatactgccactaacctttagcggttttctcatcttctctactcttctttctcttttctgagaaacccaaaagacaaaaacgaagaagaagattaggaaatcatcttgagaaacaggtttctacatctctgtgtttcaacattttctctgttttttttaagttgttgagctttctggtggtgttttaatggagaattttttctgataatttgtatggtttttaattgtactaggaggtagcaggagaatatg

SEQ ID NO: 22515 - DNA, 10 bp, Unknown
  misc_feature (1)..( 10): 2750-1469P.txt file - cDNA_ID_2105695; gDNA_ID_1620344; Annot_ID_154092
gatcactatg

SEQ ID NO: 22516 - DNA, 3003 bp, Unknown
  misc_feature (1)..( 3003): 2750-1469P.txt file - cDNA_ID_2105710; gDNA_ID_1972003; Annot_ID_177772
aaatgtgaagattttgcattttgattttttttaaaaaacttctaactaaagtgtggagtaattaattttgttacatttacgtgccattgttaattcttagtggatacgtgtcttctgaaacgaactatcattgaactaaatcttgatttgcaatccaagttgggtggtacatttaattggatcccctctcgcgttacgcccacctcagtcccaacacatttacgttcacacaaacccactatttatttactatcaatctacgtactgagacctaaatgatcacacttaaaacaatggggagttaaaaacaaacaaacaaatagaaactttttcaatggttaaactcgtcgcgtttgaattaattttctttgtgtttttgattttttaaatagaattttgatgtcgtggactagaaaatgtcgaaatcgtatattactattatagaccctctttaaatttgtcccaaaaaaaagaaagaccctttttcaaaatatatagttttcaaataaaaatcatttcatacattacaattctgtatatgatgagacttaaaaacattaatttcgctgtcgagggccttgcatattaagagcccttttctagacctataaccacaaactaatcaatcataaatacgttatcactcacgaaacaaaacaaataaagaatcgttttcagtcgacaacataaacttttaattcaatttgtacttatggtttttagaaattaatgtgtgtttctggttgtattttcttttgatttctaaaataatttcctaactttgtacatgatgattatacattagcaatctacatatgtatgtcagtatgtgtctatatacttatatgcacacacatgtgacatttctcaaaattgtaacttgagaagatagtaaaatacaaacaaaccaagcaactcgccaggtcacgggcctttgtctttttatcctcttttggtgaattttctcaattctcatattaactatgtaacttctgtttctgtgttttttgtccacaaaatctgctattggtaaagcatatagtataacgtatagttcacgtgaaggaaaactatttaggtataaaaatctttggatttgatggattcttatccatatatatatatatatgaatgaaaggatttggccatccaggtaataagttgtatatttatttgtcttcctcataaataaatctaagttttaaaaactaaaaatgaaactgatatgctacaaatgtatactctgatatgctaaaatgaattctaatttagtttattgttgacatttatacgatgcttcaaacgaaactaaggtaccgaattctatttaattatctttgttcttctactcatagaaaacatattattactttcatattttcctttgctttcatttttttcatattattacttacaattattatattttagaatatagtaagaaaacaatacatagttagataccatggacctacctattttgtaatttgttgaaaaatctatatgtccatgggtatcaacaagagagatccataaaactagaaaatgcctctttgtattcgttttatgtatgtttattgctaaattagtgggttcagcatattcgttccttatatataatacgaacaacaaaatatcacagtagtatatatttcaactaacaaacaaatgtatgaagtatgtttactaattccataatcactgatcaatataaaaaatgatatacctaagaatatttaaatcagtaatttttatttttttcttctgtttatgcgtttaatttaagtttggcattgagttacttcatcggttcaatttagtgacaaaaattgtttgagaaaaggacctatatatcgatgtggtttagctataacggaaattatatactatgatacttaacttcttataaaatactaaaatacaaaaattggatttggtaattagaatataattaataaacgatgtggtcaaacaaacttcaaaggttgactcttttcaatcctatgtaactttgtgaagaaaaacataagagtttggtatttgattaagataaagttactatacgtatataaaaaaacatcttttaaaataatatttgtgatgaatttaagtattttgattatactcctcatcattaatctttaagacttagttcaaatcggtgtagtatttgtttttgaattttgatgaatcaaatcaatgtaattggcaaaaacgaatccgtgttatattttaaagatattgttcccttaagagatattttattttgatcagtatatataaaaagatgaagcaaatataacaatgggttccaatttccaactgtctttacacagaaaaggttaacaaaaacggtcagaaaaaaaaagactaccgacaaaaaaaaagacagttcatttttttgttatattgatctttcgattatcttttgcacattcttgtcctgatcttcttcttctttcttcccagtttctctcttcgagcttccggaatctttggtgatcaccgaccggatctggacgaagaatctcgttaacaaactcaacaagcattctccaaagcttcctcctttttcttcaacgatcgtcattgcattgtaatttggagagtttagctacaaagtctgtcttcatcgaattaagatctatctgatttttctgggtggttctcatgtgtgagatttttgatgggtttagagttgtcggatatggaaggttcttcttatctttgatttgttttatatattaagcggcagaatttgaggttgacttgagcgagaatctggattctttcgaggagtatttaatgttcctgagaattccctgtttttgcgtcaagttttcatttttctgagtgttaataaatttagaatcattagtgcagcagatagagagagagtgtgtaaatctgaggaagactctctgtggatttgattcgtctttgtgagtcaggaatctgtttgatgaaattcccctgtggagagttttaggattttagaaaatg

SEQ ID NO: 22517 - DNA, 3003 bp, Unknown
  misc_feature (1)..( 3003): 2750-1469P.txt file - cDNA_ID_2105718; gDNA_ID_2926220; Annot_ID_142400
aaagtgattttgcaggtctgcgtatttctttcactgtttttattaagcagattaaatatttagtccatatttctaaaattctgtttatgtatagaaattgtaaacttttgggacatgccatgatacgtttaatagatcaagtttaattatattgtggaatacgtcaagagcttacataaaggattgttttagtagtataccatatatgtggtaatatcgcaggtccgatccgaatggtaacagtaacgtaaatagtgtaaaatgggaaagagaacataacaaggtcttgctagtgaattagaatatacaatttacgttgaacaaacggtacacataaatgaaacaaaagttgaatagtgatcatatcagaatatcagatcaataatgtataaacaatatcaaattttaactattttaatgatcgaaacaattcttataacaaacttaattcgtatgactgttttcgatcttttgatgatatatattttcaaaggaagttgtcattgtcaacttgcaattcaacagtttctaattttgggtgctgttgaaacccaactaccacattttgatgtatttaaaacattatactatgcatctttctgatacaaaaatgtatatcattaatatgtattagaattcttagaacatgcctatatatccaatatagctcatcaaacactaacgagtataaagaccatccactccaccaccacattaagtttttgacttaatgatcatcggctatgttgttgtggtccaacataaagagtctgccgagtttggtttcactgtctaaattggaaccgtttttggttcaacaactagttcacgcagtaaagtatcacttaaatacagttagttcaaccggccataaaaaagtttgttctcgtacatatggatattattgatttacacattgagaatatctacccatctattattaacaattaagcttgacctagagaaattctgatgtagatttttctgattatcttctcatggttaggaaccaaaccttaccttgtttctctactcgaatcaatctctttattagcttatgtatggtttagtgttctctaaccaaaccaagaaaaggattggtttagtgttaacatactgtattactaagtacatagttattgggctataagaagctaactgggccacaaatccagaatcccaatataagtcaatgtacatcgtttgctaaaatctaaaaacggtatctttaatctcagaaaggacattatacaaagatgatgatgttacacataaggtcgtttatctacatcaacttcaacccactagttcttcatattacataaagtctcataaaagcgatttcgtatcgaacttttactcataaaattcccttattctatgattaaaaaggaagaaattccaaagttttatagtatttttatgcaatgccaacttgtgttgcttcgtaattccaggtacattacataatttaataaaattaaaatgaaccaatcaaaaacaaatccaggtcatcatcatgacttgggccggcccaatatccctgagtcggcaacactctctctctctcttccattcctttataactaatcttcaactaacttttctcttccccctaacttttttcacccaaatatttcgacttaattaccaaaaaaccagccattgatcgtaaaacctttccaccaccgcacaccccctcgccgggggtagtgcgtcgcatacacgcgccaccgttaccttctacttctctcttgaagcaacactcgtggtctcctgatctaatccgcgaggaagcttggtcaaaacgtcaagatatctcccgccaccgtcatctccgccgtggtaagagcttgaccgacgaagatctcgacgagcttaaagcaagtttcgaactcggattcggtttcggatctcccgaaaacgctgatccaagactttccaacacgcttcccgcgttagaactttacttcgccgttcaaaaaagctacaacgacgccgtttctaacaaatcaacaacgtcgtcgtcttcactctccgacggcgataccagtcctcaccacaccgtataccaaaccagtatgtataaacatacacacacacacatatatacacatacacgattataaatttataatgatcaaatttcatttgaataggtgatgatccgcaaacggtgaagacgaagctgaagcaatgggcgagagtggtggcgtgcaccgtgaaccaatcgccgccgagatgataattttaacgactgttaaacgttgtggggataaaggttaatccggaacagggtatgtaaattgagacgccaaacagtcggtggagtccagtcagcgttgtaatattacacacacaatagtaaaatactaatatatgttggacccaacttgtttataagttatattgtttattgtataatgcatgatttgatttgatttatcttcttttagtatgtgatatataattttatatatgcaacagaacacaatttgcaaaagtatattctcagattctattgtctgacttttgtccatgggagagtggtgttggcttctcttatattcgttgctaagcttgataaaggattatgcaaattcacgtgaatttgcatatagtgattaattcagattaactgatctctttcagatcaaaatctttgtagcgtaacttatatatattataacttttgaaaagaagaaaaaaattatggccgaagaaacgatcgaaatagtgagaaaatagagaaagtgtagggaacgatgagggagtaagtaacacatctgtgttttgtctgattgtctgattaagaactacacatagcagatctgtgttttgttatgggccttcactattaggcccatctgacccatatcgttaccgctttttagtatggaaaagcaacaacaatgtaaaggaaagcagaaacgttagatttctttagacgcgcaaactgaaagagctttgatcgatcgatttggaggattcgtagaagatatg

SEQ ID NO: 22518 - DNA, 3003 bp, Unknown; identical to SEQ ID NO: 22517
  misc_feature (1)..( 3003): 2750-1469P.txt file - cDNA_ID_2105718; gDNA_ID_2926220; Annot_ID_203277

SEQ ID NO: 22519 - DNA, 3003 bp, Unknown
  misc_feature (1)..( 3003): 2750-1469P.txt file - cDNA_ID_2105722; gDNA_ID_1620448; Annot_ID_157381
aatagatatccatttgataaattaataatctacaaaaaaaatttagcatattatgagaaaatatcacatatcctgcaattaatactttaaggatattagaattcatctgataaatgtgatgtttatgttggaaagtaacaaattatagagaaaaattgctcaaactgtaatagttaaaataaaaatggataaaaccgtcttaattattctcttatgtttgcatggatctctatttcttatggctttgtctcgttatcgactatgtcaagtgatggtcattgcatttgtgttacatgtcgagacaacttatggtttttgtttaataatatatatggcagctgaaagactaggaatagcagaaacaataccagcatatttaaatccaaagctcaaaaatgaagatcttctcaagggtgtgaattttgcttcaggtggttctggttacgatccgttaacagcaaaactagtggtatttttaatatcgtttaaactttcttaataaattggagttttgattcttattttttagtcatctttttattgatatgtttttttttgttctgcgatgctccagaaagtggtatcgttatcagatcaactaaaaaatttccaagaatataaaaataaattaaaggtgattgttggcgaagagaaagctaatttcttggtgaaaaatagtctttatcttgtggtagccagcagtaatgatattgctcatacctatacggcacgctccatcaaatataacaaaacttcatatgctgattatttggctgattctgcttctaaatttgtcagtgtaagtacaaaatttgattatgttatatacctcatttatcttgcattttcaagttttttgatttttgattttatttataaaagtacaaatttgttgttctcagtcaatttaaccataaaaatgatatattgatcattcatagcaataacagcatttcaatcaaatttggattcattgtaatgtttacatcatataggcattgtatggacttggagctcgaagaatcggagtatttagtgcagtaccggttggatgtgtaccagcagctagaacacttcgtggaaaattgaagcgaagatgctcagaaaaacttaacgaagtggctcgcaactttaacgcgaagatatctccaacattggaagctttaggaaaagagttgccagatagcagagttgtgttaattgacgtgtgtgacactcttaatgacatgatagaaaaccctaaaaactacggtaagtatgaatacacatccctttttctcataataatttcatcaagttataaccgtaaagtaaaatagttgatcatttatgttgtgatacgcaagtacaaatgataattagtattttgaggattttgttttggtcccacatcagttaaatttaataagagactttgcaaattattatatgtgagacgtcacaaattattatatgtatataataaagtgtttagatggaaattttcaaaccaatgggaactacaaacaaattaacttacctcgtacaatagcacgggtcatcacttagttatagagaataagaacgaaagtcataataaccataatactaatataacttaatgcatatttataaaatatattatacacttagaattgatctaaatatgcatggatatttagtcattcaagatattgttttatggatccatgaatttaaatgttggatctagactcgcatacctccaatatcttggccatcgataattagtaccaaaaactaactttattacctactagttactatctttaacttctttcttttttattataggatttgaagtatcaaacagaggatgctgtggaaccggattagtcgaagtactatttttatgcaacaaaatcaatccttttacatgcaaaaattcatcttcgtatattttttgggatagttaccatccaacagaaaaagcttaccaaataatagttgataagttgttaggaaattacattacgaaactagtctaattctatatttttataatatactaagtaatattttttcctatgtaaaaacgtaaaaaaaaaaaatattttttcaataataagaaatagtatttaaatgttcatttagattaaatagattcaatatagtttgttaaaaatgatttatcaattaaaaaaacaggttatattggattagactagtttcgtaatggctaaaaaaaagaataaaacatacgtacgagaacaagacgaagaaatagaaggcatccactacacaattgtacatgtcgacaacaaagtcaacgacataccgtttgagacaccgtggctttcgcttttctctcaaaaaaaaaaaatcaatcatgtttttttggtttttatgtttcgacagtatttggtaggttgttttaatattattaaaaacatacttattatttgtgtgaatatgtttaaaagcaaacttggttgtttggaattgtaatatcaaatgtcaagatccatcaactttcataaaaattcgttaatttgtacgtgaacaattaataaatctctcataccacacatattattgctctagtcaatttgtttcctttgttttcagtcattttcaggaatcaaatattagcaatgctttaactctactccactgcaaccaaattggttgtttagagttatcaaatgacaaaactcgttaaaaactcgttaatatctattaaccaataaatctctagtgaacttttttcctttgttttgttctgtcattttcaggaatctaaattattaagtcttcaactctactccaccacaaccaaaattaaacgagtcttgtctacatgacctaatttgcttaacaaccttatcatctcactaacaactccatctcccaaaatttaaactcctttaactatgcctataaaaccttgatccattcttcatcacataagcaacccaacaaattcattctaaatacatttcttttcactcaagaaattaaaatttcgaaaagtttgttaaaatg

SEQ ID NO: 22520 - DNA, 3000 bp, Unknown; identical to SEQ ID NO: 3322
  misc_feature (1)..( 3000): 2750-1469P.txt file - cDNA_ID_2105726; gDNA_ID_1620639; Annot_ID_47452

SEQ ID NO: 22521 - DNA, 3000 bp, Unknown; identical to SEQ ID NO: 3314
  misc_feature (1)..( 3000): 2750-1469P.txt file - cDNA_ID_2105726; gDNA_ID_1620639; Annot_ID_162991

SEQ ID NO: 22522 - DNA, 3003 bp, Unknown
  misc_feature (1)..( 3003): 2750-1469P.txt file - cDNA_ID_2105733; gDNA_ID_1972023; Annot_ID_178127
tttttaggaaaatcttcttagatcattttgtttttgcattgacattaatatctgactttttgcaggccagtatagcaaaacttgaaacttctttatctatgtatggtgataagctagagcttaaagtgtatggctttaatgagaaaattccagctcttctatcaaaaatcttagccatagccaaatccttcatgccaaacctggagcgatttaaggtatgtgaatatttgcatgtatagttgtcatatttttaattctccttttatcttaaatttcaagttttgtgtcattttcttatcctcatcatttcttgatttaacttctttttctttctaaccttgtaggttatcaaagaaaacatggagagagggtttaggaatactaatatgaagcctttgaaccattctacatacttgagactgcaactcttgtgtaaacggatctatgacagcgatgaaaagttgtctgtactaaatgatttgtctctcgatgatctcaacagctttattcctgaactccgctctcaggtaacattctgcatcagtgtgattcctgttttacttaatacacagattttgtgactgttctctggttttgtttaaattgggcaaaggtcatgtaatacctctgttatgttttcagatatttattgaggctctatgtcatggtaatttgtccgaagacgaagcagtgaacatatcaaacattttcaaagacagtttgacggttgaaccactcccaagcaaatgtagacatggtgaacagataacatgtttccctatgggtgccaaacttgtgagagatgtcaatgtgaagaacaaatctgaaacaaactcagtagtcgaggtaaaaaggaaacagtattttcttgtgataagagtcagccaagaagagttgaaaacattgtactttcctcgggtataatcatggttttgaattttaacctgcatctgatttgcagctttactatcaaatcgagcctgaagaagctcaatcaacgagaacgaaagctgtgctggatctctttcatgaaatcatagaagagccattgttcaatcagttgaggttagtcatcacatgtttacctagtttttttaatagatcaaaattgtattcatgtatagtcacacatatatatacatattttggatataggacaaaggagcagcttggttatgttgtcgagtgtggccctcgcttaacgtatcgtgtgcacggtttctgtttctgtgttcaatcttctaagtacggtccagttcatttgctggggagagttgacaatttcataaaagatatcgaagggcttctggtaagtctgtaatcaaaaagaatatattgattttttttgttaaatctttacctcgctccacatatgttaatcggactgtaattgcaggaacaactggatgatgaatcctatgaagattaccgaagtggtatgattgctagattgctggaaaaggatccctctctcttgtccgagacaaatgacttatggagtcagattgttgacaaaaggtaaggatctcaagggtttgaagttatgtgacctgtagtatctatagaactttcaatgatttacttggatccatatccacaacggtcactggcgaatgaaaatggagttaactctctcacaggtacatgtttgatttctcccacaaagaagcagaagaactaagaagtatacagaagaaagatgtgatcagttggtacaaaacctatttcagagaatcatcacccaaatgtcgtaggcttgcggtaagggtttggggatgcgataccaatatgaaagaaactcaaacagatcaaaaggcggtgcaggtcatcgcagacgcagtggctttcaagtcaacttctaagttttaccccagcctttgctaatgagaagaaacatacaaaagagttttgcttcgtcttcccttttttttatcttttatattttgattcactcaattttcttcataccctcattggataggttatacttttgggtgacaaacaccaaaaatatccctttttgttacgatttgagaatacgctttttaaattattatttttatctggtggataatttgatatttattgattagaaaagcattatcttatacaatgtatagatttcatttacccaaaaagaagcagcaaaactaaaaaacagacagaaaaaaaaagttatcaatcgataaaaacttacttcaaataaccatcgaaactctcactaagaaaaatcccatttggaacaattttctccttaatgacaggtatatgtccactggaacaataaatgaaaagaaagtataaaatgacctttgattgtacagtgaatgtcttacataaataaccaacggtaaaaaatcaaatgtgaacgtggatcatgaatagcttgtttgataattacgattatatcccgcggttaatttctctctggtagggcctatcaaacgtagaaagcgaaaactatctttcttcttcctctctctcactatttttctctgtacggtggtgagtgaagaccatcaaaaattgcagaaaataggcttaatctgaatctcttctcctccgtcgaagttttgaattctctctggttctccaattctcctgtgagtctctctctctctctcttccctctttctccttccttatgttctccttgtttcatttcgcgtctcttgaattttgccttcaactgatttctttgatctctgtctcataacggcagatctagggtttatggcttctggctttcaataaatctccttcgttctcccactcttttatctaacgagtttctattttctccattttgcttcagctcgagctgccttaagcttcgcatttacgtttacgttatgcacgaatgaggttcgttttctccagatcgctcttgttttcttcacgttttactgtctaccgttatcattccttgtataatttttggtggattagatcatcgtagatcgtgattgaagaagcgagagataaattaggagagcgaagatg

SEQ ID NO: 22523 - DNA, 3000 bp, Unknown; identical to SEQ ID NO: 2636
  misc_feature (1)..( 3000): 2750-1469P.txt file - cDNA_ID_2105764; gDNA_ID_1620568; Annot_ID_160792

SEQ ID NO: 22524 - DNA, 3003 bp, Unknown
  misc_feature (1)..( 3003): 2750-1469P.txt file - cDNA_ID_2105795; gDNA_ID_1620562; Annot_ID_160643
cgagtgaactagccataaagtagttgaaacgtaaggttgcaactctatgaacgtttctggatatgtggttaagactttttatttggtgaaggagtaaaatgtgtgtttggccaaatgagtaaatctctatttgggaagataacaatgatttcagtatctcagccaatccaaatgagtggatgttttgaaacagtttgctattcgcgggagaatttcacagcttcaatcacagcagagaagtcgagatctcctagtcccaagcttctcgccttcttaaaagcctgtcgagaaccgaaacatatattttaagattcaagctaagaaaccaatctagaggagggagagccaatatgttattgtctctgagtaactaactaactaactgacctcgtttgcagccgcggctacaggcatggaaaccgcgttttcatcgccaagagcaagagctagcctcatgtctttctgctgatgtttcaatggaaatgctggtgggtaactactcttgttcattgaaggtcctttccccttgaacatcgggttagtcattgctcccagatcctgcccatagcagaaaccgattcaaaccaacaccattatttcagagcttgcaaaagtttgatcacctcaccagaatatccaaaagagtgtcagagctaagtccactcttgtcagccaatacaagcccctcagagaatgcattcatcatgctgtatcagacgaaaaacaataagatcatgaagccatgttccattcctactactaatggtagtaattgtaaaagagacgggacattcaccttcccattatcatgttcactattagcttcattttagctccgtttccaacttgtcccaagtaaaacgatctcttccccaagacatcaaaagctgggattgattcctcaaagagtgccttacaaaaaaggattaaaacacaaacggattatagccgcacatcgagagctccttcctactaagtccaactaaaacagttcttgagatctatcaatcaatccataagtacagttttgagttgtaccttgtcaccagcagcaaggataatgagttggccatcttcagctggctttttgctacctgaaaccggaccttctacgaaccgaccacccttcccggtgattgcctaccaatgcgcaacacagctcaatcaaactaatcaaccttcttctaatcttatcatcagcatctaaagtacaaaagattcaacctcattgatcttcaaagaagtctctgcatcaacagtcgacatatcgatataaccttttccttcacatatctgctccaaaacaccgcctttatcgaaaacaacctaatcaaacaactacttcatatcattcatcaccaatgctaaaacacacacaaaagaagcaaaaaaggatttcaaataccgaaagagcagcacaaggatcagagagcatagcaatagtgtatttgcatttcttgattacttcagctggactctcacatactgatgcaccatgctccacaagctcatcacactgtcacaatcatcaaaaattcccaaaattgcattaaattactcaaaaagtttccgactttatcagatctgaacaactaaaactaaatcagaaaaccataataccaaaacacaatcaaagacaaaaaaaaaaaaaaaattaccttggagagtgttctgttccatacagtgactttgaatccattcttcaatagattcattgacatggcttttcccatgattcccaaacccagaaaccctacttccattttatctatcttctgcgattatagtgcttacttactgcttagtgatgatggtctgagaatgataaagccggagccttttctaatcagagaaccattatcatcaaatacacttactttgaaaaggaagtatttacagtttactccctacagtttgattctgtttgcatctctaactgccagttatgaacgaacaggatttcgccacgtgtttgaaataagagggattttgggttttgattgtttctcgaatatttttggtacgatgagatatcatatttctactatatacataaagttaaataatctaatatagttcttcagcatattcatgttctctaatgactaattatatcataatcgtaaacttacaagtacaatgatgaggacggtctcaaattatatatacttcttgttcaattttagtgttaacgtagattttttttttaataaaacaacggtgatttctagatatacagagaagaataatgagaagacaaattgatcttaatttgtaatatagtacttattagagacatgaatattatattattagtttgcattattgtattaccatcatcgctgaagaaaggcattactcaacacatctgtctaactgtcttagtaatggacaactaaaccaacaaaccaacatataagtctgaaatgtggccttcagattatttttatactgcgtggcctaaagcaaatgcttcacctgctttattgatgggcagtgcctgctggaatcaacatatttttacaaagaaataaaaaattcaaattgatctcttcacgaaagagaaagaaaataaataatttgaaaatttgaaaaagaaaataaagcttttagaaaaagaaaaaaaatagtaatagtttttaaaatgctatgaattaaataatataaaagatatggatagtataatttcattactttcaagaaaataattgaaacgcagagaaaaaaaaaaaaaaacaagagcccatcgagaatggatcagtaaaaaacctaaggcctatctccagcaagtgcaacttacatacattctcgaataaattctgatccgatcaagaactcataattattgtaacagataaaatcaaatttgagagatctactactaaatctaacttaaagcattgtactttcttttatctcattctcctttgctctgctttcttctggtcaacccccacgagattccttcttatgtgattgtaaagagaagatttttcagagatg

SEQ ID NO: 22525 - DNA, 3000 bp, Unknown; identical to SEQ ID NO: 6366
  misc_feature (1)..( 3000): 2750-1469P.txt file - cDNA_ID_2105807; gDNA_ID_1621090; Annot_ID_55498

SEQ ID NO: 22526 - DNA, 3003 bp, Unknown
  misc_feature (1)..( 3003): 2750-1469P.txt file - cDNA_ID_2105807; gDNA_ID_2684129; Annot_ID_191173
aaaacaatatgaacgaatgattttagtatttaactttcgtcctcatgtagccatgttgttattttcaaaccataaagaggacttaagagtcgtcagataaaacaatgatattttcgtattcgtcgatgcactaataaccaactcgattggacaacatatcttacttcattcacgattttgatgatttcaccgaacaattttttctttctttctcttttgtcttttaattatgtcattttcttactggatatgttcactggtcgagttgggtcttggcctaacacataagatatatttatgatagacatatcttttttttttatctttttttgagttcaaagtagacttacatatgtcaaaatccgagactcccctaactcatgaaaaaagtgagacgaattcaactactttgccgaatttacctgtcttagaaaatcaatcaaacccttgagttgtttgcttgatcataccttctcttctccttgtcactttcactcaatacaattgacacaaatcatcactcgggaatcaagacccaacacttttgtcttggttgtcaggggctgggttaaatactactaggcccagtatcagcccacgtaatgttcttctttactgttttgtctatgctctagtttttgtttatacattttctttgtattcctcattctcctaacaaccctattgcctgcctattggtatcagaatagaccaccactgcacgagaaaaaacctaaacttgatcgcgaggaaaaaattgtgtaactaaagtggtcgtggagcggtggaggtaaaacattactacatagtactgttacaaaacaatatcttgtaataattaaaataaaagataaagtagtaaaaatattatttttttgtcacatcattacaattttcctaatttatgtttagaccattgctgtttggcatactaaaggtataagaaagacacgccacagagatccagtggtatacaatttttatgctttggaatcaacttatttgctacaatgacaaactaccaaagtttatttaattactttacaaaaagaattatttggataatccaaaatcaaagaggggaaagttggatttacatttccgattaacattttaacgtaaaaaggaaaaatgtgaaacataaagtgggcaactggacattcacggcaacagatcaaaaacccttttttaaatcaactacttagtaaaagaggaataaattaacagattatcacacacactgattgataaattaggagcaaattggttttaacaattcaaaagaaataaacaaagcactaagttagttttggtgctgacgagagtggacggcaaaaaaaacagaagatcactattaagaaagttaaagttaatagtgcaaaatattaatgtagggaaaaaaatgactacaataatgttcaaagttaaaataaaggacattttgttggcaagaagaaaaacattagaaacaaaaacagaacaaggcaaagctgcaaagtcaagttgagtcggtgaaagagaacaacaaccaacctttaccccactgccatcctccctagttttgaacatgtgcactttcttcgttatttaccatcacttttgtgttgtcatattcatcttcttctattcagagaagacatttagccaaaatttatgtaatttccgagattaagaactggttttcctttgtttgtcacttcaaaccagtgatcaacaatgaaaacagtaaatgttacagtggtctataccaagattctaaaagttgaaaagtggaagagggcatgctaatttgaatgaatacccaatatttaagattctagaagctcctttttatctatatatatcaactaaatagtcggcatgaagctctcaaatacttggtccacctatttatagagtacacaacttttttggaaacagctaattggaaaactctgtattatttagggtttggtactagttccttttgttgtgcaactatcaataaataacatataccttctattgataaatccaaatccaaactctaaagtgagtcgctgaaaatgaaagtagtaaaattttgtggcctctcatctcactgtattcatatttcgtttgttgagtgccgactctactatccacctattatgagattcttatgttaaaacttacaaaatatatttacctagattttgtctttgtccatactcttccatgtctcgggatcagaacaaaacaactagtttacgtgcttttttggaaggtcttatagtagtaataccaacagagctacagataatggattaaatacatgtaaccaacaaatgttatattacttttataaaataattataaatcaatgaaaaaaattccttatgaatcgctaaattttcaagaactcaaaaccttattcggttttcataatgagcaatgatgaatacatgttatacgtcgaattattattttggattctcaagccggccctttgctatcttattttctcctttacaacattttttaaccccattgtcaaagagtcggctttgagcccatgattgtaatgaatggatagcttgaatattgcgaccacactaataattcccgtcaaatatttgtttaacttaatgtatgacacatgtattttacgagcaaataaattcaaaaaatttaagcattagcgaaaacattgtttctccgctccacaagacactaaaacataaataatgaattaaatcagtcattctacagaaaattaatcaccgtagtcggttgccatcattccaaaaccttaaaaaaaacccatgtaaaatgatcattaacaacaacaacaacaacaaccaaaccaacaaaaattaaagtaaaaacagagtccaaagcctcgtcacatctgcccataaatacccttcaccgactcaccatcttaccacatcaattctctcatatctctctctcactttcgaatatatcttaagataacagagacacatactcttaagtttggtgaagaataagaagacaatg

SEQ ID NO: 22527 - DNA, 3000 bp, Unknown; identical to SEQ ID NO: 6366
  misc_feature (1)..( 3000): 2750-1469P.txt file - cDNA_ID_2105807; gDNA_ID_1621090; Annot_ID_170686

SEQ ID NO: 22528 - DNA, 3000 bp, Unknown; identical to SEQ ID NO: 1643
  misc_feature (1)..( 3000): 2750-1469P.txt file - cDNA_ID_2105831; gDNA_ID_1620429; Annot_ID_156811

SEQ ID NO: 22529 - DNA, 3000 bp, Unknown; identical to SEQ ID NO: 1624
  misc_feature (1)..( 3000): 2750-1469P.txt file - cDNA_ID_2105835; gDNA_ID_1620427; Annot_ID_156762

SEQ ID NO: 22530 - DNA, 3000 bp, Unknown; identical to SEQ ID NO: 944
  misc_feature (1)..( 3000): 2750-1469P.txt file - cDNA_ID_2105845; gDNA_ID_1620340; Annot_ID_153929

SEQ ID NO: 22531 - DNA, 3000 bp, Unknown; identical to SEQ ID NO: 8770
  misc_feature (1)..( 3000): 2750-1469P.txt file - cDNA_ID_2105868; gDNA_ID_1971878; Annot_ID_176773

SEQ ID NO: 22532 - DNA, 3003 bp, Unknown
  misc_feature (1)..( 3003): 2750-1469P.txt file - cDNA_ID_2105868; gDNA_ID_1620837; Annot_ID_169927
tttcgagatcctctaaaactgacaaaaatgagtttttattgtaaccctctgcctattccatattgctttgtggaaatgcttcattggatttgattctctcgaataccaacatttaagtgcaattttagtggcagtggacatatatgcgcaagtgtgcacatcttctcggcagtggatgttacagtcacttttcgagagattttcagttacatggccttcctcgatcgatgttttctaatcgttattgtgtcttctcataacaattatttcgtctagtattgctttccacctacaagctggtggtttttactcatctatgatcgatttgcttcttttcaacttaacaagtggtctttttggcatgcatgtacagagttttggaataattcatccatccattcttctttacaatatacacatgaccatgaaaaactacattttctatatcgtctattctggttctggtacaagagttcattatgaaacttctacaattctttcatatttctctatgttatgatcaacaaaaaaatttgaaacgacgacattagcattggcatgcacatgtcaaatagtaaacactgtccgatcccaactattattatatcaacaacaagttttttttttttttttttctcaaaacaacttttgtatttacatttgctaaaaacatcagattatttggtagatagaaatgtgtgattcattctttaccgcaaaaggttttgaaccgtatacgaagaatccgcggccttggccgaagaaggcggtgaatgaggcagcctagcggagaagttacgtagcggaaaacggtcgatattgtcatcctcatctcctttatcaaagttaagcgcatagctcgacggatcgtaatgaaagtcagcagtatggcggcgaatatgcttcccgtgaccgccaacgccacctactccaccgcccattcgatggatcagactcttacatttttcatgtgacttggacaacgtcctagtgagtcttggagatttggtcttcattccaccaccatgtgggctttgtgtagatttctcggtggtgaccggggatgatggtaggtcgtcgggaatgttgtcgtggtggtgatgattggtcgtacgaaaacatccggcgatgcaaaaccttgatttgagtttcttttgtagagacaagttggtcattgtttcgcttcccattttttttttacaaaaccaatgtttgttggttagatcaacaaaggaatgcaaaagagaaggaagacattgaaagaaagatcaaatctgtattagaggaaagaaaaacaaaacagaaaacaagtgatcgacgagatatttggttgattttcatttattattttttcttgaaatgaactgtttaaccaaaacttcggaggagaagttgaaattctttactattttaggaatatttgaatttccaattaaaatgaggttcaattttgtttcacgttaaatattaatgagtcttttgactttgtgagcaaggggggacatatttagggtaggaaaaataatatttatagtaatttattaaattagttaagattataaagttaaaaggataatatgaaaattttggaccaattttgatttgtgaatatagtaacggcatagctaaagcctaaaaacatttaatattaaaagacctcattggattttattttctcgactgtcacatttttgttttggcagaggtcttttatccatgtaactctattcagtatccacaaacagttttggaggatcaatatgggccttagaaatgaattaagatcatacttcactagagaatgtgcactcaaagaatgtgttgcgaggtttcatcgttaaatttgcattaaaggtaaggaacttgaagatcccatagcaaaattccatctctttggtgaagtcgttgtctagttgtcaccgaagctataaaggcatacttggaaatccttcatttgaaccaaattatttgctgccaggctgccagcagtgcctgtcttgtgaaaaatgaggctcaaaataactttttttttatgggtttatagaagaattttttttttttgagaccaaatcttaaaatgttatgaaaatgaaacctatgtattcaatagaaaatagataaaaattaaaaattgagactaaatctaaaaaatttagaaaatgaggcaacaaatatttttgaggtataattttgatactaaaaaccttaaaacttttggtggctcaatacccatgtttcttagaaatatgtcatgggccgggcctgactgccagtcaatggaaggaccatgagggtgtagataatgctatatatttgagattgtaaatatagctgataaactatatttacaacgaaaaatatttaaattctgacttagttaatgtaagtttaggcataatggaaacttttgtttataaatacgataaaataagccgtgggaaaatcgttttcgcactttcgctttaaacttttactcataattggtttgaaatttaaatcaatgaaaaaactaagttaaaactttaaattgcttcaaccttagttggttttttgtaagttcttcttatttttttcttgtttatgttagatatgatttttcatcaataaaagtagacgttaaaaaaaaaaaattacaaatcatttatataaaattgttgcattttcgaaagaatttttttatagtttccatttgatttttgtttctagaagtgtaataagaaaataaatccacttttaagttttgatgaattggataaccggtttgaacgaaacctggttttgatgaaatttttcccgacactgtaacacgataattagatttgttgagttataacattacgtgtcgaattttaattggatgtcctgcgtggccgtcttattagtcacatcaccgcagctaataacactcgacgagcgacctcatcgtctacatcgccgtcgcctgttaccgtccggtgctattctccttcacaatctcacatttttcgtaccggttagaagatg

SEQ ID NO: 22533 - DNA, 3003 bp, Unknown
  misc_feature (1)..( 3003): 2750-1469P.txt file - cDNA_ID_2105872; gDNA_ID_2096290; Annot_ID_195344
ctcctgttcctcctccctctgcctatgggttcggtggaggcgctgtctcaagtaataacttccctttgaatcccacaagtgctgcaaactcctacgaagatgtcttgagctcacagtttaatgagagcaaccacttggcatcatctcttcagcagcaggtaaaccatgaaattcttctcaggttttataatcatgttggtgtgttttggttctgtttggtttccttcctctgtttagtcagctggaatttatactggagtattcgattttatttatttttgttcgattttggatgggtttggctcagttttgaactgttggattttaagaaaatcggtgcagtttggtttctgttatttgtgcgttctctttttcgcaaaccttaacgagtagctttctttgttttgctttgatctacagaacgaaaaaacaacagcatggcatcaaggacaacaagccaactcgcgagtggttccaggaagcggatattacagctaccctggtcatcagaatcagcagcctcccggtttccgtcaagcccaacaactgcaacatcagcagcagtcgtctcaacaacaacaacaacaacaacattatggaggacatgggtatgtgagtccttaccattcacaagctgtaatgtcactagaacatcttcatcaccaataccaacaacagcaaaacgctagagacgcgtcgaaactgtcccaacaatagttatgggccaaccactactgatgaaaagcaatccattcaaatccttctttcccccttattttcatctctcattccagagcagcgatgggatgattccgttgtttgaaaatggcgttgtgttgtgtgtgtgtttaaggttcagggtagggtcttatgagagggttttgtgagagaaccttcaatgggttaacttgtttacttgctaaccttcttatattactaaaaagaactctatttttctttcttgtctgtttcttatcattttactttttaactatttagtcttgacattctatatcagaccaaacttcatagtaaagattattaagcttagcatgtcctgactaacctgcgtcatattaaatagtatggaaagagaagaaaaatttgaaaacagagaaattcaattactatttacacattttgacggtgtgattatgctaatttatctactattaaataagttgtgtataatgaagaaagctaatcaaatcatgtgttctttgtttggtactagtctactacacaatatttaattggatagtatagttaatagagagatgtgtacttatctaactctggaaaaccacgtcatgtgagatttgttaacaaaacgacacattttgccgttttatttgttttcagctccaaaaattcaagtcatctctgtgtttaaaaattttaatatgagagagacgctgtacctttttgtcaaacatagttgacactttaattcggtcgaagtgtttactggaattcaaacttacaacttcgacccctccattttaaaattacggttcccaatggtgacgaaaccgcacgttgcagtacaattttaatactccctccatttttatttagttgatgttttaggagaatacacatgcataaaaaaattatttaacttttatctattttaaaactaaaatatcatctattatttaatcaaccagtagaaaaataatctgcaaaaaaaaatcattaaaatcaataaaaatacaaataattttccattgaaaatttaaaacatcattcctttaaaaacaaaaataaaagtttaaaacatcattacggaaagagtagtaacaaaattttctgaaattgctagaattttagggccacaatcaattgcttctttttattttgctcagttacaatataataatacaatgaaaactacatcgcatttgatatgtagttaaaccgtatatctccattcggaacttatttatctgatctataatgtcaattagatttattattcggaacacaattcatataaatgttagttttagataaaattttagagaaaatatgaaaggagccaaactcaatcttagacttaataaagagtatttttccacaaatagttacaagaaaaccaattcaattattagcagcatgtgtaatgtgtgcaatctagtaatctgaaatagaataacaaaatcggtctggatatattattattgaagaagatgccatattattaattattataaaaaaaagatgccatattaattttaaaaaatagcatgttatataggttcttatagtatcatatgtaaatgtttcttgttttttgtgcaaaccgcatcaaatcattattaaatgaatatcagtatataacctttgatttctctctaaaaaatgttaatagccacaagaaaaacttaagaaagcgccatttctgcttcttcttacttcaatcctttgcgagagagagagagagagagagataaagtttcttcctttttcccacgtttcacgttcctcctcttacctctttctccttcgcttcaatcccttcaagtttcagtctttagatcaaaccaaaaaaaaaaaacgatctttttccgataattcagttaacttcaatcggaaaaccatttccagttttccggcgagatggccaacgaaggaagtgaccctttacttcaatacatgattagcccgagattgaaaaaacctccacagctgctgtttccattaccagaagacaacgaagttgcgattccgatgccgatgacaccgtcggagttcaaagagcgtttaatcttcggacccttttcatgttcgccgcgagattcgtctcacttcatcgattccatgaaacaaccgtcaccgtcgtcttcttcaaccgccgttaataatcctttctccgattcctcaaccctagatcctctgcttccaccaccaccaccacaaccagagccatggttgtccgatcaaacttcgagtcactgtcaaggccacgctcttcaccgatccaaaacagcaccagcaatg

SEQ ID NO: 22534 - DNA, 3003 bp, Unknown
  misc_feature (1)..( 3003): 2750-1469P.txt file - cDNA_ID_2105872; gDNA_ID_2926170; Annot_ID_140063
tacaacactgaaatttccatggccgaggtaaccaaatccccgtttctctttcatatgatcttattctaagctttccttcaataccattgcttacacaaatttgattgcaggcactaagagctgcgagtatttcacctcaaaacgcaatacccagtgcaggacagcaagcagcaactcttgcacaacatcttgccttaaatccctactctcatcagcctgagatgcctttaggacattatggcaatttgataagctacccattcatggcacagtgttacaaccctttcatgctttcagcttttcaacaagtgtttcctactggtaatcatcagtctttagttgatatgcttatgcaatacaagactcaaacaaccgctcctcctgttcctcctccctctgcctatgggttcggtggaggcgctgtctcaagtaataacttccctttgaatcccacaagtgctgcaaactcctacgaagatgtcttgagctcacagtttaatgagagcaaccacttggcatcatctcttcagcagcaggtaaaccatgaaattcttctcaggttttataatcatgttggtgtgttttggttctgtttggtttccttcctctgtttagtcagctggaatttatactggagtattcgattttatttatttttgttcgattttggatgggtttggctcagttttgaactgttggattttaagaaaatcggtgcagtttggtttctgttatttgtgcgttctctttttcgcaaaccttaacgagtagctttctttgttttgctttgatctacagaacgaaaaaacaacagcatggcatcaaggacaacaagccaactcgcgagtggttccaggaagcggatattacagctaccctggtcatcagaatcagcagcctcccggtttccgtcaagcccaacaactgcaacatcagcagcagtcgtctcaacaacaacaacaacaacaacattatggaggacatgggtatgtgagtccttaccattcacaagctgtaatgtcactagaacatcttcatcaccaataccaacaacagcaaaacgctagagacgcgtcgaaactgtcccaacaatagttatgggccaaccactactgatgaaaagcaatccattcaaatccttctttcccccttattttcatctctcattccagagcagcgatgggatgattccgttgtttgaaaatggcgttgtgttgtgtgtgtgtttaaggttcagggtagggtcttatgagagggttttgtgagagaaccttcaatgggttaacttgtttacttgctaaccttcttatattactaaaaagaactctatttttctttcttgtctgtttcttatcattttactttttaactatttagtcttgacattctatatcagaccaaacttcatagtaaagattattaagcttagcatgtcctgactaacctgcgtcatattaaatagtatggaaagagaagaaaaatttgaaaacagagaaattcaattactatttacacattttgacggtgtgattatgctaatttatctactattaaataagttgtgtataatgaagaaagctaatcaaatcatgtgttctttgtttggtactagtctactacacaatatttaattggatagtatagttaatagagagatgtgtacttatctaactctggaaaaccacgtcatgtgagatttgttaacaaaacgacacattttgccgttttatttgttttcagctccaaaaattcaagtcatctctgtgtttaaaaattttaatatgagagagacgctgtacctttttgtcaaacatagttgacactttaattcggtcgaagtgtttactggaattcaaacttacaacttcgacccctccattttaaaattacggttcccaatggtgacgaaaccgcacgttgcagtacaattttaatactccctccatttttatttagttgatgttttaggagaatacacatgcataaaaaaattatttaacttttatctattttaaaactaaaatatcatctattatttaatcaaccagtagaaaaataatctgcaaaaaaaaatcattaaaatcaataaaaatacaaataattttccattgaaaatttaaaacatcattcctttaaaaacaaaaataaaagtttaaaacatcattacggaaagagtagtaacaaaattttctgaaattgctagaattttagggccacaatcaattgcttctttttattttgctcagttacaatataataatacaatgaaaactacatcgcatttgatatgtagttaaaccgtatatctccattcggaacttatttatctgatctataatgtcaattagatttattattcggaacacaattcatataaatgttagttttagataaaattttagagaaaatatgaaaggagccaaactcaatcttagacttaataaagagtatttttccacaaatagttacaagaaaaccaattcaattattagcagcatgtgtaatgtgtgcaatctagtaatctgaaatagaataacaaaatcggtctggatatattattattgaagaagatgccatattattaattattataaaaaaaagatgccatattaattttaaaaaatagcatgttatataggttcttatagtatcatatgtaaatgtttcttgttttttgtgcaaaccgcatcaaatcattattaaatgaatatcagtatataacctttgatttctctctaaaaaatgttaatagccacaagaaaaacttaagaaagcgccatttctgcttcttcttacttcaatcctttgcgagagagagagagagagagagataaagtttcttcctttttcccacgtttcacgttcctcctcttacctctttctccttcgcttcaatcccttcaagtttcagtctttagatcaaaccaaaaaaaaaaaacgatctttttccgataattcagttaacttcaatcggaaaaccatttccagttttccggcgagatg

SEQ ID NO: 22535 - DNA, 3003 bp, Unknown; identical to SEQ ID NO: 22533
  misc_feature (1)..( 3003): 2750-1469P.txt file - cDNA_ID_2105872; gDNA_ID_2926170; Annot_ID_199415

SEQ ID NO: 22536 - DNA, 3000 bp, Unknown; identical to SEQ ID NO: 20567
  misc_feature (1)..( 3000): 2750-1469P.txt file - cDNA_ID_2105883; gDNA_ID_1620756; Annot_ID_166972

SEQ ID NO: 22537 - DNA, 3000 bp, Unknown; identical to SEQ ID NO: 1271
  misc_feature (1)..( 3000): 2750-1469P.txt file - cDNA_ID_2105896; gDNA_ID_1620378; Annot_ID_155247

SEQ ID NO: 22538 - DNA, 3000 bp, Unknown; identical to SEQ ID NO: 1655
  misc_feature (1)..( 3000): 2750-1469P.txt file - cDNA_ID_2105929; gDNA_ID_1620431; Annot_ID_156864

SEQ ID NO: 22539 - DNA, 3000 bp, Unknown; identical to SEQ ID NO: 9416
  misc_feature (1)..( 3000): 2750-1469P.txt file - cDNA_ID_2105933; gDNA_ID_2684229; Annot_ID_192186

SEQ ID NO: 22540 - DNA, 3000 bp, Unknown; identical to SEQ ID NO: 9416
  misc_feature (1)..( 3000): 2750-1469P.txt file - cDNA_ID_2105933; gDNA_ID_1972118; Annot_ID_178842

SEQ ID NO: 22541 - DNA, 3003 bp, Unknown
  misc_feature (1)..( 3003): 2750-1469P.txt file - cDNA_ID_2105937; gDNA_ID_1620552; Annot_ID_160331
cagccagtttgacctccaccatcttaccattgagttcgtggaatgtcttctgcagtactttgtcaacagcttcctcagagtcatatgaaatgaacccaaagcctctaggccgctgggttctgtggtcatacatcaccacaacatcagtgatcatcccaaactgagcaaaatactttttgaactcagcctctgtcacggatgatgccaaacctcccacaaagatcttcttggagtttgatgggccaggtgatccctgaaggctgctgttacttttattaaatactacgtgatcatctcttggaacagccttctttgcctcaacctgtatatcatggagaaaatcaacacacgacacaactcaaagaaagcagtttttcattcattgtgaaccactttctttcacatgaggatatgaaacgatccaagttttacatttttatttgtgagtgtgaaatgaacaacttctgacaaagatatgcatttatcagagcggcaaagctgattgtaaacaatagagtctactaactaaaacaggaaggaataaaagtgagtagctttgctttgctttgagaagcagcaacctcaaaatgaagcaagtaagcaggaagattgttgaaattggaagcaatgtatgttggtatatagcaggaggaaacttacaattttaccatcaatgatatgtttaagcaagacgactctttcagcaacattaggatcagcaaagacaacgaaaccaaagccacgagcacggccagtggcacgatccttcataataacagcctctaaaacctcaccaaaactgtgaaaatagtcacgaagacgatcttcactggtttcccaagatataccaccgatgaagagcttacatgattccatttccatttctgccaaacaaacaaaaaaaggtttgtttttggttccagattctatatcgatctaagtgagaaggagaatggaatcgatagaaacacctcaagggaagcaaaataggatgaaaaagagcagatgggtcgtgatcggattgtgtaaaaaccgatcgacccacgatcttggattcctgcagaaacaaaaaaaaacacaaatgatcaataaaggtgtaagcttggaggaaggaaggaatgaaaaacccagaagacagagaatctatgtatgtgtgtaataccgaaaataaagaaacggagaaagaggaaaaaaaaaagattttaggattgagaaatcttcagatttggagaaggcaaggttttaataagagggcgagaggccctcctctctcttttctgcttatcgtccaaatttttagtcttttcttttcttttctttttctgcaatccaaatcgaattaaaaggaacaaaaatggatggaagcaaataagcaatgctcagcacaaatttcagaaaatggaaaaaaaaacactcacaaaaaagaatactttctcttacgtttttgtttttatatggcaatgtttggctatccttgtaagagacgagggtattttcgtcacttccgtttcttctctgtaataagtaattaatttattaataaccaatgcgtgcacctttttacccataagttaaagaataaaatctatcgttaataaaaaatggctaattggcttaagttgatcatgatttcttcctagttctagattttagttgatcatcataactttaatttgaagagaggtctatgttttttaaatggttcgttaatcagatgattatgaaagatgcaacatgtgacaattatttgattgcatgaaattttaagattaaaatgaaaatggcatgaaactctaattagagcttttggggaatcaaagtgggcaggaacatggggaatggttgatgacgacgataaagattgccatcccacagttttttttttaattatgtcccttcattttgctttcaaataaactaatcaaatttgttatgaattgaataatcatttttaaaatcattcatcaaccaagtggaagatgtttacaagtacacaaggcattacttgtgcatccaaattattattaccaactttcataagcttacttttcttctttacattaatcactttcttgccgtccaattattttatttgggtttttttacactctttagaaaacaaaaacatcatgttatgtcggttttatcctattagaaaacacatcgacaacatttaaccactaaattacatatatatatatatatataaaattacaactattgatcgtttttgtattattctttacaagtcaaatttccaccgttgaaattttgatttacaacattaatccagagtttaaaaattcggatcatctaattcatacataagtgaattaattaattaaaagcgtgacatcaaacgttagacacatgtggagatgagattgaataatgaatatcatccactaaccattataggttagagtcttgtagcctatgtaccaactatctcttttatactatttaagtttaactctcatcttgcaagaatccaagattaagcagccttactaaatcggggaaataaacttaggtttataatcagtgcaatcacatggccataattataaatgagcaaaacaattgtctgaaaaggccataaaatttgttgggcctacaatttgattaaaaaagacgaagcgccgcatatattttatcttaaagcccaataatgttttcggcccagtaggtgttctctgtactcctattctctgctataacttatcattgtctcccgcttcagaggaatcagacctaagaagaatcctcactcgtaaagtcgcaggtatggcttcgaagagctctcgatctattttgtggttggaaattaatagtccgtgtattaaagtttcaatttttatgtccttgaatttgatttcttccatatcagtgtcgaaacattaggcatcaccagagggaatatttaaggtttttctttaaaagctgaagacttgattagaaattagtccactttgattgaaatgttcatgtttgtttcagatg

SEQ ID NO: 22542 - DNA, 3003 bp, Unknown
  misc_feature (1)..( 3003): 2750-1469P.txt file - cDNA_ID_2105961; gDNA_ID_1620469; Annot_ID_157981
tatatgacccggtccaagccacgccaagtctcttttaatacacgaaaactcaaatatcaaaggtggaaacgcatgttatataaacttttttaattgatattatatcaaattattcgatattataaaaaaattacataaggagactttgtatgataaaccatatattccgcgtagcttctcagcaggaactaggaagcatcaccgacactgacacaccaccccattggatcgatgcttcaatttttatttccagtaatacatttacatgagtcatcaaggttgttttctcttccaaaatataaaaaagttcatcatatacaggttcatacattttagatgctttgggacaaatttaaaagatatattccttaatatcataatttttttatatacttcttcttttaacaaaaacattaggtgccttttgagtatatacaaaaaacaaattgtgtccatcttgtatagatttttttttttgtgccctataaatttatgtatatgtagttatgtaccctataagtttatattatcggcccctatagttaagccggcattgactatatatttttatggaaaatttaagagttttctttttgttttgttatttttctttttaattgtttcatcaagttaagtttcgtttccaattcctcttagaatgatttttatctcttgtgttaggtcacgctttactagtttacactcctctttagaatgatttatctcttgtatgagttttgtttttgtctttttgttaagaatttaaatattccactaaaatgaaaagtgttaggattttcatgaagtaaagcctgaagtttttggtcttatggcaaaaaaagaaaaaaacatgaaaacaaaagaaatcaatccattgacatcaacaaaacaaattacgtttttgagtcataaagtgatataacaattttgaataactaccaatatatatgtcctcaatcttgtgtgagttcaaggctttatgggttacatcgttatacttagtttatgtaagaaatttgtaaatttgaatgggttaaaacttctgatctaaataacgaattggtaggaaacttttttttgtcttgttaatatttgatggttttagccaaagtaatacataaaataattatttagtgaccaaaacttatcgcatatttgatgatttaagccatagtaatatgatttgtattagtgacgttgatggtttaatatatgatttagtgatacttagtgaacgaaagatacaaattaacatatggtttaccaaagtaacgcagcgtcactagtgaccaaaacttagcgtatatttgatagtttaagtcaaagtaatatactaatatgatttgtattagtgacgttgcattgtcactatccaagtttacacttatatgttattttttgttaaaaatatatatttatagttagaattctatattcgatagcattaccgaaagtcgaaaatttaatcataggaatcattgccaatcgaaataatgctaattaaattttatttcatataaaaatttgatgaataaactattcaacgactatccttaaagagtttttttttttttaatagtcagctaacgcatttcaccgattgtatttgtagccttgtaggtagagtcgaatttccgacgcgactagaatgctagcataagagacttcaccactttgttacgaagccaagaatcttcttgttttaaaaaaaaaaatcaagacaaaattgtcgtccctcatatctatattcaattcatttcaaaacgttatttatgtcttaaaatttggaactaggccacaaagaatgactttggtcatcacaaaattataaatttaataaaaatttggaccactataggcatagctattgcctattataatctctactattactttatgatttatctactattccgaaagtgtaattgtttaatacgtcatcacattgcagcaatccacacacaagccacgtcattcatatgccgttcgtatttgctttcgtcacttccttccgtcatcaatagtgacggctatttcttaatattaatcttcttgacttaatgctatttcgtgacggcattaattggcatatcattacaagttatttacacctaagaaacaaattaaaactattgaataatatgatgtaaataaaaatatattaatgatgtgatatatcgcagtcaaataaaaatagtgattttgatgagaaaaaaaatatgtgtttatccatagatttgttaaattagagaaagatgtggaaaatgttagtgagtggcgtcatacacggagaacctttggcatcatacacggatttttctagtctttgttttctatttgtcaactttcatttgagtctttctttatacactttattagaccatgtttttaattctaatgcttattaattcatattattaaatttacaaaaaaaactattatattaactctcttgtttcctctgtatcttccttcacattgaagctgtctctttctttcaccatcacttgcacctgttgtgtcctgtttgttctcaatttcatcatcatttatcctttatatacctctctttctttcttgacttttcctctaaattctcttcctttttatctctttgatacatctcaatttggttcttttgccttctctttgatcttatctcttacgattgtgcagatctcaatctctatatccttggttgtgtcagattctcttagggtttattttctctcccaattttgtttgattccttgtccaaagtttcttcctttccttttgacttttttttgtggtacattgaatcagaggtgtaagagtaatagtttcataactcaaatccccaagtgtacaaattttcctcttttggttctgggtttggttgattccttgttagaaatgtaaatttagggcttttgtatctgaaaccgatcttcagacttgtgtaatcttcttgatcttcatgcaagattgataattctacaagaagaagaagaagagaaaatg

SEQ ID NO: 22543 - DNA, 3003 bp, Unknown
  misc_feature (1)..( 3003): 2750-1469P.txt file - cDNA_ID_2105965; gDNA_ID_2926145; Annot_ID_197706
aataaatatcataaatcttaatgattttgggttttacaacccttacttcataatcgagtttaaatagtccatagtatttgatctgcaagatttagtacatttgacattatcgaaaaacacatttcaacagaattttgaatttattcaagcttcaaaccatatcctccacaaaatgtgataaaatttgtcaaaattttttatataggatttgtttttataacaaattgtgaataataataaaagaagtcaccccatttctgtctttcaacttaaggtgactcaccacctacttaccacattgatattgtcatcttcgaagaatccaaactattttttcttctaatccaaaccttttcttattgttagtaaacaattcaagatcgttctaaactcaagagaatccgaggttccaattattgaaacgttacgttaaaacgtaaaataatactccaaaaaaatccatttttaaaacgaataatgaaaagagatgcttcgatcgtagagtcaaaaagttaaataaatataagaatttacaagacgaatggaaaacacaaccgcgtgttagtcactaatcataatgataagtgaaagtttaggtcacattaattaattttaaaatttgattaatctttgaaaccttttaattcacgtggttagggcaggctttggcaacaacgcgtagttggtgttgggtcggtggtcgacgacctagccaaatccatggctcatatttttatctccatttgtttccatagttgttttaatgatacgtgtacgtatcacttatcagatgaaaataattaattacctcgactttcctaatcatatctacgtttccacaataacagtcttcaaacaaatccattagagtatgcaatttaggagtgtcaaaataagtcaacattcatggattactcgaactcgtcaataatgttaattggtttaagtaaaaatattttacccatatatataaaggagttttaatagattaaaactaataggattataagtttaatgggcaaaacttattagagtcatgggttatccataggttttactgtttcaaaattatatttcagtattgattctcgtgttcttaacaaacagcggagtcgactttttcctaagcatgttcaagctttactttgtactagatctcccaaacccatccattaaacactcgaatctatatgaatttaggtcgggttgggtcagattggtttacccattttgacatttttaatatgcatgtaagaaaaggtttggagcaagttgggtggttacggctatcaagtagtttactgaaattccaaattatttactttatcacttacttcagtagattttttcgtttaacaacttaccaatagcagaataattgacatagtattgataattgtaggtgtaagatatagacaaaaatatgttggcaggtttatcaacaacaaaaattcaatttcacattgtaattttttttttaatgcaaaactttttgccaacaaaaattatgcccaaaagaaggaaaaaaattatacatagtgtacatttcttgtcgggaaaaatgtcatttaatctcccaacttttaaaaaatggtcattttatatatcaacttcgtatgtggccgtttaaaacatgaactaaacgttgactaatttttaaaacatgatctttcgttgaccaggccaaaatagacatgccgttatcagtcattaacggaatttctaacgtccgttatcatccgttaactttattagtcaagtttcaaattgtggtcattttaaacatcaactttttatgtggccatttaaaacatgaactaaacgttgactaccatttaagacatgaaaaatttgttgaccaagccaaaatagacatgtctttatcagtagaacctagaaaccgttaatgactgttaatctgtccaaaacaacgtcgtttgagaataatcgaaagaacataaagatttttcccatataaaatctccatatcaaaaagttttaagcagaacccatagtttgatatagagataatcacagtgccagtaattggaagcaaataaaagtgttttcgtttatatatttgttttaaattttaaaaggaatcatggaagcaaattgaagactcattataagattgttcgtcttgtttgagcggttgtagaaatagatttggggaactggagtttcatttagaaaacaatcctgattttcttttggttattctcaaaacaaagtcgttttagggatactaatagagtcgttaacaagtgataatgaatgttataagttcttttaatgaatgatgacaacatgtttattttggcttggtcatcgaatttctcatgttttaaatggtagtcaacgcttagttcatgtttaaaatggccacatataaagtcgatgtttaaaatgaccacaatttaaaacttgactaataaagtcgttaacggatgataacgaacgttaaaagttccgttaatgactgatagcggcatgtctattttggcctggtcaacgaataatcatgttttaaaatttaatcaacgtttagttcatgttttaaacggccgcatacgaagttgatgtataaaatggccatttttaaaaagttgagggattaattgacattttttccatttcttggctccttttctctaacgtacatttatcagttcatcatccaaaaattcaaaattttcgaacacatgtttggatatgaaacaaaattcgatttgtctttatgttgctttcatatagaaaagtgcaaaactttgttagagctcatgtaacttcttaattttaaaaaacaaaacaaatcagatccaaagtgtaataaagagaaactctagggacttctttataaataaaacaaaaaacatttacacgtcttcgtgtaatttcgaagaaacatcgattctcttctcttatataaaccctcttcgtctcctcctcctctctgctcgaaacaagatccttcacttctctcaaactacgaaaactatg

SEQ ID NO: 22544 - DNA, 3003 bp, Unknown
  misc_feature (1)..( 3003): 2750-1469P.txt file - cDNA_ID_2105982; gDNA_ID_2926132; Annot_ID_196993
cgtgatcgattcctctctgctggaaatagaatagctgatcttctccaatcttagaggtactcgcttcgtgctctactttcgccgatggattctttacctgttattgttccagaccaaccacaaaacaaaagtggaaatcaatcacaaaagagcaaaaaactttacagctttctcatagcttataataaagattggatcattggcaatttacctggatgtaaggataggtatttgcagctgctttgtctccgataagcattgagtcgcaagtcgaagtatttttagcaccctcagctttggactgcacctgaacaagaccacggtaacaatttctcgaatgcccggccgaaattccctttgaaatgattctacttttggtattctttcctttgtgaatcatcttagtccctgtatcagcttgctgatagttattagtcaatgccacggagtaaaactcgccaacagaatcatcgccttctaaaaccacgctcgggtacttccaagttatcgcagaccctgtctcaacctgagtccacgagatcttggaacgatccccagcgcaaagaccacgctttgtgacaaaattataaatcccacctttaccttgttcatccccagcataccaattctgcaccgtggagtacttaatctcagctcctttcccacaatagagctcaaccacagcagcatgaagctgattcgtatcataagaaggagcagtacatccttctaaatactcaacaaaactcccttcctcagcaacaatcaaagtcctctcgaactgaccagtctccatcgcgttaatccggaaataagtcgaaataggcatcggacatctagtgttcttcggtatataacagaaagacccatcgctgaaaaccgcagagttcaaagcagcgtagtaattatcatcactaggcacaactctacctaaatacttcttaatcaaatccggatactccctaatagcttcagatatcgaacagaagataacaccagacttctctaaagtcttcctatgagtagtagcaatcgaaacactatcgataaccgcatcaaccgcgacattagccaaacgtttctgctctgttaaaggaacacctaacttatcgaaatactcaagaagctgaggatcaacttcatctaaactattcaaagttggtttctttttaggagcagagtaataacacatatcctggaaattaatcgaaggatatctattatctgaccatttaggttcttctagtttcagaaacttagcataagctttgaacctaaactcaagcatccaatctggttcctctttcaatttcgaaatcaaacgaatcgtctcttcagataaacctttagggattgtgaaggaatcgatatcttcaacgaatccgtacttcttatcgtaatcgagattttggaaatactgttgaagtttatcagttgagctaacggttgatgtacctgatgatgatgattcagaagctccgatgggacgagaatcgattccaacatcggctctgagtttgaagatcggtctcgttggatttagggatttgggagatgggaattttaaggattcgggttttgggtgaaacccttttggtgattttgaggaatcggaagtgggttgtggagagaagctggagataccgtttgcgagaagagacgccattgttgttggtgtggctcttaggagaagtaaaagaagattgtttttttttttttttttggagtcgtgtgttagaaaaaaaacaacgattaggaaaaaaatgaagaagagatgaaatgttaatatttatggaattttctgagccgtagattgaagatagtctcgtgtcagccacgagacgatttttttgttggattttcacttttcagctcaattataaaccacatacgttttccactaactaattataaaaaaaaaataacgttgatctcttctttatttgttaaaaatctcttttagatattagatattttttatacttggacaaaacaaacaaagatattagatattttataatccgatttacgggttggtttcttgtttttgttaatgaaaaaaaaaattagtttgatcttttatttcaaaaacttaataatattttattttaaaatttgttggttcattcatttcagtttagtttggtacactgaaatcagttttaattctttttttttctcatctgaattatattagaaactaaagtagaatacaagttgaaatacataagccaacagaccaacggaatattttgagaaacttagctgaaaaaaaggaagtaaaaccaaaaacatatataaggaaacattttaaaccaacgaaattgaatcaagagacaaaattcaaaagaaaataaaaaactatgggaaaaataagacctaaacttctcctaaaaaatgtgaacgccggaaacaccaataagatcggatagattttacaccgaagtcaaaactaatagtaaatcgacagagaggaaagcaagaagccgctgaaaccagagacataagtacaaacaccatcacacctcacccaccagaccgagatagcaaaatgtactagggacaaggcataaaccttgaagatctactagagataattaaagcactagacacaatcagtatcgattctacttgggttagctgattttcgagccataaactatttcgattctcagctttcacccccggacttttgggcccttaaatttccaccatcaactttcatattcccaaaattacatcatctactttcggattcatgcttaaacatacatttccaattgaaccattcatttaaccgggattaaccacaaatccgcgtttactgtaccgcgattgcgattaacccgactaatacccagacccgttaagaaaacgacgtcgttttcatttcgtttaactcatcaaaaagagaaagaaaacgacgtcgttttcattcttcttcttctgcaaaatcgatttggtcgattagggttcttcattcgacaattttataagaaaatg

SEQ ID NO: 22545 - DNA, 3003 bp, Unknown; identical to SEQ ID NO: 22544
  misc_feature (1)..( 3003): 2750-1469P.txt file - cDNA_ID_2105982; gDNA_ID_2926132; Annot_ID_138792

SEQ ID NO: 22546 - DNA, 3003 bp, Unknown; identical to SEQ ID NO: 22544
  misc_feature (1)..( 3003): 2750-1469P.txt file - cDNA_ID_2105982; gDNA_ID_1621196; Annot_ID_174740

SEQ ID NO: 22547 - DNA, 3000 bp, Unknown; identical to SEQ ID NO: 925
  misc_feature (1)..( 3000): 2750-1469P.txt file - cDNA_ID_2105990; gDNA_ID_1620338; Annot_ID_153855

SEQ ID NO: 22548 - DNA, 3000 bp, Unknown
  misc_feature (1)..( 3000): 2750-1469P.txt file - cDNA_ID_2106002; gDNA_ID_2926239; Annot_ID_142841
tcctaaagaacatgaaaacattcgacaatattgaaagggtttgatgttatttgacatacagaggattaaagccacatcacatggacaacacgagactgtctgaaccgaacaagagatcttgactatataatttaaccaatgattttttgttttaattattacttctcgttatcttgtttttttttttttttctgggtggggtggtggagtccattttgatttcggtgacaataacaatttcacgattgagaatatcaaatattataaatgcttttatattagtattttgggaggttacttaagcctgtttgttttcataattcccttttctttgcttttgtctccctctttttctgttattatatacttcatgtttgtttccaaagtaaaaatataattggctgcagcttctattcccaaccatgtaaccatatgggaccttctttgtttcctcgtatattcaactatttctttatacaattctgattttaaaagtatttggttgatcagataagttgcttagtaccagtgatccttacttgctaattacctacacaactttgattactagtatatatatcataatcgctaacctaaccctatatatattttgggaattttggattttgaattaacaaagaaatagcttagcaataacaatatgttaacaactattttgcattttcagaaacattttgaatttcttagtatgctctactcaaaatttccagcttaatattcctggatcaaaattctttataaaaaaaaatatataaaaaaaaaactgaaatgtgaagttgttaaaaaaaataaaaataaaaaagatactgtaatttgaaacattcacgaatccatctgctattgtactttaacccggaacgcaaacagtaggttataattaactaattaatatattcgtccgcacaattaatcagacacctaaaccgaatataatgtccggtacaaagtacaatccatgattaattattgattatggactcgcgcagaacacgcaaagatgaattataaactcaaaacataaagaagccaacgacagaaaatattaatttgcagctttgattgccaaacaaaaattaggattatacttggttggatcgcacatgttaccgtcgcttgcgtaggctccactgtcacatgcatacacggcagaccatacccaatttcctcaaaactttagacttagccagagagagagaccttcgaatgttttgcttgcaatgtacgcttatttaacgtatgaaaagttctacaaaataaaagatgtacgcagctctttgactctagggttttgtgaagcatcatgacatattctcatcaacggaagcattcgagcacattattgagaatgtttgaaatgtttctcttgttagtgttaccataccgccctcgaacacaccctcgacccctatcacttgacactatacccttgtcacagccacaaatgttcttgagaatgtcatttgacacttacaacttttacaatcgttgtggccggcctttgatcatgtcgataattatcacactcatcattatccatgttcatgctatgcatttctagccaactcattcacacaatttatagcatgatcactcgcaaataatcaacttttttcatacacattacatgtaaaataattttagagcatagttgctttaatcccgcatccaagaatttattttagacctacaaatggccgcacgcccgcacctatagaaagaattcacatttcgtgggtttcgtgaaaagcccatataagggcccatataaatagatcagcccaaaggtatttccaaaaattcatattagccccataaaataaatttaagaacacagaaataaagtaataaaccatcaggatcaggcaggatgatttcaattttcaaatgtataagttgattggtcttttgaagaatactaaacattgtcggcactatttatcaatgatcataccaagcaaagcagtccatatattcccaaaacaggaattcattaatatgaagaatatgtcaacgaaaaatgtctatatcttgcttgggagagcgtttttgaggacatcgctaccaataaagaaacatagatgagtacctcgatgttttctagtttgtatcatgaaggcagcccaaaattcgataaaagaaattcaaccacgacaatgatggcaaaaattaagtcattagttgatcatttttcttcttcttgatagtagaagtcttgaggtttctttttctttttacatatacatatgataaaaatttaatcctatcatcaaacgtgcaatttcatggcaatcacatgtcgatcctaatccaacggttaaacaactcatttacaattaaattcactgccagaaatgtcaggtaatactaacgaaagacatctgatataatgagatccttgtgctacttgtttattagcggatcatgattcaacttacaaaacatatcaatatataagatattttttggccatcaatttgttggatccaaacacctcagagtttttaataaaatttaaatgatatttataaaactaaataaaatatatagagataaaagtttaagcaattactagcttctgtaagacaaaaatgatacgttaaatgaatttattaaattttatacaagtttgtacgtaattggattcgttgcttagtacgggttctaaagaaacaattatgaattaattcattagaagatctcattatcgttatgtcggtctaagaaagatttttttgaaataattattataaagaaacaaaaatctaaatactttagcttggtaccgtacgatttaaaaatggacggttgagatgaaaacaaatgggtcataatggatcctgcatcagaagaagcatcaacgaaacttccaaatcctttatataacttctcacaagtcaccaccatttctctctagaaaatatcagaaaaacaaaaccatctcaaagtttcttgagaagaaaaaaagggtcaagaaagatg

SEQ ID NO: 22549 - DNA, 3000 bp, Unknown; identical to SEQ ID NO: 22548
  misc_feature (1)..( 3000): 2750-1469P.txt file - cDNA_ID_2106002; gDNA_ID_2926239; Annot_ID_204012

SEQ ID NO: 22550 - DNA, 3000 bp, Unknown; identical to SEQ ID NO: 2181
  misc_feature (1)..( 3000): 2750-1469P.txt file - cDNA_ID_2106006; gDNA_ID_1620499; Annot_ID_158794

SEQ ID NO: 22551 - DNA, 3000 bp, Unknown; identical to SEQ ID NO: 1672
  misc_feature (1)..( 3000): 2750-1469P.txt file - cDNA_ID_2106017; gDNA_ID_1620434; Annot_ID_156928

SEQ ID NO: 22552 - DNA, 3003 bp, Unknown
  misc_feature (1)..( 3003): 2750-1469P.txt file - cDNA_ID_2106021; gDNA_ID_1620307; Annot_ID_152846
cagatccggagtctgaatctgaatctgaaatgggttgctcttgtgacggaggctgtggtggtgatttccaccggaactcggtggtggcggttccggccatattagtcattcttcttcttcatctccttcttaaggacaaagtccagaaatttgggggggaataagaagaagaagaagacacgtgatgctctcgtgagcattgtaatgaccaaattaccggtttaatttggatttaccggcttagttaagacagtttctagcttatccccaaggacttctcgcgttatcttctcgaagttgataagcacgatcacttatctatgattatcctcttttccttttttgcaagagaattaagtcatttaacatttccttaaaatcattccgatttaaaacagattatctaactcgaaaatacagctactcagttttgaacaccctaaatcatccaaagatctcatatacaaaaggatctctaaactcaaatcaaagtcacagcccaaagcataagaaacttgtggtagattcaatctatgaaggcatgttggagctcatggcttgatgtattctcgaatgaagtcttcaatctggatggtttctccggtaagtccagatgcctcagcgacagtgactttgttggagcaatgcgtgaaggagaacacttctccctcaattccaatggtgaagtcattcgctatatcagcagtagagactgcactccttgaagccctcagtttctcactgcaaaaactcatcaaccaatgatgattagcttttatgcaggaagataggctttatatataagaaaattttgtcaagaaaactgaaattcttacatttctttctccatttgcttccggataaactccttggtgtgtgcagtgagtttatcggtcttgttacagcaaaggaggactggaatcttcttcttgacaacattcgcattggtcagaatctcgtataggtacctatcaccataaaaaaccatggcaatgcctcattttcaacattgagatgcaaacatatgcaaacatgtctcttatctgtgtcttacaatgcgtgtgtgtggaagagagagggtgtttgaaattactctgaagctgcacgacagtttgggaggaactccaaggcatccactacgaacacaatggcagctgcttggggcaagaattcttctagcttgggtcgaagccgagagtgcccaggaacatcaacaagatgaacaggcttgatttttcctttctgtcacaaagagcaagcacgggacatggtttagtaatatgttattccatccatcacaatcaactgcacgtgttgtttacaacagaacacagtaagattctttaccttagtattttcactgtgaagaacaaaagtgccttcatttggttccattgatgttacagtgccctgatgcgacgatccatctcggagctgccaatcaaacaattatcgtgttataactctccaacaatgacctagtcactcacactgactcacaatagtgacacattacaaaaaaaaagtacatttgaaggaaagtcataaacaatattcatatgaaaaaggtaacgtcaagccaaaacactcacttggtaaaagagcacagtctttccacttccggtcagcccagaaaggagtacagtgttggatttggtacgtctgaccaggcgaactgcataccccagcaagaacaacaagtttagcaacaaaagatcaaaagtttgtttatgtataatcaaagaaaaatcatgaataaacctcagaaattgcaataatagttctaattccaatacacaaaatactctggcttaatcacaagtctaaaatggtaccatgagaactataacctctgcagttgtaaacaatagcaggcagaagaaaagtaattgaagacatttagaagaagaacaggctatatgtccttatcaatggcaaacaagatactaccagggggagatcttacataaataaagcaattctactaggaaaggattaagaaacaacaaagtggtgtctaatacatactggataggaagagcaagatggttgtaaacaacaaaacaccaatggcggcatacagctgattcggtggtatcttctgaagatattcaattccttgatgcgaccactgctcagccagaattttcagatcttccaagttctccattactctctcaagtttcacttcttctgccaagctgttcaaaacctgcatccagagatgtaattcattcctcttaagacataaaaataacctagagttaactagaaaactctcttctcctacacaaacaacatgcatgggaataatttaaaactgcttcctgaaaacaaaaattgaaatcggaactctctaatatttgcaaacattatatcaatactggttctcacattatcatgttcatccttgtgataaacccagtacagtgacaataatcatcttgtgaacaaggaacacaatttgtttatcccaatttaaaaccagttttaccagatcaatacaacccgtagacccatacacgatcatcccaagttatgaaaagataaatgctaatcctacattgatgcgctgtttcaacgagatgtaaaaaaatacaaacagattcctctaaaattccagataatgaatatagacaaacaagagctaaaatttacccaagagtaaatgaatccatttggtggaagagatagaaacgcaccgatgggagaggaggcggaagacgaatacaacgacggtggaagcggagaagaacacggcgacgatgatttagggttcagatttaattttatatattaaaaccagttagtgcttcttcatttcaatttgtttcgaagatagttaatgggccgaataaaagcccattaaacgtcaatacgaagtcgtttcaactgtatctgcttcatcgcttcttttctcccttctcttcccgccgtgaatctggtgtctgtgtctgcatctccttccgacgaaaacagatacactcgagtgaagaaagtatg

SEQ ID NO: 22553 - DNA, 3003 bp, Unknown
  misc_feature (1)..( 3003): 2750-1469P.txt file - cDNA_ID_2106027; gDNA_ID_1620475; Annot_ID_158138
ctacaccgtcatgaagagagcctttgatgaaggttggggggccgtcatcgccaaaaccgtaagctcttgagatttgactttttcaattttagagtagatgatgattgagtctgttttgcgttgactatgttggaacataggatttggttgtgtttgtgtatgatgatgatgatattgagtttcgtctgaatctgtgattggatgatttaggtatctttagatgcatccaaagttatcaacgtgacacctagatatgctcggctacgaaccggatccaatggctcagccaaaacagatgtaattgggtggcagaacatagaactcatcagtgacagacctcttgaaaccatgctcaaagagtttgagcggttgaaaaaagagtatcctgatcggattctgattgcttcagtcatggaggaatataacaaaactgcttgggaagagcttatcgaccgtgttgagcaaactggtgttgtgagttttccctaaaacacagattcttattcttccttgtggttagattctctttcactttgtctgatattagtatacattgttgaagagacagttctggatgattgttgtgtaggatgctttagaaatcaacttctcgtgtcctcatggtatgccagagcgcagaatgggtgccgctgttggacaagattgtgcgcttctcgacgaggtttgcggatggattaatgctaaagctacagttcctgtatgggctaagatgactcctaatattactgacataactgaggtgtgacatctaattctctcagcctttttgcttcctggtttttcaaccattttgtataaagcctatccttgtagaaaatgaaaaaaaaactttgatgcaagtttattgaaaagctccctacttaaagctgagttattgttactctgttttgctctgctttgaccatgtccgttttgctttttcttttgaatagcctgctagggtgtcactaaaatccggatgtgaaggaattgcagcgatcaatacaatcatgagtgtaatgggaattgatatgaagacgttgcgtcctgagccatgcgttgaagggttagctagatagcacttttataatgtcaaacgttttggcaaatcttgtaatggcattacaagaatagctaacgttgatagtgttttgcagttactccactccagggggatactcttataaggccgttcgcccaattgcactggcaaaagttatgaacattgccaaaatgatgaaatctgagtttagtgaggatcgctcgctttcgggtattggaggagttgaaactggctatgatgccgctgaattcattctccttggatcaaatactgtacaggtaactaaactcaacactatcctcactcttttgttttagactttatgccttgagagaaacttagttttactgctttttgttggaaggtatgcaccggtgtgatgatgcacggctatggtcatgtgaaaaccctttgcgctgagctgaaagatttcatgaaacaacacaacttctctacaatagaagagttcagagggtatgaacaactttccttttagacttttatatcattcttttcgcttgcttggttgcttgctgagcaagttcttcgtgttgtttgttggcttaggcattcgctgcagtactttacaacacacacagatttagttaagagacagaaagaagcagttgagcagagaaaagctgagaagagaggcttgaaatctgataaagattggaccggggatgggttcgtgaaggagactgagagtatggtttctaactaagttagtagcctgatgaagttatgaccacccaaatatttcaataaaggttcagcaacttcattcacaactcacatgcaaattacgaaggctctttctttcaaatgtttaaaatcaacttcttaaatctcacttgaaaagaaataactaaattttatgtttcttaattttcttctcgttgtgtattattcatcttgtatccatccatagcaaccatttctttgttacttcaagttggcttaaattttggccaataataataccatagaccttctccatgaagcaagatgttgcggtagtaaccttttattaaggtgtgatttggctaaagaaacttggtcttatatcattaaaattagatattgaacaaaatcaagtatgagctgatagaaccaagattagtaggaagctaatcaaacaactctggatacatttactaggaaaatatggtcatgcttatttttatacgcatcatttgaatccgaagaggggaaaaaggcaacaaaacgggcttaatgagaaattgactatggaagaaatatcaaaaagccaaaagtggccacgactttctgcatcgcaatgatacctatattagaagctacttaaaaattttaacacaaaaaagaaaaacatttagtttcctcctaccttacctacctacgtttacgtgatcatcaacaattctatttttactaatttactcattaatatatcttctaaagtatacataaacaaacaaactgtacgaagaaattgaaatataaatatcaaggaaattggtagcagttgttgagttatttcaatgatgctgtgaagtggaaacatttattacgtaacgcatatccgttttgtatataaactcttatttttcggctgtatatataatctttttagagattttccgtgagaaatagattaaatattgttgccataataacctgtaatctcaggagaatcctaacggaaaagagaatattagacgatagtattatatggagtattaattacttattaacaattctaggagataatatcagcacacaacaataaaagaaattactaatttactggaatcatgtattcaccgtaattatttaaggagaggaaaaaaaaaatacaagctctttctctataaacacacactctcaggagagaagttgtattgatcgtcttctctttccctaaacacactgattattttctctccgacgccgccatg

SEQ ID NO: 22554 - DNA, 3000 bp, Unknown; identical to SEQ ID NO: 6663
  misc_feature (1)..( 3000): 2750-1469P.txt file - cDNA_ID_2106051; gDNA_ID_1621100; Annot_ID_171353

SEQ ID NO: 22555 - DNA, 3000 bp, Unknown; identical to SEQ ID NO: 6663
  misc_feature (1)..( 3000): 2750-1469P.txt file - cDNA_ID_2106051; gDNA_ID_2926168; Annot_ID_199273

SEQ ID NO: 22556 - DNA, 3000 bp, Unknown
  misc_feature (1)..( 3000): 2750-1469P.txt file - cDNA_ID_2106055; gDNA_ID_2926252; Annot_ID_204399
ttttgaagtcaaatcccgagcttttgttcagttctgggtcatcaccgcggttttggatgaatcaaccagttcctggttcgagtatttacgatcgagtcaatggctctatgagcgaggccctgaagtctgttgttgtcaaggaaagtgaaagactctatggagaagaattagcagtaactgttcttgttactggtaatgtggagaaattgaataggttagatgttgggaacaattgggattttctagatgtgtggttgcatataggtgcatactcgcctttaggcccgttaggtgttggagaaaatgccgcgagtttggctttggttggtcgtggacgagatgtagctgctgctaaatactcagactgggttaggtattgtgcttgttgtgctcatttagctgattcttgaggatactgatagctcaatttttcagggatttagcttgtggattacttgagttttgttgtttctttcttaatctcggtatggtttatgatttaggcaggcttaggaagcctctggagaagtttagacctcctttgaccactgaacttcttttgtcaaacgatggtgatcatttgcttgagggctgcatcacaaactttttcgtagtttgccgcagggtactaacaaaaatttgatttttttttgttcaagcacaagtcacctatgttgtgattaggatgtttattgtcttcatttatgttgcattttagaagtttgaatttcattttaccactgcatgatttactgtttgatctcattttaggtgaagtcatcagagaatctctacggcgggagtttgagcgagtttgaggtgcagaccgcgcctataactgatggtgtgctagcaggagttataagagaccttgtcatcgagtaatatgttagaccattaagaatgttgattatattcgtctgtgtttatggcctgatcaaccaataagatttgcttttctgtcagagtgtgtttaagcgaggggattccataccgcgagagagcaccttcgtggtctgagcgtgagctttgggaagaagccttcattacaagtagatctttccatatccataatctgttttttcatcttctcgcatatatattggcctgaacactttcaatgtgttgtgtgatgtttgtatattttaacatcccaagaactcactgggttcaggtagtctgaggattttgcagcatgtagggacgatcaaagtacccgttggttcaatggagggattggcttgtaacaaacctgaggagattcaatggaaggagaaaaggtttaaggaaagacctgggatgatcactgaattaatcaaggtaaagcttgttacttttattacccttagaatcattggttttgttcttgtcttttgagtcaaatcaaagatagaaatcactttaaagtttttgtttgtcactgttatgttggagtagaaagcgataatggagagaggtattaaagaagggttcccgttgaaggccttttagtgctcttcatgattttgccaaatagctgaaatgttgattcgtctatggtttgtaattgtattgacgccaatatcttcccaaatcatcactcattataattttaacgatctgatgtttaaaaggttctcagttatatatatctgtataattgatcagtagaacatattatttaacggattttatggagatactccggtaacttattaaacagatctcatgaaagtaatcagtgtcaagaaatgtcaagactgtatacatatgttaatatgctaaaccacaacgactatcacttcccaaaacatggttatgatgttgatatgaccctccaaatccacaagtgtgtatgtgtatcaacgtcaaagtattgaatataaagagttgtgagtactaaaaataaaagcaaactaaaaatatagtccgtatggaatgcctttaaaactgcttgtagtggaggaaaatagaaatttggaggacaccaaattttccccctttttttttcttttttttttctagtaaatcaaattaattaatatcataaaaaagattagatgatatataagcatcttttttttttccgtaaatcaaattaattgatattataaaaaagataatggggtgattgacatcgcattgtcaagactttaaaactatttaacaaatgataaatcacattaattgacaccatgtatgttttggatatgtttgataaaaatagtttactagtgaaaaaaaaaatatgatccacacccgagggagtagatttaatttttttttttcttcagaaaatcagctatacattaattatgtattctgacttaataattggtcgggtttgcaaatcttttatttttttggtaaacatgtgaagaaaaaaatagaaggtttgtaaatctttcaatattgtttgtacattttccataaatctttcaatattgtttgtgcttcatcaacatatagtcaacacaaacaatgctacgctcttatgaggttctgcaatatgagtagcttggacgaggtttctgatcaatagatctgttataatattataaaacatatcgattctaacagattttcaatggatatataatccgataactttttagacacatctgatgagtgatcactgtaaaaaaaaatacaaaaaaatcaaaaccatgtgtatatatgctaaactacaaatataaaattaccacacttgtacaatatataataaaaataaacatcataatactaataattacgacactattggtcttggtttggtttatatgcacgactccggctttaaacaataaatccaggagcatgacacttccacgtccttggctagatctaagtttaagtcaacgatgactcatagtggacacgtgtcactcgttcattcgagttatccacgtgacttcttattacagtcttcttgactctttttttttttttttttttttgctgaaaattataaaaacccaaaatccaacaaactttgattacacacacttacatacaacaatg

SEQ ID NO: 22557 - DNA, 3003 bp, Unknown
  misc_feature (1)..( 3003): 2750-1469P.txt file - cDNA_ID_2106101; gDNA_ID_2926145; Annot_ID_197697
agtaccgccggtcaagtcagcgggcagacatttcgaaacataacttatcccgccaaacaatttcgccatccaactcaagggtacgctcatcatttcccggccttataagtacctactctcacaagcccaccgaaatgtgtcttaccattagtttttgggctgaattgtaccctcccgtacaaaagcccctataattcaagctttttgaggactttgtgatatgttttctcctgtcacaatatttaaaatataagcaaaaatacattaaaataaaataataagcttactaaaaaaagattaaataacatgattcagaaacacttccataaatttagttatagatgaaactactgcgtgatatttttaagaaaataaatgcctccataaaattactaaaaacatactctaaatactttatttcatgtatcaaaggaaaataattagaacaatataactctacaattgttttcttcccatatgttaggtttaaacatttgtgatatacatgaatgtctagcaaatcattagacgtaaagtgtaaacactagtaaatcaatatttataaaatataagaatctactaaaataaataccataattttatgataaaacggattcgagttctactctgtattgtaaaattatcacatctaggctccgaatgatgacgtgcgattcaactacggataaagtgcggtgtggttttaatagtaacaaaaatatatacatatacatacatggctggtcccgactattcggagaccaaagcaacaagttatatattttgggattattataaaatattttaaattttggaggcctttttcttagaactgaatatttttggaggcctatttgcaaataagttttggtgtaaatttttgaaagaaaaatggggtcatattcaaatgtttcatgtggctcccttaaagactagtcttgtatgtatatatgtagatatttttgttactattagaagtatacgatactgtgtggtctgttctctattcggaaccctagtctgaccctttgttcaaaaaatcggccgcctagccgggcgcctaggcgctaatcagatgggatccacgacaatttttttcaaatcgagaagattaatcgttgatccgatttttatccgtatagacccgcctaaatccgtctagagggcgcctatcccaaattttttttttctaaaaagaaaatttaaaatttaaaatatccaacttatgttcgtaatttgtatgaaaaatcatatatttgaacctacaatcttattttcatatgtttaatataattttaaaaacaatattatataaatttcttaattataatgaattaatatgttttaaaaatattaaacaaccctaaaactaatccctgattaatttttgtataatctctgatttttttgttaggcgctaggtccactcttactgcccgactagcgcctaacgattttttgaacaaaagtttgaccagataatataaaatgatgaaatctagcttgacgagataataataaacttttcgcatggatctgcatttttttgagtaaaatagaaaagtggaaaaatgaaaaaataaaataataatatattaactgtttttattatataaattttacttttacgcaaaattatatattaaacgtcacataattaaaatcccttaaatctttatcctactgtatgttctgaatcgggcttttgtattttgattcgtgaaaagtctttcacttcaccggaccgaagatgattcgtgaaaagtccacatttcacatttctcaattcacacttgtgctttcgaaatgggcttttaactttggtcctaaagactttctctcatctatatgtctctgaattctaggacacagtcaacaagtcaacgtcggtaagagatcccacaacaacatctacacagacacgtgtacactatctctcactttttcaccgacacgtgtcggttctttcacctacaagtaaaactctctccattatcttcaataatgtcaaaaatgtcacacacacacttagtcatagtaatacccaatttccacggcacctatttgccatcgaacaaacaataaaaaactttattagttttcacaattaatacttttaactctttcccgagagtcgtaagaagagaaaaaacaaaacttttttctttttcgttgaagaatttttacataaaagttttgtagattctctgatcagaattgtgtaaaaggtattctctttttttttacttgttgaagaattaaagtaagtaaataattgatttcttattggagggacccttttgttgtcatagaatttactctgctgcgtttttttttactgttgttgctttgttcttgttgtttggttgtatattgttgatgctctctctctctcgttaggtgaagtagatctctcttttctctttctctttctcctctctctctctttccttactcagcttttgtggtgaatattgaagaaagtttctctggtgaataagagtttgttcttatttttatgaatttgttctgttttcttgttgatagtttttgggtttgataaagttgtttcctttttacttcttttagtatctatctttccaattctagtaacttcactggttcttgagctctttcaactttttgtttcagatctctctgtgtttttttctgatctttctccagtggtagcttctgagttagtgattgtactttacttccatacttcttgttcttgctcatagattttagctgtggttttgtggagttttagctctcagtgattgttttagttttagttccttaaacatgttttgttcatatgggtttgttagatctttgagttttcttcatttctttattatctctcttggatcttgatacaaaagtatgaatctttagattgcttcaagaaaaaaagttttaaagactttaagagattcttagatacatagaatttgaagatcttgtattggtttttgtgaaacagatatttgttagatg

SEQ ID NO: 22558 - DNA, 3003 bp, Unknown; identical to SEQ ID NO: 22557
  misc_feature (1)..( 3003): 2750-1469P.txt file - cDNA_ID_2106101; gDNA_ID_1621187; Annot_ID_57451

SEQ ID NO: 22559 - DNA, 3003 bp, Unknown; identical to SEQ ID NO: 22557
  misc_feature (1)..( 3003): 2750-1469P.txt file - cDNA_ID_2106101; gDNA_ID_2926145; Annot_ID_139080

SEQ ID NO: 22560 - DNA, 3003 bp, Unknown; identical to SEQ ID NO: 22557
  misc_feature (1)..( 3003): 2750-1469P.txt file - cDNA_ID_2106101; gDNA_ID_1621187; Annot_ID_174502

SEQ ID NO: 22561 - DNA, 3003 bp, Unknown; identical to SEQ ID NO: 22557
  misc_feature (1)..( 3003): 2750-1469P.txt file - cDNA_ID_2106101; gDNA_ID_1620778; Annot_ID_167821

SEQ ID NO: 22562 - DNA, 3003 bp, Unknown; identical to SEQ ID NO: 17756
  misc_feature (1)..( 3003): 2750-1469P.txt file - cDNA_ID_2106105; gDNA_ID_1621088; Annot_ID_170578

SEQ ID NO: 22563 - DNA, 3000 bp, Unknown; identical to SEQ ID NO: 17757
  misc_feature (1)..( 3000): 2750-1469P.txt file - cDNA_ID_2106105; gDNA_ID_2926212; Annot_ID_202702

SEQ ID NO: 22564 - DNA, 3003 bp, Unknown
  misc_feature (1)..( 3003): 2750-1469P.txt file - cDNA_ID_2106109; gDNA_ID_1620315; Annot_ID_153135
atttggttcttgaggttgtggttgggtttgggagctaccaatgccaaggcaaagatccaaacatattggtgacgatagtggttgaggttgagattggggtaggaatgggatcccggtaaaggtccaatcctggttcattccttgacttgggtcactttgtagtcctgcaaagctagagcttgaggatcccacatattggttgtagaccatggacatcttgtatgatctatcaactttgtactgaggctgttcaaatcccggtgggagtgcgtattggttaggaaatgaatgatgatacgaatacgagtacgcgtaaagatctggttctggtcggttcaaatgcgccaaaaatgctttttgttgtttttcgacctctctctcctttctgtgtgcattttgatgaccacctaatgcttgtgttttatcgaacttcctaggacaatacttgcatttgtatataggattctctatcgatccggtggcggaggcatcgtcgctaatatcactagcgtaattcgagtccgaggacaacatttcgttgtcgatcggatcgggcttttagaaattaggtttgatggcttgaatatgttattgcacccggataggtatttaaagatttaatactttgtatgcacttttaatatcaaggaaagttatatgttgtaatgttatgatgtttgaataagataaatgcatattgatgaaatatggaaagggacttagttatagagaaacatgatgaagaacaaagactaactgaagtacttaacaaactagtttatcatttcgacaactcacacataacatgtttaattactatatatatttgacattttacatttgccgaatttgcgtagtaaatttgtttctgaattaatacttgttgcatttagcatatttagtcaaaattagttccaaacattactgatttccaaagtgagtagggagattttggttttgccctattaaatttgagatatagttgaaaacaaaattatttagaagagtttaaagagttaattagtagatcttaatgtagtcaactttagaaaacaagaattaaagatttaattagtgtcattatgtagtaaacttttagtacataattatctcaactcttaaataaaatatttacctttaagttttctattgttttccattgcttgcaattttatttattttcatatacatcactttggaggtaataaaaataaaattattttcatatcaacataatgaaaatatatattaaaagtaagtaattaaactaaatttggctaccttttaataagagtagagaaactgatggaagcattttaccatcaaatctataatgctgattctcacatcaaaaaagcattaacttaataattttactatgacatatagcacattttcagactttcttgtgatatacatggcttagtatgacagattggattaaacttaagataatgaacatctatgtatagtcaaggtttaaacaagatattcaactctaacataccaaattaaaatctatatagtttcttagctatcttttcagcattaaaatatacagattggattaaacttatgatattgaacatctatgtaatcaaggtttataaactttgtaaacatttttataaatagcacattaattggagataagaagaaagctatatgtattataattagggttagtgaactttgagagcttggattgacgatgaacttccgccgtatcattggttctagtagccatctcttgaaaagggtctgtacaacggagtatgctccgacatcgatcagggttgatgtacttgcgaagacaaaagtggaaaataggaggatggagaagaagagaatcatgcatgttcgagaaactgcaatctctcactgagccggagggaatagcgcacacgttaaacaagttgatgaggattgagaaggagcacgaatccgtcaccagagaagatctgaagcacgtagattggatggtgcgacgacctgtctttccttcaaaagcaaagatattgattggttattagctacctgagaaggaaaaaggggactataacacactttcaacacatttcgtaaatcgcaactggtacctgaggctgtccaacacactttcgcaactgaaactcatggtttctttgatggattgtcttaatgaataacttaaccacggctttcagattttctctttgccttttaaatctctcttgtaattagaggtaaaatctctagtgcaatcttttgcattttgcaatttgcgcttctgagtcacctaggcttcttcctagtgcaatttttgaagggtcacttgcagcaatgacctagttcgataataaaacgaagcttatgacactgtactatggaaaattaagaaagtgcgtctttgatcgttttgagtaaatggttttgtttacatagaacatataacatgaaatggtatagaacaaagaaaacattctatattgttttattcatttaatctctatatcaaattactaaaaaaacacatttttgaacattttatatgatttctacaatcaaaaataaaatattgtaatgatttgtgttctatataagaaacaaaattttagataatagccaaattaaccatacaaaaaacaaagtaatgtttgtgtgaacaacctctccacttctgcttcccaagacaaatttgaccaaatgccaaagactgagcataagtaccaaacacatattgagaagcagcaccaaactgatctttgaggttgagaaaagaaaactgatcttttgcatatttttttttcaaaggattaacaacattgatttaaaatgggctttcagatgagtccataaaatgggcttaaaaatcatatttaatggcccataatatttgtttgcttctcttaaacggaaagagtctttaaccggcgaaagaaaccaccctctgactgttaagaaaattctcatcggcgtttagatcagaaacttgggaatcggagaagctcactgagaacaatg

SEQ ID NO: 22565 - DNA, 3000 bp, Unknown
  misc_feature (1)..( 3000): 2750-1469P.txt file - cDNA_ID_2106119; gDNA_ID_1620331; Annot_ID_153646
tcaacacgatttatttcagaagcattaggggaaatttaccagtgcagggtctatctcaaatgagtgagtttctttctcttctgctgctgctgccaattctgcttcattcaacaactccccaggtcctgcttcaagttcaccacttgttttgccgatcgtaaatccatcaccaccataatatggctagaaaaaaagttaataagttggttcaacatactgtggagaatacaatggtataagagatatcaatttcacattcaatgaaccaaggagtttaaaaagaaggataatgagtttatttatctattaaatagttcaagaaaaaattagaatttaaacacgaaaccaatagccccaagagaatcaggatagatctctctgccgcattggtatcaaaagatgcaaaaactgttgagaacaacagatcatggtatgtatttccatccagtaatagtaaacataaagcactaaattgaggagttcaacatacctcagaagtaaatcttgctcgatttatgacatcatcactgagaagccttttcaacacctaagattgtttatatttaacgagtgagcaaaaccaacagagaaactacacaaaaatcccatacgcataactagagaaagaggatcagtctggtgaacttacctccgggaatggtgattcaataaaataccgatttttcttcaataccaacttcactttcccataattagcagtagaagcatggatgaaatcaatgatctccccgggtagcttggtcttagatagcttattcaaaacagagatgatagtttctgtctcaagaccaacggaaacagcagcatacaacgagtgtggggttaaattatactcgtgcattgactcaggcctgaaatagtaacaaatgaatgaaaatcaacaacaaaaatcataacttgtacattgatataataatcaaatcaaaatcaaacctgcaaacgggttcagcaatggcgataagaaagtcataagcttgtttatagagaggagaaaatgtctccaagaaaatctttccatcagcacaagcccacaaaggcctatttccatgatccggcttcaactccaaatcagtaaaatctctcctcttctcctctccttcacctttaaaaaccattataaattctatttcaattttgttcccaatgtatctatgttaattatacgagagtaatcaatattaccatcacgagaatcctcatcagcatcatcatagtaatcttcaacgttttgtatgttcttcatcttttgatcatcctgagatttttacagtacaattacactaactagaagtgaagagcctaataaataaaaaaagtcatgtggagaagaatcaacacgaaccttcccaccgtacttcatcttctttgtaggtcgttttctttcatctaaacatcaacattttccccagtattagcatactcttttcaccggataattcaataaacgaatcaaaactcagtacgatcgagattcgagaccattaccgtttcccatattgattttcttcttttcgctcctcttaatcaaatcgattttagggattgtttctcttgtattttcaatttgtgaattcgcacataacctaaattgtacgacggagggaatatacaaccgtcttcgtggtaatttcccgttgtaagctattcaacgaagcaagctgcgtctccggcgaattcggattcctgtgtcgagtcggtgactcgtttgaagcggaggaaggaaattgttaagcagaaacgtaagaacacgattcatatataaaggctgcagtaacagatcaaatatgggcttttaataggattctttaaatgggctttattcttaagtttgagcccatgtttcttttttaaacatcgataaattatttgccggaaaaaaaatagtaataattttactgaaaatggtacttcccaatttataattttttggtcgacacttttcagccgattttcagttatgtaatttcattattgaaattttgaaaaatacattgtaacggaaaaaataaaataattaatcagctaattaataattgtattaatgaatttaataaatcaggtaagtaaatataatattgagcccaaaaagagtctttgtaatttcttaggaaagtcattttgatagagcgcacgataaacacagcaccgcaaaaagcacagaagcagagaaagacgaagacaaaacaaaaaaagcttcccccaagaacaaaaagtaaaattctctctatgattttgagatttttaattcctcttctctgattcaatctcgagaagatgatcggttcttctttggtgtttgttcttgctagtgatcgcttttctttaggttttgagcttgatttttgtgtgaaattctgtgggttttttttttactgttttgatccgtatttctcctatgtgtttatgctagattctgagaattctgatgtttattgttgcttttataagtttcggtttagggttttacggattagcttgctcttaatggagctttggttctttttgtggattcattgtttgtgttggagttaaattctgagtagaattgttttaagtttttggggtttagtgtaaaactgatttgaatttattgcaattgtgtgtagatggtgctaaagagaatgagaattgtaggagattcacataggcttgtagtcgcaacactgttgtctcgattttaatggttgatgtttattgtatctttgattattgagagtgaatttgaactgttagtagctgaattgttttattgttgctactagcatgatgagtctgatcagactttagtagacagctcaaactgatatcgaaaacgataaagcttgtttgagtttcttgcatatagatgataaatattctcctactgatctcagaatgtaatttgtttcttcacatatcttgtaggttagcatagatgaagagtcttcgggttttgtagtttttgtaaaacagaaaaaaaaaaaaagagaagaagagatg

SEQ ID NO: 22566 - DNA, 3003 bp, Unknown
  misc_feature (1)..( 3003): 2750-1469P.txt file - cDNA_ID_2106176; gDNA_ID_1620604; Annot_ID_161732
ctttatgcttacgtcatcgcacacgtctatcttcttttggttaaagtgataaaaaggaaagtcgtaaatggcttcgtcactgagtctttcctactattttaaccccattagtgacactcctttcttctccactacactccatttctctttcttcttgactcgaccatcgtttctctaatctccgcaactatggcttcatttacgaaaacggtgtgtggggtttcacgatcccgagatcatacttttttccctcctcgtacgtaacgatttttttttgtgattattaatccaaggttttttggcgtctcttttaggttttgatccctattgcgcacggtacggagcctctagaagcggtggcgatgattaccgtgttgcgtcgaggtggtgctgacgtgacggtggcgtctgttgagactcaggttggcgttgatgcttgtcatggcatcaagatggtcgctgatactcttctctctgatattaccgactctgttttcgaccttattgtgctccccgtaagtctctctgctgatttaacattgtccatttgttttgtttctttgtgtgtaatctaagaactaaggacagccaataagtggatcgatcaattatcaattagctcacttaactaaagtttcgaaagtgatgtttatagttcctactaagaacgatggtttttagatgtatctgttgcaacttttgttctctgaaacaacttcatagattcttgttttctgaaagatttcataattgtgttgctgatatactttttgatatgattgggaaaagggagggcttcccggtggcgagactcttaaaaactgtaaatctttagagaacatggtcaagaaacaagactctgatggccgacttaacgcagctatatgttgtgctcctgccttggctcttggtacttggggtctactagaaggcaagaaagtaagtcagaagtgatcagtatatttccaagggcgtttatttatctttttttcaggccttgtaatgtcttgttattacatggggtttcttgcaggcaacgggttaccctgtttttatggagaaacttgcggctacttgtgcaactgctgttgagtcaagagtgcaaattgatggaagaatagtgaccagtcgtggaccaggaaccaccattgaattctccatcacgcttatagagcagttgtttgggaaagaaaaagctgatgaagtctccagtatcttggtatgttttgtctctgcctcttttatcaaccgctgtggtacgtgttcatgtcacctcctcgtagacttacttgttatccttttgaaatcagctgcttcgtcctaaccctggtgaggagtttacttttactgagcttaaccaaacaaactggtcatttgaagatacaccacaggtaaatgttcagttgcctctccacttggcccttttaacatttttccaagacaggctttgtttgatccgttatacagattcctaggaacatgctgtgttgtaaagcttttgtctttcttgatcaatagtcttttatgagtcagagagataatgttttcccttttcagattctcgtacccattgcagaggagtcagaggaaattgaagctatagcgcttgtagatatcctgaggcgggcaaaagcaaatgtagtgattgctgcagttggtaacagtttggaagttgaaggatctcgcaaagctaagctagtagcagaagttcttcttgatgaggttgcagagaagtcgtttgatctgattgtgttacctgtgagtattgctaacttccaaaatgtgaatatactatttagtcttaaattaaattttaatattctatgatgacaaataaccaaaaacataatccaacttctttgatgaactacagggcggtcttaacggtgctcaaagattcgcaagctgcgagaagctagttaatatgttaaggaaacaggcagaagcaaacaaaccatatggaggaatctgcgcatcgcctgcttacgtcttcgagcctaatggtttactcaaggtgcataaatcaaacagtactagaattgtagtttcttgttctatcttttaagtcattaaactgagatataagagacatgttttgtatagggtaagaaggctactactcacccagtggtgagcgacaaactttcggacaagagtcacattgagcacagagtcgtggtagatggaaatgtcataacaagcagagctccagggactgcaatggagttttcacttgccattgtcgaaaagttttacgggcgagagaaagctcttcagctcggaaaggcaacacttgtgtgatttcaaacaatgaaagtatgagagtggcttgaataaaaagaaggctttgccttttagttatctctctccattagtaattacttactttatgatatatgacatatgagcttggcttagtgattggtgtgtaactttatgcctttataaatgaataaacgagatttttctatgtatgttgccgatattttctttaaacctctgcaagagctagagggtgtgctggagaaaaaaattattttatggagaaagatattttagtcacacattttcaccaaattgaccttacaataactctaaaatacgaatttgcccctatgtttagctttggaatatttcatatttgtaaaccatttaataatatgattattaccaatttagtgaaaataaaatcttcagtcttctcttcttgtataaaaatagcttttttatcatttgaaaacagagtaatgtcactaatttcttggcgaaaatgtgtttatttgtaacttaaggtaaaataggggcaattttgttgaatctgataagatcagggggtagtaccgtagatttcgctgtccagttcagttatgaaatacctaaaatgccctcgactcataatctactattaaaccctcataaaacccttgatttcatttctagctcatctgttttcacactctctcctagggttttatctgcgaagcccaatctagagcttccatg

SEQ ID NO: 22567 - DNA, 3003 bp, Unknown
  misc_feature (1)..( 3003): 2750-1469P.txt file - cDNA_ID_2106191; gDNA_ID_1620355; Annot_ID_154451
acctttttaagaagaagaaaaataccctgcctaaaaccaggtcattggaaatagacttcagacgcacgaggattttctcaaaaatttctcaaaaaatattgaatgttgatagaaaaaacacaaaaattccttccatttttagcattatatttgtttcaatatgtatataaataaatgaaaactctatcttttcctcttttttttttcttcttcaaactgtgtaacagactaacaggtgtattcacacaaaacagtcgtatttttttttaatatacatcaaatactgatataaaaatttacatagaagctctagtatgaatatctaaccttttaattaaaccgcactattttgttgaacacacagggcttgatggtactgacggtccaagcccacgagcactctaccgagccatggtctcgtgtatttctatttgtgggtctatatttagtagctcttggtgtcggaggaataaaaggctcgttgccaccgcacggagcggaacagttcgacgaagaaacatcgagtgggaggagacaaagatctttcttctttaactacttcatatttagcctctcgtgcggtgccttgatagccgtcacggtcgtggtctggctcgaagacaacaaaggctggtcttatggcttcggtgtctccacagccgcgatcctgatctcggtcccggttttcttggccggttctcgcgtttatcgcctcaaggttcctagtggaagtccaatcacgactctgttcaaagtgttaaccgctgctttatacgctaaatataagaaaagaagaacttcaagaattgttgtaacgtgtcacacaagaaatgattgtgatgacagcgtaaccaaacaaaactgtgacggagatgatggatttctcggatctttcctaggtgaagttgtgagagagcgtgaatcactaccacgtccactccgttgtacggaagagcaagtcaaagatgtgaagatagtcatcaagatcctacctattttcatgtctaccattatgcttaactgttgtctagctcagctctcgacgttttccgttcaacaagcttccacaatgaacacaaagctcgggtcctttactgtcccacccgcggcattaccagtttttccagtggtcttcatgatgatcttagctccgacctataaccacctcctcctccctctagcgagaaaatcaacaaaaaccgaaaccggcataacccaccttcaacgcatcggaacagggctagtcctttccatagtcgcaatggcggtggcagccttagtggaaacaaaacgcaagcacgtcgttgttagttgctgctcaaacaacaactcatcttcttattcttcttcgccgcttcctataacgtttctttgggtggctattcaatatgtgtttctcggatcagccgatctattcactctagccggtatgatggagtttttcttcaccgaagctccttctaccatgcgttcccttgcaacctcgctctcatgggcgtctcttgcgatgggatattactttagctctgttctcgtctcggctgttaatttcgtaacaggcttaaaccatcacaatccatggcttttgggggagaatctaaatcagtaccatctcgagagattctactggctcatgtgtgtgcttagtgggattaatttcttgcattatctcttttgggctagtcgttatgtgtaccggtcgaaccaagggtaaatcctaagcacatacattggtggtatcagactatcaattgtaatgagtgagcttattgtagggtaatttgttgtctgttaatgatccgattagaagaagtcaagggattagtttcttggagaataagttactatgatgctagattggtttttaattttacggctagggttataagttgaactagcacaaatcctatgctcttcaggaatatgtcatttaataaaattataaagacattattatttttatttttatttaatactccatgaaaattaattgtaacgttagaaattaatggttgtatttgctgcgtttatcaaataaataatagcaagtgcatctgtaaatcacaattcacaaccgcttttttacttttaaagttttaaccactgcccaaaacaaatcaatctcataagatgttatggtggcaagtagtccttttttcatgtaacgtacgtaaaagattgacaagttgtaatttgtaacttgtaatgaagcttggtttggataactactgactaaataaaaatcaaccgagtattcttttccgatgtatttgtggaataaaatcttcgacttttatcaatcaaaactgactcaacaactcatcccttacttttaaaattctccaaatttagaccctataatgtttatatttatcacagatataacagaaaacagtttttctttttcttttttttgtagaaacaaataattattcctgaatctaaaatagaacaataatgaaatttatcatatttcgtcaagagttcctggttttttttaaccaattaaaatttatattgagtatattgtgtaaataacaaataaacttaagggtaacaattcgaaatagtcgaaagctagggaggtctttcttgtatataaaaccgtctctgcccactgaaatatcaacttagctcataagcatatctaatcggagctcggagaaatttcggtaaaaccctaatcatcatcttctccttttgatcaatcttatcttcacatgaaaaatctctgttcaaagacatagctttgttctggaattccaaattttggggttgattttgtattttctgggtacgcgagattagatcgagatagaaaaaaaaagagcgatcttttctcattaattccggttcgacatggctagtttcagcttaaatttacaagctttgagttcagtatttgttcttatgctcatgatcttcagaattttctcaataaaaaatttgattttttgttgttgttgttgttgatgggattaggttgtgaagagaagaaagatg

SEQ ID NO: 22568 - DNA, 3000 bp, Unknown; identical to SEQ ID NO: 2752
  misc_feature (1)..( 3000): 2750-1469P.txt file - cDNA_ID_2106220; gDNA_ID_1620586; Annot_ID_161298

SEQ ID NO: 22569 - DNA, 3003 bp, Unknown
  misc_feature (1)..( 3003): 2750-1469P.txt file - cDNA_ID_2106236; gDNA_ID_1971789; Annot_ID_175534
gttaccatttagcactactgctaattgcaatcagcacacaacaaaaatgggatttgttatttgaaagcacttatgttgcatgtctactacttaaattagaataaacaatgtcacagaataaaaaaggaagaatctttacgtgatgcagagtttgatcgctggagaagtaaacatcttttgacattgccattgacggccatggccagcgaattgttgctctgtcattaggacccacaaatcccccaaaaagattgaaatttgtttaattttcctcaaaacaaaaaatgacgattttgacctcgagatttttcttacccggagagaaggctaacaaagccggcgaggccaagctccgtcgtctccattgaactcacaaccatcatccaagtaaatatcgcaaatccacacaaatgcctgccaaatttcaaaaccccgtttacaaattttcaaccaagggaaaaaaaaatcagaagaaaacgaaaacatacgtccagatgttgagagtctcattgtgccatgagaaagcgctgaggaaagtttctttgattgaccactcacatcgataatgattgtgtatgaactcgttatctttcaaatacctaggtaactcctcgaacttcatcaatctcttctcagatctcttcttttcgccggaatccatacctttaccatttcttatcttcgtagattccttcaccgttctccgtttctgcatgattcccctccctctctcgcacagctcgtcggggggaaaaggaggagaaatctagctacgaaattgaactccggcgaatcacccaccaccgtagatttctctcttcttctttttattttcagtatttgagaatctgatttgttttttttcgatcttcgtggtatgcttcgtcgcctacttatacggagatgaaacctctttgaattttaaaaacgagcaagcttcgtgacttttatctacgtagcgtctttgaccggtcttttttacacgtgtctcttccttattagtatgttagtttcgccttagtgtgagggaggatacacctgattatttttacccgccgtgtcaatttgaaacaaatattaaagttacagttggaaggtgagaaatgcagaatttgtgggtctctgtttaaacctatagtctataattattaaatcgagaactttgtttttacccctcaagatttttttgttgcctgacccttaataacattgttgagtaactaaaacatatattttcgtttcatttatacgtttcctaaatgatttgataatatggggagtgttgatcaaaacagattaaacgaacgaggtaaattgaaagagtaggtaactttttattggctttatggcataagattctccaaggagggttgattcataagacaagacaacacgtacatacatatctatatttaattggtatgaacatggattatgttattgatttatttaaaacgcgtcaaacaattggatataataattaaaaactgaatgaatggttcgcttaccaaagcaaaatatagttggcccagaattcgatgttggcatgttacgactacattgctacattgttatcatcaatgtttcagattatttttaatttgtactttcatagtaattcaccgcaatgaacgatgaggaaccatcgaatcggactaaacgagggtaacaaattttgagtagtaaagtgtagtaacaacaaatgagtgaacaaaaatcgaatggaaccgtacgaatatagtaataatttttgttgttcgcctgctgaatctcaaatgataacctttaggatctttttagcaaatgataatcagtttgtaatctagatttatttggagttcttcattttaaaatcaagataacgtggatccggtttgatccggtctaattcaaatttcataatataaatacaagaatatttcaacattagcctaaaaatacattaaagaaaagagtgtagtattttcaaaagatttgttgtatatcatacaaaatgaatgtatattgttttgtgtataattatatacaaagttgtcgtgaagtgaacatatattctagtttgcttagttggtccgtttttcatctaaatcgattcttagacgccataatttcttgctaagaggattaagtataaactatgtgtacatggatgagtaaattctttggattatttaacgattactcattatctttgtaaagtgtataaagaaaggtgagtattgcgtggtgaactgtggaaacctagactcaaagatcaatactttattagattttgttgctaaatatggtctaacaaagcaatttacgctaggtattttgtttgagtatagtaatcaaatgaaaactgaattatcgaaatttagacaatagacactaacgaaatgaaaaaaaaaaacgaaattaagatgttatacaaactgattaatccatttatctttcactagatgaaatcatagatcatttttcgtgagtctgtaaagatgtatgataaaaaaaagagagtaattaattaaaacatacctagaaagcatataatttgatttaagttgtgacataacgaacctaaaatgacatgtaaacatatccaaaaacgaaaacgaaatatcttgtttataactaacaaaccgaacactgatcaatacgatatactttcaaatcatgatttgattaattttagctatttgttcagttccgttttgggaaccggcattaatcattgcgtgtagcactgttattggtagatatgaatgtgggggattttagttggtaaagaaatttaactagcagaaaaaatgtttgggggcaattaaaacaatatttaaaatacaaggacctttttgtataatattttaggacaaatctcccgccttaaattccctccatattttttcatgtctcttcgcttttcgcctacccaacaaagacaaaacgtaactgtcttcttcttcttactcttccatcttttgtactttcgagtttaggatgttagatctgggaaacatg

SEQ ID NO: 22570 - DNA, 3000 bp, Unknown; identical to SEQ ID NO: 6388
  misc_feature (1)..( 3000): 2750-1469P.txt file - cDNA_ID_2106236; gDNA_ID_1621091; Annot_ID_170731

SEQ ID NO: 22571 - DNA, 3003 bp, Unknown; identical to SEQ ID NO: 22569
  misc_feature (1)..( 3003): 2750-1469P.txt file - cDNA_ID_2106236; gDNA_ID_2926198; Annot_ID_201644

SEQ ID NO: 22572 - DNA, 3003 bp, Unknown
  misc_feature (1)..( 3003): 2750-1469P.txt file - cDNA_ID_2106377; gDNA_ID_1620503; Annot_ID_158959
ttgtgataaatacctttacatctcgtatgagttctattattagagtatgaatgaatcaaagcaacttgaataatgtgaaatgattactattacaacttgtgtttaaacgatacaacaacaggtttaacatttggtttgaaagttggtaatgtacggagaggcttgacttgtctcgtgttgtgttcatcttttagcaagaaagctctactgctccatggtgacttttcccggaacaaaagagctgtttattcccctaagttcaaaattaataatgtcccttaatacttgtagtcgctaggcatcaggcatgtatctctgtaccaatctgtatctgtaagagcttcaaactatctgaaaactcaagacgaatattgttgagtcgagctgcatgttacagattacaacatatctaatctagctctctctagcatagatttaaatagtaaagtcaagtcctactaattatctaaatatgtcaaatatttctcaaaaataaaccattccctaagagacctgattaataattttcaaaaaatttcagtaagaatcaacataaaattatacaataaatagtttcccttgtatagatcaaagagatgacgactcagtagttaattatcgcagtgggtatgttcactatcaattcatagtgttccgtgattggagggtttctaagtgatatagacttgattaacgcctaaatcctgaaaatatgaaatcgataattactctgattgattggtacgtttactgtttatcaccgaaaaatctctcaaactttattcttcgtctaagactttaattttgaccgccacatataattcaaataaaatggtacaattattagaacaaaagttcaaatattcaagaactttacggtaaaactacagaacatagacaagatgattaccctaagaccaatggttttaataaccactgtccgaaagacaaaacaaaatgaagacgattcttctataaaatatcaaatacaagaagaaaaaaataactcaaatataaatcaatatgaatttaaaagaatcaactcaaaacctgaatcaaagcactggaccaaatcagaaagaaagcaaaaaactacaaaacttggttttatttctgtttgcttattcaaatggaacacaaaaatcaaaattcgaagaaaacatcttatagaacacaaaccatatacataactagatatttcatatttagttgtagatgcaattgagttaccatatgcttctggtcatgcttgactccttgtacgccaccggcagccgattttaaaaccaaaatcggtatccactcgtggcatacagggagccaggcataacgacaaactattatatgtatatattgttgtataccaaacctctacgcatgaacatatctttatacgtggatcttggcttgaatcgaatcagaactttttttaactgttgggaagaggaaatgaagtagtcagagagaaatgttgaagagttttggttgaagaggaatatgtggtacaaatatataaaggggaaagagagaagagaactaattatgttcttgccaaaaaaatatattcaaaagcatgactaagttaggttttgatttttaaaatctttaatgtgaagatagatgaataaaattgttaacaaattaaaggacccatttactcactttccttaaaggtttctcctttttccacatattttatttatctattgagagttaaatcatgcaaagaattttgctttttaaagcacataatagaaaaagacaatggtgatgcatattgtattatttcttcaatattcaagttctaagatattataaacttgcttaaactccaatatatgtacattgttattgtaaggtggaaacaaaaataaggattcttcttgtcaaaggtaataaagattacatagcgtgcaaacctgctgagttacttttaattaaatagttatattggagagttttttataaagatttttggtatcatacaaaggaaaatttataaaaaagaaagagtgaatgggccattgatcaatcatcttcatcagcataaaggacctacattttcatcccaatccagaactttagcgttggacaaatcaaattgatatcccattaggtcttgctttgtttttgtttcttttttgttggtttatgtatgcgtttgtattagtatttacaagttaagataatgtgttcattgtcaaattgtaaaagggttttatacatgatatcaatgcaaatacatatatttggggtttgaaataaccaaaatcttaaatcttcataacttgggaaataatgtgaataagcatttctttacaaatgaacattgtacttgtagacacactatgaacatattcatgagcgtgaacaaaaagtgagtacatatatgttttataacgaagagaattcaaattcaaagactctctaaagcttaaaattcgattcttcttttgcaaaaatagattttgtatgcttttttcatcatagctctacatcggtcgtgggctctttcactttcacttttcattcttttataagtgaagacactttttctttagtgtcattcttagtattattttctcttttctttttattcattttccctttcgtttgtttttttctttgataatggttttaaaaatttagtccagaccaaatatggcctagaattagagaatcttgttaggatgaagttttattttcttctttggtcttacaaaaactgaaacaagataaacgacgtcgtattacacacaaacaaacgaaaactaaacgacgtcgttaaatattaaaaaaaaacggaaacgagatttactagtttggattttaatgggctcaacaggcccatactaaaccagtatgggcttctttcgtgctgcaactcatccagatgatctccggcgacgagtaccttcgccggcaataatggtctctgtgtagatagatcgtgaagaagattagagaatcgaagaactcgtatcagataagctaaaatcaatg

SEQ ID NO: 22573 - DNA, 3000 bp, Unknown; identical to SEQ ID NO: 5823
  misc_feature (1)..( 3000): 2750-1469P.txt file - cDNA_ID_2106384; gDNA_ID_1620820; Annot_ID_169435

SEQ ID NO: 22574 - DNA, 3000 bp, Unknown; identical to SEQ ID NO: 9114
  misc_feature (1)..( 3000): 2750-1469P.txt file - cDNA_ID_2106396; gDNA_ID_1971986; Annot_ID_177744

SEQ ID NO: 22575 - DNA, 3003 bp, Unknown
  misc_feature (1)..( 3003): 2750-1469P.txt file - cDNA_ID_2106422; gDNA_ID_1620815; Annot_ID_169214
gcaatttggtatgttaaaaaatcatattttgagttttaattcgatgaaaatatgccaattattttcttcagatggactaatgttttttttgttcgtgtgttttaatgcagcgatgataaagtaaacgttacagggtattttcattggtcattgatggacaattttgaatggcaagatggatacaaggcgagatttgggctctactacgtcgattacaaaaataatttgacgcgccacgaaaaattatcagcccagtggtactcgagtttcctccacgatggatcaaaagagttcgaaatcgagcacgagttcgaacacgatgagttgtagagtgaattctctacaaacagactttgaaaatttgagtcatatatatattatatattcataaactatttgtttacagtttgctgcagtgaatgcatttccatattcaagtaaataaatcagatactcaatatacagacaagtaaagtttggattgtgttgtagtaagtatttggatagttgaatattgagatcaagggtattcacgaagattccgtactagttattgatattttctattgcatatttcatatttgcatgcacggcaaagtgccaaagtatatttattgaagaattcaaacagatggtcgtatgatccaaatctctaactattttaaaatgtgatatacctaacaatatactcaaatttctagctttctaaaagagactacaagtctacagactacaatacccatttaacatgttttggacttggttaccatatcttaaaattccaaatttatcggcaaactcaacgaaaataatcaaatgtataaatggacctgatagtgccattgatatttgggttctgacttcagatatgggccttggacctttctgataagactcagtatctttaagaagatacttgaatttggtaggtgagaatcatcatcctatcctccatccacggttttgtagagggtaatataattttttctatggacagtaagaagtgataaaaatataatattatataaaaatgttataatgctttttttgtatgacacatgtccattttaaattacaaaaaaccatgtaaataaagaataaaatacgttataactaaaaaaactgaatgcatttcaaaaaagttaccatataatcatataagtaagcatataaatcatacaccttatcttgatgtatatgattagttataactagaaaagaaaacaaaacaaagttgaatattatatctaagaatatatattacccattaagaaataaatgaaagagagaataaaatccacagcattatataaatattgtagccctgggagttcggatatatcggtttaatcggttcggtttatttagtttttcggggtttttggattttttaatttctagccgaattgaaccgaacaaaaattcggttcgggtcggttcggacatcggttttttcggttcggttattgggtataaattaaattccggattaaaccgattttttttctaattcggttaatttgaaccaaataaaccacaaattaaaaaaatggacttacaaaaatgaaatctaataaaaaacaaacaacaggcccaatacacaaatatacagttacaattacaaatccacaacacaattatgggtcaggtccattacaaaattagggttttgagttttgacaaaaaaaatatgtacgactacaactccaaactgcgacgtcgagcagtgcctctccaatctagtgatctaccattccgacgacgtaatgccctacgagacctgttaaacgcccgtttgttatccatgaagtaagaaaaaacatgagatggaagtgtaaaccataaaagatccataaaaataatggataatctcagatttggaagtgtaaagcctaactctaaaatttcagaaattatagagacagaggaagagcttagagagcaaagaatcaaacaaaacaaatgattaaagagaaataagaagagtttaccctaagaaagttgaggttgtgggttgaatctctgagcaaaggttttttgtaagaccaactgagattagagagaatgaaagaggcttggaagatgatgaattcatgaaggagaagagacgagttgatgattactaattcaatcgaagaaaaatatcaaagtttctttgttgttttcgcaagaggcagagagccaaaaacgaagaagaaacctaattaggttaagactcatcaattaaccttatatatggctgcagattctcggtatgggtgaaaccgattggttccgattaccgaaccgacccgaaccgacttccgaattcttaaattaatttggccgatcggttcgatctccttaattcggttgctgccgaaaaccaaaattttcgtttttttcggttcggttttctcgggttgaaccgttatcccaggcctaaaatattgtatgactcttgaccaaaaactagttagatatattatttattatgacatattaatattaacttaatataaaataaaaataaatgttcaaaaaacatgatcttaaagctgacaaagctgatttgattgactaatacttatcctacggtgatttttggttcttttactttttttgacaattatggagctggatggaaaaaaaatatatataaaatcatatattattaataatgagataaatacaacgaattaaacggatcaaagttaatatttccaaaagaaaaatagaacagagtcctaatttcattaatttcaactattgaaaacaaaatttaaaatcaataggattgatttctatttttcttttagaaaaacaaaatttgaaacaatttcctaatttccctaaacttgcgactttttaacaatcgaccgacttatcaaaattagggattgttttatatataaagagagacgcatctctttatttcattcatcgcttctccaaaattttcttcaaagaacaaatctcccaaatctaaaatctttctcttctctcttcgtttccataaccatg

SEQ ID NO: 22576 - DNA, 3003 bp, Unknown
  misc_feature (1)..( 3003): 2750-1469P.txt file - cDNA_ID_2106478; gDNA_ID_1971786; Annot_ID_57999
cgcttgttaaaactcataatcaatgcatcccttgaccttagaacaaaacctgatgagtcccacacacatgtcacttcgctgtccatgaagttttttgaccggaggtcaaagtaatttaattgacttgatgttaagaaatgatatgtgcagagaatcgaatgtttctttgtgtgtgtggtgagtgtgtgatggatataattattggaattgaaatgtaatttatgtaaacttctagatttcgaaggcataataactctctaaaataattgagaattggataatatccgatgattaagatagcatttacttacaagtaatgttttcgatagaattaatggtcactatccaaattccaaaccatacgctaatggcttccaaaggaaaactaagactttatggagttttacataaagtcttcgttcaaacatcattttcataagtcttttgtaactttcttcctcttaacggcttcctacaatatctcgatttagaactccaatcaacatctaatattttgtctacaactttatgttttttcaccttactatatgatctagacaatcttttgttaggtaaagtgtctagatattctttcacctaattaacacggaaacgtaaacttgtacaaaaacatctattgattatagaagagaaccgagccgtgagagtcgtttctcgtcaagaccgcaccaatcgactcaaacatgagccaaactgtacgtagttcttataaggaacacaaacctccatcgtaaaccaacgttttcgatcggttctagctagactcgccatgcatgcatgtgcgttggtgcccgtaattacgtacaccaatcttgattgatatcaatgcttatatgccgttaatcttcatctcgactctcgaggtagtagtacttgacgagttctaagttcttcttccgttatgagaaatcatatataagttcttctatacatctcgcttgattattataatctttcgccttttaatttctcgtttgattattataattaatgtttataatgaaaagaatcattatttcccaaagcaaacgaatcattttgagatagacttacagttatcacaaaaagaaatctaaacgttttccccaagatttagcctttcgtcagcatgtaattactcgtgacatattctctagctcatatttcttcttcacgcacgagcaaccaattttgttatatatgtataaatcatctttgacaattatatataatacagatttgttacgagtatatgaatttttttgaggtacagaagcaaatcaactagtgaaactaaattaaagagctaaccatcaaataaagtaaattgaattaaacaaacaaatcataccacgtgatgacagccaccacattcctaaagttagaaaattggcaaacctgtaaaaaagcatcacttccccgaaatcgcaggtcatatttctatgaaaacgaaagagagttatctatatagtaaatggctatattcatatttgccccaccacccatgacccatctcagttaataaatagttcttctattcacctctatactataatcattcactttatcttatatatagtctataaaactaaacgtaattcgcatgattttgcctttcgttgcatgaaaaatcctccttgacaatgtacaattcgttagtactactcgatcagtcgccttgactcacgacattttctctagccactgttttatcttcacacacaagtaccaattttaaactgttgtacttaactgtataacatcctttatacgtaacgtaagccaaaaattatgatctaatcagttactacagattaataataagattaataacggccggtctactaattttgaacacttgtgcatgcattatctctcgttgaaatagtaaattaatgcaactaactttacaagattaatcgaggtatattatagtctaaaacaaatatttaaattaatgcaactaactcttgaagattaatcgaggtaacgcatcacactaatcatatttaatcggataatacatatactgttagtaaaataaattaaaaaagatttggtagataaacgacaaaaatgtttttcgtcttgttgttttcgagaagcttctttttccggattaaaaaaacattatgcaattccacgtcatcagcgcattacaaacaatgaaagactacacacgaccttgggtcagcattccaaagacccaaccctgactcgccacgtcgacatatgccagctattaatgaagagggtaattccgtaacttactctaaccacagaacccttgaatttaaagtgtagcagtaaaatctcatttctttgagttatctcgtttgttcggagttagagagagagagaaagatatagagagaacacagagaggcgagagcgacgtagggttggtgtttcgtacggattttctcggtcaatcttagtttctccggcgagagattgcttttcaggtaaaaatggcggcggttttggtgtttgttcttcacttaatctgtgttcgatctgcgtatgaactcgatttttccactcgattgggtggatccgcttcgttttggtgttatggttcactgatagtgttgtatgtttagttgatctttgcgatttcggatctattagcttcgtagctgttttggtgtgtgtgttcgtcttcgaagatatttaggttttttttttttgttgcttcaaatttcttactgtttcgtgcttgttttcttacttcgttttctgtttaggtctttgattgtttcttactaggttttctatgtttgctttgggctgttgaatttggttttctatctctctagctaatcactggttttcgtgcttctgagtcgtttgtttttgaagctagttagggttttcttctgttgcttctatatttcgatagttttgtgcttgttttcaatgtttgcttcttattttcaaggataattttaaaatgacccactgtttttgggtggttgtgttattttcacaggaatcatcatg

SEQ ID NO: 22577 - DNA, 3003 bp, Unknown
  misc_feature (1)..( 3003): 2750-1469P.txt file - cDNA_ID_2106497; gDNA_ID_1620521; Annot_ID_159482
acaaaggtaagacgacagctcatgagcttaacatagtaacatatctagtacagtcacggactcatcaccaaaagaaaaagaaagcaacaagatattatagttgggtctgggactatcaatagagtttccctttctaagactactatagctaataatgaaaaagtgaagagactagacaagatgtaccaagtaattgggctagttgcgtgtcagactccctcctaaaagagtgagatgactgctccctgaatttgaggcttcttgagagagattgcctattaatcttaagggaaaatttacaaaaaaaagattatcctaggagactatggatcttggcccgaaacttcattaaacagaaaattaaacaactagagaagaggttgtttaacaaatggtatatactaagcttttggtcacaaaaaagacaattatgcatatataattatatatccatacatacaaaacagtaggacagccacagagattaaaatagctacctaacatctatcaatagagtctcatggactcttcaaaaacgtaaaagaaagcaacaaagctttaatacttgggtctaggacgaacaatggagcttcgcttcataagagttcttacgttaaatagatgaagcaattagacgagaggcttaaagaggttatttcataaatggtatagtatacctaatatctggtatactcacggaccttcacacacacaaaaaaaagaagcaacaagctttgataattgggtctagagggccaacaatggagcttcgctttgtaagatttcttacgttaaatagatgaagaaactagacgataagcttataaataggttattccacaaatggtattctacctaatatctgatatagtcacggactcttcacacatgcaccaacaaaaaagaaaaaataagaaagcaacaagacttgctaatggggtctaaggcctacaatggagcttcgctttgtaagagttattttgttaaatagatgaagaaactagacaagacgcttaaagaggttgtttcaaaaatggtatattacctaacatttagtatagtcacggactcttcacaaaatttataatttctctatttcactaattaagcacatcactttggttataggtataacaaaagagaagggttatgttaaagagcaattaagaaacctggaaatgggttcagggaccataaacagtaaatccccataaggaatttaataaaaatggtagaagcaaaattcaataaaagaacagtaaatgctaaagatagactttgaatttcttcatttgtaaaaatgtacttccctttataaaggtgcatggattctctttttttttaccatattcgatttctcctttttactatttatcaaagtcttcttaaaaatttggaagtaatggagacaaatcattccctcaaacaaaaaaagttaacgagtgttgttgtgtaacaaatccacctgtgaccgaggatacatatgactgatgagctaatattagttgaaacaatttttcttttcttttttaccaattggaaacaatttaatatatatggtatgaattacttatactcttaatttctctatttcagggaatataagaaaaagagattgataagatctttgatacgctaccgggaataatattgaacaaaatgctatcaaccaaataagacatataactacataagcaaatcatacaatttggaaagtgtttttagtttcattttaaatcattgtaaaatagcataattgtagcatgattatcgtgaaaatccaagttgaggccatatttcaagtgcggtcccgccaaaaccctattgaccttaatcatggcatcttctacaccaaactcgtattgtttatctttctccatgtctatttcactcttttcaatgtaacctaagttgattttctaagtatgaaacatcaattacatcctgcacaaggtgggtgaaaactaggacatgcaaacagggtgtagacgagtagttcctagtttttatcacttttctaattgcactctgaaactagattctccttctatctttaatctctcctgaatttcttcttatctcatgcatgtcttcttctatttattttttatttttttaaatttgtcgacaatttctatttctttttattattattttttgtatgaatcgtttctaacctctttcactcagcacttaattagaaatctgaattaaagatcaatataccatgggttcaacaattgaatgaataaaattttagaaactaagatcgaaaattatattcaaagtgctaagagtaatcattattttgtgtttatattctggtttctacttttatgttcctattttttcttctcattattatatttttttggtttaacactttttcttttttccaactcatgttaacaaattaagctacaaaaaaaaatatgttgtaatgggaaacaaaataaaaaagaattatgttatgcgaaaaaaaaaatatgcggcaacaaaattttggcttgttttaggtatcaaataaatttggaccggcactgtttgcgagcgtagaagaaactgttcacacatactaaagtaatggttgacaagatcagtttcagagttgacgataagaaatcaactaggttaacaaaatgtaatgaaatcagaacatggaaatctgaacgtggcagataaatatacatattcaaactcttttctgttaatttgcgcagaaatgcaaattcaattgctaagcctatgcggcctttacaacgaatcagttaaaataatcaaagtaaatcaaataatctaatgatgatatatcgtgtttacaggtttatatggaggaaaatatagtgatatgataatcctcatttaaatcattatatagtgaagatactacttacacacgtaacctcctcgatcgtcttttccgattgaagtggtacagaatcctatatatatgactaccttcttgcaagttttccaccaacaccacatctctctctatctatg

SEQ ID NO: 22578 - DNA, 3003 bp, Unknown
  misc_feature (1)..( 3003): 2750-1469P.txt file - cDNA_ID_2106516; gDNA_ID_1620666; Annot_ID_163945
gaaagacaatgattcagagccagaagaattactacgtatatcatcaactgcgttaaatatggcgtctgaagttgtgagaaagagagaaccgccttctgatgattcattcttggttgcaattggaaatgaggattggggaagagaaaccagcattgagaaattcaatgcaggtgagaatgttcggataataaggaaagggaacaactatgacgaggagatgttgaatccgggtagaagcgatgaatcaagaagctattcgcaggcagagatgtcggttcatgatgggaagctcagaaccagaaatgaggcggaagaagactggttcatacgtaaccaagctggtccagaaacagatccaagtcttgtcaaaacatttgtaggagaccatttccacttaaataagagcagtgagagagatgtcctgaccgatgactctttcatgatccattctcgtgttgagaaccaagtagaagattctcggttaaggacagaaatcatggacttagacgtttacggaaccacccaacaagaaaacagtgccccggagaacactccgcatgaaccagatgacctatacatggttcttggacgggaacaagatgttaaacctacattgttaccatggacccctgaaattgactttgagactaacactttggctcaaagaacaagcagaatcgatttgataactgccacaaaggcctctgcaggtgaacaaaccttagatggtaaagaaaagaagagtcgtggtatctccaaggggaaggatgcaaagtcaagagcatcaagtagacctgacccggcgtcaaaagccaagagacctgcttggggaagtagagctgctgtctccaagtccaaatccgagatggtaagttccgtaaccgcttttcgtctttcttgattagtttccttctctcatctggatttggttttttgataggaggaagagagaaagaagagaatggaggaacttttaattcagaggcaaaagagaattgcggagaagagttccggtggtagtgtatcaagttctttagcgtccaagaaaactcctactgtgaccaagtcagtgaagagctcgataaagaatgagaagactcctgaagccgcgcagtcaaaggctaagccagtactgagaagttccaccattgagcgccttgctgttgctcggaccgctccaaaggagccacagcaaaaaccagtaatcaaaagaacatcaaaaccttcaggatacaagacagagaaagctcaggaaaagaaatcgagtaaaataggtcaatcagatgcgaaaagtgtggaactttctcgtgacccgagtctcgaaatcaaggaaacggtggtggaagattcacattcttacttgtcagagaagcaagttgatgcacttcctgctgttgcttctgttgatgatttcaaagacattaaagaattgcatagcttgccatcagaagaaacggccagagtaaagaacagaccgaatgaaatcatagcagagaaagtacaagatcagacgaagatcgatgatcaggaaacagtgaagaatacatctgtttctgaagataagcaaatcaccacgaagcattactcagaggatgttggagaagtccaggcttcacaggaaaaaccggtgtctccaaagaagtcggtgactttttcagagacaaacatggaggagaagtattatttctcaccagcggtctcagagattgacatctcaacgccacctgctactgaagcagatcattcgaggaagaaatggaacagtgaagagacgtctcccaaggcaacggctaaagtcttcaggaagcttcttatgttcggaaggaaaaagtaaaaccgacgttggaattcttcttctccggcatcatcgaacctttgttttgagacgacgtcatgttgagttcagttaaaaagcctctcttattctttaaatttttccttgtgtgatattaaatactgtttttcattttattgttgttatcagtttgatttgtctgtttatattacatttgttgatgtgttgtttatagcattgaaagtgggcatttgagtgtgtataaaaaattggtttggtgagttgaataatgtaagaatcttttgtatttttctaattaaactgtttatgatcattaggagaacaatatatggggatgtgttggaatcatgaatcgtaggttaaatcctacaagaggaaaagcttcaggagacagagaagatgaagagaagagaagaaaggaagaagaagaagaagtcgtgacaaagaaagtcagctaatagacatatctccgctatttaaagtcgagtctaagcctttatacacttaaaggttgagggttcgaacccttgttatgtctttttgccctaaaagaaaaaaactttctcatgaaattccgtgagatgattcttccattctaagcatttggttctgttagattgataaagaagtctcctacagtaccaaggcaatgtgccatccatctacaatttgtataactatatcttttggtaacatgttcccatcaagtgggaatctaattcccctgttattcttttcacgttctaagcatttttcaagctgtttaccattttgaaacttagtaacgatcaaaaagaataagggatttcgtcacgtaaattaaatagaatctgtatacaggtcatttaaaaaaatattttagtaagatacacaggcacagctcaacgtctgatcttggtttgtcataaacagcagagaattctaccacaaggaagctctggtactatctttctcattaagcatccgcgactacaatattccccaatttattaaataaacttttccatgatgcaaaagtaccttttattaaacactacgaataaataaataaaggtgaaacacccatttcaaagaaatggtaacgtgtctttttcattaggcgagactagccaatctaagcaaacagagtcgtctttatatctaaacgaacattttgtgaaagaaagagagactaaggtgaatccatg

SEQ ID NO: 22579 - DNA, 3003 bp, Unknown; identical to SEQ ID NO: 22578
  misc_feature (1)..( 3003): 2750-1469P.txt file - cDNA_ID_2106516; gDNA_ID_2926191; Annot_ID_201029

SEQ ID NO: 22580 - DNA, 3000 bp, Unknown; identical to SEQ ID NO: 60
  misc_feature (1)..( 3000): 2750-1469P.txt file - cDNA_ID_2106619; gDNA_ID_1933; Annot_ID_145435
  misc_feature (2002)..(2002): n is a, c, g, or t
  misc_feature (2016)..(2016): n is a, c, g, or t

SEQ ID NO: 22581 - DNA, 3000 bp, Unknown; identical to SEQ ID NO: 2475
  misc_feature (1)..( 3000): 2750-1469P.txt file - cDNA_ID_2106638; gDNA_ID_1620543; Annot_ID_160079

SEQ ID NO: 22582 - DNA, 3000 bp, Unknown; identical to SEQ ID NO: 4253
  misc_feature (1)..( 3000): 2750-1469P.txt file - cDNA_ID_2106659; gDNA_ID_1620692; Annot_ID_164832

SEQ ID NO: 22583 - DNA, 631 bp, Unknown; identical to SEQ ID NO: 4139
  misc_feature (1)..( 631): 2750-1469P.txt file - cDNA_ID_2106659; gDNA_ID_1620686; Annot_ID_164627

SEQ ID NO: 22584 - DNA, 3000 bp, Unknown; identical to SEQ ID NO: 4253
  misc_feature (1)..( 3000): 2750-1469P.txt file - cDNA_ID_2106659; gDNA_ID_2926202; Annot_ID_201930

SEQ ID NO: 22585 - DNA, 3000 bp, Unknown; identical to SEQ ID NO: 8489
  misc_feature (1)..( 3000): 2750-1469P.txt file - cDNA_ID_2106682; gDNA_ID_1971812; Annot_ID_175785

SEQ ID NO: 22586 - DNA, 3000 bp, Unknown; identical to SEQ ID NO: 8489
  misc_feature (1)..( 3000): 2750-1469P.txt file - cDNA_ID_2106682; gDNA_ID_2926171; Annot_ID_199529

SEQ ID NO: 22587 - DNA, 3000 bp, Unknown
  misc_feature (1)..( 3000): 2750-1469P.txt file - cDNA_ID_2106686; gDNA_ID_1620459; Annot_ID_157690
atgatcttattggttgttttttgtttatatgcaggtactgtatccggtggggtctaactcttccaagtagaaagttacgtgaatctgcttggaagaagctttatattgatgtgagtttctccttggtttttcgtataaacttgttagatgtttccaagtagtattacattgctgaagaatatacagtgttagtttgcgttgctagtagaagtcagatcatatatatttttaagtgattcctttctcttgtcgaattttagcgtgatgaacaggacatgattgaacttgtcagaacctgtccgtcggatttcaaggagtattacgtacatatgcaagcagcaaagagaagccaagcacctcttccgtcccaggtaactatttataattatctgtttatgttttaggacaaatcatcacgtgaagaattttctcatgttcttgtttgcaatttttagatggtggatgaccggataattcttgacaatactgtacttgaacaagtttctctatggaagaaaagcaaaggacttactgataaggctgtcactggccatatttgtttgggaaccaaatgttcataccatcagattgacgacgtgttcatatgcaaagagacgggaaatgttcatggtatgtaatgaaatgctgtaaaatgtaactttgttactgtgttttactctaaacttacatagtttttatggtctttataacagtatgcgatgataactgcaaggaagtaatactgagtccagagggtgacctcatggtgtgtactatctcaggagtttgttctgatactttacttgtacaaactgagccagacgcagatgggtgttatgaggaagaagctgaactagaagctgaagtattcacagataaaagccgattaggtacacatctatctatctctttctcatatctctcacacacttccttttccaaatattatttttattttccaacataagtgaactatttgcgtcttcttttcatcgcagcccgagcttttgaacttggctacaactgcgatgatgagcaggaactggaacgtaccctgaggttctgctgagcaaaagtctcgaccttttgtccaatttcataaggcctactttctgtaaggtcttctctctctctctctctctgacctgattctgcctgggttctgtggagttgaaatgaatcaaatgtagctcttgttttaatcagtcagctttgtaacgtatacatatatatcattgtatgtgattaacattgtccttaaaaagtgttacacctagtaattacgttccaactttatcagtaaacctattggtaactagtaatttgctcccgatattggttttctcattaatttttatagccattctttgttcatttaaaccatattacaaatttgtcctggttagaactgattatgatgacaaatcgatgattagttcaaaatgaagtttatagcaatatattctaataactatacatcaattatcaccactgatgtgtttgaatgaaaaatgaattgataatcttaataaatgtttgattttatagataagtataaagtatgaatggatttagaaaattttagtatttagtgagataagcataagcaaaactagaaaaatgaaattattattaaataaattcattaatacacattggcaatgtgacattgcctaaaatcaaatatgtactaattcaattaatgttaataagaattttttggattcgattctcttgcgaaagtgcaaattaaaagacattcttatctcctacgtaaacagaatcacgcgtccattgcgcgttctcgcaacgctaaaatatttacgttggaaaatattctcataattctctcctttgcccccacagtttaatatatttcataaacacccccacgagaaattaaaaaccgttccaaatttgaaaaaatacaacaaacaattcatgaaaatattcaatctataagcaaaacattggtagtgttacatgtgtcgtccttcgtgctgaaaatttggatagcattgttaattatgacaacgtaagtgtagcctgtgattcatagtaaaatataaggactaaaaataaaaatatatcttttttggaaatcgtaccgcgtaagaaacatgtataaatacctataaggtcttatttttttctcttccaatttcgtttcgacatatttcgcgattcgtctaaggtaaaaaaaaactcatctttttttcttttagatcgttaatttttgatcagcgattcgctcttctgatctgtgttctttaagcttgtcttctctcttgattcgatctgctgaaaacctagaaatttttgatttttttgtttgttttgctccatgtgtatgggtatatttacgattttaacaaaacaaaaatatgaattgaggttttttatttagcgaattgggttttaattgttcacattcgtttggctctctcgaggtgagtgataaagtatagaactttcttatgcttaggatcttaaattcgagttctttgatttacctgtcatgtgttattgattgatctcatttatattgtgtctgcttgatgtttaaagcttggtgtatgcaatttgattgggtttactggagattgatctgtgacctaatcaatgagtgataacattgctggttcatctgatttctcatctggtgtgtctgctcgattccctgaagaaagtttgaaactcaggcttggtttgtgcagtttgattgatttatctcattacttgactctggtgtacttgattctttgatgaaagcttgaagttaatgtttggtttgtgcaatatgattgggattaactgcatttgatctctgaccaaaatcagtgattaattacattgcttggttatctcattacttgagtttggtgttcctgcatgatcccctgagcttgaagttcatgcttggtttgtccaattgtgacctaaattgatgttttcttgtggtatcttttcgtaggttttgttactgattgagaaaacatg

SEQ ID NO: 22588 - DNA, 3000 bp, Unknown; identical to SEQ ID NO: 8855
  misc_feature (1)..( 3000): 2750-1469P.txt file - cDNA_ID_2106710; gDNA_ID_1971906; Annot_ID_176996

SEQ ID NO: 22589 - DNA, 3000 bp, Unknown
  misc_feature (1)..( 3000): 2750-1469P.txt file - cDNA_ID_2106717; gDNA_ID_1620544; Annot_ID_160105
agattaacacgctgcaacagatcctaaaggagtatggggatgctacgggtcagagagtcaacttggataagtcttctttatcttttggctccaaagttaattctgttctgcagcttcttatcaaaacaaagatgggaatcatgaatgaaggcggagcaggtacctatctaggtctcccggaatgctttagtggctcgaaaatccagcttcttgactatattaaggacaagttgaaggctagattgtctggttggtttgcaaggtctttgtccatgggtggtaaagaagttctacttaaagcagtggcattggctatgcctgtttacgctatgtcctgctttaagttaactaaaacgacttgtgcaaacttaacaagcgcaatgagtgatttctggtggagtgctttagaacacaaacggaaaatggtttgggtgagctgggagagattgtgtttatcaaaggctgaaggtgggttagggttcagagacattgaagttttcaatcaagctttacttgctaaacagacctggcgtattcttcagaatccggattgcctttttgctcgcttaatgaagagcagatactttcagtgggatgacttcctgaatgctaacatcacctcaagaccctcttatgcatggagaagcattttacatggtagagagttgttgtgcaaagggctgaggaaaatggttggaaatgggaaatctctgaatgtttggattgactcttggatttacgacaatgggttgagagctcctcttatcaagaacccgatcattaatattgatttaatggtaaaggatctcatcgatgtggaggctagaggatgggatagagacatattggaggagcttttctatcccaatgatgttcagcttattctctcaaagaagcctgtggtctcaaaagatgatttccattgttgggagcatactaaaagtggagattactcagtcaaatcgggttattggtttgctaacagatctcccaataaccaggtttttcttgatgcaattgtccagccatctttaaatgccttgaaagagcaagtctggttggttcaatctgctccaaaaatcaagattttcctctggagagctcacagctcggctcttccggtggcaaacttgctgttaactagaggcatgaagattgattcgaggtgtcaaatgtgtggacaagaaggtgaatccataaatcatgttttgttcacttgtcctgtagcgagacaggtttgggctatctttctgtttcctttccctgaaggcggttttagtgaggagtctgtttacagaaattttcaatctctctttgatataaagaagaatggaaagataccgctaagaaacagaagatgttttccttggattctctggagactctggaaaaatagaaacaagttctttttcgaaggggcaagttactgtccagccgagactgttgttaaaatagatgaagatatggatgagtggttcacctctcagctcatccctacttcggttgatgtggaagaatcgatctctaggttagaggtaaagaaagaatgggaacctcctcctactgattgggtcaaatgcaacattggtcttaggtggtctaataagcatggtttcgctggagcttcatgggttgtgagaaatgcgtcgggagtcgttttacagcacagtaggagagctttccttgatgtgaaggataaaaaagaagcaactcttaattgccttacttgggctatcgacagcatgcactctcttcatttaggtaaagttgtttttgctttggaagctcaggatattgttggagcttttcgaagacccaaggcttggccttcctttactcatcaggtaacagaaattaactattttttggagaagattgtggactggaaattagtgttagaaactgtggaaaccaatagaggagcctcgttaattgctcaatcggttgtctcagactttagactcaactcttatgttgcgtctggacatccattctggctcaatggcctttttgttgaagagagatcctcctcttgatcctggattctccttttgtccgctgtccactttctttggctatattttttggtagattaggattattctcttctaattcctaatcttctcatcttggttttgtcaagattgaagtatgatgtatgtgtaacattttaaccatcaatataattattcagacgacaaaaaaaataaaaaaacataaaacaatgttactatagtaaagtttgaaaatccaaattttaaaaaatcttatataactcactaagatatttggaaaattttaaattatacaaaaatcaattatgattacaaatatattttagttacttcaactaggtgttagaaactcaggtaatgtttaaacaatcgtcttgatcgcctaaataaacatatattttattttagtgtgtttttaaaaaaaaataattaactaagtttttcttcatatacataattataatttttaatatatatgtcaacataaattaaacagtattttgtcaaattattattttcgatttaatatatattttagaagagattttatatattttttaaataatatcctttttataacattttattttataaacacttaaaatgcctaaaaccaattaaacattttaagcattagacaataatgatcaacacatacttagtgactatcgttttcttgaaaattgcttcatgtacattgaatggaattattatagttgattagtcttcattcttgacttttcacccttcaaaacaaaagtttttttctcactatgagtcatttgataattaattgaagaaaaagaaagaatcaataatgcatgttgacagaaagacatattaaataaataaataaaaaagctaatgattcttcttaaaagtccaaagtaagaaacagtcaacaaacgttggctatacaacaagaaataaatacatcacatttttcagacaaaactccaatttcacagtgaactcaaaaacaatg

SEQ ID NO: 22590 - DNA, 3003 bp, Unknown
  misc_feature (1)..( 3003): 2750-1469P.txt file - cDNA_ID_2106795; gDNA_ID_2684129; Annot_ID_191175
cacagttactccgtttggcaaataatttatgctccctcattacttccaataccagttttaagtgctgcaaatgctccttctttgatttgctatagataaggatatcatcaaaaaacaccaagacaaacttccttagaaacttttgaaacactgaattcatcaacccttgaaaagtagctagtgcattggtcaatccaaagggcatcaccaaatactcgaaatgaccactatgagtcttgaaagcagtcttgggaatatccttctccaccattctcacttgatgataacccgctcttagatcaaacttcgagaagatcactgccccacccaactcatccataagatcttcaataagaggaatagggaaacaattcttcactgtaattccattcacctttcggtagtccacacacaatctccaagagccgtctttcttcttcactaaaaccacaggggaggcaaatgaacttgaactaggctggatgataccgctctctaacatatctttgacaatcttatcaatctcatctttttgatgattagcataacgatatggtcgcatgttcaccggattagtgccctcaatcaaaggaattggatgatcatgatgtgtccgagaaggaggcagccctttaggttcagcaaacacatccttatactcatcaagtaattgagaaatagcagaagtagtacttggtggtgacacctctgttgttaaagaagacaactgcaacacctctccctcatcctcatcagcgtctgcaacacacaacatagacagctgaacttcggagtctctcagtttgttcaatttgtcagccttgatagcacgcaccgacgaaggctgaataccatgtatcatcacccgtttcttatcccatttaaactgcattgtcaacaatgtgaaatcccatgtaataggacctagaggtttcaaccaatgtacacccaaaactgcatcaattcctttcaaaggaattaccataaagtcagctacaaaagtcgtgttatgaatctcccacttaaaattctgtattctcgctatcaccttcagattgtaaccatcagccacccgtactcttgcattatcactaggtaggagtgagcaacccaacttctttgccatttgaggatccataaaattgtgagtggaacccgaatcaaccaacataaaaatggatctcttctgacttgtacccttaactcgcatagtgttgtaagttgagataccctccatagcatgagttgagatatgagctacttccccaactaactccttatgctcttcttctgcatccaagaacacttcctcagcatcttccatttccaaaacaaacaattgtgttttcttgtgaatcttataatgttcagatgtgtattgttcatcacaaaaataacacaatcctttagctctcctagcactcatctcttcagtagataagaaccgccttggctgattttgttgtgtgtctcttggtttttcctgaaacgctggtttattgccctgctgctccatgtctttcttaaaggagaactggccctttgaagtagccttattgttcttccaagaagtcgcattgttctgcacaggatgagcagtttcatagagacgtcccaacatcaaacactgccgcaccgtttggggttgaaacattcggatatgcatctgtgtctcaatccttaacccaaccaaatacgcactcactaaataatcctccgtcatccttactcgagtccggatcgcctcaaactttgcgtgatagtcatcaatgctagcagctgtttcctgcaacttcttcagctcagcaataggatcctctccaaccatctcaaacctctccctgatcctagctttgtacacaccccactcaggaacctgcacttcatcctcaatcatattctggtgccaagtagcagccagaccatccaaatgaatagaaactacagacactcgcatctcttcaggtataggatccaccgcaaaaaattgatcaaccttaaacaaccattccttaaccttctcaccactgaatctgggaaaatccaacttccctaaccttgttactcccgaatgattgttagcgtgaccttgccttctcatgtaatccacgtctgttgctgaagcggatgaagcacgagctgtttgatgagtctcacccagatttgactgcttagatggagacagcatgtggatcgcctcaaacatctccgagatatggcgctcgatcttcagattttgagcatcgatcttgctctcgatcttctccatctgtgactccatcgattcctctgcttctaacgccttctctcgacgagcttgagctaactcctgagctcgagtctcgatcaccatctccgagaaacgtctttgctctgatacctttaatacagtaaaaccacaccacaacacaatcaatcaaccaaagcaatcatcaacaactccgattacttattattacgatgtaaataacaaatgaaatccaatgttcataaaacaagggatttctggattcacctcgcaagaatcgacgttctatgcagaggatgaatctcggaatgttttcagagagaaaggaataacaacaacttcaacgataacatgaaaatacgatgacacttgatatttattagcttcagctctacgcacacttaatttgaatcacagccgtccattgatcttctaatcacagccgtccacgtggccttactcaatatcctgtatcacacacattattctcctgcttgttctgattttttttttcttttttcttttctagataagatttcaattcacaaatttctttttcctcacgtaaaaaaaagaagaaaaaggtcggtctacttgtggctcactcagtggttcgaacctgggtttagattttgacttgaccataacgaaaactaactctaatgattaaaaaggcttcttttattgtgctccgattccaaaatttcacggaaaatagaagcgtcgagttcctcctctccctcaggttgtcaatg

SEQ ID NO: 22591 - DNA, 3000 bp, Unknown; identical to SEQ ID NO: 6368
  misc_feature (1)..( 3000): 2750-1469P.txt file - cDNA_ID_2106795; gDNA_ID_1621090; Annot_ID_170683

SEQ ID NO: 22592 - DNA, 1373 bp, Unknown; identical to SEQ ID NO: 2638
  misc_feature (1)..( 1373): 2750-1469P.txt file - cDNA_ID_2106809; gDNA_ID_1620568; Annot_ID_160797

SEQ ID NO: 22593 - DNA, 3003 bp, Unknown
  misc_feature (1)..( 3003): 2750-1469P.txt file - cDNA_ID_2106821; gDNA_ID_1972003; Annot_ID_177776
ccacggacgaagtcagcaccttcacggtatgggtcgtacaaggtgttgaagaaaaatggagttgatgggcagagaaggttcttgatgtgttgctcaagagcgttcacagcttttccagatggatccttagcaacctataacacatgacaacaacaataatatttaaattataagcaaagaatattcaaatgcatctaaagccaacaaaaataagaaaaagagacaatacgttacacatgactaaaccaacacaatatgaaagcaacatcaatgctacaatcatggcgtaactgaaaactcaattctaaaaagaaagccccacaaataaagtttggacttttctttgccttaagccttatgaccacaacataaatgtgcaggacaatgacatgcaagaatcttgtgaagttaactgttaagacataacatagaaaggttggtccaacaacaatgacattacctaaacataagagagatcatggcaatgccgacaaacataagactaacacaatttcaattctgaaaacagatcgaaacccatcaagcagatgaatatatagatctaagtcaaaacagtgtgtttcttaaagttgacctagagaattgtgatcgtattttcaattttcaattcaaagatcagtcaaatctacagactttatcactagatctcaaactgaacctatgaagaaggaaaaaaagaacagatctataaacagaattgtggaaacttacgaagcaatcgtcatcaatagtgaagatgtacttcttcttggagaccatgtagccgaagcaacgacaagcagagtccttgaaggaaatgcaggaagctttaggaccaaggatacggttgatgtcgttcctgttgtagagttcgtaatcgaacccttcagggacagcaatggtcttcgatggatctccatcttggacgataatcagatggtaaggctgaagaaaaggcctccacatctccaggaaatcgaggttacggatcgtggggatcacgatatcgagctcatccttcaacaatgggatgtggttcaccggaattccaacggtgttcgccggctcaaccatgattggattgattcagagagaagagaatttggagagaaaagattgtgagatttgagatcggaggtgatgggagactctgaagaccgtcgctttggcttttatattagttggcacgtgagagggctttgtgtgagttttgacacgtggtggattataagtcgttcaccaggtcaaaagaatttttaaccttgttatggtgaggaagtgaagactttactattttgtctcttaattgtccgttttctaggctattaataatttgtcttattggtttagaaaacatttgttaattaatttcccataaaaatagaagcttataatattgtctagagattatattttagatatttatcaccacaaataaaataaaataattgtcaatctttttaaacagatacttttgaagaatatccatactttttgatattcttgtttagttattaaattaaattatcagatatacctacgaactaatatggatttatatatttcagttacacttttggttttataacttgttgtcaacagaaaaataaaattgttgtcaagacatttgaattttagaaactaacttattttggttaattaaaaggtcaaaagattcaaaataaatttgtttctcaaattttagtggtcaatattaaatttctgaccaacaaaaatcacaaaacctcagttttgatcatttattattaattatataattgtgaattttgttttgatttaaggctttttaataagttaaaaagttttgtttcttgttcgtttaggtttttttttttttgttatacttataatcagttttagacttagaggaaattgaacagtttagaatagtaggtctagctaacctctttttttttggccggtctacataaccttgcgaaggatagatctttcagctagcaatttaattcatttctgcttaccattgtttcttacttaaattagttacattaccatcaatgtacctcaattcgtgtgtgagcgtttttaacaaacaaaaaaagtcgttcgtgagaattaaaagatggggggatacaaaaaccgaacaataattgaatactttttgaccggagtgtaacatcaataaaggtgttaattagagaatgtaattaggctttttactaacgggaataataaattaaaaactgtcctcgatctactttactatgtatggaaggaacattcgcatgtggcattgtgggaagctgaatctcaaaacttattttaagttttgacattccttacacttatgaatatactatacgattttttttttatcatcaatatacggattagtacattgatgataaaagaaaccacggatgataactattaataattattttattatatgatgaaaatgattatgcatttcacgaaatttcactaaaaaacaattattatgaacaaattcattttgtttatctaataacaataaaaatcattggactttgattttatacgtcgtgggaaggtcgtcgaagcacgttgcgtttgatcattgcatgcatcgtgaaaattccactaaacatcgtcttttaaaaaaagaaacctttaaaacattacaaatggaacgtgaacctataaaatatgataggtagatctcacactttatttacagtattaaacaatatggaacattgacgttaaattattattttctacttataacaatttacacctcccaaaatttggaaaggataaacccaacaaggcaacaagtatcacaaatgtagctgaaatagatgggcttttaaagtttatggattgggccgtcatgaacacatattccataacataacctaattgggtgctccgacttcttttcgcgccgctcgcttgtacatgtcctcttcttcgacttccagataaaatcgcttcctctgtttttttccgatctaaattcacagctcatcgaaaatg

SEQ ID NO: 22594 - DNA, 3000 bp, Unknown; identical to SEQ ID NO: 1506
  misc_feature (1)..( 3000): 2750-1469P.txt file - cDNA_ID_2106824; gDNA_ID_1620410; Annot_ID_156247

SEQ ID NO: 22595 - DNA, 3000 bp, Unknown; identical to SEQ ID NO: 8894
  misc_feature (1)..( 3000): 2750-1469P.txt file - cDNA_ID_2106879; gDNA_ID_2926147; Annot_ID_197801

SEQ ID NO: 22596 - DNA, 3000 bp, Unknown; identical to SEQ ID NO: 8894
  misc_feature (1)..( 3000): 2750-1469P.txt file - cDNA_ID_2106879; gDNA_ID_1971919; Annot_ID_177160

SEQ ID NO: 22597 - DNA, 3000 bp, Unknown; identical to SEQ ID NO: 8894
  misc_feature (1)..( 3000): 2750-1469P.txt file - cDNA_ID_2106879; gDNA_ID_2926265; Annot_ID_204893

SEQ ID NO: 22598 - DNA, 3003 bp, Unknown
  misc_feature (1)..( 3003): 2750-1469P.txt file - cDNA_ID_2106908; gDNA_ID_1620321; Annot_ID_153333
gaaaaaaaaatgttatcatcagaagtttgtatatgaaaacccggaaagaaaaaagcttctccaaagactggtccgccacgtatgacgtatcgtttgtgattccgttggtagaatcgtaatgcaaaattatccaaacacgacaaagacgatacacacgaatttgcttgaacaataataaacaaggttctttgaagaaaagaaagtaataaactatgcacggcactaggagtagaaatgattgaaaccctttaacaaattgaactcatcttgttgccgaagttatacagataacgtatggaatatgaatgggtttgcgattattagtttattggactttcaggccctttttagagaaaattagtttcctcctcccgaaatagtcctgcattatggaccacattatgggcccatattgaggcccaccttaatggtacttatatactattttgtacggaactgattgatagacattagacacggagacattgttgtcgttcttcgcagacatttcgattttgaagacaaatcacaatgggagaagcgcctgcccagattccgacgagtttcggccacgagcttagggcttgtcttcgatgccgcctcgtcaagacctacgatcaggtctggattctcttgtcacttgtgatttgcgtgtttcttctcttgcgaatattttttgcctaatctggtttctccaacagtttagggattctggatgcgagaactgtcctttcttcaaaatagaagacgatcatgaacgcatcgtcgatgttacaactcccaacttcaatgggtatggcttaaattcgaatccttactttgaaaatttacatggcactgttcataagtctgtctctcgtacttgtcgttacattgaaatttctgaacctagtctatacttatgattaaatcgtatagtctatacttattgagaagacttattgttggtcgctaatctctcgtttttttgttgaatgagtcgttgcaaattgtgaaatcactgtggtggatatgaccataaagtttgctgctttacgttaaaatgagttaatagtaacagagatgatgctagtgttgattatacttgtcatttgttgatgtcacgtccatgtaattatgtattgatataatgaatgtttttgcagtataatctctatgatggatccacgcagaagttgggcagcaagatggttaagaattggtatgtttcagctctgtttcctgatcatcctcattgtcttttagagtttactatactgtgtagcttcttctttccgtttcctgttattcttgtctcaccattatactttataaatggggatattagtgctgaatttaactgtgttgtctgcatccatttgagcggtagctgcattctgatttgctgtgtgtttatggcttgatgacctgatgttgtattccctaatattgccagctttgtttcagacagaagagaaataaatctaacacattgcaatatcttgtttccagggaagtttgctcctggttgctacactcttgctgtctcagaggcactcccagaggaaatgcaggtaaacatatttacttctcttagaaacctaagaagggattaataagcaaatccttagctctgttttcgtattgactgttcgtctttttcacatgtatgtggcggaaatccgctggcagttcatatgccaacaagcacgggtgcagtacgttccacccaaacgtatttgaaaccttttgcaggttgcagcaagtgtctccatattagcatctctgcaagtcgtcagtttcaagacaacttagtccgatggaggttatgaatggaagtagttaagttttatgtactttgtttctgatttcaactaatatagagagatttgatcctcttattgttatcaaaaactcttatttgatccggaagatagagatagattacattttttttttcaagtatggaatggatttcttttcctgtgatattcagtacattatttgaattacaaaatgaagaaactttaaattgagcacctagcagaaatgtgtggtaccaataattcacagaaaaaatgtcaactacgcagttgatagaagaagtggctccttaatcaggccaagagggaaacaaggagagatatttattggtttttggaatatgaccattgaaattcccaaagaaccgaagaaaactatgggaaaatgtataaaatgcctgtctttataccaaaaaaatataagacccacaaattcatggatacaaagtacaaacaaacaaattatacacaagaatcatcttccgatccaaggtatattcttctgctagagtaaatcatggacgtaacatgcataattaacaatggttacttaacaacaagtagtaatgaaaaattgaagacgttcagtctatttgggcaagaggcaaatattaattttcgttactatacgtttattttcttggcaatttagtttaattttgtttaggtcaaaggcaatttattttgttattaaaaagataaattagatttttttagaaaatagcctttctatattaattttaaattcgagttcacgtggcggtcgctaccaaacttcgctaaactttagtgctttactccaaaacccagagtccatcacacaagtccaagcccgaaaacaagggttcttgctccgacacgacaacaaatccagattttgagcttaggtaaactcctaactccccttatactctcttcttattcaatctaccttgtttctatgccttgaatccaattcccagacactctggttgcttgtaatctatgttcggttgagagtgaatctgtgttcgatcgtgtgtattaatacctccttctttggttcggacatggatctctgtctataaataacgggaaatctagactttaagtatacgaatttgagaaatttcgattctttcgcttgttttgttgatgggtgtgagtttttatgcttaaattctttttcgttgcagggaaacttgagaaggagaaaaaaatg

SEQ ID NO: 22599 - DNA, 3000 bp, Unknown; identical to SEQ ID NO: 2898
  misc_feature (1)..( 3000): 2750-1469P.txt file - cDNA_ID_2106933; gDNA_ID_1620614; Annot_ID_161999

SEQ ID NO: 22600 - DNA, 3003 bp, Unknown
  misc_feature (1)..( 3003): 2750-1469P.txt file - cDNA_ID_2106939; gDNA_ID_1620324; Annot_ID_153425
gtgaggttcctccccatcaacatcaagaacagtaaaatgaggtccaaaatcacaaaacaaagacccaaacagccccctaacatcagccttgatgaatgcaataggaggctgatgactgtgacaataatcatcaatctctgtcgctttctcaaaagagatatccacaaataccacaacctgcatcaaggaaaaaaaaaagaaatcaaccactaaagccaaacattctgtacttttagtagaaacgttttcatccacgttcagtcacctctaatctcttttacagataattatgtccatgaatcatgatagtattattaacaactagaacaaggaagcaaagacaaaccaaataaaggaagggtttggatacctggaaatcagaaagctgctctttggttaacttcccagtcaaagttgagacagccacagcattgttgagttcttgcaacttgtgaacagaagcaagtgctctattcttaccaatgtcctcctccgtgaaaacaaagttactagataggtcccatagctcaaccacattttcatcgtgaagggtcactgacttcacaccagctagaataatattcttggctaaataagaaaaaaaaaaaaaaatcatccatcagaaagaaggaaataacgaagagaataaagagctataccagtcattagttcattacaaatctatagtgaatattgaataatccttccattatataatgtgtcactaactcattagaaaatcaggattaacaagttaatataccaattttacaatctcaacttcaagtgcccaaatgtacacacaacatcaaaacagcttaatcacgaaatacgtttgctcaagcttgaagctctttaacaaccagcaggacaagcacaggaataacatgcaagcagaaattaacaacgaaaagtacaaaaatcgttaccaatctcaacaccaaggccctgcatcccagagatgagaacgttggaagcgaaaagcttcctcatagtctcacggccgtaaacggcgagctgtctgctatgaagatcttcatcgatctcctgattgttggagttgtcgttaccaaactccgccatgctcatcaccgtatcgttaccaccgatgctgttgttcaaaccgatgctactggagttagaagcgttaatcgcagaaccatcagctgactcagtgtgatcgatccgtcgcttcttcatcggcgaagaagcagatgcgatgatgttctccttaacaacgaatggttccatatagagtaactgaaagagaatatgtatcaaataaacagaagaagcttcgaataacaaacaaagacaataaatgaattccgatgagaaggttcctagagctaatcgatgaaggaatctgaagaagaaacgagaatcggaggaaatgaaaacgaaaccgtacctttgagagaagatcggaggcgataagcggcgaatttgttgttaaagtagaaagagagagtatactaagcttttggctttgtaggttgtgtagaaagaagcggcggtatataacaaaaattgggcgatgattgttgggctttgaaactatttgtgctgaattcagaatcagcctgtgttgtgtggtaagttttttcgttttttcaagtggaccagtttaagataaatatctggttttggtcttgtaacattgaaccggatttgagtatgcaatagaccaaattttaattcaggttaggtgtgattgaatttaaactttgaaattgttaatcaatcaagttttgttttttatttgttgattgataaagagagagtagttgttggatatttgaatgtgtgtcgtacttgctaattcctaaagattaatagacatttcaaagaagtgtaataagagtgaaacttaagcataatgtgtggaaatgtaccttatgaactcaaccattttggtgtgagcatttgtgtttggaaaatgatatggggatgctctctctatcacttataccaacaaacacaatctatgttttatgtgtgatttctaaacgaaaaaaataatattaatggatttgtagtgtgactacattagcgtgaaaaaaaactcttgtatcttgagaatttgaccaacattgcttgacaagtatattcacggttgtatgataacgatgaaaaatgtctcacattatatttcttgtgtgaattggcgttggtaacaaagattgacaaggaccccttaaaaaaaaaagtcaagaaaaacattcaaaagacatagaatttcggttgaaccggattggtcagcttaaattactaacgtatggttggttaagcaagctgaggaaatgtgtctccatttcgtgatttcttcttccctcgcggggatttagtcttctctcttccagcagaaaccagaagaactgttcctcgcttactacgatccctaaccggacgcgaaatttcaaggttcgtcctcctcttaacttctcatcagttaatgtctcttttaagttgaatttgactagtatgattccaatttcagatgatagttaggggattttatctctcggatcgatcgttttgggttacaagaactaagatagaatcaaatgtttttgtttctccattagttaattagtctaagagatatagaacaaaaagtttcgcttctttcttgttatcttttgatgcacagaaaggtcatgaaacctagaactagggggagtgatcaatggtatttgtagccaaaactaaaaaaaaagtttgtttacctctactttgatcaattcgatgctagatcattgtttattcaatgtgtggtcctttcttcacccaatttctccaagtttccaactcatgaatacttgtagttttttataaaaaagaggaaaccttattggtgctcaagttatatgagtgatgattggattcactatcttactttccacttctattagtattgagataagtttagctacaactttgtcagttatcgttgaatctaatttgatttgtgaatattctttagtgttttttcatcacatg

SEQ ID NO: 22601 - DNA, 3003 bp, Unknown
  misc_feature (1)..( 3003): 2750-1469P.txt file - cDNA_ID_2106946; gDNA_ID_1620525; Annot_ID_159556
agtctcgcgattgctatctcaatatgtacgcggagaagaaacctgacaaggttgatcctaatgagcagaggctctccaaatggttgaattgtgctttgtctaacgagcctttggctgagccgtgcgtgattgatctccttgggaatttgttcaataaagaagttttggtgcacgctttgttgtctaagaggttgcctaaacaattctcgtacattaagggtttgaaagatatggtgaatattaagcttacgcctgttgctggttctgatggttcatcgcaagatacgactagtgcacagtttcagtgtccggtctcagggcttgaattcaatggaaagtacaagtttttcgctttgaggggatgtggacatgtgatgagcgcaaaggcgttgaaggaagtgaagtcttcttcttgtttggtgtgtcatgcggatgtcaaagattctgataagattgtgatcaatggtactgaggaggaagtagatttgttgagggagaggatggaggaggagaaagctaagctgagagagaagaaaggtgtctcaaagaagagtaagaacggtgctgctgtggtggctgatacaggtgcgaaggtcgcaaagagacagatagaggatgggaatgtcaatggcaatggtataactgtgaagaaattcaaggcggcggataaagtgccggttaatgctactaaggaagtctatgcttctctctttacttcctctaagaagaagtctgatttcagggagacttactcttgcaggtcacttcctctcggcaggaattgatttgttggatcaatgttgtttacctgctcgcttcatttgctctgtaatctgttttgattatattgatatatcaacttgcttttgtaatttcgcctactggataatataatgtttttcttttccttttgcaattggtaaaaacagtaaacatgtttgcatccactatgctaaaactagtaaaagtgttgtatcataagctgcaattgtaacaagaggatatgtatgttgtttacatcaatgcacgggtcaatggctttgcagctcaattcaaaatgttatatagtcatccaaaaacagatagcagatttgcacaagcagttcacataaagccaatagtttccagatcgtggaaactcgtgaccatagtactctcattggcttagccgtgcctctctcttaagcacctgtgcggcatagaagtaaaacaactgtcaagaattaagtttttcccacaaatctagatgaggaaaagagatgaatgtaggcattaacctcatcagcaaacttgatcaaaatagtagttcgaggacgttgttgtccttcaatgggtacaaaatgagccgttaccacagcaggaaaccctgcgttatccagaactccctacatagaggaaaccgtgtcaggctcattatcttcttcctctaccaattaaatttgaaccctattcgtgaatatgtcaagggagcactcaccttcactatgccagcaacaaacgctccgcagttgaatgttcccatgtcttttggaatcgaaatgaacctacactttcacatttgttatcagttttcttgaccttaaaaaaattacattatctcagagtgtttatggaaagagctggagcagtataaacctgttaacaagaagctccttttcactgatcatgtactcatcttcatgttctgttcctttttcaagtgaatcagcaacctatggcatgttcgttaagtgtgagttagaatccaggaacaggcatgtcgatagaaacactcaacaactaattgaatttgaaatcgccactcacctttccaaacaacactttccacacagtactgtgaacgaaagacagaattcccagtaaccgtgtctctcttctgtttccctgaaacaatgaaacaatatatccataagacatgattgaactctgcattgctcttccatgaacaaaactagaagtatggaaacgttcttttttttttccagtttttgaggcaaaacacacaagtaagaatatcagattgcaaaaataagatgtaccttttcccggttgcaaagaagctctagaactcgagatccaactgcatacccagcatcctctagtctgagagtcatcataaaagaaaacacattgttaaggatggaatgtaaatgaattagactaataaaaaaaaatcatatgtatttctaagaatccaatcagctcaccttctttcaagttcagctatattgtcaacctgggtttgattgtactgaacgagctccgagaataagaaagcaaatgcggtcaagctcacctacaacacaagtacagttccaaaacgactaaccaatcagcagatgctcgaaatcgaatgatcacaataaagagatcaaagaagaagaagatcaaaacccgagagatttgaaatcgaaccctcccacaactattagatccggatccaaattgaacaatgttctcaatttccatacttagttcagtgtaaaagtttctgaggaaagctccgaaattggaagagaaaagtggatctacgtagcgaaaacgtacctcttgcttgcctttgctgagaggcttgtcaaggacgttggagtactgtttcattttcccgactccgatcatattcttcggttttccggtgagaacgagcttcccagaaccagaaccctaaacacagaacctttcttagttttccggtgaaagaatctgaagatgcttttgtttattgcaacctggtttgtcttttggttcgatgaaagtacaaaaaaagagtttatttacatttttgttaatattaatttttactttttcactaatcctaattggggtagaaaaaaaaaggggtaaataagtgtataaataagaccctagcgatgataaaaagaagccgagacttgttgagaagaagcccttaaagcttcaccgtctctctctctctctttctcgtgagcttcaattcgaatcggccgttcttcttcttcttcctccaatctctttactccaatg

SEQ ID NO: 22602 - DNA, 2341 bp, Unknown; identical to SEQ ID NO: 1273
  misc_feature (1)..( 2341): 2750-1469P.txt file - cDNA_ID_2106958; gDNA_ID_1620379; Annot_ID_155257

SEQ ID NO: 22603 - DNA, 3003 bp, Unknown
  misc_feature (1)..( 3003): 2750-1469P.txt file - cDNA_ID_2106965; gDNA_ID_1620328; Annot_ID_153573
aattttacgtaccgcatcaggtgcatggcaagttgcttctattgcataaactgcatcgaaactgttttccgggaatggcatcttcatgaagtcagcctgcaagattaacaagtgacagcaaccttcatcatgttgtcctttgcaaggtgttttcttattcaaaacatgatttatagcttatgcaataattacaagaactatgtactcaactgaccttgacaaagttacatgtcttgtcgacacctgcaagtcggtttagttcctgcaaagagaaagatgccaatatgaattataatggacatagcaggaatgcatcatctttcacaaatgtagatacgttaccttgcctctggtgatctggtattcgttattgttgagcccggtaacaactgaattgctgcaacagagcaaacacaaacacacttcataattgaacaactatgttcctaaccataaaatctatttcaaaactcatgtatagtagaagcacatgatgaaaagagtgtgtgtgcgcttttggtatgtgtagtcattttacctgaatcttgcaatttccctcaacggtccaccaattccacatcctacatccagtacctactcagaaacataatggcaatgagcatctgatggcgatggcgaagggtccattttcaagtgttcggttaaggtttaacaaaccttttgtcctggttggatgccaagctgaagagcaagaaagtgctcgtgtcgcttaatactctctcgaagcgattctcctttccatctacaaacccaaaattcatgtcaatcaatacatatataactatagtatcagtagcatctatggctgtaagaaagaaagtatattgaaagtcaagaattacctttgtgcaaaatggaaggattctccccatccgtactcataaaagctagtagcaaggtcatagtacttattaacctgaaaatttaatcaggaaatactcattccaacaggcaatgatttgttaaagaaattcaatacctagcctagtgaagtagtactttaactattttaaatatgatctcctggaacaatataggcttttttagttgtcgcatattctcaaagtcaggagacacaactacaaggaacaggcgtgtctcaaggtggtgaaaattttataaaatgtaaaaaaaaaaaaaaaaaaaacatttttgaatttaccatgtcagtataattggcttttctctcttcctcgtttcctccatggaagacatgatattgctcatacctgaatcaccaaatcactaaaaattaataatgtccaggacaaaaaaaaaagtccaccaaataacattttttttttttttttaattcatagaactctgaaaaactttggccaaaaaaaacaaaccaattgttctatatagatagatagatgaagtcaatgacaataagattggtggtcgggccctcaagaacgtgacagtagtgaaatacacgtcaaatggatcttttatagagccaaaaacgaaactagggaccatctctcactcatcatttttcttttttctgctgtattgaaagctcagttccatgaagcattaaaaaccaaaacaaacataaaaacagaggcgaaatccaatgccatcatggtattcgtggaattggtaaaaagcgtaaacgtatggaaatagtaggctcaaaatatacgttgattccaaaaatatggagatgctacacaaaacaacaatcaaatcttaatcttaggagttgattatagataaaaaccaacgagatcaatatgcatgagacgaaaaaagcgaattgtaagtgaatcggagatggaaactacgatcaaagaagaagggagaagaaattacttttcgacggcggtgagaacatcggatttatcgatcttcccaccaagattcgacgcgagatccatagcacttatgcaacaacggacgagatctgcaaaaagtgagactgaatcagaataaggatcaaggagaaaagagaaatcggaatcggaacacacattggaggagacttacgagagagaggataaagatgaatcggagtggtggggaagagctaaagaggcacctgactggctttagtttataactagtaagatagagaggtcacaagccgtcaatcccagcttggcaatgagagtgtattaccattatatcctctctacttgtccaaattaattatgaaataattagagcctatataactctactctctagtgttaagcatattctccactatctcgtaatttattctagtataaaataaaacctttactatagaatctcaccacctaccaagaacaggcgcgacattcgagtggttaattggttttaaatctagatcaaagattgaatctacctactacttccttgatcttctgtttttgccatcctgattcctgaatgtttttaagtgtttgtagcaagaatatttgactttctactaactccaaacctggtttaaaattttgtgaaatattcaatggtttcaagagaaaaaaaaacttagaatttttttactagtccactacttcactcctactttaatctctaaactccaaattctgattcttaactcatactgtatggtctgtatatgtttatagtttatacacatgggtatctcaggaacaattgctatttttatttttatcaatattatcggatttgattacatgtaaaacacaacaacaatagttagtctatgtcaacaatagttaattagaaaatgactaatctacctatcatttaattaaaaagttatagattacgttgtgattaactagagtagtactaatagttagtctatgtcatgattaacgtaggaaactaggaattgaccgtttgggttaaaattccaaaggaaaaaccaacttcaaccacacaccacatatttctctcccgcctaatcctccgcgttcccaagccgacgcgccgatctttcttctactacttgtcctccggcaataacaaactaaccatttcgaaaagtaattatctatg

SEQ ID NO: 22604 - DNA, 3003 bp, Unknown
  misc_feature (1)..( 3003): 2750-1469P.txt file - cDNA_ID_2106980; gDNA_ID_1971791; Annot_ID_58034
cttgagtctttgatttatttattcttggggttattttgatatcaaattgaggaaatttggtttcaaaagtcaaatttttatttagtgagatttcataaaaacaaatagactctgtaattttgttttgcagaagttgaggattgagtttttttttttttttttgtgtacagcaaagtgtacaaactaaattgtgcttcctaaacttcagatttctttattttactacattttctcataaatatagaaataccatttgttggccaaaaaagaacgaagaacgaattaccacttaaagtgtataaataaatatttttcaataactcatcaatctctttttctttgacattgtatatggtagctcatgcatgagacagacagtaacactcgaaaaggtaatactggaaaatcttgaaagtaacaacactcaaaaaggttacaaagtaagtaccgtgtaccgagaggtctaaagactaatacatagaagatgatagaaacggcgtcgttttcgataatcatggttagatgccatgtgactgattagagccgtcatgacttaaaaagttaaaactcttttattgattttgtgtattatattagtttataaaactttgatcaaataattcatgtgccaactagcgattgacctagtttttttaatcaaccgaaacatgagtcaataaaatgtgcaatgtaactctctctccctctcttttttccagagcaaattaactagttaaaatgattcataagactcatcacatattgccacatctctctatagttggacgtcttaacgaaccctaatgatttttaggctttttagcttgtcgtactctaaatgacaattatatataatgtacgaaactttctagtttagacttaatttgatcatcaagacagaactattcatctagctgaatttaatattcaacccaagcgataacacaactataatagcaattattgacatattgtcatcatgcaaattgtaaagtcactagtcattgatgtaagatctcttaacaaactcttttttcaatatatttctaatgtgaaatcggataattataatatgtagaaaagttgatacaatcatttactttcaaattaattatcgtctaattcatataaaatcatgcgtagttgtggaactttatttactactattagtaacttattttactgttataatgaaattttgcgtgaaaagcttcttacttgtgaattaattcgcatttggcattacagtgacatgccttgtcgcttttttccagtttagtgtttttttaatcgtatattcgtatgagagaatatcattaattaaaaacgttaaaacaaaacattatcaactcaattattgacaatattacagcatcaaggaacatgttcgtgaccgcgacgcccatttttttattaggataattttcttacattttgttttattgtggatcccttaataatttcatagaaaactaaaaaaactgtccctaatacggcaatcagggatttaatcattttcttaacgacgattaaaattaggtctaatacattacaatatatgtatgaaaacgttgcatcgtctcgcatgacttaattgtctcccaaacatgtagtatttgatgatctttgacgtaatttttttttgttagagtatctttgatgtatatatttatcatccaatttataattagtagtgtaatgatatcacaatacagttcttacattttgaatgacattggtttccagatttaacttcatatgtcttgccaagtaaaatttgtacgcattgatatagtatcatggtcctgactttaagcattggcgatgggtaatgatattaatgaaatatcggcgaaatttcttggataaaaagaaaagattcgtacgcatgaaaccaatatgtgatgttggttccatattcacatagcatttgtaaaatttagaataaaatcgagtttacgtcagagccatccaaccattaccattaaaaattggatgaactgatgaacaggttgaaccagaaattgtcactcaaagttagagcttggttgataggttcttaagactaaacagttcctcatcagtatgtaatataatgaaataatttaatctctttgtgtgtaaggtgttaactggactaccactagactgaatttttaattaagtcttatcctatagtcttttcaataagttcacaattgcaagtacttaataaacaaaataattaatcagttaattatgacaaattagtcaacatccgatcacattccacgttgtaaagttaaattttaaggtagatactaatcatacttgtaaaatgaataagatgagttcttcttcttgtcacctctcgatcttgttttaagtagttggtgagatgtgataaacttgtaacatgccactgagttgtcaaagacaagcatctatacagttattaaaaaaaaaggttaagcatgtaaaaatacacacacatgtcgtagtaaatatacacctttttataattaattatattgtaacgaatttgttgttttgttataatatatagattaatgcatgatgttttgcgattaaagccagacgagttgtaatatccacagccttgataagctctacatgcagtgaacaattttatacatttagaaaaaataatcactatctcgaccatatagaccaggccactacattacagctaatctctggatttacttgataattaagacaaatatagaacattaaaatactaactcgatgcctcaccttagcctcctctcaaattgtcaatatctagatggagtgttacatccacattcctaacagtttttactctttattttaatatatccttcaacagatcatcatcagaataatcatcaaatcattattatatatttaactagcccaaattgtaccatacctatcaatttaaatttctctttctatctactataaaaagtgactctctaagaactccaaagattagaacattgaattgaattagccatg

SEQ ID NO: 22605 - DNA, 3003 bp, Unknown; identical to SEQ ID NO: 22604
  misc_feature (1)..( 3003): 2750-1469P.txt file - cDNA_ID_2106980; gDNA_ID_1971791; Annot_ID_175559

SEQ ID NO: 22606 - DNA, 3003 bp, Unknown; identical to SEQ ID NO: 22604
  misc_feature (1)..( 3003): 2750-1469P.txt file - cDNA_ID_2106980; gDNA_ID_2926197; Annot_ID_141331

SEQ ID NO: 22607 - DNA, 3003 bp, Unknown; identical to SEQ ID NO: 22604
  misc_feature (1)..( 3003): 2750-1469P.txt file - cDNA_ID_2106980; gDNA_ID_2926197; Annot_ID_201548

SEQ ID NO: 22608 - DNA, 3000 bp, Unknown; identical to SEQ ID NO: 7882
  misc_feature (1)..( 3000): 2750-1469P.txt file - cDNA_ID_2107008; gDNA_ID_1621171; Annot_ID_57253

SEQ ID NO: 22609 - DNA, 3003 bp, Unknown
  misc_feature (1)..( 3003): 2750-1469P.txt file - cDNA_ID_2107046; gDNA_ID_1620648; Annot_ID_163365
aacctgagagcggtggtcgaggctgctgctgatatcaatctcggtgagccagattgggagctggagcgtagcgagtttatcgaggatggctctcatcagcgctacgtttggcgtcgtgaagtgaccctcgagaccgattccgtccatccttatgccgtcgtaccgttggagttccctcaccctggcgatgtattcgtcaaccgttgacttctcgtcgctgcaagtctccaccacgttgaaatcattgaagaacagagtcgccaacgagtcaatctcacgaaccgcggcgaagaacccgtacgacgttcttccccagtctgctctcgtagaagtcgaagtgaagcatctcgttgctcacgtcccaatgcacgaactctcctctgtaccgagtcattagactcttgattcgccggttaaccgccgaccggagatcttcgccggttagattacgaacccagtcgggattgtatttgggatcctcccagaatatgttgtggccgcgagcgatgattctgttagctctgacgagattcatcatcttatcagccaatgtgtagttgagtttgccttgatcggactccgtcgcgtaccatttcagctcgttctcgaataccgtggcgtcgaatctcttgacgaaccattcctaccaaaacagaatccgtttaaagaagcaaagacattgttgttttagtgtagactttagcgagtgtgttttacttggtaaggaatgtttccaaggatagttttggagatggcagatccaatggggaagtctttagagatctgctctactgtcacctctgctccttcaacgctctctccgttttcttttgacacgtgaattgtcactgctcgttttctcgcttgaaaatgagtgttaagagggaaccacataaagaatacagtttgcgattttgatgttagaaatgagtgtgtgtattatgcaacatggtaaactattattgtgtcgatagtcttcctagctagaagagttaggcagcgtgtcctgtttatcttaacagcggtacaagacaagtatgagttgcatttcagctacaagagagtacaagagattgtctgagattaaggcattgttttgtgatacatcagcttaagctatatcatcatcaaaacatgaagaatgctccatgtaaagagaggacaaggttgcagttattaaagaaaagttcttggtggttcttttgggaataaaagaattagattgagtggctacatgaagaaaggagatgtgtcacacgttttggcacactttcttaagagttatgtcacagaaactcattcggatacattagaacgtgtgagtgaatcaaagaaacagtgaagagcatgcagcataactcatagaagagaagctgagcttacaaagacaaagtgacatccttttttttagtttctggtgaagctatgttcatggaggttgtcttaggtatgtagctcaatggatgagtcaaaaggctgcagaaaatgtttgataaagattcatggaagttcagtttaccaaaagaaaggaaagccaagaataactggttatgaacaagttcaaaggttataaatctgtgggtaaaaggactcttacggatttgtttgaaggtcgttgattggttaagatattcagaaacgaattgcagatctctagagaattgcaggttttcgaaactaagttgcagatcctagaataagttgcaggattctgaattattatgttttttagggctgagtaagctaagaagaggttattggagtgattcagtgggattcttagaagaagaaaatggaagagacaagtgcaagtgctgcatgaactgtctcaaggctactcacttcaataatgtgaaagtgtcatgtatctagtttgataaacgacacatctcaatgctggtggcagtggctgaaaagaagctctagaaggaagcaaatgcaagaaatttaaactgcatttagaagacagtaactaaggagtttgagttagctgtctgcatcatgagaagattacataagtaactactcaagggaaattcactcgcaggttagtcaagtgaacggtttttcaaagtatcagagaatcataaagaagacaaaggctctagtaccaatttttctgttatccacctgttttatatatagatttgaagagatgagatttttaaattgctacaaaagagagagtctacaatttcacaagcttgtaccaatttcagcaaaatgattggacaaacttgtaccaatatatttaacatgtttagaaaatattcaactcacttagtttgatttcttcagctgcgattctttgaatcaagttttcagttataagcttcaacctgtaaaaatggctgcagaacaaaatgatgaggaaattttttagtatcacaaagtccagattcaagttttttttcaattgtatctaaaacacacacaactttcagattgaataaaatctgaatttcattctcagcaggggctaatataaaaatgacaaaaggagaggaggaggataggagctatatgtctactatttttagttttttagccaatgagagagctccacttcataccccacttttaccgatcgtgccatttcacagtcactctcacccatgtcgcgttgagcgcgtgtctacgatttctaaagggggttaatccacaaaaatcattcatttttcgatccacgcacctcattctcaaaaacccgtcgcgtgtcttatttttttttgttttcttctctaaaccaaagtaaaccgaaccaagatcaatttgaatttcaaaaccaatgtaaacccataaaacccatcgctgtttcactttcactatccaattccaacgaaccagattgataattttgattcgattccacacagagatcataatctaaaccaatgcgattaataagagagccaaatcttacagtatagcttaaaatcttagctaaatcccaaaaacacgagattctaggcgaaaagagaagaaaaaaaaattgccagaatg

SEQ ID NO: 22610 - DNA, 3000 bp, Unknown; identical to SEQ ID NO: 3866
  misc_feature (1)..( 3000): 2750-1469P.txt file - cDNA_ID_2107050; gDNA_ID_1620671; Annot_ID_164103

SEQ ID NO: 22611 - DNA, 830 bp, Unknown; identical to SEQ ID NO: 3085
  misc_feature (1)..( 830): 2750-1469P.txt file - cDNA_ID_2107050; gDNA_ID_1620623; Annot_ID_162384

SEQ ID NO: 22612 - DNA, 3003 bp, Unknown
  misc_feature (1)..( 3003): 2750-1469P.txt file - cDNA_ID_2107050; gDNA_ID_2926200; Annot_ID_201803
cctgtaaaaactttttccctggaaggcatttatcgagggcaagaaattttgtcactgacccatcattcccgtgttgaacagcagcagcaaatttgcaatgtaaatgagctgaaaaccaatattgaggcttcagtttttctagcagtagagccgctggtttacttccaagagttttttcctcgatctgtaataaattttggtcaaatcaattgaaaacctctcaaaaccaaaatgaagaagtagaatcatgttcccacagatttacctcttgacgaaagtatggtttttgccgcataagtgattctgagtctccataatcagtgattccaacaggccaatcatgtgatagaaatatatcaagcggctcttcaagttgcatcaacttctggacatcatagtcacgaacatgatagaccgatctgatggtgctctcgttatatggtggccgctcaaagtgtcctactcacacaaatgactgattctcactttattgacaccaaacaaatcaaacgaattccctaatctatacatttccactatagacactaactcagaaatccaactttctcccatttcaaaagctgaaaaattggtactttgtcagagagatgaagaagaaacaaacctgaacggtaatgacgctcattgtatataccagaaaggccaccaattcgcacattaccaaacttgacaactccagcaaaacccaaaaagtaaatattggtggcagcccaacccccataatacctatagcacaacaaccagcaaccatcaagaacacattttttaagcctcggaatcctaaactcaaatactagataacttacaattcccataagtagttagaagcctcatgattcccaccaatgaaaattgtgggaatcggagcaacttcttggccggagtagtacttccagaaagatttcatctctctgtattttctaggtacgttaaggctatccatgtctttctcatttctaacagcctaatgttttccacaaagaacgaatcttttcagacttaggaagcagaatcgaatggatttttattttcaaggtaaaaaaaaacaaacgattacctgaaaatcgccgcagcagaggaggagatcgactttagtgttgtgaatctgttcgtaatgttgaattgttttatacacattgtctaggtctccatgcatacaaccttcaattgcaatcttcatctctctgctgaattctactattctcgggtttcactaattcgacgagctcaacttacaaatttgaattcgtgccgtgagacgaacaaacgattagtggacaaggaccaagaaagaggcagaagaattgagtaagaagagcagagaagaagcgtggatttagggttgtggattttgagaatcaaaactgaggaagaagaagaacaaaacgatgtcgtttcaataaacaccaaaaccacggtcgtttcgaagagaagagtcaaataaagaaaaaacgcgggacggcggcgcggaatgaagaagaacaaccaaaagcccaaaagctaaaattgaaaataaatttgggttaggcccaaaagcccactaaacattttccatgtgtactgcgagttttgattttagtccgttaaaatagggcctattataagaaatggtctgtctttctttttttgataatgggttaaaatcatagttgcaacagttgattatgagtttgatatataaataattttttgtctgttaatttttctcgaaactaaacgaatgtgagggatatcctaggttttgcacctatatttgttagatattagaataattaaattcatgttcgtcgtagtttccttgtaaaacacgttttgttttagaatctaaagcatgtgaaaggcatgcctcgccaacttttagttttcacaccatgcgtgcctttttcttgttctttggtcggtcgtagtcttcttactaataacgaattctattccatgacgagttccttccacttttctcctttctaatctaaaccttttataaattattgattatatctgagtgagtagctcaaatataactataaataacaaaagtacctcaaaattatagtattaaggtataggaacgagtggagaattggaagcatgaaacacatgtgcatcagaatgccaacgttgactcacgagttttgaaatcttaatgaattcgataaatcgtctgagtcggattatacttcgttttttcataactctttttcagatacaagaatcggttgtttaagaaaaaaagaaaaatcgctgtttaatgaatcattttaccaaagaacccatgtagactatctatatctatagtattataccatgtggcttggatcgggtccgaagtactataagcctaaggcggaaaatcttttggttgagagaattgagctaaaatatcaatccagtatataaaaaacatataccgtatctctattcattataagttggttaaaaccattcccaaactcatgataatcactctctcaccaaaaaacaaaaatcaaataaactgatatatatatatataagaaaaacttgaacatttcctcacattgttactctagattttaaaggtgatagtgatacaatggctgataaatgtgctaaaatttgaaattaatttgtccattatgccgacatccatttataagcttttaacatgatactagaatcaacaaataaatatttttattattttatttggaaactattaatgagtacacgatatttacatttacataaattggttgattggttacctgaattttggtagaaattgcccacagaatattcggataagtatttcggtttagccaaaagcagtgtcgtcttcttacacaaaaacaacaaaactccaatcgtcctccctcgtcctgaatccatccatcatccactctcctcttaaaaatcctatctttgtggtttgcaatctctcccacgacgcgcttcatcattcatggctatttgaatctctcttctctctctctatcaaatatg

SEQ ID NO: 22613 - DNA, 3000 bp, Unknown; identical to SEQ ID NO: 8500
  misc_feature (1)..( 3000): 2750-1469P.txt file - cDNA_ID_2107183; gDNA_ID_1971813; Annot_ID_58162

SEQ ID NO: 22614 - DNA, 3000 bp, Unknown; identical to SEQ ID NO: 8500
  misc_feature (1)..( 3000): 2750-1469P.txt file - cDNA_ID_2107183; gDNA_ID_1971813; Annot_ID_175836

SEQ ID NO: 22615 - DNA, 3000 bp, Unknown; identical to SEQ ID NO: 8500
  misc_feature (1)..( 3000): 2750-1469P.txt file - cDNA_ID_2107183; gDNA_ID_2926218; Annot_ID_142322

SEQ ID NO: 22616 - DNA, 3000 bp, Unknown; identical to SEQ ID NO: 8500
  misc_feature (1)..( 3000): 2750-1469P.txt file - cDNA_ID_2107183; gDNA_ID_2926218; Annot_ID_203140

SEQ ID NO: 22617 - DNA, 3000 bp, Unknown; identical to SEQ ID NO: 4592
  misc_feature (1)..( 3000): 2750-1469P.txt file - cDNA_ID_2107235; gDNA_ID_1620716; Annot_ID_49119

SEQ ID NO: 22618 - DNA, 3000 bp, Unknown; identical to SEQ ID NO: 4592
  misc_feature (1)..( 3000): 2750-1469P.txt file - cDNA_ID_2107235; gDNA_ID_1620716; Annot_ID_165646

SEQ ID NO: 22619 - DNA, 3000 bp, Unknown; identical to SEQ ID NO: 4592
  misc_feature (1)..( 3000): 2750-1469P.txt file - cDNA_ID_2107235; gDNA_ID_2926190; Annot_ID_140998

SEQ ID NO: 22620 - DNA, 3000 bp, Unknown; identical to SEQ ID NO: 4592
  misc_feature (1)..( 3000): 2750-1469P.txt file - cDNA_ID_2107235; gDNA_ID_2926190; Annot_ID_200970

SEQ ID NO: 22621 - DNA, 3000 bp, Unknown; identical to SEQ ID NO: 6661
  misc_feature (1)..( 3000): 2750-1469P.txt file - cDNA_ID_2107285; gDNA_ID_1621100; Annot_ID_55837

SEQ ID NO: 22622 - DNA, 3003 bp, Unknown
  misc_feature (1)..( 3003): 2750-1469P.txt file - cDNA_ID_2107289; gDNA_ID_1621135; Annot_ID_56536
accagaaacagaattatttctcaagattttgtggttacggtttttgctgctatcatatccgaaagcatacgagcaaaagttctgataactctcgaacaagctacggttttgaatcaacctagtttcccccaagtacatgttacataccatgagcgtgtagttgctgtagtggttattggagatgcaaaacaataagccgtcgcagtgaaagagttgagatatcgcgaatccatcaaatgcacttacttgattcactgatgtgtcaacaaagtcatcgccgccatttaggtccagcttcattgaacagatcttgtcaccaatgaggataaaccctacgtgactgcttttccttgcggttgctttaccacctacaagattggttttcgatgaagcctcccatttcttgcacgttgatcggagtgatctaagagatgtaatgggaaccctagcgagaatctcgtctaccaaaaccactggaagggttgacatcgtcgtcgtcatttctctgaacttcagaaaaaccaaggactgttaggggttgtttcgtttttgggttcagtgtagccactagacaaatgtgttagtttacgatttaagggtaagaaatcttttctaaattggcaataaatgcttaatacagaaggaaatctggaaaagattttaattatttttggtggattttattccatctttgtatccctaatctacaaaggtgattggttaaaatgactaacagtaatcttgttcaaaaggacgttacacgaaacaaaaggagatgatgcaagaagaaaaaaaaaaattattgtaatcagtggaactaatttaataatctctctcgttacttttgcccggttgatagattcttcgtatatgcactaaacttggaacgtaagaagagaacacaagtggatcaaaataatatctaaacattttaggtttcgagatgtgatctgttccgattttcacaacagatttgtccaatgatgttaactgtttcgtatccacagttttcgttcggtctatacttacgagatttggaaaccacaacaactttcttctcctcgtcgatatagaagctctcaacacgaaatttactcgaaaaatcagagagcgatgtcctttccattgtgaagaacttggtccatgcatgatactgcattggactcaattttagtcgttatctccatgaccaagtccaaacataagtcgtagggttgatataacatagcgagctgctcttctctgatacaagatatatagagtcacagtctcttcatcactagagtgaaacggaagaggaagacgcggtccaaacctttctgatgtaaaatcaaaacagagtaaaaaaacaatacgatttgaaactgcatggctatctgacttctttttgtggagcataataataagtatttcccttcaaagacacaccgttgttgttgttgttgttgttgttgtttgtcgtaaccgaaagcatacatgtctaatctgtggaacttatggtatttgcttcttggttggatccacctgaattccccttaataagggttccacaccatgagcctccttctccttttgtgtatgacgcataacaatcaagccgtcacagtgaaatatattagatatatcgtattgatcaactatatatatttcctttaaagatggatcaacgaaatcgttgttgtggattccttggagatcaagtctcagggaacaaaccttagaatacattactacgaaacctagaaattgcttacttgtatctgctttaattaccaaaaacataattttccgacaaaacgttccaggataaagtgttccacgttgtacaagtacattgcacttcactcagagatatcaatggaactctagagaatatctctcccaccaaatctactgaaagatcggacaaagtcgtcattatttgttcgtctccttaaatgatgaagtgagagacgacacttgtatattctttgctaagaaccgtcatttgtgatcaaagaacaacttgaccaaatgatagatacttattgttctggtatttacaacattaagaactaattacaacttaatgaagaacagaacttgctggtctttgtgttagtctgactgtagaccataagtattagagatcttaactcattcattgatctgtaaataattcacagaactaacaactccttataaagcaaacaaaaaaggaccaatccaaaaacttgaacttttcctactatatacatcttcaaaattagctaacaaaagaaattaaaacttcaaacaagaaaaagatctaagaacaaaaatatcagtctcaaagattgcttgcggtgtacgtcaaagagagccagaagaagatatattaggttccaatctcatacttgaaccaaccttggtttcaagctttcattagtaatttcgagagcgagtcaaggtttgatcatccaatgggtggcttagcgattccttgtcctgaagatacctacatcactgcaaatccaacattttgttcttccgagttgaaaaatagacttactcattttaaacgtaggagtttttccccctcttcttcttaaagtttgaagatagaatgacaggtttttgcaatagacatgatcatgttcatgtcaatacatttaggatcgatcttagaaaaagaaagacaatagactaaaactagtcatctaaattttattgccaagagatgtacttcgaaaatgctagtatagattttagtctcttgacaataaaattttgtataaaatttgtctcctaaatagtatgtttttgtttttgttgtattccccaacagctaattctgtcttctggtatatgggtatacttcggttagtttcggtttgattacggttcacctttcaaatttaaacattgaaattgtaaaccatcttctttgtccaaaacgatgtcgtataataataacacgtagccgttaaatgaaaaccgaagcgtcaaaaaatcaaaatcgataaaaactaattagggtaaatg

SEQ ID NO: 22623 - DNA, 3003 bp, Unknown
  misc_feature (1)..( 3003): 2750-1469P.txt file - cDNA_ID_2107289; gDNA_ID_1621135; Annot_ID_172621
gctgctatcatatccgaaagcatacgagcaaaagttctgataactctcgaacaagctacggttttgaatcaacctagtttcccccaagtacatgttacataccatgagcgtgtagttgctgtagtggttattggagatgcaaaacaataagccgtcgcagtgaaagagttgagatatcgcgaatccatcaaatgcacttacttgattcactgatgtgtcaacaaagtcatcgccgccatttaggtccagcttcattgaacagatcttgtcaccaatgaggataaaccctacgtgactgcttttccttgcggttgctttaccacctacaagattggttttcgatgaagcctcccatttcttgcacgttgatcggagtgatctaagagatgtaatgggaaccctagcgagaatctcgtctaccaaaaccactggaagggttgacatcgtcgtcgtcatttctctgaacttcagaaaaaccaaggactgttaggggttgtttcgtttttgggttcagtgtagccactagacaaatgtgttagtttacgatttaagggtaagaaatcttttctaaattggcaataaatgcttaatacagaaggaaatctggaaaagattttaattatttttggtggattttattccatctttgtatccctaatctacaaaggtgattggttaaaatgactaacagtaatcttgttcaaaaggacgttacacgaaacaaaaggagatgatgcaagaagaaaaaaaaaaattattgtaatcagtggaactaatttaataatctctctcgttacttttgcccggttgatagattcttcgtatatgcactaaacttggaacgtaagaagagaacacaagtggatcaaaataatatctaaacattttaggtttcgagatgtgatctgttccgattttcacaacagatttgtccaatgatgttaactgtttcgtatccacagttttcgttcggtctatacttacgagatttggaaaccacaacaactttcttctcctcgtcgatatagaagctctcaacacgaaatttactcgaaaaatcagagagcgatgtcctttccattgtgaagaacttggtccatgcatgatactgcattggactcaattttagtcgttatctccatgaccaagtccaaacataagtcgtagggttgatataacatagcgagctgctcttctctgatacaagatatatagagtcacagtctcttcatcactagagtgaaacggaagaggaagacgcggtccaaacctttctgatgtaaaatcaaaacagagtaaaaaaacaatacgatttgaaactgcatggctatctgacttctttttgtggagcataataataagtatttcccttcaaagacacaccgttgttgttgttgttgttgttgttgtttgtcgtaaccgaaagcatacatgtctaatctgtggaacttatggtatttgcttcttggttggatccacctgaattccccttaataagggttccacaccatgagcctccttctccttttgtgtatgacgcataacaatcaagccgtcacagtgaaatatattagatatatcgtattgatcaactatatatatttcctttaaagatggatcaacgaaatcgttgttgtggattccttggagatcaagtctcagggaacaaaccttagaatacattactacgaaacctagaaattgcttacttgtatctgctttaattaccaaaaacataattttccgacaaaacgttccaggataaagtgttccacgttgtacaagtacattgcacttcactcagagatatcaatggaactctagagaatatctctcccaccaaatctactgaaagatcggacaaagtcgtcattatttgttcgtctccttaaatgatgaagtgagagacgacacttgtatattctttgctaagaaccgtcatttgtgatcaaagaacaacttgaccaaatgatagatacttattgttctggtatttacaacattaagaactaattacaacttaatgaagaacagaacttgctggtctttgtgttagtctgactgtagaccataagtattagagatcttaactcattcattgatctgtaaataattcacagaactaacaactccttataaagcaaacaaaaaaggaccaatccaaaaacttgaacttttcctactatatacatcttcaaaattagctaacaaaagaaattaaaacttcaaacaagaaaaagatctaagaacaaaaatatcagtctcaaagattgcttgcggtgtacgtcaaagagagccagaagaagatatattaggttccaatctcatacttgaaccaaccttggtttcaagctttcattagtaatttcgagagcgagtcaaggtttgatcatccaatgggtggcttagcgattccttgtcctgaagatacctacatcactgcaaatccaacattttgttcttccgagttgaaaaatagacttactcattttaaacgtaggagtttttccccctcttcttcttaaagtttgaagatagaatgacaggtttttgcaatagacatgatcatgttcatgtcaatacatttaggatcgatcttagaaaaagaaagacaatagactaaaactagtcatctaaattttattgccaagagatgtacttcgaaaatgctagtatagattttagtctcttgacaataaaattttgtataaaatttgtctcctaaatagtatgtttttgtttttgttgtattccccaacagctaattctgtcttctggtatatgggtatacttcggttagtttcggtttgattacggttcacctttcaaatttaaacattgaaattgtaaaccatcttctttgtccaaaacgatgtcgtataataataacacgtagccgttaaatgaaaaccgaagcgtcaaaaaatcaaaatcgataaaaactaattagggtaaatgtcaacaacaatccgatttctgagaattgtcacaagtcgagcaatg

SEQ ID NO: 22624 - DNA, 3000 bp, Unknown; identical to SEQ ID NO: 3895
  misc_feature (1)..( 3000): 2750-1469P.txt file - cDNA_ID_2107309; gDNA_ID_1620673; Annot_ID_48178

SEQ ID NO: 22625 - DNA, 3000 bp, Unknown; identical to SEQ ID NO: 3895
  misc_feature (1)..( 3000): 2750-1469P.txt file - cDNA_ID_2107309; gDNA_ID_1620673; Annot_ID_164155

SEQ ID NO: 22626 - DNA, 3000 bp, Unknown; identical to SEQ ID NO: 3895
  misc_feature (1)..( 3000): 2750-1469P.txt file - cDNA_ID_2107309; gDNA_ID_2926200; Annot_ID_141456

SEQ ID NO: 22627 - DNA, 3000 bp, Unknown; identical to SEQ ID NO: 3895
  misc_feature (1)..( 3000): 2750-1469P.txt file - cDNA_ID_2107309; gDNA_ID_2926200; Annot_ID_201770

SEQ ID NO: 22628 - DNA, 3003 bp, Unknown
  misc_feature (1)..( 3003): 2750-1469P.txt file - cDNA_ID_2107426; gDNA_ID_1620639; Annot_ID_47447
caagagcagaatctctctcttgctaagctaagaaaacatgaaaagtggaataaatatttttaaaagaaagaagagtatagctcatacatgtgtatgcattggttaattgggggtatgttgctttgatgattgtaggaaggtacttcacttgaatagaggggattcttccctttatcttttgggttcttcacaatctaatctattagcttttcttttcatgcagtatttttcttgttactctaaacctcttccaaatcttcttggatattctcatatcattatgattccaaattcgtttctctttattaaaaaccccaataagaattggattctcatggttttcgatacgttattcagccatacgacgactatgagtgattctagtgagactaattgaggattttttttttctatttttacatgagaatactgaagatgtttaatttatctctgattaaatataatccattatacagcatattacgataagtaacaccgcctcgtttgtttttgtttagctagtaaaccgaaattttgatcgaatacattatataaaaattcatgtaaaatactctacaatataatactctcttgtagtctgaatgtaattataaaaaaatgttttgtgtagacattaggtaaaccatctagagtattagaaacaaaataatgtaagtaaacgtaaaactaagacgatttcatgactaaattattttgaaggtcgaaccaaccaatcttaaatacacatatatgaagaaatatatgttttcgaacaaatggcaatcaagaaaatgctttttgtgtgttaatgaaatataaggttgacacatcaatatcgcgttgatattctcattgtagattgttggttatgtagggagactaataatgcgaactagaaaaagatatgtgagtcaactaaggttagtgttgatatagcaactctcttatgtttttaaatttgccataaaataggttgttagtccaaatagccgatataaacatcaatagaagagtaattaatcgttccatcggaacatccgatgaaattggaacgagacctatacagaagaaaacaaaagagcaactaatcatcttgatcacatgcccaatatgcatttaagtaaattggagagaatgatatagaaaaacaagacattatctacaactacaagatatcaaagcactcggttaaccgcgtccctgtgaagtgttagttatcagtacatgaattgtgatttcagcatcttggtccttttttttttggacaaccgtcatctttttcttgatcggtttttataacgtacaaacatatactatttcaacagttttcttttaattttttttttttttgaatatacactttctttcttttatttgtttgattacaaaattttcaaaaaatagtgttcggcaaaaaaaaaaattagatcggccaatgcattatatcccctagcgtaagctctttttcaaccaatcgagagtccatgttttcaataaaaatagggttttattagtaacagtagttaaagcatttaacatacgtaatcccaaaaaaataaaataattctgtatagggacgaagactagtattcgttgacgacaagagtagagtagactctagctagctgcaagttttgaagaaatctaataaccaaatctaagtcattttacttacatcatcatggatcatcattaaccacatgaggctgagcagatatcgaacgtgtgattgcgatgtggagaagtaaaggacgaggccacgcgcaactgagcaggagcgcgtgagattcagggttttagggcagagatacggaaagagacagaggttttatagcattatattgaaagagaacaaataaaaataaaaatatgagcctcgtgatcggagatttttgcagtgatgactgtactcttcttcctcttctctcccccttgtcacgtgggctaaattttgaccacccttcttcaatgaccatcaacatcgcatcacactctctccttcttcttcttctacgttttttattttctgttaaatttcctccacaaaatcgataatttcaattttttcatacaatatcatagttctagtaaagtaaacattcgtgtgtgagtgacataataattgcttcaaaaagaaataacgaattaataagagttgtgtgcttgatggtccaaaagtcgtatgtttttcaccatcacaataagatttaccatatctacttaaaccaaacttcaatctatgatatttggaagctagcaatgaatgattttgttttagcatatgttaccgagcctattcatctttagattgaaagttttgtgtccaacaactagcaaacccttcgctttttaaaccaagatcagtttttctacatagtttcgactttttgttattttacttcccatcatattttgttttatttactactgacattttcataatgtacggtacattttcatatattagcatccttatctaaaagctaatcaactccataacgtacttgaaatagggatattttagttgaattattcaaaacaatcacacagtgacacagactctatgtagaccaagcatgtgttatgtaattagaaaaaataaactgtgattaaaatatcttttaacttgttaacttggctgcctaaagaaacttgatactgtatcatcgttcatcgtattttgtaattaataaaacataaaaaagcaaggaaaacccatttgagtaaatgatatattaatattacttcgtaaaaagctgcgtccccacatattctattgattttaaatactattcgtattaatataaacctgcatataagcgtacatatacatttctgattctatatataggtgtgagaccttcttctccattctacacttcactccaacgtgaaacctgcaaactgaacttatctcttcatattttctttagcttctcttaattttacacttagggttttcaaaccagtagagagagagagaagtgtgtaagagcgatgatg

SEQ ID NO: 22629 - DNA, 3003 bp, Unknown
  misc_feature (1)..( 3003): 2750-1469P.txt file - cDNA_ID_2107426; gDNA_ID_1620639; Annot_ID_162986
attcaagagcagaatctctctcttgctaagctaagaaaacatgaaaagtggaataaatatttttaaaagaaagaagagtatagctcatacatgtgtatgcattggttaattgggggtatgttgctttgatgattgtaggaaggtacttcacttgaatagaggggattcttccctttatcttttgggttcttcacaatctaatctattagcttttcttttcatgcagtatttttcttgttactctaaacctcttccaaatcttcttggatattctcatatcattatgattccaaattcgtttctctttattaaaaaccccaataagaattggattctcatggttttcgatacgttattcagccatacgacgactatgagtgattctagtgagactaattgaggattttttttttctatttttacatgagaatactgaagatgtttaatttatctctgattaaatataatccattatacagcatattacgataagtaacaccgcctcgtttgtttttgtttagctagtaaaccgaaattttgatcgaatacattatataaaaattcatgtaaaatactctacaatataatactctcttgtagtctgaatgtaattataaaaaaatgttttgtgtagacattaggtaaaccatctagagtattagaaacaaaataatgtaagtaaacgtaaaactaagacgatttcatgactaaattattttgaaggtcgaaccaaccaatcttaaatacacatatatgaagaaatatatgttttcgaacaaatggcaatcaagaaaatgctttttgtgtgttaatgaaatataaggttgacacatcaatatcgcgttgatattctcattgtagattgttggttatgtagggagactaataatgcgaactagaaaaagatatgtgagtcaactaaggttagtgttgatatagcaactctcttatgtttttaaatttgccataaaataggttgttagtccaaatagccgatataaacatcaatagaagagtaattaatcgttccatcggaacatccgatgaaattggaacgagacctatacagaagaaaacaaaagagcaactaatcatcttgatcacatgcccaatatgcatttaagtaaattggagagaatgatatagaaaaacaagacattatctacaactacaagatatcaaagcactcggttaaccgcgtccctgtgaagtgttagttatcagtacatgaattgtgatttcagcatcttggtccttttttttttggacaaccgtcatctttttcttgatcggtttttataacgtacaaacatatactatttcaacagttttcttttaattttttttttttttgaatatacactttctttcttttatttgtttgattacaaaattttcaaaaaatagtgttcggcaaaaaaaaaaattagatcggccaatgcattatatcccctagcgtaagctctttttcaaccaatcgagagtccatgttttcaataaaaatagggttttattagtaacagtagttaaagcatttaacatacgtaatcccaaaaaaataaaataattctgtatagggacgaagactagtattcgttgacgacaagagtagagtagactctagctagctgcaagttttgaagaaatctaataaccaaatctaagtcattttacttacatcatcatggatcatcattaaccacatgaggctgagcagatatcgaacgtgtgattgcgatgtggagaagtaaaggacgaggccacgcgcaactgagcaggagcgcgtgagattcagggttttagggcagagatacggaaagagacagaggttttatagcattatattgaaagagaacaaataaaaataaaaatatgagcctcgtgatcggagatttttgcagtgatgactgtactcttcttcctcttctctcccccttgtcacgtgggctaaattttgaccacccttcttcaatgaccatcaacatcgcatcacactctctccttcttcttcttctacgttttttattttctgttaaatttcctccacaaaatcgataatttcaattttttcatacaatatcatagttctagtaaagtaaacattcgtgtgtgagtgacataataattgcttcaaaaagaaataacgaattaataagagttgtgtgcttgatggtccaaaagtcgtatgtttttcaccatcacaataagatttaccatatctacttaaaccaaacttcaatctatgatatttggaagctagcaatgaatgattttgttttagcatatgttaccgagcctattcatctttagattgaaagttttgtgtccaacaactagcaaacccttcgctttttaaaccaagatcagtttttctacatagtttcgactttttgttattttacttcccatcatattttgttttatttactactgacattttcataatgtacggtacattttcatatattagcatccttatctaaaagctaatcaactccataacgtacttgaaatagggatattttagttgaattattcaaaacaatcacacagtgacacagactctatgtagaccaagcatgtgttatgtaattagaaaaaataaactgtgattaaaatatcttttaacttgttaacttggctgcctaaagaaacttgatactgtatcatcgttcatcgtattttgtaattaataaaacataaaaaagcaaggaaaacccatttgagtaaatgatatattaatattacttcgtaaaaagctgcgtccccacatattctattgattttaaatactattcgtattaatataaacctgcatataagcgtacatatacatttctgattctatatataggtgtgagaccttcttctccattctacacttcactccaacgtgaaacctgcaaactgaacttatctcttcatattttctttagcttctcttaattttacacttagggttttcaaaccagtagagagagagagaagtgtgtaagagcgatg

SEQ ID NO: 22630 - DNA, 3003 bp, Unknown
  misc_feature (1)..( 3003): 2750-1469P.txt file - cDNA_ID_2107486; gDNA_ID_1621099; Annot_ID_55815
aagaagaaatagacatataattataatctctagtagagatatttgtactagtagtctatgcacatgatgtgtaaaaccagtggaagataaatgagtctttatgtgaaagaatagtgaaattaatgagattttcacaagataagaaatgtattatgaagagatatattctcttgtggtggatgtaatatttttaagtatctaaagtctgacaataagagacagaacactggatatgacatttatatgaaattattgaaagatataatctctgaaggattaattatatgagaattatgttctctagaactctactcgatcgaataaaaagaaatatgtaacatgacatataatcatataaatgtatatttatgttgagtttgtcaaaatatattgatcaaactaatatttgttttgaaaatcattaaaactcgtacagagttatcataagtaatacgatgacaataatctatgataaaatatcactagataatgatatttataagtctatatgaaaaccatataattttgatcattaagattatggttattaattccaacgagatattgtatttgattgaaaatcatctccttaagaagatgtttccgagggggagattgaatgatatgcgtggatgtaccctttttccttatcatagtttttatcccacatgatttttctatgacaaagtttttaacgagacattaaagaacacgcaaataatacacttgatgaatattaagaaattctatcaatcatccaaatgaatattatacactaatgatatttagagaaataaataagatggtcaagatgaatcatctaaaagattcatgagcagaagaatgacgttgtactttatccagaaatttgttcaagagaagatttggcagacttattctcaaatactgtttattctctgccacatcttctaatcatgcagagattttactaattcatgaagctagccgcgagtgtgtatggctaagatccatagttcaccatatacaagaagactgtggtatgtatgcagggaaaaaaactccaacaattatgtacgaagacaatgcagcatgcatcgcacaactcaaagacggatacatcaaaggcgatagaataaagcacatcctaccaaaattcttttacacacacgatctacaaaagagcggcgatgtacgagttctacagatccgttcgaatgataatctggctgacttattcaccaaggcgctacctactgctactttcaagaagttagtctatcgtatcggattacgccgtctcaaagatctcgacgaatatactcataagggggagtaattgtatgttgcactctttttcccttaaccaaggttttcctattgggttttcctggtaaggtttttaatgagatagcatttcaaatactttacgagttatggtactataatggtcatcaagggggagtgttatgaataaagatggatgcccattataagacccatcatctaagcccatcatttagatgtttgtagagttttacctttttcttgtactcctatataaagaacccttttctcaatagaaaacacactcatttcttctatctctttctcaagagaaatttattttcaacggatacttgtgacttttggagactcgagaatctaaacaacggcgatctacaaagataaagagttattgagctcactatgccaagttctgaaaaggcccacttcaaattataaaggcccagtttaagcccactatggaaacgagacagaagcaaatgggtataatcttcaagtcaagcgaacgatcggtgacggtgttatcttaccgccggagccggagtttcccactctattgtaataacagatatttcgaccggagtttctaagtgaatccaaatttgttgttcttcgttgcggctccatctctcgctgtgtatttatagtcaggtcttttgagttatcccattttgcgcgatcccgtcttcaccgtttccatcttccagcgagcacatctctgttgatcgataattttgtacctagttcaggttagttgcgtaattatacttgtgtaatttctttttttggattctctctgaactgatttgctgggcgtggaccttcggttttgttcatttcgtagtcctctatgcgaatgtttccagcgtttgatctttagatctgtagttcgattgtatgcttctaatagttattcgttgtcttgtacatttgatctataatgagaactgatgcgcggttttagtcgaacgcgacatcgtagttcggattagagagtgtactaatctttgtttaacaaagatggcatttcatcttttgactgtgtgatatgtcaaacccgcagaatccataaaactagtttactttgatatgttttgttcttcttcattgaatgtttgtgtggtgtcttgtagttgtaggaaagatgaacaagctgttggaatatgggagaaaagctatgttctatgtgagagttctctccggctatgaagaaaggagaatccggagttacaggttgcaactcgaaaagcgtatccagcaggtttctttctcaccatgcctctatctaatttcttagcataaatggtagaataagatgataaaaccctgctttggactatagttggtcgcataaatttgaagaaccctgtctataaacattattacccttgtttttattcattgttaatggaagtcaatatgtgtacttctagtttatgataattgaataatatctataaattagaaaagcttagtacttattgtacattgtgaagactgctgaaataagatcttccttacattatagtttcctaatcgtatagacttctgtacttgtgacttctagcttctagcttgggttggtcatggacctcatggttacctttttatctgatcaaacctctggtcctgcaggctaaccaaaggaaagtagagataaacagacttccagagcagattgtattatctgaagtccgccgtatggttgaggagatg

SEQ ID NO: 22631 - DNA, 3003 bp, Unknown
  misc_feature (1)..( 3003): 2750-1469P.txt file - cDNA_ID_2107486; gDNA_ID_1621099; Annot_ID_171299
agataaaaagaaatgaattatcaatgatcttcggagtaaagaatgtatattaagagtccaaaagataattcaattacagaatttagcgttgtaattgccagaggcatttgctgacccaaataaagtgatgaagtcacctataccagttgtaaattaaatgctctagaatataatgaatgtcctgtaaggaccaatttcaaactgctattgagtcttaagatcgcatgaagcgtaatagaccttggttccaaatataaacatcctcgtaaaagtgaaggagcacaaaattaaaaatgaccaaattgaggaaataaatattttgatgatctcttgaagagagtgaatgatctctaaaagagacataaacatgacaaatgaaacattcaagtacttgacaatgaagagatctagctagttatgtcatgtcaaaatataatggaatcaaaagcaaatcgacgtcgtaatatatttgcatgctatgagcagttgatattatggacaaaaaggaggatcatgaaagaaagtctattgaaaagtgtacacaaagtaatgattagccaaaaatggaaaagaagaaatagacatataattataatctctagtagagatatttgtactagtagtctatgcacatgatgtgtaaaaccagtggaagataaatgagtctttatgtgaaagaatagtgaaattaatgagattttcacaagataagaaatgtattatgaagagatatattctcttgtggtggatgtaatatttttaagtatctaaagtctgacaataagagacagaacactggatatgacatttatatgaaattattgaaagatataatctctgaaggattaattatatgagaattatgttctctagaactctactcgatcgaataaaaagaaatatgtaacatgacatataatcatataaatgtatatttatgttgagtttgtcaaaatatattgatcaaactaatatttgttttgaaaatcattaaaactcgtacagagttatcataagtaatacgatgacaataatctatgataaaatatcactagataatgatatttataagtctatatgaaaaccatataattttgatcattaagattatggttattaattccaacgagatattgtatttgattgaaaatcatctccttaagaagatgtttccgagggggagattgaatgatatgcgtggatgtaccctttttccttatcatagtttttatcccacatgatttttctatgacaaagtttttaacgagacattaaagaacacgcaaataatacacttgatgaatattaagaaattctatcaatcatccaaatgaatattatacactaatgatatttagagaaataaataagatggtcaagatgaatcatctaaaagattcatgagcagaagaatgacgttgtactttatccagaaatttgttcaagagaagatttggcagacttattctcaaatactgtttattctctgccacatcttctaatcatgcagagattttactaattcatgaagctagccgcgagtgtgtatggctaagatccatagttcaccatatacaagaagactgtggtatgtatgcagggaaaaaaactccaacaattatgtacgaagacaatgcagcatgcatcgcacaactcaaagacggatacatcaaaggcgatagaataaagcacatcctaccaaaattcttttacacacacgatctacaaaagagcggcgatgtacgagttctacagatccgttcgaatgataatctggctgacttattcaccaaggcgctacctactgctactttcaagaagttagtctatcgtatcggattacgccgtctcaaagatctcgacgaatatactcataagggggagtaattgtatgttgcactctttttcccttaaccaaggttttcctattgggttttcctggtaaggtttttaatgagatagcatttcaaatactttacgagttatggtactataatggtcatcaagggggagtgttatgaataaagatggatgcccattataagacccatcatctaagcccatcatttagatgtttgtagagttttacctttttcttgtactcctatataaagaacccttttctcaatagaaaacacactcatttcttctatctctttctcaagagaaatttattttcaacggatacttgtgacttttggagactcgagaatctaaacaacggcgatctacaaagataaagagttattgagctcactatgccaagttctgaaaaggcccacttcaaattataaaggcccagtttaagcccactatggaaacgagacagaagcaaatgggtataatcttcaagtcaagcgaacgatcggtgacggtgttatcttaccgccggagccggagtttcccactctattgtaataacagatatttcgaccggagtttctaagtgaatccaaatttgttgttcttcgttgcggctccatctctcgctgtgtatttatagtcaggtcttttgagttatcccattttgcgcgatcccgtcttcaccgtttccatcttccagcgagcacatctctgttgatcgataattttgtacctagttcaggttagttgcgtaattatacttgtgtaatttctttttttggattctctctgaactgatttgctgggcgtggaccttcggttttgttcatttcgtagtcctctatgcgaatgtttccagcgtttgatctttagatctgtagttcgattgtatgcttctaatagttattcgttgtcttgtacatttgatctataatgagaactgatgcgcggttttagtcgaacgcgacatcgtagttcggattagagagtgtactaatctttgtttaacaaagatggcatttcatcttttgactgtgtgatatgtcaaacccgcagaatccataaaactagtttactttgatatgttttgttcttcttcattgaatgtttgtgtggtgtcttgtagttgtaggaaagatg

SEQ ID NO: 22632 - DNA, 3003 bp, Unknown; identical to SEQ ID NO: 22630
  misc_feature (1)..( 3003): 2750-1469P.txt file - cDNA_ID_2107486; gDNA_ID_2926167; Annot_ID_139954

SEQ ID NO: 22633 - DNA, 3000 bp, Unknown; identical to SEQ ID NO: 3129
  misc_feature (1)..( 3000): 2750-1469P.txt file - cDNA_ID_2107558; gDNA_ID_1620627; Annot_ID_47176

SEQ ID NO: 22634 - DNA, 3000 bp, Unknown; identical to SEQ ID NO: 3129
  misc_feature (1)..( 3000): 2750-1469P.txt file - cDNA_ID_2107558; gDNA_ID_1620658; Annot_ID_163698

SEQ ID NO: 22635 - DNA, 3000 bp, Unknown; identical to SEQ ID NO: 3129
  misc_feature (1)..( 3000): 2750-1469P.txt file - cDNA_ID_2107558; gDNA_ID_1620627; Annot_ID_162532

SEQ ID NO: 22636 - DNA, 3000 bp, Unknown; identical to SEQ ID NO: 3129
  misc_feature (1)..( 3000): 2750-1469P.txt file - cDNA_ID_2107558; gDNA_ID_2926186; Annot_ID_140819

SEQ ID NO: 22637 - DNA, 3000 bp, Unknown; identical to SEQ ID NO: 3129
  misc_feature (1)..( 3000): 2750-1469P.txt file - cDNA_ID_2107558; gDNA_ID_2926186; Annot_ID_200661

SEQ ID NO: 22638 - DNA, 3003 bp, Unknown
  misc_feature (1)..( 3003): 2750-1469P.txt file - cDNA_ID_2107626; gDNA_ID_2926148; Annot_ID_197847
tttgtgaccaagatggataaagtctcaatccttggagacaccattgcgtacgtaaatcatcttcgaaagagggtccatgagcttgagaatactcatcatgagcaacagcataagcggacgcgtacttgtaagagaaaaacatcggaggaggtggaggtttccatcatagagaatgatgttttgttagagatgagatgtgagtaccgagatggtttgttgcttgacattcttcaggttcttcatgagcttggtatagagactacggcagttcatacctcggtgaacgaccatgatttcgaggcggagataagggcgaaagtaagagggaagaaagcaagcatcgctgaggtcaaaagagccatccaccaagtcataatacatgatactaatctatagaccctaactttattgatgccaactctagagaaggataattaagcgtatttttgttttagcctcacatgtattaagacatcagttacatatatagccggatgcaacatataaatgaaaatgtactagatgatattgttcatttgtccaatgtagtacttgtgtatgatgcaattgcaacatataaatgcaaatgtactagatgacgatgttgttcgttgtccaatttagtacttttgtatgaatgcgatatttggatgcagattcagttgcatctaaaacatcatattttttttgatgcataaagatgtagaatttctatgtagttttttcttacgttcaaatttgagaaaatattattaaaaaatctttacaaaattcattaaaataatttatgccaaaatttgtatgtcataatttatgtaattttatcattaacctcagattagagaaatcaaagagtttatataaaacattacattctactttggtgctcaattttaagaatcaagttgtagcacatcaaattacgaaatcaaattttccagcaaaattacgaaattgcgttttagtgtaagaatcaacaatttctagagtagactaatagttatactcataattagtgtatggaagaacatttataagtcaagaatattaagctatcaaccaacgagataaatgtattgacaatgttcatagttgcagcatgagctatatatatttttctcttagttgatcatcatacattatcaaagctgcaagatgtgtaactgcattggctccacttcctttgttgtcttctttcttgaatagtggtgttcaatagtgtaagatatctttctatagtttcagcacttagcaggctgcttaaaattggcctggcccattcgattctttgatttcggtatgaactgttagaattctgattgaattcagataccaaaccttgccaaaaagaaaaaaaaaacggtttaaatgaatattaacttactttgaccaaaaattgatggcagggtaaaaagactcaagataatccaaggtcaaacctattttaatttcagaactttataataatcgttttaaactgaaattggtttaatgtaaaaatttaaccaacctgaaccgagaactacaatcaaagtaaacaggagattatattaaatcgaaccactcttacaactcataggggtgggcgtacggttttatgatttggttttggtttggttttttcggttttataaaaactataatcatagaaaaacagaaaaacagtatgtaattcagtttggttccggttcggttttataaatattaaaaccatatgtatctcagttcggtttggattcgatttgtttttggtttggtcccggttttttagttattccatacttttacaaaaaaaaataagttcgatgatttataaataaaaataaacataaaagaaaataatatatcaatcaataagttagatataatagatatctttttaaaattaaattcttggtttctaaattactaaaaaaattaataattctaagcctactaaatttttttttttaaaatgaaactattattaatcaaactaatcacactataaaatggacaaaaatatttatcaataattatttttaatttctctaaaaaacctaaaaataatctggttttacggtttttaaccaaaccaaaccgaaataataataaaaaaatacaaccaaatagtttttttttttaaaactataaccaaaccaaactatttttttcgatcgggtacggtccgggttttcggttttcggtttttttgcccacccttacttacaagtcaaatgatgacatttttttaccggttaacataaaaaacacacacacacacaagttatagatgtttgtttactcttattgtgaaaattaggcccatttactagtgccccacataaaactaagataaacaaatttagggattacaatttttcattttctctataagcttggctttctacctctcaatctctatttttctacttttaagagaaaaaaactataaaaaaagaataagaatctttgtgcgataaataaaattaagaaaaaaactctaaaaccttaaagaaaacccttaaaaaaaatcatggaggtacgtataagttttgtaagaaaaaaacagatttatggagatacatatacataatattatttctgaaaaatacatatacataattttattttacccattaacaagtttgtaaattctcctcttccctctatacacctcttcaattacttctcttaaatcttttttcctctgtaatcaactcaaaaaattgtttacaaaaatttgctaaaactctcttcaaaaatatttaacacaattaacaaaaacaaattccaaaactttgtaataagacaataagtaatcaatctccaaaaaaaaaaaaaacaaaaaaaaaaaaaccttgttggtttgtttgggtcttgccgtttcgtataaaagtgcgaagtaccctctctctacccaattcctcttgttttgtttctctttcataatctccaatcttcttcggattcgacgaatccgtcatcgccgacggaatcgtggccgtgtaatattaacagatg

SEQ ID NO: 22639 - DNA, 3003 bp, Unknown; identical to SEQ ID NO: 22638
  misc_feature (1)..( 3003): 2750-1469P.txt file - cDNA_ID_2107626; gDNA_ID_2926148; Annot_ID_139164

SEQ ID NO: 22640 - DNA, 3003 bp, Unknown; identical to SEQ ID NO: 22638
  misc_feature (1)..( 3003): 2750-1469P.txt file - cDNA_ID_2107626; gDNA_ID_1620633; Annot_ID_47306

SEQ ID NO: 22641 - DNA, 3003 bp, Unknown; identical to SEQ ID NO: 22638
  misc_feature (1)..( 3003): 2750-1469P.txt file - cDNA_ID_2107626; gDNA_ID_1620633; Annot_ID_162776

SEQ ID NO: 22642 - DNA, 3000 bp, Unknown; identical to SEQ ID NO: 3900
  misc_feature (1)..( 3000): 2750-1469P.txt file - cDNA_ID_2107665; gDNA_ID_1620673; Annot_ID_48188

SEQ ID NO: 22643 - DNA, 3000 bp, Unknown; identical to SEQ ID NO: 3900
  misc_feature (1)..( 3000): 2750-1469P.txt file - cDNA_ID_2107665; gDNA_ID_1620673; Annot_ID_164166

SEQ ID NO: 22644 - DNA, 3000 bp, Unknown; identical to SEQ ID NO: 3900
  misc_feature (1)..( 3000): 2750-1469P.txt file - cDNA_ID_2107665; gDNA_ID_2926200; Annot_ID_141466

SEQ ID NO: 22645 - DNA, 3000 bp, Unknown; identical to SEQ ID NO: 3900
  misc_feature (1)..( 3000): 2750-1469P.txt file - cDNA_ID_2107665; gDNA_ID_2926200; Annot_ID_201780

SEQ ID NO: 22646 - DNA, 3000 bp, Unknown; identical to SEQ ID NO: 8093
  misc_feature (1)..( 3000): 2750-1469P.txt file - cDNA_ID_2107797; gDNA_ID_1621193; Annot_ID_57507

SEQ ID NO: 22647 - DNA, 3000 bp, Unknown; identical to SEQ ID NO: 8093
  misc_feature (1)..( 3000): 2750-1469P.txt file - cDNA_ID_2107797; gDNA_ID_1621193; Annot_ID_174626

SEQ ID NO: 22648 - DNA, 2055 bp, Unknown
  misc_feature (1)..( 2055): 2750-1469P.txt file - cDNA_ID_2107895; gDNA_ID_1620643; Annot_ID_47525
gaattcaaaacactattatattatatattaaacatattggaaagggttgacaaaagaaaaacataccggaaatgagatcctctctttctaagtaattattggcgttataactttcatcataaatcataagcacggcttataggtatacatgtcactgaaacttgtatcaaaacatgtaactaacaaatatcattagttattgtatatatataaacaaaaatgctatgacaggaagcaatctaaagactatactcattaacgaattaggttctacaattacactcgatcacataaatttctgttttatatttattacaaacccatgtatgtgtagagtctatagtttaatagtgtttaattaaaatttatcacaaacccatgtatgtgtagagtttaatagagaaggaaaattttagtgaatcgctaaggtaatgacaagatacaatgatacatgcattctaagtaactccatgcgaaacgatcctaatattgacttacaaacatatagcattttggctgtagtatatttaataatgttgtaggacacaacatgtagattaattgattaaagacaacgtgcatgtctcttttttttctctatgatgcgggccttttagcagaggaatgctacagacatgtaaagttttgataaaattgaataattagctaattatggcctgacttgtttaacctctatatccagaatgaacattatattgaaaactgatctttccacaactatatatgtaatatagttttttttgttttgttgcattctgatctcgtcattctgatgtaatatagatccttgccatcataaaaaaaaatggtaatcgatttttagttaagtatgaagttgtcctcttagtttaaaattacagtcagcgcaaatgaattatcttcccagaaatcaattaattttcttgcattttaaaaagccagacataaagttttgactgattaagacatacatgtatatatatggttaaatgatttatcatttttctcgatcgattggataaaggacatggttttcttagaaaagaatataagataaatgacaaataacagaaagaagcgtgattgcctttacttgcatgcagatgcagtagtctcccattttgaatgactgctctaaactcttaaagtataactattctcgtcaactaaagtttttgtttcttttttaaacgtcaactaaagtctatatcaataacaataatttatcgcctaaccagtaaccatagataaagaaaactttaaatctagaaaccattagcttctgaaacaaagtaaaacagcccttaataaagccatgaccatgtcaactgtttcggaccatgtgtagtgtacgtagtaaacatttaaattgataatgaaatagcaagacgcaaatggacgtttgtaaaaattgtatggttggtaaaaaagacatgaggctatatatgaatttctgtcattaaatcagctttaggtattacttgttaggattaaggttatcgtagttgattagactaattaactaatatatgaaccaaaaaagtataatagtcaggagtagtagttgagatttcaaaaagattcaaggtggccataacacaaatattattcgcaatgacaagtgaagcatcgttttcacttttcaacttatccctctcaatccccaccaccaccactctctattccctcatatagatagatcatcctagtgatcatatacacacacaaacattgatagagaacaaaacgaaattggaaaaattcattttaaattttaaaaatacaaaaataatggaattggaaaaagtcttttttttgtaaatactaatcaaatattttaaaattaacaaaaaattcaatagtaaaaaaaagccatcaaaaaatgatgtcaacaattagataagtatttagtctttttctcttttaaaaaatgatatgcaagctggccggcgctacttgtgcgcacacataaaagcatatatataagatccctcactcgattcatgtaattatacacatatagagagattgagtgaaaatatttttttttaaatg

SEQ ID NO: 22649 - DNA, 3003 bp, Unknown
  misc_feature (1)..( 3003): 2750-1469P.txt file - cDNA_ID_2107895; gDNA_ID_1620678; Annot_ID_164324
aaattcggagattttggaatctggattttgtgagaatcgattgggttttagatgggaactgagaaattgaagatgaaaatgagatttctggtgctgaagatgaacaaatgcgaaggagagaagaagatggagatgaagaacaaagctccattgcttctttagactgttactatcaaacaaaaattaagaatcaaatcatccaattcgactcgagaacacgcaaaagacacgatttttgcagcagtagaagaaaatggtaacgaagaagattgcagagttccatggataaggtcatggcggggagatttttctaatggatcatggtttcagtgtaaatcattcaggcccgtaaaagcctattataaagcccaataatatagcaagacccgtaagacattgtagtatgaaatgatcatcattaatatagcttagacttagattatttcacattcaaaattcaaagatgctcaaatctatatgtggatctctgttacgttggatacttttctatagcatgcattcaaaatctatattattttgcttgtataaattgtattgtattgcagcatgaattatcatatgtaatacgtaatcatgacaatagactatagatataatcatataatctatgatactttatatataaatatgtcacactttgcaggaaaaagattccttttgtgttggtcttttttctttaaatcacgtggcacatgttaatccgatttgcattatttagaaaaattatagaaaacgtacaagtcatcctatattggtctttcttacaactatttgttttatttaagtacaaacattatattgtttactgtttcatggtcaagagtctctacgcgtgttatctaagtaatctaatgaattggtaaaattaaatctaaattagattatagtattttgtaaacgatttgaaagaatgagaatccaattatagaattcaaaacactattatattatatattaaacatattggaaagggttgacaaaagaaaaacataccggaaatgagatcctctctttctaagtaattattggcgttataactttcatcataaatcataagcacggcttataggtatacatgtcactgaaacttgtatcaaaacatgtaactaacaaatatcattagttattgtatatatataaacaaaaatgctatgacaggaagcaatctaaagactatactcattaacgaattaggttctacaattacactcgatcacataaatttctgttttatatttattacaaacccatgtatgtgtagagtctatagtttaatagtgtttaattaaaatttatcacaaacccatgtatgtgtagagtttaatagagaaggaaaattttagtgaatcgctaaggtaatgacaagatacaatgatacatgcattctaagtaactccatgcgaaacgatcctaatattgacttacaaacatatagcattttggctgtagtatatttaataatgttgtaggacacaacatgtagattaattgattaaagacaacgtgcatgtctcttttttttctctatgatgcgggccttttagcagaggaatgctacagacatgtaaagttttgataaaattgaataattagctaattatggcctgacttgtttaacctctatatccagaatgaacattatattgaaaactgatctttccacaactatatatgtaatatagttttttttgttttgttgcattctgatctcgtcattctgatgtaatatagatccttgccatcataaaaaaaaatggtaatcgatttttagttaagtatgaagttgtcctcttagtttaaaattacagtcagcgcaaatgaattatcttcccagaaatcaattaattttcttgcattttaaaaagccagacataaagttttgactgattaagacatacatgtatatatatggttaaatgatttatcatttttctcgatcgattggataaaggacatggttttcttagaaaagaatataagataaatgacaaataacagaaagaagcgtgattgcctttacttgcatgcagatgcagtagtctcccattttgaatgactgctctaaactcttaaagtataactattctcgtcaactaaagtttttgtttcttttttaaacgtcaactaaagtctatatcaataacaataatttatcgcctaaccagtaaccatagataaagaaaactttaaatctagaaaccattagcttctgaaacaaagtaaaacagcccttaataaagccatgaccatgtcaactgtttcggaccatgtgtagtgtacgtagtaaacatttaaattgataatgaaatagcaagacgcaaatggacgtttgtaaaaattgtatggttggtaaaaaagacatgaggctatatatgaatttctgtcattaaatcagctttaggtattacttgttaggattaaggttatcgtagttgattagactaattaactaatatatgaaccaaaaaagtataatagtcaggagtagtagttgagatttcaaaaagattcaaggtggccataacacaaatattattcgcaatgacaagtgaagcatcgttttcacttttcaacttatccctctcaatccccaccaccaccactctctattccctcatatagatagatcatcctagtgatcatatacacacacaaacattgatagagaacaaaacgaaattggaaaaattcattttaaattttaaaaatacaaaaataatggaattggaaaaagtcttttttttgtaaatactaatcaaatattttaaaattaacaaaaaattcaatagtaaaaaaaagccatcaaaaaatgatgtcaacaattagataagtatttagtctttttctcttttaaaaaatgatatgcaagctggccggcgctacttgtgcgcacacataaaagcatatatataagatccctcactcgattcatgtaattatacacatatagagagattgagtgaaaatatttttttttaaatg

SEQ ID NO: 22650 - DNA, 2055 bp, Unknown; identical to SEQ ID NO: 22648
  misc_feature (1)..( 2055): 2750-1469P.txt file - cDNA_ID_2107895; gDNA_ID_1620643; Annot_ID_163096

SEQ ID NO: 22651 - DNA, 3003 bp, Unknown; identical to SEQ ID NO: 22649
  misc_feature (1)..( 3003): 2750-1469P.txt file - cDNA_ID_2107895; gDNA_ID_2926213; Annot_ID_142092

SEQ ID NO: 22652 - DNA, 3003 bp, Unknown; identical to SEQ ID NO: 22649
  misc_feature (1)..( 3003): 2750-1469P.txt file - cDNA_ID_2107895; gDNA_ID_2926213; Annot_ID_202776

SEQ ID NO: 22653 - DNA, 3000 bp, Unknown; identical to SEQ ID NO: 4407
  misc_feature (1)..( 3000): 2750-1469P.txt file - cDNA_ID_2107920; gDNA_ID_1620704; Annot_ID_48838

SEQ ID NO: 22654 - DNA, 3000 bp, Unknown; identical to SEQ ID NO: 4407
  misc_feature (1)..( 3000): 2750-1469P.txt file - cDNA_ID_2107920; gDNA_ID_1620704; Annot_ID_165197

SEQ ID NO: 22655 - skipped

SEQ ID NO: 22656 - DNA, 3000 bp, Unknown; identical to SEQ ID NO: 4407
  misc_feature (1)..( 3000): 2750-1469P.txt file - cDNA_ID_2107920; gDNA_ID_2926206; Annot_ID_202185

SEQ ID NO: 22657 - DNA, 3000 bp, Unknown; identical to SEQ ID NO: 4275
  misc_feature (1)..( 3000): 2750-1469P.txt file - cDNA_ID_2108207; gDNA_ID_1620694; Annot_ID_48648

SEQ ID NO: 22658 - DNA, 3000 bp, Unknown; identical to SEQ ID NO: 4275
  misc_feature (1)..( 3000): 2750-1469P.txt file - cDNA_ID_2108207; gDNA_ID_1620694; Annot_ID_164884

SEQ ID NO: 22659 - DNA, 3000 bp, Unknown; identical to SEQ ID NO: 4275
  misc_feature (1)..( 3000): 2750-1469P.txt file - cDNA_ID_2108207; gDNA_ID_1620699; Annot_ID_165001

SEQ ID NO: 22660 - DNA, 3000 bp, Unknown; identical to SEQ ID NO: 4275
  misc_feature (1)..( 3000): 2750-1469P.txt file - cDNA_ID_2108207; gDNA_ID_2926208; Annot_ID_141858

SEQ ID NO: 22661 - DNA, 3000 bp, Unknown; identical to SEQ ID NO: 4275
  misc_feature (1)..( 3000): 2750-1469P.txt file - cDNA_ID_2108207; gDNA_ID_2926208; Annot_ID_202412

SEQ ID NO: 22662 - DNA, 3003 bp, Unknown
  misc_feature (1)..( 3003): 2750-1469P.txt file - cDNA_ID_2108258; gDNA_ID_1621097; Annot_ID_55707
aaggaaagaggaggaggcttcttaattgggggaaacgtgacttgaagtcttaataatgtttttattttatttgttcacactataatgattcaagtatgcaagtgtgtgtctattggtgtgaatggatagtatcggatgaatgaatgacaagaaaacaaaattaatgatttggttaaagtataatagaggaatgaagtgaaatagataatggacttttcttatctttctaaactggagattgtttttcatgttatgaaaaaagtttactggaatatagatttacctcactctgtagcaaattgtacccttttagtggaatataaaaatataattttctacttctttttacccatcatttttatttatataaactagtataagctacatactagttgattttggtctataatatccagatttgagactaattttggcaatcaatatgagaaaataaatttcatgcaattagttgcaccatatgaataggattggtaaaagtgatatagttttcttcttaaatcacccataaatcttaacctaaggatgggcattgaagatatgtaagtagttaagtcaatttgattacccttttctgaccggagtttgattctactaaatcgcgttatcttgcgtagtatggattgactatacatcgagtcttgtggatccaaaaatgtatataaaataaaagatgggcacaaatacttggtaattttcctttatccaccttgaaaacataaacactcatcattattaagataactaatactcattctatttcatattagttgtagtttaaggtttttacacacatattaagaaagtttttaaaaattcatttaatatatctcttttatataaaaacatcatttattataaccaattcaaccaataaaaaatatataattaagtatagttggttaaaaagtattgaatatatttattatttatacacaaagttgaaaacaacagttattgtgaaaaaatataaaaacctttaaattacatttatattgaaacaaagggaataataagtaacataactttgatacttacaattaatttgcaaatagttttacaaaaaacacgtaatagaacaaagcaagtaaagtaaaatatttttagcaaatatttgaaattgaagatactcgtttctcacaagtcaaatacgaatactaattttacccttacaaaatgggtcaagtagcaaatacttgtcctgtgcccatccctaatttttgcaagcaagatgcactaagtatgagagagttttgtagaacctagtgttttatagcaaatctgtaactaatcctaaaatatggaattacataagtagtaaagtagcaaccaccggtttactttctgaggaattagcaaactattaatggaatgaagaccctttctggggaattagcatacaaaactaatatgagaatttcatgtggtgattattggccaaggcaaaagtcttgactacataaattctaccttttattcagactgaacaacagctcttttaatttttacttcctgcgctagttttttgttcctattaaaagagtcattcaagatttcttaggtaaattcttaaatgaactaaaaataaattttgttaagtaatcagaatcaaaggaaaacgatggtataacagtctggtatcatatcccacttggttgctactcgctagtaaacttcaaccacaaccctctgtccctctatgacgttgatgccacttttaagactaacaacaataatattgtcttttttttcttctttcgaatccacatctcttgaaattttgttaaataatttaaaatatgtaatctatatgtctgtgtgtacatatgcataaatcatactccctctgtttctaaatatttgtagtttaaaatttttgcacacaaattaaaaaaccatacaaatctcatttaatttatctctttcctataaaaacatcattaattacaactaatccaaccaataaaaaatatgatgtaaaatacaattggttaaaactattaaatacatttaatgtttgcatagaaaagtaaaaacaacacttatattgaaaaaaataaaaaacctttaaactacacttaattagaaacagagggagtaatacggatctacgagaaaaatttagtgaagtcgcggtcgaaggaccttaggttggtggctagaccatttcgttcaaatcaatcccactttctttcatcaagataacaaagattcacaaacatccttaccaaatgatacaaccaaatgaccaaccaaatgataaaaactacctaaggtctatcatcaagtttttataagttctatttatcacttaatatcacaatggtgcattcgagaggatacaaccaaatgaccaatacacatgtatttttaactgcttgtaagtatcacatatctcatgattttaaaacaaaaatattgatttacttgtttattattattattattttttctatacttatttggtttgatagtagatgtttttatatatatttaagatatcattttatatatcttgagactgtatttatacctctcttctttattctacaaactacctgtcaaaatagttggttttgaaatgtaacattggtgatgatttttcttttgtctttaaatgtaactttggatgacaaaattcagtaataataatgggcctgaggttatgaatatagaattccactttatcacattggacccaaatttgccatgatataatataaaacgacgtggtatcaagtgttcagtgagtgtgagtcctccgacacgaataatctagaaaattttactaagactagtgtcagtatttttctaccacactcgtcgccttgctttacgctttattctctcttctttagctttttatttcttcagcaaatctgatttcaaaaaaatttcatcgaggaaactgaaaaaaaaaaatgagtgacgggaggaggaagaagagcgtgaacggaggtgcaccggcgcaaacaatcttggatg

SEQ ID NO: 22663 - DNA, 3003 bp, Unknown
  misc_feature (1)..( 3003): 2750-1469P.txt file - cDNA_ID_2108258; gDNA_ID_1621096; Annot_ID_171059
tattggagaaagagtttctgagagagagagaaagagaaagagacagagagacaaagagagaaaggaaagaggaggaggcttcttaattgggggaaacgtgacttgaagtcttaataatgtttttattttatttgttcacactataatgattcaagtatgcaagtgtgtgtctattggtgtgaatggatagtatcggatgaatgaatgacaagaaaacaaaattaatgatttggttaaagtataatagaggaatgaagtgaaatagataatggacttttcttatctttctaaactggagattgtttttcatgttatgaaaaaagtttactggaatatagatttacctcactctgtagcaaattgtacccttttagtggaatataaaaatataattttctacttctttttacccatcatttttatttatataaactagtataagctacatactagttgattttggtctataatatccagatttgagactaattttggcaatcaatatgagaaaataaatttcatgcaattagttgcaccatatgaataggattggtaaaagtgatatagttttcttcttaaatcacccataaatcttaacctaaggatgggcattgaagatatgtaagtagttaagtcaatttgattacccttttctgaccggagtttgattctactaaatcgcgttatcttgcgtagtatggattgactatacatcgagtcttgtggatccaaaaatgtatataaaataaaagatgggcacaaatacttggtaattttcctttatccaccttgaaaacataaacactcatcattattaagataactaatactcattctatttcatattagttgtagtttaaggtttttacacacatattaagaaagtttttaaaaattcatttaatatatctcttttatataaaaacatcatttattataaccaattcaaccaataaaaaatatataattaagtatagttggttaaaaagtattgaatatatttattatttatacacaaagttgaaaacaacagttattgtgaaaaaatataaaaacctttaaattacatttatattgaaacaaagggaataataagtaacataactttgatacttacaattaatttgcaaatagttttacaaaaaacacgtaatagaacaaagcaagtaaagtaaaatatttttagcaaatatttgaaattgaagatactcgtttctcacaagtcaaatacgaatactaattttacccttacaaaatgggtcaagtagcaaatacttgtcctgtgcccatccctaatttttgcaagcaagatgcactaagtatgagagagttttgtagaacctagtgttttatagcaaatctgtaactaatcctaaaatatggaattacataagtagtaaagtagcaaccaccggtttactttctgaggaattagcaaactattaatggaatgaagaccctttctggggaattagcatacaaaactaatatgagaatttcatgtggtgattattggccaaggcaaaagtcttgactacataaattctaccttttattcagactgaacaacagctcttttaatttttacttcctgcgctagttttttgttcctattaaaagagtcattcaagatttcttaggtaaattcttaaatgaactaaaaataaattttgttaagtaatcagaatcaaaggaaaacgatggtataacagtctggtatcatatcccacttggttgctactcgctagtaaacttcaaccacaaccctctgtccctctatgacgttgatgccacttttaagactaacaacaataatattgtcttttttttcttctttcgaatccacatctcttgaaattttgttaaataatttaaaatatgtaatctatatgtctgtgtgtacatatgcataaatcatactccctctgtttctaaatatttgtagtttaaaatttttgcacacaaattaaaaaaccatacaaatctcatttaatttatctctttcctataaaaacatcattaattacaactaatccaaccaataaaaaatatgatgtaaaatacaattggttaaaactattaaatacatttaatgtttgcatagaaaagtaaaaacaacacttatattgaaaaaaataaaaaacctttaaactacacttaattagaaacagagggagtaatacggatctacgagaaaaatttagtgaagtcgcggtcgaaggaccttaggttggtggctagaccatttcgttcaaatcaatcccactttctttcatcaagataacaaagattcacaaacatccttaccaaatgatacaaccaaatgaccaaccaaatgataaaaactacctaaggtctatcatcaagtttttataagttctatttatcacttaatatcacaatggtgcattcgagaggatacaaccaaatgaccaatacacatgtatttttaactgcttgtaagtatcacatatctcatgattttaaaacaaaaatattgatttacttgtttattattattattattttttctatacttatttggtttgatagtagatgtttttatatatatttaagatatcattttatatatcttgagactgtatttatacctctcttctttattctacaaactacctgtcaaaatagttggttttgaaatgtaacattggtgatgatttttcttttgtctttaaatgtaactttggatgacaaaattcagtaataataatgggcctgaggttatgaatatagaattccactttatcacattggacccaaatttgccatgatataatataaaacgacgtggtatcaagtgttcagtgagtgtgagtcctccgacacgaataatctagaaaattttactaagactagtgtcagtatttttctaccacactcgtcgccttgctttacgctttattctctcttctttagctttttatttcttcagcaaatctgatttcaaaaaaatttcatcgaggaaactgaaaaaaaaaaatg

SEQ ID NO: 22664 - DNA, 3003 bp, Unknown; identical to SEQ ID NO: 22662
  misc_feature (1)..( 3003): 2750-1469P.txt file - cDNA_ID_2108258; gDNA_ID_1621097; Annot_ID_171083

SEQ ID NO: 22665 - DNA, 3003 bp, Unknown; identical to SEQ ID NO: 22662
  misc_feature (1)..( 3003): 2750-1469P.txt file - cDNA_ID_2108258; gDNA_ID_2926164; Annot_ID_139849

SEQ ID NO: 22666 - DNA, 3003 bp, Unknown; identical to SEQ ID NO: 22662
  misc_feature (1)..( 3003): 2750-1469P.txt file - cDNA_ID_2108258; gDNA_ID_2926164; Annot_ID_198998

SEQ ID NO: 22667 - DNA, 3003 bp, Unknown
  misc_feature (1)..( 3003): 2750-1469P.txt file - cDNA_ID_2108270; gDNA_ID_1620649; Annot_ID_47694
ttgatggaccaaccaaatatgctcaaagccaagagtaaagagagcggtgaaatctgcatcaatgatttcactaccacctgaggtttgaaaacaattggaaccatgaataatgcagtaggaaaagctcaagagattaaaggggaaagagaatagaagagaagctcacgttcatcaagttttcggtttggttcgttgctatgagaagaaggattatataaagaacctgtagtcatttgactatttgagaaactctgtgtttacaatatctcccaatagaaatacattgaaaaaaagttaagtagctcagatatcaatgatccaattacctcgcaggaaacacagcaataacccatgaacatccggtttccataatagagtctaaagagccagctcgtgctatctttcacatccttatggctggtcttccctgataggaaggtactgcgaatcaagtattaaattcctggtttgctatgtacaagaacaatacatctaagaagttgaatgaagattttatgtagcaacaaagagtacctgtacatttgcagccagtgactagcgatatctaaagccagcaatgacaggaaaaccaagctaggcctgtttgtaattgtgaaagtccaagactacatgttaaacaaagattacgtagaaaaccagataagtccatgaaacggagatgtcagtgtaaagaagtagagaacactgacacctgtatatctgggagagaatcacgagaagacaggctgtgctgactctgtaaccatgcgcagaccccaaaatatatgacaaaaatgttaaatgagattaaaagaatgagcaagttgaaactcgggaatatgtagcggaagattcacctatctgtaaccatatccaaaacagctccaaatgtagagactgaaaggaaaagagttgtgtgttacgttcaatcgtttctgataatgtagaacaagaataaactgtgtatgggactaaaaatattgatcaatgagacaatgacatgaaatgtcatatttaatcaatgtcaggatcatagaggaagcataagtaatgagttagttgaagctaagaaaagagatggggagaatgaaaagagcaccttggttaaatttacgagcgcaccatccatccacagcatcacaacaaaaactggaaacaagattgggtaaagagtgactaacatatgaaagaagaagcaccaaacacacaagatcaaaaaaggagaagaacatgatgttggtaccacaaggataaagtcacctgaaaaagtacaagagggagaagagtgtcttgttggagaagcacacagagaaggcaatgcagttcaagagaactctcatgtaccctgccaattttgcatgtaacaacactaatctcatatggtttaaaaaaaatgaaatttttaaagacagaagaaaggaagtagcaaaaaaccgaccaacgatattgggaatgtagaggtagactgacaacgtcgccggtctctgtttagccataacagagagagagagacttcagtttgggcaatctgttccccaacgaagaaaacaaggatctcgccaatgaagggatacctacacgagattagaaagaaaaaaggaacaaactttgtgggaaaatgcgtacggacagaggaaccccaaatccggtaaatacgtgaacacacacacacaaacaaagtaggtcaatcgattttcagacgcaactggaaatatcaaatctcaaagtaagtatggggaaattaaatatttctcacctgcctaagagaaattgggaacgaagggatccgcaggatgagcctgcagactttgttggaagctctcacaagaatcagattcgcctctctctcaagcaaaaacgttttttcgtttaatattctcaaattcaatttgtgaaatacagtactaacatttgttaaattatttgtaaaacttttctcggtttcgccgcttcaacactgaaaatttgcatattttatttgcaaacaatacatacacgcatatatcgttaattttcttcttcttccacgcacactttatttactgctgaattcggattgtgtcattagtcattactcactcattactaatttccacaaacctttgtatcttcatcgcttaagactataattgatgatgggattttcggatatatgaacttgaatcccatgggggtccagatatccagatggttctacttgcaagtcttgcaaatctaaatggaattaaaactcggttgatttttgtcaaaaaatcgccaaaaatataaaatggtaagtaagtgggcctcagaaaaatccattagaaagcctagaccaaattttggagtgggcttcataaaataaacaaatctggtcatcaaggtcggtacgtcggtgtgactttgcgagtcatcatcgattatccaaaaacaataactcctctctttactttcttcccatgcaccaagaatatattttttttattattatttattaaacaaaaaaaaaagtaaagcagcagaaaatctaacgcacgactcttgtcccaagatcagtctcagtcatcatcaaaacagaaaattttattatccattgtaattttatttttttcttacaaattacaactcttttttttttcattcatggaattggaatgaagaaatgttttaagccaatccaaaaaagaaaccgaaaaaaaaaaactagaaattaggaaaccgttagcaagaagagaagaatcgagacggcgactaggaaactgctgggaccagaaaagaaaggtgacccatccatcattcacttaattagatacatactgtattacttattacaataatgcctatatatattctcccaattcatcatttacttctttacacctccactttcccttttgcccctcttttttacagatttcactctctgctctactactctctcctcctcctcctcctaaagaaagttcttaactctcctgggttcttcaggtttttccttttctggaataaaaagaagaagaaatg

SEQ ID NO: 22668 - DNA, 3003 bp, Unknown; identical to SEQ ID NO: 22667
  misc_feature (1)..( 3003): 2750-1469P.txt file - cDNA_ID_2108270; gDNA_ID_1620649; Annot_ID_163400

SEQ ID NO: 22669 - DNA, 3003 bp, Unknown; identical to SEQ ID NO: 22667
  misc_feature (1)..( 3003): 2750-1469P.txt file - cDNA_ID_2108270; gDNA_ID_2926215; Annot_ID_142197

SEQ ID NO: 22670 - DNA, 3003 bp, Unknown; identical to SEQ ID NO: 22667
  misc_feature (1)..( 3003): 2750-1469P.txt file - cDNA_ID_2108270; gDNA_ID_2926215; Annot_ID_202938

SEQ ID NO: 22671 - DNA, 3000 bp, Unknown; identical to SEQ ID NO: 5722
  misc_feature (1)..( 3000): 2750-1469P.txt file - cDNA_ID_2108291; gDNA_ID_1620813; Annot_ID_50613

SEQ ID NO: 22672 - DNA, 3000 bp, Unknown; identical to SEQ ID NO: 5722
  misc_feature (1)..( 3000): 2750-1469P.txt file - cDNA_ID_2108291; gDNA_ID_1620813; Annot_ID_169131

SEQ ID NO: 22673 - DNA, 3000 bp, Unknown; identical to SEQ ID NO: 6597
  misc_feature (1)..( 3000): 2750-1469P.txt file - cDNA_ID_2108377; gDNA_ID_1621098; Annot_ID_55786

SEQ ID NO: 22674 - DNA, 3000 bp, Unknown; identical to SEQ ID NO: 6597
  misc_feature (1)..( 3000): 2750-1469P.txt file - cDNA_ID_2108377; gDNA_ID_1621098; Annot_ID_171229

SEQ ID NO: 22675 - DNA, 3000 bp, Unknown; identical to SEQ ID NO: 6597
  misc_feature (1)..( 3000): 2750-1469P.txt file - cDNA_ID_2108377; gDNA_ID_2926166; Annot_ID_139925

SEQ ID NO: 22676 - DNA, 3000 bp, Unknown; identical to SEQ ID NO: 6597
  misc_feature (1)..( 3000): 2750-1469P.txt file - cDNA_ID_2108377; gDNA_ID_2926166; Annot_ID_199159

SEQ ID NO: 22677 - DNA, 3003 bp, Unknown
  misc_feature (1)..( 3003): 2750-1469P.txt file - cDNA_ID_2108405; gDNA_ID_1621111; Annot_ID_56093
cgcttgtcaataccacccaacttgtagatcaagtgtccagtggtggtcgactttccagaatcgacgtggccaatgaccacaatgttgatgtgaaacttctctttacccatggttagagactgtcaaacaaatctgcaataaaaagaacaatcaaatattgaatcaagaaaaacagtagacttatgaacacaaaaaacaatcattgttaaaagccgctatcggattcaaaccgatttctaccacaaaaaatgtggtgctctatcaactgagctaagcgaccctaaattcaatcaaaacagcaattctggagatatacagcaaacaatcctagagtttccacaacttggtatcaagaagaatgaatcaattgattgtttatgctgctccagaattacctaatcacaattcaaatcgacaattaatatcacatacatcaaaagatccaatcaacaatccattgaacaatacaaaaatttcagaaccagatcgatcatatagtttatcatcagctggcatgaagaaaaaaaacaatacgatggcactgtaaaaactttgttctcctaaatcgataaaactttacaccacagatcagaaattccaaacgatctataaacaaagagaatcgaatccaagagattacaacaaacaaacgagaaggatcgaaacagattcaacacagatcaacagaagagaaagaagcagatcgaagatggtgacgaaaaagcttacctcagagatatcgcaagagagtaaagcggctagggtgacgaaaaatgaagcaaggaataaagctatgtttgggattcgagtttatttatagtggtgaatcgaaagaaataataagttagggtttaacataacatcgtttgccaaattacaaacgtacccctatcccgccgaatattctctttttctttgggccttgaagagtcggtcgcgtttcataaaagtccactaacctcgaggggtcgctcttgtttcataagtcaagctaatttgaatttgatagtttcaatccaaaagtggaatataattaaatttggttcaacgcgaattaaatcaagaaggttttacttggacgatatacactttgcaggttaagagaatgtaatttcacgtaattatcaaaacatacaagaggataacagcaaaaaaatcactaatgattgatgaaaacatcaaacgcttgttcatcagactggaacatttaagattgctaagtaatatgcgaattgagagaggaaatatgatcaatgtgggaaaggatagtccaaaacgttgtccatgacttcaaactgcatatccttcgatggccgtttcctctggtttatgaaccaattgttttatctgtttcctctggtgtctccaggcattctaatatcagatgtctagagtcaatctctgagcagaagagtaatagtgagactcgagctctttaagattggcagatgcatcatcagcaattctagccaacaatcgatttgtcttctcggcctcttgatcaaactcttctattctttgttctacatgatcgtttagtgatgcaaatcctgaaaatatcgctgtttgcttaagttctgatacgagtttcaaaagagaatcagctgcttgaacctgccaccattggtgaggaagtaagttaacaacactccagagactcataagaaaatctttcaacaacacttgagtggcctatgtaacttccctaatccatatgcctaaaagaaatcattcaacaaacacaatgaggacataagctaacaaaacaacccagttttgaaacaacagtaaaaattagattttggagaatcatgagtgaatgtttggtagactcaaaaacattccaaatatgtgtactttggcagagattcaaaacgtttcacatctgatttaaaccctgatttgcatgaacctattaaagaaatcattcgaattcaatggagtgaagtaattatttaccattctagaagctcgcatctccatcatgtatgtctcctgcgagttcttcaccggcggatcactcacctaccgaaaccaaacatgtttcgcctcaataaacactaatcttaaagccaatctaagagattgaaatttctgataaatcctaactttaaaaccggaaagaaaccacacttacccttgaaacattgacgatctgcgtgaagttatcgacgacagatgtgatgtcagtctccactctctgtaacaacgccttttgcttctgtaaagccgcggcggcggcggcggccgttggaccgcttcctccaccggatccgccaccggatccaccgcctttgttcataattatcgctggtcttttgcaaagaaacgaagaaagtaaaagaagctgatggctatgggaagaagatccacccaacaaaaaaaggagcatgatgttagtattgggcctaaagtaatgggcttacgtatttgtgttttaagttattattattaggggacttaactttctaaaaccaaacatgctttgacattcctctctttcttctgctctcggaattggtgttgcagaaggtaagcgattcagacacatctaagatttgatatccctactcttctatctgatccctccaatgaatcttgcttcaattctttcgtattagtttcagatcagatgaatagatcgtttctcttttgaaatgttttctcaaccaaatcctaatttcgtcccttgtaatcggtttggagttttgcctttgctagcaattgattagtaaaaccttgaaaggttttgaaagtttcattcttttaatgttattagttaaactcgggtttgcaacttcaatctatttaatcgtgtgttgtttcataatctttttgtcttagattttggtgtttcttatgctccctttcagtgcactgtgcattgatcctttgtagtttattattttggaaatagtgtggttaaatgcaattattttgcaaatttggaagaaaagttaacaggactggtgaagtatcaaaatttggggttttgctgcgatg

SEQ ID NO: 22678 - DNA, 3003 bp, Unknown; identical to SEQ ID NO: 22677
  misc_feature (1)..( 3003): 2750-1469P.txt file - cDNA_ID_2108405; gDNA_ID_1621111; Annot_ID_171809

SEQ ID NO: 22679 - DNA, 3000 bp, Unknown
  misc_feature (1)..( 3000): 2750-1469P.txt file - cDNA_ID_2108470; gDNA_ID_1620809; Annot_ID_50579
tgaagagcttattggcttctaagagaaactcatgaagaaaaggtcgtagctttatgataaactcgtaaccgtctacgttgcgtctccatagatcttgccttgaatcagtttcttcgagtagatacttctcgcgtttagataggtctgaaaccagaacagagtggagtagcgtgtggtccaagtcaaggactaaatgaagcttcttcttcttcttcttctgaaagagttgcgtagtaagatgcttttttaacatcgcagcgtggttttgtaatctcttgacgaaatcatcgaagcaagacgacgacgaggacgacctctttggtcttttggatttcagttgcagaagatgtttacgtactagaaacataatcgacaaatcagtatctgaaatcgaacggaaaaacaaaaccctagtttgttcggaaacaatgagttgtataatctgtgatgataatgatattgattgatactctgcgtatatatagagaaggatatggaaataacaagacaaaatggaaattggagtagagtaacgaaaaatggaaatcgcaatgtgatgttgacacgtgttcaggtgtgacacttgaagccgttcaatatttgtttggttggtttaaatgggcctaggcctttgagtgaaattacataggccatctggttttacgttttgtaagatttgggaaactacagattttagtatgagcaccccattggagtaccttatttaaggaatccttagaattttttattattagattttgaataaatgaaagtttagaatttttgttgaatctttatattttttgttgtccaatggtggaatctttaagcgggcttttttaaaaaaaaattcaaaatataatattataatattttttattttacaaaacacaataattattaaaaatattaaaattgtaaacatacataacataaaaacaaaacaaacatattaaatgaaaaacttgaatgacgattagaattaagcttgaatcggaccaaacttttgccatatatgttcaaccaaatcagcttttaagtgttcatgcttagtccgatcacgaagtcgggttcgagtggccatcatattaccaagatttgaaggcatgtccgtagaataggtgaaatccacttgtgaagaactagctgattccggatgtgcgaaatcggatacatcatactgagtgtatccatctcgttcgtcttctactatcatattgtgaagaattatacatgctcgcataatattcccgatttttatcttatcccaaataagagcaggatgtttgacaatagcaaaccgagcttgcaaaactccaaatgcacgttcaacatctttacggcaagcttcttgatttgtagcaaataaagaagctttttcatcttgtggaagtgaaatagattggataaatgtagcccattttggataaatttcatcagtgagatagtaagccaaattatactcattcccgttgactacaaaagccattgagttttactttatacttctaacaagtatcaatcggatagaaaatctagtttcgcacatagagattatactaggcaagacatagtctcttccaatgacagagtaaatcacaaacacagaatattacaaaagctaactcctgcatcaacaaatctctttttataccttttgttatcaattagagaagtgtgttagctaatctcaaactttacttattatcttcctacattaaaagacagaaccaatacgaaatcaaggctaatttcactaaaacaaagaagaaatcataactgagtaatttgttgattttataaccaaattcaatacgaaacaataaactaacgaatctcaacaaacaaaaatcatcagaatcatcatcatcaaagaaatcccaattcacgaaaccctaatttcattgcaatctatcaataactctaactactcacgatctacacaatcaataaggtagaatcataccttcataatctgattggagcatgctagcttctgatgattgagagagatttctctcttcgtttcttcggacaaaacaaagcgaacaatagaaatgaaaataaatcacgggagaattttttttttttggttttgtctcttccctcagccaataacaaaaggccacgtgtaagactcttcccaaaccaaaaacacctaagataaggttcgaaccttactaatttcatgacttctgatttaattttagcatattattctaaggacttttgctaaaaaactcataagaattccccactggacatggtctaatttctccacaatttagtaactatatacagtagcgagataaaaatatacgcatattattggaaaatatgaaattaagtgtgtgattttttttatatatttttataaaattgtgtgaagttatatgaacttatttgaatacaggtcgaatttgtggtaaaatatttttttatatagatttatgtgtatgtttactcaaaaataatttattaaattcagtgtaattgcaaaaaattatgaaatattagttttattactgttaataatctttttaccaaaattttcaatatatgtgtatgtatttttttatatctatatatattaactaattgtcaatattcctcgatttgtttgagccttaaattattattggatgacaaaattttttttactaattgtctcttgtgaagacaagaaaaagaaattatttcgttcagctacatatatttaagataaattttaaaaagtagaagtaatacactaccattaataatgtagctaagaaataaaaatggcaacataattaatacattaatacatgtagcaaatagagtaatattaacaataaaacctctcataaattacaaaaattagcttaattaaacccacttcattaatttccgcaattgttgcaaatttcagacaaaactttccttttttttgtccttttcagtcattgttccgtcttcgaccaccaccgtcaaatccggcgacccatcaaccttcagatg

SEQ ID NO: 22680 - DNA, 3000 bp, Unknown; identical to SEQ ID NO: 22679
  misc_feature (1)..( 3000): 2750-1469P.txt file - cDNA_ID_2108470; gDNA_ID_1620809; Annot_ID_168978

SEQ ID NO: 22681 - DNA, 3003 bp, Unknown
  misc_feature (1)..( 3003): 2750-1469P.txt file - cDNA_ID_2108547; gDNA_ID_1621154; Annot_ID_56974
gactctgaagtcttgtttcttcattattctttacctcttccacttcagatgttttctcttttgcatcctcaggtttgactaccagagaaggggaatatctcaagaactcacccgacatcaaaacttcatcaggttttaaattactgtgacgagacccttgagcgtttgactttctatagccatcaattttcagactaaacaaagactcatttgatatttcgctccaatccacatccccattcttactaaacaccgatgcagggattctcccgggatcgtaattcgctataccattattcatcaagtgaactggtcgtaacctagaaggcggagatggagctggttgcatcctgagatgagtcaaaccagatatttcagagccttgagaagaagaagaaggctgcatcctgacatgagtcacacctgatatgtcagagcctttagaagaagaagcatttgaaagttcccaattctgctgactcgtatcctcagaagatgctttggactcttttgtacttctctctacggcatcatcccatgaaacagaggaagacattgaagaaaaagacagagatgatgatgttaggaagatttccctcgcaggtcttgtaatcattctgttaccactcatactcacatataaagctcttatcagttcacttttccggttgttaatctttcaaaacatttcgcagtgattcacggattcgattccatggctgataaactatgaaagcaattaatttttcttacatgaacagatgatgttctagtcccaccgatactacaacttcggtgaaagctggatccttgaagccattagcacaagcaatatccactcttttgcatccaagcacagtgccaagataatttggacaagactaatcaaagatgaatccaatattgcataattcttggtgtcttgtgaattcgacctattggagacggaaacatgtcattttcattcggttcttaaggaactagaaaatgaaaaacaaaacaatttatggagaagttttgaaagtgaacacaaaacaaacatctttgaatttagtaaatttgaacgaatggccgttgatcagagttgaatacagaagaaggaaacggtttcttgtggagaaatttaaggtggcatttgctggcatttgatcacttctatttcggggttgactgttcttcgcgccgttgctgtaaaacctaacttctttacattcattgtggacatcagtatggcccaataaaggcccattttgaaataatcgggctatttggtccacacatgaggacacgtgcatacgtaagagagtaccagaaaaggagattcataaacccgttaaattcgcggttaggaaacttttgccttttggttgaaacatcgttggcctcttgcaagttaattttcttattctatcgactatttcggacattcaatcacgtgattttcgtgtttgaaaagatcaacaattttttttttcgttaaaatatctggcatttaaataaacactatacgtaaattttagcagtatgaaattaactaggctgatggattcgaaaaataatacaataaaaccaaaaagaaaagaaaaacatgtattccaaattacaggagtactatcatcaatcattcaatctttaagtagctacaaaagtctacaacaaaaataaagagaaacaaaataataatttaaaggctagataattgaaaggaatagtgatatgcaagttccaaacacaagtatgaacaagagttaatggaagagactataattatgaaatatcggtcatggactcagggaagtggggaccctatgataacaagccaccaccaaattagcacctcaaaaacaaaaatgtataaaccatattatattgtatattaaatataagcatacattaggttaaagatgtttgctcaaaaattaaaagcaaatagatatgagattgacacctaaacagccttaatctggacccaatctgacagttagggcttaggctatgggtacgacaatcaactagatatgtggacaaaacattctactaattacacaatatacatgtacatggaccaccttttaatttttattttttttgtccttttactttttaacttgtacatgcatgttgtcaatgtctaattatataatcacttttcccctctatgtatgttgttttatacattgcatgtgttatatttgatcgcgagtgaacaaccacttttctcagcgcttattacgtgttttctttttgcggcaaatcattttacgattgattaatcctattcaaattcactacttaaacttactcccactgaacaaagtcccaactaaagcttataaattgtataatgtttacattaagtcttggggattggattgacaatgatgattttggccgatggttagtgctggttgttaaccaacatgatagtataatataaaatgaaacattaatatggactgatgttcggtcttaattaccactccactcttagatataaaattttgcagttaatggtgaacgcaaatttgcttatacgtacgtacgaagctgtatacaaatataagtaagcatcaaattaaacagagagagagaggcgtagtacttacgtagctatatgatgtggacgattgattaggatgtacgtatgctaaaaacaatatacacggccatgtgatacttgtaccacttgcgcatctctacatatatacgatccaacctttggaatttatattgtttacctttataataaccatccttcacattagcaatcaatctacaccaacaactacaactaaattctatctctctctctataataaactagcgagcgaggacgtcaaatgtaataagagtaagaacaagtacaccttttcatccaccaaaatttaacctatgtatataaatatacaacattaccatttaccaaacatccatcttacatatattactcatcatcaagttcctactttctctctgacaaacatcacagagtaagtaagaatg

SEQ ID NO: 22682 - DNA, 3003 bp, Unknown; identical to SEQ ID NO: 22681
  misc_feature (1)..( 3003): 2750-1469P.txt file - cDNA_ID_2108547; gDNA_ID_1621154; Annot_ID_173404

SEQ ID NO: 22683 - DNA, 3000 bp, Unknown
  misc_feature (1)..( 3000): 2750-1469P.txt file - cDNA_ID_2108737; gDNA_ID_1621146; Annot_ID_56760
ccagtaacgtactaaagacgctttgggtgtgaacggatttatctccggtgaaaaaccgccgttagttaaccgttctcctccggctataactacctgcattgttggaagttacaaaaatttcaaaaatgatcaaaagaataaacggaaacaaatccaataaaatctgaagtgaatcgattatagagaaatgaaacaaacggattcaaatgaacgatttaggtttgacttacatggtagagacgtgacaagaaaggcagaagaaaaacaaattgtttgcgcatttttgttgagagttagaggaaacattcgatggagacagagagagtgttggtgagttattatcgatgcaaatgtgtgtatatacacatttctaagttggaagttggaagttggaaccaaggcttatatagtttttaatctatgaatcaatcaataccgaaatgtcacattttactctattaaaatctctgaataaatcgtattagaaaattttgattaagaggaagagataaggaaacagctctaaagactaaaaaggactaaacgcactaaacattgcccacttaacactcatgaaaagatacattactttttgttggtagaaactgtttcttcactaactattttagtattcatacctattattcgtttattatatcaagtttgaagtttcattaccgatacgtgacaaggacaaacatataaaaatgtaagaagataaacatattaaaagacaaaggaaaccaagaagccatcagtcatgacgcaatgatgacacacatttgaagtcccatcacttcacacgacaacatttcttctccacaatcattaacaaagtgattcaagcccatctcgagttgcattttggttaaacttctatttttatatataaccccaaaatagaaagataatcattatggtcgttgatcaacagaggcttgcagttactgtttacttcactaagaatatggattttttgaaacgaggcaaagacaaagagagtaataatgtagcacaaaagccttagcgtgtatgatgacattacaaaagaaaaggtatcacgaagtcataacctaagccaaaagctctgcattcaacttttagagccatcatcactcttacatagcttagtgcaagacatcagctgatcagggtttaactcttttcttgacgctaacataaacggttacggatttgacttgtttattcttgagggcgtttctcctagtggtatttcgaggaatttgtcactcattcaacgacgtttacgagctcatactcgataagggacatgttggtgtcttctttcactttgaagctcgcaggctctgtgacttcaacacgaccccacttgtctacagctagcctcattgatcctttatacatgtcgattttcgcattgcgtagagttacagttgatccctctttcattaagtccactacacacaaaaccaaatcaagatattactagctaccctgtaacattactagaatcaagtacacaaaccgttatatgaacgttttgtttttcaaatgatttattgactgaagtaaagtaccttggtcatttcttgcggtaaagacgatcactcctgtctcgtcaccaacaatgcattcagaaatccgcaactggcgagcttgaggaccatcagcacgacctttctgtaacaccattttcgtgctgacaatcttcacattgacattgtgtccgctagtcccaggacgcagctgatcaaccttagtgaaagctggcttcttcaaccctgctttggtggaatctgccattttcaataacaagagcctgcattgacaatcaatcatttcacttcttaaccaatttaaaatagatcaaatcttctaatgcaaatgctgatttataagatttagataagattgacacaagaattagaaagcagaacaatgaaggacattccatataatcttaacaacagaaatttcatgtaaaggagatgactttcgaccgagttataacaatgaggcaaaacccgaaacaaagggaaatcgaactcaagcattaaacatagtgcatgcatcattattacaaaaagctgggcagatttgaaatcaagacaacaacacatgaacagcaatgtatgagtataagagattcaaaatcaaatatcagggatttagttttttttatcaatagcttacctttggataaatcgaaggcggagacgaacgagaaatatctgattgacgatttccaaaaacaatcgagctcggagaaagttttctcccttctcttttttctagttctggggaaatggacggtggatctttaatctctaccaaggacccaatcataatttaacacgtgtactgatcgtgcttcgttgtgcgcggtttctatggttaatctcatcgtgcctagatgatcgacttttagtactgcgttttctcaactgttgggcttattcataaagcccaatttaaagtttaggcccattaatgtcgattgtatcttcttacgtaaaaattgtacattgtaatgttcaaaaaccgaagtgttttgtgattgttctagacttctgtagttctaaaagaaatgaaacaaagatgaatcacaaaatcagcaccagatcaaaaacgattatgggccacaatttttgtgatataaacattaaaatgacaaccacaagaaaatatcaaccaatcaaagaaagccacgaaacagagtattttaaaaacagaggaaagcgaaagagataagccttttagacaaaactagtggcagactgaaaaatgaacgcagcgcttgcaacaaccaccgccacaactcccgtactccgccgtgagacgcctcttcttcattattgttctctcacaacaaaatcgccggtttaccaaatcaacagagttagattcggatcttgcgtgcaaacagtcagcaagaaattcttgaaaatctcggcgagctctcagagcgcttcagcggcggtcaatgtcacggcggatgcttcgattccgaaagagatg

SEQ ID NO: 22684 - DNA, 3003 bp, Unknown
  misc_feature (1)..( 3003): 2750-1469P.txt file - cDNA_ID_2108769; gDNA_ID_1621173; Annot_ID_57276
cgcaatggggagtggacaatgggcatcttacatctgggccgaagcttgtttccacacaaaccttaggatcaaggactattccatgcagctcaaatacccccagtttctatccgagtatgctgatgagtacaactgttattctacactgctccaccggaaaacatatatgtcagagccccacttttacttcggaggacctggccggaactctcgttgtccttaatctcatgttgattttgtcaatgttcattctcctgtttttttgttagttttatcttcggaggacctggccggaattttgtttgtcttctaatttaaactaatcagagaagatcttatattgatcataatcttttaatttttttcattactaacaaagcctaagaaagtggaaaacacaatagggagggtaaaagaaactgagccaaatcaaaaggaagtctctaaactgctaatcacaaattgcatcgagtcttgatgccgcggtggaaagtttcaacctctacatgtagaacaaagagacatgttgaaaaataaaatgtgataaaataatttttccgtgtatacataaaaaataaaataaactagtttcaacctctatataagtatatattaccgtcgacatcaatagtaataaaaaatactcaaatgaataaaaacaattctgtggataataagttccaccaaaaggaaggatcaaccataagttcatgacttttgggattatctttggtagttaatcttagtttcatagcacaaagaatgagccaaatgtacgttaaatatgcatatttttattaatttgtatatatagttttgtgtatgtttcttatcaacttaaaaaagaggaaaagtaaaatcatatatatatatatatatatatattatataattgaattatactataaggagaaggcaaattttaattgtgtctaagttactatatatatatatataattatgtacatataattaattttgtattaaattaaatatttgctaccctttatggagcttatataccaaattttgtattaaataaaaaataaataaatagtctttaacctttataaggtactgaaaacctttaattcgtataaattaatatatatgttttgtttcacaataactaaaaaaataagtaaaagtagaaacaacagatatgtaagctctataagtagtaggaaaaatgtaattaaggatccaaaataataatatttatattttatttgcaaccgaaaattttatagacaactcgcattgaaaatgttctcaacttgtttttataggaggcaatacttcttgcggtagggttcaattatattggtgctcaatcagggaattgtccgatgccattttccagtggaatttgatagaaaatttaaaattaagcatcaaaaagttgtctgatggcattcatcggagttgtcttgaatcaccatttttccgtttcatctcctaacgtctgtttttcacttaaaaagtctccaattccagtataacttcgtaaaacttgtacaaaacaaccgaaaaatacattaaaaacgaacaaaaatgtgacaaacaactcaaaacaaacactagacaaaggacataagacactaaaaacacaatataccacatacaattttggagacacccgcacaccgctcttcacctcttggactgtcagtaacattatgacatgactatagacattacattcactttcatgaaatttacaactactctttggatttgggttgcagaaagatgcatacagtaaaacagctccatcaacctcttatgctcatgtttcatgcacataagtactcaattagccataggtggaagcttagaccctgtttcgactttcgagtagctcggatatatatgcattatatcacatatcccttagcaccatattttctaatttaatttacaatatcactcattgccacaagtgtataaaaaccatagcaatagaagggtatcaaagttcaagtaaccaattaaattagaacactagaaatacattctatcatccaatctaagcaatcaagttaaatcattagaacaatattgaactaccgccgaagtaagatctcgtctaccggagatattgtcagattcttgcctccgttttgtatttgttgttttgatttgtaaaactttggctcaagtccaattcaggtattataatatttttaaaaaaagaatattgaactattaataaaatcttaacattttctgttggtccctagtacttttgatgggctctctatatcttcgcttttgtatgtttgaagcattaaggccgaattcatttaaaactcaacttctataccaaaaattttattttaaattttatgtaattaaaataaactaaccaattttttaaaaattactattttaatcacatataaaattaagttttaatttatctttctatacaaaaatatcatcattaatgaaattaactaatttattatatttttttaatcattttttcacttataaattttatctaaaactgaatcgattaatttcttatatctctaaagatatccgtatggtaacaaaattgactccaaacatttcttaagtcgatttctaaaaccgctccaaaagaccattgtgcattaaaaatactaaaaatctaaaatttaaaatattctcaataacaaacatttacgaaccactgaattttattttattttaaaaataatctataacataataattgttttatctgttttctaacacaaattattctaaatacatgattgaaatacatttctaaattggcgttttatagactatagtattttgacaactttgttttcaatattggcgtttcattattttggtgaaagattcccaacttataaaaaaaaaaaacgaatttttaattttcgtcctaatcatttatttcctaaccaaagaaaaaggcaaatcgcgacccgtctctctctctctctctctccttgaaatcgaaagatcaaaaaagcgacactgaaaatg

SEQ ID NO: 22685 - DNA, 3003 bp, Unknown; identical to SEQ ID NO: 22684
  misc_feature (1)..( 3003): 2750-1469P.txt file - cDNA_ID_2108769; gDNA_ID_1621173; Annot_ID_174059

SEQ ID NO: 22686 - DNA, 3000 bp, Unknown; identical to SEQ ID NO: 5316
  misc_feature (1)..( 3000): 2750-1469P.txt file - cDNA_ID_2108769; gDNA_ID_1620779; Annot_ID_167874

SEQ ID NO: 22687 - DNA, 3003 bp, Unknown
  misc_feature (1)..( 3003): 2750-1469P.txt file - cDNA_ID_2108834; gDNA_ID_1972144; Annot_ID_179339
ccaactttaatcacctaaaagcctaaatatgtttaaatcaataactggagaaagatcagccatctaaacgtcgtcggtttatcaaatttttattttgttttctgacggcaccggtttatcaactgttaatgtcaacattttttatctaagccaaacgttttgagttttgacggcctcgacgacattcataaatatttgtgtaaactcactaaaaatcctaaaataatcactgcttgagaacataggcaacatttaacatccgattggcgtcaaaggatttcattaaaaatgtagaaaataagtagtataatgatttgttcataagttgattccatagttttgttattctactcattagctggtgtagtaagcaaagagacaacaccacccatgtgcttagtagaaccatacacacacacacttagtggcaacaccacttgactctagaccataatgatcattttctgtctccatttcgtttctgattttataatttcttggatcaatgttcaataattgaatcccaaatatggaacaataataatggtggttgttaataggacaaaagtttctctaaatagatgcgtttttttttaacttttgtaggtttctttccctatctttcgagatagtttcttcatttgcttttgtgaaagattggtttatgtgtcacggatcgatcattgatgaataatgtgagaaaatgacttgctctttatgaagagagtaactgaaaacgatttgatattcaaacaatatttcaaaagttatgtttctcttttgattatgatctttataacaaacaaccaaataaatatccgatcagcttttcttgttcaacaatattttgatctatatacaaatactatcattcattgataaaatttaagatatgtaatgaactatagtatgttctattgttaggatcctacatctaaagttagatggaatctaaagtaatatttaaatgagatacactaattcattaattgttatttagttttgagttagggtctctattaaacttgagaatctaggttattgatccgggtggagtaacctaagaatgatatgttgcatgtccaatcttgagatttggttccacatgaagggatgagaattattgtcttgaaagcatgttaaattttttacaagatgatgcaaatagtaattaacatatcatgatcaaatcttgtaaattgaaaaaactcaaccttttgaggggaaacagctacaatatatactaatgattatctagctactcgtctaagaatataaatgtttagcatttaggtgaccaatatcaaactccgagctacttgccttacgttttacccttgcaagtaagtcaaattaaatttctattcattactaatcacattatgaaaaagggaaaccaaaacttgctgcctacttcattctttttcttgaatctttcgatttttcttaaaaattattattttgataaatatttcttccctatcttagtgttcacataaagtgtgaccgtaagatgggttagctttctcgtggtttgaccaagtcattcaaaaactcaatatactcaatgcctgaatggtcgtgcagcaacatatatgaagtctgctggctacatatgttaaagttggtttcgagtatgtaattttatatataatcttttaatttgttgaaataattttagatattttatacaaaattacaacctatacctcaaactatatattatactatatgcattttgcttgtagtcctatgaatatgagatttgtcttagagtcttcaaaattttatatttcatgaccgatcaacgttcaataaagtcgccgcttctttaaaagaaaaaatttggttgccaaacctattattattatagcttgagatataacttatgatcctacttttaatgcagtttcgaaattattcttctccaagacgaaaagaattgagaaggttggtccataatctttataacttctaagactttaacgtacaaatgatatatcgtcgttggttttttgcatttaaccagaaccagtttcttgtttatttatattttaattaattaattacaaacccctgaacagtaaattaatattggattttaaaacgttcaatttctgtagagcaataatatttcgaatttgtaagatacacgacaatcgatttgaaaaatagacaatagtagtgggatgtcaacgtcatgaacatgtaaggtcatcggacggcagcgatctcccccatatcctcggacgtatgtgggacaaaataccaccaaacaaaaaaaaaaaattgttgctgcatttctttaataatttgcgttatcataataattaattaacaaaaaaatatcaaaatatttccgataaaaacaaatcttcaacaaaatatttaacaaaaaaaaaaaaaattgcgcattttaatgtagtttatgtagtatttcctagtcacaccattatttacctgatataaacaaaaaatagtataaaaacagtaatattatttatcaccatggtttagtgaatgtacatgaaaaatttgttaccataccaatgagttttggaaaattgaaaattgactcagaaaacatgaaaatacaattttgtgatatttgttttgattcctgaatgaatttaataagctcacaaaattaaaattgcgaaattattcttaataaataaatatttcttactaaataaaaggaaacctacggaagagcaaaacataattttcatggcataaagagtgagagagagagagtcatagacaggagacgtttgagattgatgaacagcgaattcgaaacaaatcacatggaagaagagctctctttcgctaccgttaccttctccacttttctccttcattagggttttctctcttatttagctgcgcagctctctctctttcttacggattcacttcttaaaactcgttaatttcttgtgggtttttgtctcttttgcgatctgattccgaaagttgagtgagagtgagagaatcatg

SEQ ID NO: 22688 - DNA, 3003 bp, Unknown
  misc_feature (1)..( 3003): 2750-1469P.txt file - cDNA_ID_2108842; gDNA_ID_1620409; Annot_ID_156214
aagtttttggcaaaagaactaaatctgaaattttcaaaattttcttttgaaataaggcatcaagtgtcagcatattcatcttctgaatctccctcctctaccaccaccacgaccgcctcttcttccaccaccgccaccgcgacctccaccatgtccattgccgttagctccaggagtcttcatgttttcaggcaatgggaggatttgatcaacacacttcctgaagctgaaatcgtctgcagtatcgtcttccctaaccagaaagaagcatctgcttttccacattgggtgggttcttacttggaaggttttgattcctcctccaatcttcttttcaggctcagaatggcccttcttaatcagatctagcagcaccatgtgctcatactgaaatgtacaatccagaacaaagttcagtacaacgagttagttagttggaagctcaaaagaaactgcaacaactgtaatatattacatgactatgcaatgttttatcttttatttgtgccctcaaaatttgacattaacttcattcttctaaccattatatgacatcaagacccaaaaaaactttctaattcacacacaatccacaatcatataatcagtaagaacacgatacatttgaacttttcaactagtaaaaaagctgcaaaggagtccaatttacaagctatctccacttcactaatcctctccctaaacataatacaatatccacaatcatctccctaaacataatacaatatccacaatcattgtaaacaaccactaatttgagacaaaaacaaaattctaacaccaaacactgaatccaaaatcaaatcatatgaccaatacaaaggcgaacccaattctcaatttcttttagtttaaatacaaagcacgatcatcatcagattcattgataaaacatcttcctaaacacatcacagaacttaataatcacaatcagagctcttagattaacctatataagtctcgagcaaaggaatgaatatttccaaaaaatttgaaactttacaataaacaaagccaaaagacaaagacgaagagtaaacccaaatatgtattaccttattaacatcgagatcagttggccaaaagtgtaaaaacttgacaaagtaatcgaacatcgccacagaggtaacaaactccttgggaccaagtttaaccggacctgacttctcttcctctccaaccttctgcttcttcgattcacctccgttctcttcttcctctgtctcctctctctcacgtttctcatcgccggtctcggctttcggggtcgcggtttcgacttccatgtccactttctggtctgggttcacttccgctgacagggaatcgacgatctcttgttcttcagccattgttaagctagtaaagcttccgcctttttttcacctttctacgatttctagggtttaagcttgagggtgtgtgacctacagaaatcgtctaagcggtatatttatatgactttggtttccgattgaaccgaactggttcggtctatttgattttttggctcgacggcatacactacatgaaaaccaggattttcaatgtagtaactaatttgtcgtcattgatctgtccaattattatttttacgtctcttaaatcttttcattttaaagtctacatttttctaatatatttttttattaatcatctcaagatatttttttagtctacaaattacttttactgttgtagaaaatttggataatagtcagtaattctaaataatagaataaaaactcaaatcttaatataatagtttaacaaataaatcatattatactttttttggataaaaaatgttgatataatttacaatgttattaaaaataatttttgggatacctaaacgttttagatgttcagtctgtcgggatatcttggagacttaacttattgatcaatcacaatttttgccaaagaggaaaatgtcaaagtcaaacgaacatcttttgaaattatttacatctcgtggaattaatggaacttcttaaatttttcaaaaatttgacataattggaatatattttttttgcttctagtcaatcttaccatattatctatcaacagtcaaacacctcaatcttaaattttctaaaaataatggaattattttatcgtattttggtaaagagttatttttgtaatattatctaaaatctaaaaagaaccaagatagataggtacaaaaaaaaaaaaaacttttttttgtgaaaatctgattatcataacgttaccgtgtcaaatcgtcaacctccataactccggttttgtgtatttaattatatatttatctgtttacacgcgcttcgaaattttgatttacttatctgaatatttttccagaccgaacatcaaacaagaaaacacatttgtccgaatttcatcttgagagctgtttgtgcccttcaagaaatcgaaagagagcttctttcccccattttctgcgattcacgatatttcttcttctataggtaatcataatttgatcatcttctcttttatctctttttttctttcattttcttcttgggttatggttggttgattctgctatttgggaattttgatttctgtgacttttggggtttcaatttcattcctgaattgtgatggaatcgaatggtatctctcttttgttttcatggttgagatgtgattctgaaatttggggattttccgattaggtttatgtcttgaaaatttggggaaatttggagacaaagacatattttaaactcagatcctaatctcttccaccaagacattttccctgaattgttccgctttaatgaaatgaaatcgattgtctgagctcaattatgatgtttcgattcaaagaaatggagatttttgtgttgatgatggaacatttatcattataagagttatgagatttttattttgaatctttggatctttcttggtttttaacaggacaacgtttttttacacattgaggctaaaagagagatg

SEQ ID NO: 22689 - DNA, 3003 bp, Unknown
  misc_feature (1)..( 3003): 2750-1469P.txt file - cDNA_ID_2109031; gDNA_ID_2096299; Annot_ID_195631
taatctataaattagaagttgaagagcttacattaattatttagtggacatagggcaaatgttaaagtgatgatgtgtcaatcatatggaaagagttggccaactttcatatatatgattggagtgaatcgaatctacatcattcatcaaccaaaaaataatctagaaaaatatatatcataatttctaactaaactaaacaaaaacgctcgttgttatattttagctttttaaatataataaagctcgtattgacaaagctaacggataaacccttattattttgactggttaattgttatctcaaagaaaaagtatttaacatcctgactttaaatttagaaaagttcatcgactatttgtgatgtcccttcaaaaagattaaaaaaccataacaaaagttaaatgtttctctgggttgtacaaatgttagatgttaactggaccagatcacatataatataagaaaatgaacctgattaattctctttactgagctaaattttttactgacaagtctatcaaattttaccatcatacttaaatcctcaaaaacacataaactatacagtacttttttcttattacgtatttactattctatgcatgaaattgcgtaaatgtttggttgtatgcatattagaatattctttttatttttctctccaacagatttaatattgaacggtggtgttcgtatgatataaattcaaaaccacccaccttttatcctttcgaactttttcgagataggataagatgacataattattttatttgtaatttaggaaaaggggtaggcctttttttttttctttcaaattaatgattgtggggctaaaaaaaataatttgtgtccaacacaggatataatattttgaaacttgaacgtaaatgttgacttttgatttttttttcttctcagcttttgttaaatttaaactcgttcccttatcagatttattaaaatggtgagtgacgaaaaaaaaaaaaatggtgagtgaaacgttagagaaatcgacgtatgaaatgaaattatgagagtgtacagagaaatatttgaacaatacttagagctgacaacaaattcaaacactgaattagttcttgaagacaaactcgctctttgctatagttgaggagaagaatcccacatactcaattatagatcgagaacgaatctttacgttttagttttcttgtcacatttactatgtaaaatggttcatattattattaaattttcatttattttcaaaataaattttttacaaatatatatatattttaatatgatgttaaaggtttttgtacataaattaccttttaattttgtttggtttatttagaaatcaaaatgtaatttattatctacctaaaaacacggttctttcagtataaaaatttacagaatataaatcattaaaagcaaataactaattagtattgtattaaaaattaaacacttatctaataatacaaaacttttgttctaaaacatgaaaacggaagaagtatgtttcttttaaaactatgaaattcatataccatattcagttttatttaatatcatttaatatgaatcgactacctcataattatacaatatagcaaactagggaccatcttatcttttacgtgattcctaaaacataaatatttatgggaatgttgcccaaaaaaaaaaatatatatatatatatatttatgggaattttatcattttcttcctattaagaaaaacctcaaaaataaaaatattaaaatacaaaaggaaaacataaaagcacaaacgaatattccaaatataaactaaaaataatactcataaacccaaaaatacatttttcctttcccgaaattcttttttttgttaatattattatcatgacaagacgaaatttactcaaaaggctacgaaccaaagccatgtgatgactacatcagtaccacgtgtcaagatctaaggacttaacgagttacgagtgtgtcgtgggccatcgaccatggaaaagcaacgagtctttaggtgaatgttttacttgctataaccggtaacaacgggtctggtaataccggtagctccggtggttggttgagttatatggctatgggggtttaagcaagaaagacgtggtcgtgttcttcttataagggtttttgtttataatttggtaatcgaaaaagagagatttgataaaatcctttgtgttgaaggaaaaaaaaatcatataggtaacgtttgatacaagtaaaaaaaaaaaatttccatcactttcttgggtaaaaaaaacatgggttagaggaaaaactggggaaaagattttagattaagtgcgtaaagaattctgattccttcgtctccgatctctcatttttctggagaaattgtcaaaaatttcagatatctatattgtcttggaactgaagattcatcgaaaggtgagaaagatttaaactttttttgatggtttttgtgttctcgattttgtcaaaagtttttgtgtttgtttgatcatcgagaaacttagtaaaaattcattttttatgtgaatttagatttggaattttcaaattcaagttcttttggtttggatcttaaaagggtttttgttatctttttgaacttatcatcatcttcgattgaaatttttcgttttcttatatgatcagaatcatctcattcatcgatctgtgaactccgatctgagaatttgaaagtgtctctctttttgttctaagttgatctgtttatcctttaattcaaagatcgaagcttttttataattgaattacgttttgtgttcttcaattcggatcttgtgtttattagggttttagaatggtttatcagatttgatttgatattaccgatctgtgattcttgaattgaattgagtcttcttatggttcttgtttcttatatactacagattggtgagttttattcgctgcttatcgcttgtggcaatcacatcatctgtgttatgcatccaagtaatg

SEQ ID NO: 22690 - DNA, 3003 bp, Unknown
  misc_feature (1)..( 3003): 2750-1469P.txt file - cDNA_ID_2109039; gDNA_ID_1972122; Annot_ID_179050
ctgacaagagcgatgtttatagtttcggggttgtcctggtagagctcataactggagaaaaaccgttgtcccgaattcgttctgaggaaggaagggggttggcaactcatttcctcgaggccatgaaagaaaacagagtgattgacatcattgatattcggatcaaagaagaaagcaagcttgaccaactgatggcagtggcgaaactcgctcgaaagtgtcttagccggaaagggattaaaagaccaaacatgagagaggcttcactcgagctggagaggatccgttcatcacctgaagatttagaggcccatattgaaaatgatgatgaagaggaccaagtcatggagatcagcagagaatgattctggaagcgtgtacaagaatatttcagcctttatgtaatgtatatggtgacaagaaaatcaataagatcactcggcagcaagtcatccatctttagccacaaagtgtatttgaaattcgaagttaacatgtacttttgaaaatgaagtgtggacttttggtgtgacttgaatgtattatttgatgactggaaaaacttacttgtctaggagtcaacgatgtgtcagaaaatgtttgacttcaagcattatggtttcagtttcagagtctcgacctgtgtaggtagtagaagttatatcccgctgctatcatcattccgctggtaagaattcccaaatatacagaaacgcatgagctctaataagagcgcctaatagaggcttgacatacaaccggaggtgacgatccgactcaaaacagtgcacatgtatactctcatctcatctgatgaaataaagttatctttcaattatgaatctctggttttatttcaccatgtaataatacacacaaattgcattatagaataaagaagaaaaagaatgttttagtacaagaacaataaatgtgggggtttcaaactttcaccgatagataaacagtctagaagaatttaagtttccctttggagagagcttgaacaagttgtaattgacacattgccttgtctttcccggtcaagccatagcaggacgagtgcctagcgcctaaagtgactgcaaagtaaagataaacagtacagaggaaagccaaaagagccaaagctgttaagagatattgatgcctctgaataagagtcgaccagctacccaactcgtcccactgcttctttagacattgttgtctccttgacggtgaagatacaagcccatcaagaaccatggctttataataccaattaacctgcaaaaattgacacacaagtcgttttaacacaattttacaagaaacataaacatgctatgaaaaggagatcatcacaatcagattgaatgtaacatttgggagatcacttttccatcataaaccatcataaatgtcaatgagaaacaagaattcgagacacatatcgctgttttgattggttgtggaaacgacattagtcataattataattacaaaagagcttggatcgtatacgaaagatgaaaatgaaagcaacaaattgccaacaataacgtcattctcaatcaatcatcaatcacaatacacaacaacaacaactcgcgatcgatgcacattggataatcgagggaaacagatccgaagtaggtgaaagattattagaaaacgaaccggtgagaatcggtttagagatctggagaagaaaaagctagattccagctccgtcgacaacccccgaaatcttcagcagtgttgttgcgatatggagagagagagagagatggatctcctccgtagattgatgatggctcgagctgggccgatttgccggatacgccgtacgcggcttattatgtccgttacataaaacgggaatttagggattttatatacaaaacaataaaaagataaaaaataggaaagaagatatataaagaggacaaaaaaatgatgatgcgttgtttgttagcttccactcctttgtgttttgaagatgatgggcatgttgttagaatccgatgatgagtgatgacatttacctaggactatgatctgactcttgcagcttccagagggcatttacgaatacgtattaagataaacttttttaatcattaacgagaagacaactcatgttctagtaatcacgataatgtttagtacttttgtatattgtatttgtatgacagtatgaggtgttcaatattttggtttgcttccaactaaactaaaagtctaaaatacattgttttagttgcactgaaatcctaatagactgagttgccgttgccgtgaatcactttagccggttagcatttagcatccaaaccaaaactatttacccccaatagcctagagttttttttttataacttttttctttttctttgtaaggagacttgcaaggttttagtagaggtctatcttaatcaaaagcccatgcatgataaacagaaggagaaattaaaataatttgggccattagtgggccaaacatgaaaacttggtattgatggtttactagttcctttgtaagttggtcaaaagtccgaaatcaggagcgagataataaagaaacaacgagttgttttacttttcaaggagaggatagctcaaggtttttgatcgatcgcaaggtattttgattctctctttctcaagcgattttcgttttccttcttttgttccagaggtcaaattcaatccctaaagctaggtttctcgggtgaagctttagatcgggagctatgatttcatctcgaatttggggataaatttcagcttattttaaccaatttcaattgattccaaataattctgtttatctctgagcaaaattgattaattttcgattcggtctttaaaaagctgcttttcttaccgtctccatccgaaattagttttttttgtttgtttgatgatttgtgttttgatgatttgtgtttgcgttttggttgatactagcagctgaatattgaatccaacctttaatctgagaggagaaagaagatg

SEQ ID NO: 22691 - DNA, 3000 bp, Unknown; identical to SEQ ID NO: 9970
  misc_feature (1)..( 3000): 2750-1469P.txt file - cDNA_ID_2109082; gDNA_ID_2096296; Annot_ID_195565

SEQ ID NO: 22692 - DNA, 3003 bp, Unknown
  misc_feature (1)..( 3003): 2750-1469P.txt file - cDNA_ID_2109090; gDNA_ID_1620328; Annot_ID_153568
catgtcacttgacaatgaaactgggttggatccagctggtattagagttcgagctgtatcaggactcgtggctgctgactactttgctcctggctactttgtctgggcagtgctgattgctaaccttgcacatattggatatgaagagaaaaatatgtacatggctgcatatgactggcggctttcgtttcagaacacagaggttcttttctcatcgttctttctattattctgttccatgttacgtttctttcttcattacttaaggcttaaatatgtttcatgttgaattaataggtacgtgatcagactcttagccgtatgaaaagtaatatagagttgatggtttctaccaacggtggaaaaaaagcagttatagttccgcattccatgggggtcttgtattttctacattttatgaagtgggttgaggcaccagctcctctgggtggcgggggtgggccagattggtgtgcaaagtatattaaggcggtgatgaacattggtggaccatttcttggtgttccaaaagctgttgcagggcttttctctgctgaagcaaaggatgttgcagttgccaggtattgaatatctgcttatacttttgatgatcagaaccttggctctggaactcaaagttattctactaaatatcaattctaataacattgctatattatcgctgcaactgacattggttgattatttttgctgcttatgtaactgaaactctcttgagattagacaaatgatgaattgataattcttacgcattgctctgtgatgaccagtttcttagcttcgacgataacatttgtcatactgtcttttggagggcattgaattttgctatggaaagcgctggagcttccatgcttgcattctttaccaattagcgttattctgcttctttcaattttcttgtatatgcatctatggtcttttatttcttcttaattaaagactcgttggattagttgctctattagtcacttggttccttaatatagaactttactttcttcgaaaattgcagagcgattgccccaggattcttagacaccgatatatttagacttcagaccttgcagcatgtaatgagaatgacacgcacatgggactcaacaatgtctatgttaccgaagggaggtgacacgatatggggcgggcttgattggtcaccggagaaaggccacacctgttgtgggaaaaagcaaaagaacaacgaaacttgtggtgaagcaggtgaaaacggagtttccaagaaaagtcctgttaactatggaaggatgatatcttttgggaaagaagtagcagaggctgcgccatctgagattaataatattgattttcgagtaaggacatataaatcataataaaccttgtacattttgtgattgtatgatgaatatctgtacattttatctggtgaagggtgctgtcaaaggtcagagtatcccaaatcacacctgtcgtgacgtgtggacagagtaccatgacatgggaattgctgggatcaaagctatcgctgagtataaggtctacactgctggtgaagctatagatctactacattatgttgctcctaagatgatggcgcgtggtgccgctcatttctcttatggaattgctgatgatttggatgacaccaagtatcaagatcccaaatactggtcaaatccgttagagacaaagtaagtgatttcttgattccaactgtatccttcgtcctgatgcattatcagtctttttgttttcggtcttgttggatatggttttcagctcaaagcttacaaagctgtttctgagcctttctcaaaaaggcttgctcagtaatattgaggtgctaaagttgatacatgtgactcttgcttataaatcctccgtttggtttgttctgctttttcagattaccgaatgctcctgagatggaaatctactcattatacggagtggggataccaacggaacgagcatacgtatacaagcttaaccagtctcccgacagttgcatcccctttcagatattcacttctgctcacgaggaggacgaagatagctgtctgaaagcaggagtttacaatgtggatggggatgaaacagtacccgtcctaagtgccgggtacatgtgtgcaaaagcgtggcgtggcaagacaagattcaacccttccggaatcaagacttatataagagaatacaatcactctccgccggctaacctgttggaagggcgcgggacgcagagtggtgcccatgttgatatcatgggaaactttgctttgatcgaagatatcatgagggttgccgccggaggtaacgggtctgatataggacatgaccaggtccactctggcatatttgaatggtcggagcgtattgacctgaagctgtgaatatcatgatctctttaagctgtcctgtcagcttatgtgaatccaatactttgaaagagagatcatcatcaattcatcatcatcgtcatcatcatgatgctcaactcacaaagaagcctgagaatgatactttggtgcgaaattctcaatacctctttaatattcttattgaatgtaaattatacaatcctatctaatgtttgaacgataacacaaaacttgctgcgccatgtttgtttgtcttgtcaaaagcatcaatttgtgggttatacgtagtgtagaggatgattcaaatttgtgataaatttggtaatcaaagttaattctgaaaatgcaacaccacatgaactatgtcactaaggcctagaagatcgttatcagtaatagactaatagctcgccaccatgtatgtgaagttgggaatcgataagtcggaagagtgagagacgtggcttaacctggtccctctaaatccatacgatcgcttaatgaaatcctcggaataaaacagcagcttctcctctccaaccaaataaaatcctttaagctcccctctctctcccattctcttctcccttttctctgtttcgcggcggagaaaattgaaatg

SEQ ID NO: 22693 - DNA, 3000 bp, Unknown; identical to SEQ ID NO: 1391
  misc_feature (1)..( 3000): 2750-1469P.txt file - cDNA_ID_2109094; gDNA_ID_1620396; Annot_ID_155768

SEQ ID NO: 22694 - DNA, 3000 bp, Unknown; identical to SEQ ID NO: 2704
  misc_feature (1)..( 3000): 2750-1469P.txt file - cDNA_ID_2109154; gDNA_ID_1620578; Annot_ID_161051

SEQ ID NO: 22695 - DNA, 3003 bp, Unknown
  misc_feature (1)..( 3003): 2750-1469P.txt file - cDNA_ID_2109164; gDNA_ID_1620618; Annot_ID_162145
aagttaaatatcaatattttatgaataaaactgtattttctcagtaaatcgaattaatagaacaattaggagaagattaacgtattaggctccgtcttcttcttcttcttctcccttgtaacgttttctggtatgggccgctcacgatttctctctcaaaatatctttgcctttgtacttatctgatccataataatctctggataacgacgaattgacgattctgagactttatttttgtttggttttttgctagtttactaattcgttaagtgtttgatgataatgactcttgaaaaaagtttactttatcttcttctcttcttctgcttttggtagtcgtctagtaattaagattgatagctaagtaaagccaagatttctctggcttgtttttcaagaggaataacgtaagcgagcaaaaagctccacttattgtcgggaagcaagcttcgattctttaaattcctccaaacaaaaaaacacaacgtggaaacttttctataaacccttttcaaattctgtggattagaccagaagaaagaagaaaatttactataaacccttttcgattccactaattgttttcacaaaactctgttctgtactctgttttttgttaggtcattttttagcaaagaagaagaagaggaatggcgatgctagttgatcctccaaatgggataagacaagaagggaaacattactacacgatgtggcaaacattattcgaaatcgacactaagtatgttccgattaagccgattggaagaggagcttatggtgtggtttgttcttcaatcaacagcgaaaccaatgagagagttgctattaagaagatccacaatgtgtttgagaatcgcatcgatgctttgagaacattgagagagcttaagcttttaaggcatgtgagacacgaaaacgttatctcccttaaggatgttatgctgcctactcacaggtacagcttcagagatgtttatttggtctatgagcttatggattctgatttgaatcagatcatcaaatcctctcagtctctctccgatgatcactgcaagtacttcttgtttcaggtacgttggttcgatacattttctgtttctcttgttaagctttggtttgatgattgaattgtatctttttgtcgacattgtagttgctaagaggattgaagtatcttcactcagcaaacatccttcatcgcgatttaaagccagggaatctcttagtgaatgctaattgtgatctaaagatttgtgatttcgggcttgcgagaacttatgaacagtttatgacagagtatgtggtcactcgttggtaccgagcacctgagcttcttctctgttgtgataactacggaacctccattgatgtttggtcggtaggatgcatattcgcagagattcttggaagaaaaccgatattcccgggaacagaatgtctcaaccaactaaagctaatcataaatgttgttggtagccaacaagactgggatctccagttcatagataaccagaaagctaggagatttataaagtctcttcctttctcaaagggtactcacttttctcatatttacccgcacgcaaatccgctggcgatagatttgttacagaggatgcttgtgtttgatccaaccaagagaatatcggtcagcgatgcgcttttacacccctacatggagggactgttggaaccggaatgtaacccgtcggaaaatgttccggtcagtagtttggagatagatgagaacatggaaggagatatgatcagggagatgatgtgggaagagatgcttcattacctcccccgagcttaaatcaatattttgtaaaatcatctctctaacacttgtttataactttagtttgtggtaacttgtattcgtcttccatgtttctttgttacgttgttttgtgcggaatgtcattgagatgtatgcgtcaaagtagactttcggttattgaaatttggtctggttatttgatttataccggatccggtttactcccctcgtatgagagaccttcggaactatggagaaggttttgactctctcttcagtgatatgatccgtcgcaaatcggaatctgccggcgagatggttccagtcgtctttgttcccttattgatagaataatcaaaaatccgagtcggagacgacgaagacccgagttccagctattaactatgcagataccatcaagagagcatagtttcattctatttctcttcatatctggtaaaaatcctcgtcgcacgaatttgccctctctcgaatttttgagcttttgaaattttatcttttgggaaatgctgcagcttttgtaattggtgctgcgtctgtacctgtacctgattctaattgctacgctctcgacaattcaagtcgtcttgtcgattttgtatcctctttctattttattaaagcttaggatcaattcttagtaaaaaagtttgctttttgttgcattggtttgatttcgtgtcttgtaaagctgcttcctttaacttggtttgatcagagcagctggatcggtcatccatttgaatatgatggcaaggttgtgtatatgtttctcattttttagtgttgagagttagttttaaggactttggggttgagttggtatgtgttttttgatgcaggaatttgatttggtggttagattttgcaaggatgtggaaacaagagggcaggcggtaaaatatttctatatcatcaaattcaaaagctttttgtttctactctagattccactaatgtgcgttttcttgcgtgcagggatatgttgattttggacgatttgacccgttaagctactttgtttctagttctgaaaatttcgatttcgtgcaagtaagagctttcacttctttgctttgctctttgggatcaggcatcagaaccaattgttgcatttggtagactagtattatgatattatcctcggaacatggattcatttgttagtatatataaatatagggtttaccatg

SEQ ID NO: 22696 - DNA, 3000 bp, Unknown; identical to SEQ ID NO: 9888
  misc_feature (1)..( 3000): 2750-1469P.txt file - cDNA_ID_2109180; gDNA_ID_2096290; Annot_ID_195337

SEQ ID NO: 22697 - DNA, 1243 bp, Unknown
  misc_feature (1)..( 1243): 2750-1469P.txt file - cDNA_ID_2109180; gDNA_ID_2926169; Annot_ID_140057
gagggcacatcaacatggattctaaactatgaatctaagactcacatcgtcgatcacaaaaattcaggatccttctcaataagtatccaaggaattgagcggattcttatccggagtcctagcggtcgtgaaactttggctcaacaaaaatcgctaggaaagaagaatgcaacagtaagaatcgcatccgagatcccacctgttttcctcaccggagaagaaatatgcagtatatttgtggctaacgtgttgtccaagtcaaagatcaacaagtggattcagcaaagtattgttcctaaaatctgcgaagacctgattgatataagacgccaccttgaagaagaagaaaaagatggtttcttggttgaagttgaagttgttctagaaacgttgtatagtgattggttaagagtcaatgattatgactctcaaggttgtctaataccaatagaagaagagtgcataatatgtctagaagagttagcatcatcaggtagtgagaggaggatcatgaagttgctttgttctcacagttttcataaagattgtattctcccctggctacgctgcaagcgatcatgtcctacttgtcgtgacgacatccacaatcgtcgagcagaagaagaccaccatgaatgatattttgtaaaaagaaattaagaaacaaaaaaagaaaaaggaagaaagaaacaattcaagcgtttctcgtttctggattgataatatgcaagatgtttggtgctagattctgagttaagagttttgatttcctttgttgtgtgcttccttagtcgtcattgttttgacttgtttctcttgtagtgttgttatttgctctccatatttcttggcttagtttccgaggatatctttgtcatccttcgacttagtttccgggatcatgtattgatcgtcggctttttgtatttcacctaatatctcatcaatgaaaattaatcttccagtgaaaaaaaaaaaacgaaaaattttcttaattgaagaaaaaagtgtattttccttttagtttaataaattagattgttttcttaagagcatacaatttctttagttgaaggaaaaaacgaaaaggccgtgaaagaaatcttattgggccacaacgtgagcccatttagtaatgtaatatcagaaaccctagtgtacgcttataaaagacattttaggtttgttcagctgttttacggagtcgcttttgagatatcgatcttacgaagaagcaaatatg

SEQ ID NO: 22698 - DNA, 1243 bp, Unknown; identical to SEQ ID NO: 22697
  misc_feature (1)..( 1243): 2750-1469P.txt file - cDNA_ID_2109180; gDNA_ID_2926169; Annot_ID_199390

SEQ ID NO: 22699 - DNA, 3000 bp, Unknown; identical to SEQ ID NO: 9888
  misc_feature (1)..( 3000): 2750-1469P.txt file - cDNA_ID_2109180; gDNA_ID_2926170; Annot_ID_199408

SEQ ID NO: 22700 - DNA, 3000 bp, Unknown
  misc_feature (1)..( 3000): 2750-1469P.txt file - cDNA_ID_2109184; gDNA_ID_1620312; Annot_ID_153008
gaagactctgaaatcaaattttctcttattttaataccactactccttttactaaagccaataaagaagaaacattcagctacagacgtaaaaaaacaatatggctgctgactttaaattttggttataaaatcacaaccataacaaagctaggaagagagatagtcatcaaaatggattcccactttctggagaagataggatttatctcaaaccaaatctccagagataaacttaaaccaggagatcacatctattcatggcgtaacgcttatatctactctcatcacggttcagtctctatctctcaataacgtgactttttttttgtttcggattgcatcaaagataatcaaatatttgatgctcatcctcaggaatatatataggcgatgagaaagtcattcatttcacttgtggaggtggtctagaaactggaactgggaccttcttggacaagatcgtcgttagtgtcatccctaatcataaaggagacaatccttgttctaattgtgaagagcaattgaatctcgaaggtgtaatctcttcttgccttgactgctttctcgccggaggaaacatctatcttttcgagtacagtgtctctccagctgcatttatcgccaaacctcgacgcggcacatgcactatagcaccttcggatccctgcgatgaagtcatttcccgcgccaaatacctcttattgcggaatgggtttggtgattaccatgctttggaaaacaattgtgaagattttgcaatatattgtaaaacaagcttgctggtcggaaaagactatgtgttgggaaggggcggtcaagccagctcagtgagtgcagctgcgtggcttgcgcaacttagtcctttcggcagcaaagctattcagctatttgcagatattggtatgagaaaggatgctattaaggtgcccgtcgagagcctcgttcctcgcgcatatgctactggtacctctagaaatagaaggtgatgaggtttgaagacacgccaacgggcgggtaggcgaattcttcgaagaatctataatgtaggaaacatgatccaatattgtagaaaaattcactactattctatataaaccaaaaaaacaaagaatgagattcctcagacatagagttagaatgatttttttactttccatcaaggcaaatattctacaaagataacattttacattgaggagattaagatcttattgtcgagatgcagctagctactgagaataataaggcgggtggtattgaggcggcaacacatatccagtttgctgagcatagtaaagagattgaggagttgcacctgaaccaaagagcccagttaatgggttcacaacaacaccagaaaatgctgaggtcataagaccataagggttcaactgtaagccatgatgactatgctcaggcataagaagagcttctggtctagaaagtagctgctgactcggaactggaacttgtgacccatttttgcagtctctagtccgctttttccccttttgctgtggctcttgcttgggaggattagtcgtgttgcgtttcctcaatgccttatttttctccagctcttctacacgttcctcaactttctcctgagtaaactctgattcaaggttctgatctttgatgattttgatcaatggtttcaaggcactgacttctttatcagaggcttcgttctgcgacttgagagagtagttatcttccacgcaaactctaagagcagcttctctacagtccttaatgtaagatttcaaaacagggattggctcaaattcatcagtcatcccacactcatacatgaatttgactgctaaaattggtttaccagaatccaagagagtcttgatgagtttcccaactcttttcctatctacaccaatcttgttacaaaccaaagttgcttgcttatacttagcgatcatgaaaacgtaatcagaaagctcctctgtgtcaaattctgatcctaattcaaaagctgcgaccaaatgcagaaacactaacgcctcgaaaggcttgacaccaaccttagatttccaatggtaagccagtttcttagctctatttctcgtatcaacagtgatattcgcattgatctcaatcaaaacttccattaacaaaacgaaaactctccttacatcgaatgatcttcccgatgatgacggtgtgtagttcgaaccttcaatcgcgtcaagcaccatggacgccgtatccggagagtaacgaatcgctgcagaaacttcctgattgagaggagtttcatcatcccatatcctaatcaaatacttaatcaaaccaattccgtcaatcttctcacacaaggctctcaactccggctcaacaacgggttgctccgatacctcctccgaagacgacgatttccctgcatcagaagcgtcgattctatacgaatcatgttccaaaggagatgtagagtggaggaggcggaaacggctagcaagggaggattggagagaggaaaagtgagaatcgatctcagaccaggaaagtgagaaagacggtgaaaggagagagcgatgagcttgaagatcgtcgaaagctttctttagcttttccttcttctcatcaatctgatttatcgcggtggcgatagtctcactcgccgtcattgtttgatctctaagatttctttggctctctccggcaaggatatataagaacgttatcggttcggttcggttcgagtaagtttaataaaaccagaaccgaattgtttttcacttgatttggttcgatttatagaaattgaaatggtttggatgaattcaatttcgtttctactcggtttagagcgacctctattaagacaaaatcgagaccacaccagtctatagtctctctttcgagtctgcagctagcgtgaagacgatgaaatcgatgggaggagatagataagcgcgaatttgagagtgaaaattctaaattcagacccattttcaccggcgcgagtcatcgttgaaccatg

SEQ ID NO: 22701 - DNA, 3000 bp, Unknown; identical to SEQ ID NO: 1867
  misc_feature (1)..( 3000): 2750-1469P.txt file - cDNA_ID_2109192; gDNA_ID_1620460; Annot_ID_157747

SEQ ID NO: 22702 - DNA, 3000 bp, Unknown; identical to SEQ ID NO: 2709
  misc_feature (1)..( 3000): 2750-1469P.txt file - cDNA_ID_2109199; gDNA_ID_1620579; Annot_ID_161097

SEQ ID NO: 22703 - DNA, 3003 bp, Unknown
  misc_feature (1)..( 3003): 2750-1469P.txt file - cDNA_ID_2109211; gDNA_ID_1620808; Annot_ID_168945
gaactgaagagcgtatcttctccatgtaatctcctgcttctttctgcaacaaatacatatgaatttcatacgatgattaaaagctttatcatatagtcaattttacggtttggcattcgattttccggtttgattcgggttacttgagtttcacgttttggaaaaatgggttcgagcaagaaccgaaatacatatgttaatcaaaaacagaacccgaatcaaacctaaccgaacttcgaaccagaacaaatttcttttgtcaactcaattattaaccgggtctaacctggtttcctttgtatgcattggctatgttttcgtcgagaagtgccaacaaagatctgttgatttggtttttctccaccatatccaacaactgtatcaaaagaagaatcaacaaaatgtctcaagatcatctcatgaaatcatcataaaatgtttttgtgtttatgggtaaagtgtcacatactgtggtttttatatcggttgaggttaagagtttggttaagctatttgtagccgtcataagctcattttgcattttgtcataagcctctgcaaagcaacataacaagagaagttatcaaaacctgtaaaatcgttgagtccatgagtcacttaataaggaagcaagagatggcacaaacctattccttcttctaaagctttttgaagtgtttcaagctcaatcaatctatcttcaatatcctgcatgattttgccaccaaaaaagatagtttagtagtctgattttcggtgacagattaaatgttgttgcttcaagaaagttgtaccgcagtcttagtaacagcaaatcgaatctgtccgatttcaagtcgtatctgcgcaaagaattcgtcgtttaacctgtaaaatttacagtaatcatgagctcgtttgaagtttagtcatcatctcaaatccccaaatttattactctagtatctatatttcaacgaaaacggattcacttgagaaactaaagcaccaaaacatcttcacagggtcgattcatcgaacactgaacatctatattcaacaatttactctcccaaatgctattttgatcaaccaagtatcaatatttcaacaaaaacggattcacttaataaactaaagcaccaaaacatcttcacagaggcaattcatcgaacacgttgtgtgcaacatacaaaaattgacaaaccttcctctaagcctagcgatctcatactcaatctcctgagcttcagtatcaagaaagtactcaatcagctccgcagcagtatccggtacaactctagactaacaaaacccaaacaaccaaaatcaatcgatataattgcaaatcacaaatcagtatgatttcaagaaaaaataagagatttttaacttgtctaagagcttgacgacgctctttctcttcacgaagttgtttctgaaaagcttctcttgcctctgaatctctctctagccgacgcttaaactcaagccgagctatatgaccagtttgagccggacccaacacacctttcggatccttccttcgaatcaatcaaacaaagaatcaatttcatgaaactaatctcaaataaaacttccttgttttgatcaaattcttacccattcgcatgtgattttgctcctccgtgaattaaatctcggaatcgtacggacggtggttgcagcggcggcgattccaaacgaaagcgtagccatttttgttttttgttttctaagtgtgagctctgcttttttggttagctacgttatctctaaacttctcttatctagttatctgttttaatggcgggactattcgtgaccgttgaatttacaagtgctgagagacgtttgatcagatcgtaaccgtttaaacgttttgatctgacgatcacatgtttgtcacgtggcaatataaggaggtccttttaaacatgtgcagaggcccaattaatcaaaaccttgtaaggcctttctatagcccaattatagaactattcttatcgcgctggttatccatatggtttaatgctggtttggatccaaaatttatgaaatgatttagtcttgcaaattacttgaagatcaaagtatttcaggttgacctagtcctaccacaagaaaattcaacaaaatttatggaaatttggtagatgttttattactatattagcataggctataatttttatttttgacagctacaaattgaagtgtacaaagaacaaaagttggcaagaaaacaaaacgtgattaactcatcctagaatctagagatttacgtcaaatggcaattaatataaacatcattttcaataaaatttattaaattacctaaaaaatattcaatcttctagttgaagtatctgagaaataaaaacttatcatgaaaaagaagtctttaagaaagcggcactaaacgctattagaccatttcggtatttatagacgatgaaatatttttggtggattatgcggtcattaagcgaattaaacgactattagatggattgtgtagatttaaatgtgttataatatttgataaaaaatttgaatctttttaaaaatatatataattgtgttaaaaaaaactatactttttattattttattttatcttcctttaaaatgttaaatttaaatttattttcaaaaaatttgataattttaggctttttgataatgtttttcaactttttatataatatataagtacatattgttttattctaaaatcgtttagatcttaacgaatagttataggcgttagacggcctcaactaattgttataagtgttagacggaaagttaccgtccccttagcgtttattttaacattaaaagaaaagatacatactattaaactaatggagtattaacaagaaaaaaaagaaagagtaaaatacgaaaggttccttaagcaagtttataaatatttatagccaaaaacaaaagcaaaaccaaaaatcacaagtaaccccaaaagaaaaaaagcaaagagagaggaaaagaaaaaaaatg

SEQ ID NO: 22704 - DNA, 3000 bp, Unknown
  misc_feature (1)..( 3000): 2750-1469P.txt file - cDNA_ID_2109223; gDNA_ID_1621091; Annot_ID_170725
tcttctattccttgcacaccgtccggatgaatatcaaggtgtagcaagagatacggctgtacagtagccgaagctttagttcctgtaccataaatgacatatgagaaaattctatcatgaaagaaatttagaatgattacaaaaaatacaaataccttttgccttcactacgcttttaagctgcccgccaaatatctcactaagctcagacggaacaaaactttgtgttcttgtcacagctgatttgtttttgggtccaactgtttcccattcatcaccatcatcgttggcagaagaaataaccgatgacttagaagcggtgactttgggggactgttccttgagtttcaacaactcatcatgcatttggtccattataaaactcaaaaactcttgagcatcttcctgcctgccagtacatgcacacaaagttagaatagggacatacatatgaactatttaaaacagaggaaccatcaaaatttagactgtgtaagggagtcactaaccttggcctaccagacatgttgttgagtacatctggggtaaaatttctaaggactccttcgaacatggcaggtctaaaaggtctaccagcctcaacaacagtaacgttatttctgatgctggaactgcttggcacatccaattcggagatgaactcggaaaatgcagctaaggttggagagtcagcctgataaaaaagaaaatggaagaatatcgataagaaaacaaatattataggaaatagaaccaaaatcacaaaaggaacaatgtacgttaaaaacctttggaatatcttggagttgaattttctggaggagctgcacaaaaggagaacatgaaagcaacgcttgtagtgttgcattcaggaagcacaagtttccagcgtttattaatcctcttggtgtaaagtctttaacaggtggaacagattcagtaggaaccttcaggtttttctttctttgaatgcttccagacgaagagtcacttgagaaatcttcattgtccagcgcttgaaatttagagctcgaagctttatacacaggatcactttcaccatcagacatagacaagttatccaaaccaataggatctgttttcaccgccacaccattgttgagagatttgttgctttcagagatctcttttatgattccattttgtaccacatgctctggaactctcaaagagttctttcttgggagttttgcatcactatcattgttcttatccgagctggcaggtctagaagcatcaagtctctcttgagacccagcagatttaactgtcccatcagcctcacctttcttcaactcgccattagtatttactgaagaattttccgcagcaagattcaaggagccaaattgaatacttcccacacacttgtctttagaattctgaggatccttagtgggtttctgctcaaaaaatgacctagtttcatgttctgtaaaggatccaaacacaaatacctgccatgaataaaagtagaatagcaaatgtaagtttcaaaggagaatcatttacagaacaattaagaaaccaaatgataatgaaagttaagtctctcggatatacattgacctcagagaaaaactacaaaatgatcaaaacgaagctataaaaagatactatctccatgaaactaaaccacctaaaactagtctctattgcaattgggtgacctctgcatcgttctctagaccatgagaactaaaccttaagggaaacaaaataagtgaagaaactcaagaggcaaacaacaagtagtaggaaattaccttcttttcactcatatttggcacatagaacgcaacggagaagagattgaagagcagcacaacaacaacaagagcccaaaagacgtaatctgattcagagagagatccgaaacgaaagaagcatgagaaatctcaaaagcgaaatcaaaaactagggtttgatgcaccaacaaccctggatgagagtcgtagacttgagaagacatgaaaggggtagagagacggaggaagaagaaagagaggatttgttcttctctgcaaattcgtaatgggtaatcatccgaatttggaggagagctaagttagagagatagatagagagagagacggacctttcggggattttgagaaaaggaaattagggttaggtttctgcttctgtcttttgtcggatagttttgaggaggagaacggagcttagcttagcgccgtgtttggatcttcttcgtctcctttttcgtcaaaggcgtcgtcgtatctttacaaatataaatctcggttcggttttgtattcactttggtttaattcggttattcaacaaaactatctcaaacagttgttgttactcctgtttggtctgaacggttattaaaaactcacgtgtctgtaggggttccatgtctcgggttcgaagcttgtctgaaattaattttaaaccttaaaaaaatctagagagagaccaaaaagccgacgattagtccaccgtgactccaccggtccctccaccgtgacttcaccggtccctcctccgattagttactcttcttcttcttcttcccccgtttccgatttgatttgtttctgaagttgctgatttatacatgtatcaggaaatggctttaagagacttttggtgatcaaagggcatgactttcacagattttccagcaaaagtcgtcaaatgtccaagactcattttctccactgttgttgttgataagagtctgaaacaacaaggttcgtattggattcctcaataatataatataataaattatgttgattgattttctttcttcgaatcctgagctgttttttcacataaaaattgataagcttttgacttattattgaaaatcatgtaggtcacgacgacgatgagctgctgctgatgtgagagagacctttgtttttattcgtcttaccaaaccataaagaaagaagagagaaaactagaggaagaagaagaagaagaaaggagacaaaacaatg

SEQ ID NO: 22705 - DNA, 3003 bp, Unknown
  misc_feature (1)..( 3003): 2750-1469P.txt file - cDNA_ID_2109223; gDNA_ID_2926198; Annot_ID_201649
gcgtcttctattccttgcacaccgtccggatgaatatcaaggtgtagcaagagatacggctgtacagtagccgaagctttagttcctgtaccataaatgacatatgagaaaattctatcatgaaagaaatttagaatgattacaaaaaatacaaataccttttgccttcactacgcttttaagctgcccgccaaatatctcactaagctcagacggaacaaaactttgtgttcttgtcacagctgatttgtttttgggtccaactgtttcccattcatcaccatcatcgttggcagaagaaataaccgatgacttagaagcggtgactttgggggactgttccttgagtttcaacaactcatcatgcatttggtccattataaaactcaaaaactcttgagcatcttcctgcctgccagtacatgcacacaaagttagaatagggacatacatatgaactatttaaaacagaggaaccatcaaaatttagactgtgtaagggagtcactaaccttggcctaccagacatgttgttgagtacatctggggtaaaatttctaaggactccttcgaacatggcaggtctaaaaggtctaccagcctcaacaacagtaacgttatttctgatgctggaactgcttggcacatccaattcggagatgaactcggaaaatgcagctaaggttggagagtcagcctgataaaaaagaaaatggaagaatatcgataagaaaacaaatattataggaaatagaaccaaaatcacaaaaggaacaatgtacgttaaaaacctttggaatatcttggagttgaattttctggaggagctgcacaaaaggagaacatgaaagcaacgcttgtagtgttgcattcaggaagcacaagtttccagcgtttattaatcctcttggtgtaaagtctttaacaggtggaacagattcagtaggaaccttcaggtttttctttctttgaatgcttccagacgaagagtcacttgagaaatcttcattgtccagcgcttgaaatttagagctcgaagctttatacacaggatcactttcaccatcagacatagacaagttatccaaaccaataggatctgttttcaccgccacaccattgttgagagatttgttgctttcagagatctcttttatgattccattttgtaccacatgctctggaactctcaaagagttctttcttgggagttttgcatcactatcattgttcttatccgagctggcaggtctagaagcatcaagtctctcttgagacccagcagatttaactgtcccatcagcctcacctttcttcaactcgccattagtatttactgaagaattttccgcagcaagattcaaggagccaaattgaatacttcccacacacttgtctttagaattctgaggatccttagtgggtttctgctcaaaaaatgacctagtttcatgttctgtaaaggatccaaacacaaatacctgccatgaataaaagtagaatagcaaatgtaagtttcaaaggagaatcatttacagaacaattaagaaaccaaatgataatgaaagttaagtctctcggatatacattgacctcagagaaaaactacaaaatgatcaaaacgaagctataaaaagatactatctccatgaaactaaaccacctaaaactagtctctattgcaattgggtgacctctgcatcgttctctagaccatgagaactaaaccttaagggaaacaaaataagtgaagaaactcaagaggcaaacaacaagtagtaggaaattaccttcttttcactcatatttggcacatagaacgcaacggagaagagattgaagagcagcacaacaacaacaagagcccaaaagacgtaatctgattcagagagagatccgaaacgaaagaagcatgagaaatctcaaaagcgaaatcaaaaactagggtttgatgcaccaacaaccctggatgagagtcgtagacttgagaagacatgaaaggggtagagagacggaggaagaagaaagagaggatttgttcttctctgcaaattcgtaatgggtaatcatccgaatttggaggagagctaagttagagagatagatagagagagagacggacctttcggggattttgagaaaaggaaattagggttaggtttctgcttctgtcttttgtcggatagttttgaggaggagaacggagcttagcttagcgccgtgtttggatcttcttcgtctcctttttcgtcaaaggcgtcgtcgtatctttacaaatataaatctcggttcggttttgtattcactttggtttaattcggttattcaacaaaactatctcaaacagttgttgttactcctgtttggtctgaacggttattaaaaactcacgtgtctgtaggggttccatgtctcgggttcgaagcttgtctgaaattaattttaaaccttaaaaaaatctagagagagaccaaaaagccgacgattagtccaccgtgactccaccggtccctccaccgtgacttcaccggtccctcctccgattagttactcttcttcttcttcttcccccgtttccgatttgatttgtttctgaagttgctgatttatacatgtatcaggaaatggctttaagagacttttggtgatcaaagggcatgactttcacagattttccagcaaaagtcgtcaaatgtccaagactcattttctccactgttgttgttgataagagtctgaaacaacaaggttcgtattggattcctcaataatataatataataaattatgttgattgattttctttcttcgaatcctgagctgttttttcacataaaaattgataagcttttgacttattattgaaaatcatgtaggtcacgacgacgatgagctgctgctgatgtgagagagacctttgtttttattcgtcttaccaaaccataaagaaagaagagagaaaactagaggaagaagaagaagaagaaaggagacaaaacaatg

SEQ ID NO: 22706 - DNA, 3003 bp, Unknown
  misc_feature (1)..( 3003): 2750-1469P.txt file - cDNA_ID_2109256; gDNA_ID_1972123; Annot_ID_179081
ggtacaacatgtttgattctgcttcctccataatgatcttcaggctacttgatctctttttgtttcgattttatcgccttcttgggataggtacaacgggaagacccaagggtgtgacgataagccacttggctttcataacacagtctctagctaagattgctattgctggctacggtgaggatgatgtacgctttttacctccacttatctgtttgtcctcaatgaaatctatagagctgaatacttccgtaagtaaatagtctcttaaatttctctgcaggtgtatttgcacacgtctccattagttcatatcggcggtctgtcatcagctatggccatgctaatggttggagcttgccatgttctgctgcccaagtttgatgccaaaacagctcttcaagttatggaacaaaaccatataacttgcttcatcaccgtcccagctatgatggctgatcttattcgtgtcaacaggtaaaagtccttgcttgaagtaaatttcggtctgtaaaccgttggttggctgaaatacttttactcaaaggacaacgaaaaatggagctgaaaaccgcggtgtgagaaagatactaaacggaggtggatctttatcaagcgaactccttaaagaagctgtgaacatcttcccatgtgcgaggatactttcagcatatggtgagtcactctcatcaagcttctaaatcaaccgtttttgttaatgttttgactttgagatgttggttttaaagggatgacagaggcgtgctcttcgctgaccttcatgactctccatgatccaacacaagagtcttttaaggtgacttatcctttgcttaaccaaccaaagcaaggcacatgtgttggcaagcctgcccctcatatcgaactgatggttaaactcgacgaagattcatcgagggtcgggaaaattctaacgcgcggaccacacactatgcttagatattggggtcatcaagtagctcaagaaaatgttgaaacatcagaatccagaagcaatgaagcttggcttgacacaggtgatatcggggcctttgatgagtttggtaacttatggcttataggccggtccaatggccgaatcaagactggaggcgagaatgtttaccccgaagaggttaccttccaacacaagaaactgctcgatattaccctcaagtttttttatggattgaatttacgcaggtggaagctgttctagtagagcatccagggattgtttctgctgtggtgataggcgtcattgatactcgtcttggagagatggtcgttgcttgtgttcgtttacaggagaaatggatatggtctgatgttgaaaaccgtaaaggaagtttccaactgtcaagtgagacactcaaacatcattgcagaacacagaacctaaccgggtaaaatatctttgataatctagttacttaacgagtaaattgttgtatatatacttatcagtttgatgaaattcatgaaacttttgttggacaggtttaagataccgaagaggtttgtccgatgggagaagcagtttccgttgacaacaactgggaaagtgaaaagagatgaagttcgaagacaagttttgtctcatttccaaatcatgactagctctctctgatcattacaattttaaaccgttaaaacattctttatttgtttgatgatacaaatttttagttagttttagtttgatcattaaacccattattgccctttaatacagagacaactaaaccatacagatcaaaatcaacaatattttcgagccgatcatttttctctgtgatcaactaaaccaaacccattcttgtatcaagacttcaagccgatcattttcgaagctctctctcaaagaagtttccgattagtatctaactatctatggatttaatcttctatcatatcgttttcaagctttattttaactggatctctttggtaaaaaattgcgtgtttctcttggttgttgtaattgtaaattaattttaatataaatatggttgcacagaacaaaaaaagaacaataataaagtggattcaaacctaaatgtatattatttgatttttccaacgtgaaaagaatgcatgaccgtacaataatcaggaaccactaattttacctaccaaaactatatgtatatgttattactttactgatgggatgggatgggaccataaataattcatattacatttatgatcatcagcagagattgagactctcaaagcatcaccgtggtgataaatggaggtgtcttccctaattttttaatatttgattaaagacacacatgaagaaagataacaaaaatgtctataacaagacattaagggtttgaatggttacggcggacaaaacctccgatcataccactttttatttactattcatcaattataatccacagtggtctggaccaaaaaagataaaagaaaaccgcagcggcttatctgcggaccgcttttacatacaaataaacttggtccacaacggtttattgtctgcttcaaaaatgaagtagactaaaccgtagacaaattagaccgctttgtccgttacatccattcaaagagtaaagacatctttaaagacactcttgattgatcaagacttttgacctagaatctaaaaacgaagaagaagccaaataagatcgaaagagaggtaatttagacaccattaattgttcgcaatgtttataggaaacacttcattcttttatagagagagaaaattatagaaaaactaagcaagtacttgtaagtgtatatttaatctctaagtttaatctcttaattagatttgttttcaagcttagtttaatctctaagtttggtaagcgttcttcaagtggtacctaccactgtccagagcaattaaattcactggccatagctctttactacttacttgctctattccgtattcttatttaatgaccctctttgcttctgcttccttcttatcattcactcacgacactaaccatg

SEQ ID NO: 22707 - DNA, 3003 bp, Unknown
  misc_feature (1)..( 3003): 2750-1469P.txt file - cDNA_ID_2109274; gDNA_ID_1972137; Annot_ID_179164
tgtgttctcatgacgtacgaaggcaagaaaaaatgagccccttgatcatacctgtaaaatactgtcaagttacatagcaattctagaaacatacttgagcaaactgtagatatcacctgtatgacggctacacaagaaagaatatctatatagccagagtaaggaaggaacaatataagtcctaattattggtgaaaagatctcataccctgtccagttctggggaggtattagcattggcaagtagggaatgaccatatgtctagcctgtttaaaacaaaggaaaattgtgagaaaggagtagggagatctatagtggtaaaagattgttatgacccaaacattacaaaggtacaggataaaagatcagtaaaaacatagtccacgattctgcttactgatttgtcaaggccctttaggaccaaaggatcgcattcgatgcaaccatatctcctgctcgtttttctgaagaagaatacaatagaatgtaaataaacagcagatacaaggagagggagagacagagacagatacatgtgaatgagcataaacagaaattcaagactcttacgtattttctaatgtgacagttctgaaattttgcttaaaagcaggtcggatgtcaggtggaccatcatcaaactgttcagctggaggttgtatatatgcattttccatcagcagctgaatcaaacgtgcgccgacctagaagcacaagagtcaatattattaaatcacagagacgagaaaaaaaaagagaaggaaaataagaactattataaagctctgtgcattgacaagggtggaagtataaacaaaccttcacttgagcctcttgaccccatggcttgaatgagtcatgtttcctcactaatgcttttacttgcctcaacttatttttttccatcagtacagtaacttgtttcctcgccttttccgtttctttggccacaatttcttctgaaacattctcagcttctgtattgatcgtcttgtcagttgcattttttttattctttttctgcaaaaaactgttgatcctgacctgatccagtaacaaaatacacaaaccatcaaaccaatatacacttcataccccatggggacaaggcaatatgtatcaatgacacattcctagattcacacatcatgaaatagcatcaaaagcaacaagagaaattaaaacccacctcctgctcaacagcttccccgatctgagtagcagcattcactagcttaacaatgccaacgccttccgcattagtcatcaacaatcccatcatcttatgcatagtgataacagccatcttatcagccggtaactgctccataaaaggcgcatacggaatcttccctttcttgattttaaaagtatcaagatcatcttgaatagcattacgcacaggctcaaaccagcctagaaacaaagacttcatataaggtaaattcggtgcaagcttctgctcacacatatcagctagaatctctctacactctctcgctgctctttcccattcttcagtctccattttcacctgtctctgcttcagcatatagaacttctgtgctcccattcccgcaatgactctctttggcggtatagctgcaagcctagcttttttacggattctctcagtttctttctccatttccgttatcaattcattaacttcatcagacccagaagactcatcttcaggatcagtcgaatcaatagcttgcgcagctgtagcatacccttcaaacacataacattgaccatgacgaaacgagcttaatccacccatttcgttgactggatttatagataaaccatttctaacgccactgagattaacagaagacagaatcccacggactctattcactggataatgagtaccggaggagctagaatcagataaaaacttaacctttctcaatgaagctcttcccagaatgttcctccacattttttgaatcgtttttgtgatcgccacgaaatggtaatagtggctgcttcagatagtttactgcctccacgagcacaatctcgggctatgtagctacttgattttgtagagttattaatacaaacatagaaatcaaagagttcagattcgaagaacagattaaaaacaagacttgggtgaagagaagagagatctggagaaaagagaaggcgccgtgaagtacaaacacagccgccgaaataaacccttcataaaacctttggtttctgcttcacatttcatggatcttgtcaaacccgacccgcttatcagatccgttacgctcttatttgggctcaaagcccatattctggcacgagttatacattaccatgataaatatatacctaattaacattacaacaacaaatcagagtggcgcagcggaagcgtggtgggcccataacccacaggtcccaggatcgaaacctggctctgatagtattgttactcttttttttttttttgtaacttttgggcttagcccatgtctgataaattcgaataaggtatagtattgttttggaaacataggcatatgttacttctttttttcctttgtaaagtttgggtttggcccaagtctgataattccattcggccctttatagtattgttttggaaacatagccatatgtcaccgttcgattagaaacaaacatagtacgtgaaaattaacagatcagaaagagaccacgtgcatcacgtgaccaccttaaatctgataggttagaatctcgtcttatcacgtgaatcccacgtgtcatcacaagctacggttcatttagaggcctaaccgggtaatcacatcaagtcgtacacgtctccaaatcacgaaactgacggacaaaagctcaagtaaactcacgtagtctctcccacagctaactagaactcagccgagtcacgaggcacccaaaaaacaaaaaacaaataagcaacaaaaaagagctcgtcgacggcaaaagttgaaaataaaacaataaacagtcgaaattctccggcgaagatg

SEQ ID NO: 22708 - DNA, 3003 bp, Unknown
  misc_feature (1)..( 3003): 2750-1469P.txt file - cDNA_ID_2109309; gDNA_ID_1620368; Annot_ID_154919
cttgacgaaaaacccatgtcgcctcttccgttctcccagctttagccagaatggtgatagcggtttcccgaggaatattatccgggagctttaactcgtgaagcagacgtttagcatgacccattagaccaactctttcataagccacaatcatggtttgatacagaacttgatcgatttccacaccagagctcctcagcttctgaaacagtgtcgcagctcggtccaatttcccagcttttccccatattgatataatagttgagtaggtaatggcattaggttcaattcctcggctctgcatctcttgaacaagattcgtggccttttcgtgctccatagttttcccatagatcttaatcatcgtattgtaagtaacaacgttctgttcaatgtctttcctctgcatcaacctgaaaagatgaatcgcttcaccgaaaagctcagcctcaccgtaaacacgaaggatagtattgtagctaacaacattaggttcaatatccattttcctcaaactccaaaacaacctatcagcttctttaaccatgtcaagctgaccataaacatcaatcattatattacaagtcgtgagatccaacgcacaattcacctctttcatctctgcgaaaaccgataaagcttctaaaaacttgtgattctctacataaacactcaaaagagtagagtaactaactgtatttggtaagacaccagcttcattcatctcctttataagcaaccgcgcctctctaaacaatttggcctttccataaacattgatcatcgaattatacgcaacaagatcaggcgtaataccagacctcttcaacctcgagaaaatcgagatagccttagagtaatcacacagcctcctagaaagctcaatgaggttgctatacaaaacaaggtcaccagaaacacggtcttgttccatcttttgaagccaagacaaagcagaatcaaacataccctctttaccaaacgaggtaattagcgttgaataagtatacctatcaggggcaagagctctctgacgcatttcgtcgaacagtccgtgtgcaatatcaaactgcttagctctcaacacatttcgaagaacaacattgtaggcgaacacagaaggtgtgtatttggcttcctcatgaacccaatcgagcaatgccaatgatctctgccaatcattttctcgagaaagaagagagaccatgaaccgtatagataattgtctgtctttgtaagttgaaagcaaagaaaaaagctctttttcgttctgggtctggtgaattgaagctaaaagctcgtccatatcgacgttgtggtcgagaaaagcagatctttgatacctccgatgtttccttaaggcctgaaacgacgacgtagtgttcttctccggttgttttctccatacctttttgttttgtgtggattctgaagaagaagaagcagagactgtgaagatgagattgcgttgtctagcttcaggaatggtggagaagggtatcgaagtgtagatatgaggtctggttaagggtaataatggaagagaaagtgaagaagatgaagcaatttctatgtacatcttacacaaaggatttttttaaaaacaaaagtacgttaaattttagtttccagcctcatcgacagtctatttataagtaatatatcagagttgagagtcagcaaaatttaagctcatctctatctctcaaaagcaaagtaaagcttaaccaatggagataaggtattttcatatccgtagttacgtacaattcgtaaaatgtgttttcgtacctaaatatatttgtagagtaaactataacccaaaccaaaaaaatatttaaatttcatatctaaaatttgtgcaaaaacaagagtcaaattaattagtgttagccaacattgttacagtgctaagttaagcgaacacatatatgatgatatgtctttaaaagatatgtagactcgaacctgtaagttatagcttttaaataagtatctaataccgatttatccgacaaccttctccgggttatacacaataaaacaaatttataaatcttaaatatctggtatcaattatcagttcttatttacggaccaaatttcacgctaaaatgaaaatctactattgataaattcgtggaaaagatcaaatcagaagttaagaacaatgacaagactcatttagattcactgctttatgtattttgttagctatgtcttttgaaatcgaaatggaagaagagtctattgagaagatgtatcaaatgatggcggaaattttaattgttgttgatcctacatcaaaatcctagaatttgattattttttccaattcacaacgacattcttttgttaatctgaaaacacaacacacttaaggtatataaactaaaacgtttgggtaaatctcgatgaagattatgagataaaaatggttatgtacctcctttaaaagcaaagatctaaaaccaacatttactctaataaaaattcagataataattgtaaaagtaacagaatgtactttcctaacatgtatacaaccggatatccatcattgtctgaaatggacacacaccctcgaaagtctaaattagttatcactggttacttctctatttgtgtctaacgaataaagtccttggttgacttattatgtgttccaagtttatgggctttatagtggcccatcacatagattccagatttcattttatttcctacctactaagatctgatctggttttaatgctcttgaccagtagtaatctttctcttttcgttatttccttcttcttcagttcctccttcttcaatctctctattctcttactaacgttatttcttcaatctcattgatcaaaaaaaaccaaaaccctaatctgcaaaaatctcaatttcctccaaaagtttcagtttttaaaaatgggttttcttcttttgtaacgaaaaaatgtgtcaaactttgaattgaccatttttttttataaggattcgatg

SEQ ID NO: 22709 - DNA, 3000 bp, Unknown; identical to SEQ ID NO: 5418
  misc_feature (1)..( 3000): 2750-1469P.txt file - cDNA_ID_2109337; gDNA_ID_1620786; Annot_ID_168152

SEQ ID NO: 22710 - DNA, 3003 bp, Unknown
  misc_feature (1)..( 3003): 2750-1469P.txt file - cDNA_ID_2109345; gDNA_ID_1620712; Annot_ID_49040
gtctttatataaatgtttataaacttggctgaggcaggatcaaaggcacaagttttgaagtagtagtggaaaatgaagagctggtagaaatttccttctcaaggaaatgggattcttctctccaagacagtattgctcctattaatgttgacaagaggtatgtcattttaatacaacatgcatttatgtgtgagtgtgacagagagtttgatttggatattgtatcattcaggttcataatgcgtaaagatgtaactggattctactcatatgcgatatttgagcatctagcggaatggccagcttttaacttgcctcagacaaggattgtctacaagcttcgtaaagacaagtaactaaagttcaatatcaatctttcccttaaaaccaatattagtatatactcatgtggaaagaaaacttgcaggtttaaatatatggcgattgctgataacaggcagaggaaaatgccacttccagaggatagattggggaaaagaggaagacctttggcttatcctgaagctgttcttcttgttcatcctgttgaagacgagtttaaaggagaggttgatgacaagtatgagtattcaagtgagaacaaagatctgaaagtgcatggatggatctcacataacttggatttgggttgctggcaaatcattcctagcaatgagttcagatcaggtggcttgtccaaacagaaccttacttctcatgttggtcccatcagtcttgctgtatgtttcttttctctcttcctccttgaaacatgttctcttatctatgatgatgggttcttacttaatgattgtgtaaacacagatgtttttgagtgctcactacgcgggtgaggatatggtgatgaaggtgaaagcaggggactcatggaagaaagtgtttggtcctgtctttacttacctcaattgcttgcctgacaaaacctctgaccctctttcgctatggcaagacgctaaaaaccaggtttatccattaaccaaccttctaccttttgtgcatattataaaaaacttatctaacattgtaggaagtggtgtttgattagatgttaactgaagtccaaagctggccttacgatttccctgcttcagaagactttccagtgtccgataagcgcggttgcatcagcggtagattactagtatgcgacaagtaagcctcacattccaccatttgctctgcttttcttcgttttactatcattcactcaccgttgttttcttatgtttttttgttaaaattccttcagatttcttagtgatgattttttaccagcaaatggtgctttcgtagggttggctccaccaggagaggttggatcctggcaattagaatctaaggtcagccatgcaaattatactcttagaccatataagaatatacatgtaaacaatgaacttatgcttgcatgaatttaacttatatacatagggatatcaattctggacagaagcagattctgatggttatttcgcgataaatgatatccgagaaggcgagtataatctcaatggttatgtgacaggatggataggagactatcaatacgaacaattgattaacattactgcaggttatattttctttaacttacaatgtaatcaagatttatattaggctgtatcaagaagtgcaagttaacttaacattagctacactctgcacacaaaaaccaggctgcgacattgacgttggcaatatcgtgtatgaaccgccccgagatgggccaacagtgtgggaaatagggatacctgaccggtctgcagctgagttctttgttccagacccaaatcccaaatacatcaacaaactatatattggtcatcctgataggtatgtccatgatcaaagatatcacaacattaaggtttcagattgttaaaacagtagagagctaaagtatggttgtacgtaagcaggtttaggcaatacgggctatgggaaagatacacagaactatatcctaaggaagatttggtgttcaccattggcgtcagtgattacaaaaaagattggttctttgcacacgttaccaggtaacaaatatttcacattttctaagaagagtaaaacaaagaagcctcacatttattttaaatgatgataggaaaatgggagatgatacatatcagaaaacaacatggcaaatcaagttcaagctagagaatgtacagaaaagttgcacatacaaaatccggatcgcgctagcaactgcaaatgtagcagaattacaggtgaggatgaatgatgatgacacagaaaagactactcctatattcacaacgggtgtaatcgggcacgataacgcgattgcaagacatgggatacatggaatctataggctttataatgtggatgtaccaagtgagaagcttgtggaaggagacaacactttgttcttgacacaaaccatgaccaccactggagcctttaatggtctcatgtatgactatatccgcctcgaaggacctcctttagattcatactctcactaggacttttagtcacattattgtatacgcaattttgtattgcgggttactttactaataaaaaaaaagacattatatgggccttgtgttgggccttctttctaatctcagatttgactttattacaaacgaaagggtaagaatgtaatttttcgccgactcgatctatcgctgcctatatatacagttacctgcaaaatctagggtataaaagcccctaattttttctccgcccaagagacaaaaatccttcgcaatcgagcaacggaagctcctgcatccaccgtccaaatctcttctaacgtcgccggagatcggtaaaccggttcttcatcccgtattcatctcttattgaggtcttagattcatctagcaccttttttttggcgtcgaaactttcagattccctatttgtaattagttgcgaattttgattcgacgatttgttgctcgaatttgaatcaacagatcgttggggaagtagagaatg

SEQ ID NO: 22711 - DNA, 3003 bp, Unknown; identical to SEQ ID NO: 22710
  misc_feature (1)..( 3003): 2750-1469P.txt file - cDNA_ID_2109345; gDNA_ID_2926185; Annot_ID_140754

SEQ ID NO: 22712 - DNA, 3000 bp, Unknown; identical to SEQ ID NO: 9599
  misc_feature (1)..( 3000): 2750-1469P.txt file - cDNA_ID_2109463; gDNA_ID_1972159; Annot_ID_179550

SEQ ID NO: 22713 - DNA, 3003 bp, Unknown
  misc_feature (1)..( 3003): 2750-1469P.txt file - cDNA_ID_2109489; gDNA_ID_1620362; Annot_ID_154675
atgtaagagattgtctgatatgaacagaagactagtgacgatggaaggaacttagccttacaaagcttgctcatgtgtttctaaagtaaaaacttttatttattgacttatatagattattttcatattattctattgttacaagttacaatgtaaaaatggcctttcatatattaaattatataatcgtggttgattgggcgtatgcggatcgagaactttagaattcaagttaaagcaagtgtccattagaggcaggatgtatatagcttcaatttgctttatttagaaatatataaattagtggttcgtggttttcacgacaaataaaatcaataagtaattttcttttaatcaaaatcacgcctttgcgtctccttgcatctcgcctgaatcatctcagaccgtcccatgaggcaaagcgatggattccgtcatggtttgtcacgcatatgcagtttttattttagtttatatttttttggtaaaaagttaaatttatatcatttttgaaatttacatacagagaacataaaaaaaaaaaccaccaaaaactacaatacaacacaaacaagaaaaacataaacgaaaactcgattagcggagatccatgaaaaaacaccgattctgaaccgtaaagttcagccatttgcatggtttcctttggtcgaaagagttagaatcctcatctttattttctatttttgttatatgttgtcattataatttgaagtttttttaaaaaaaccgatatatatagaacactctgattaacatggtatcaataaaaaaataacatgaaagttagcattggtaagtgctaacctataataatgaattcaaatgatcaccacatgtaaaatcaaccatattccaaagatagttctctcacacctggtaacatattacaaatgcattactacattattagtacgagaggctgtctaaaattaatatgttttgattacgtatatcacacataatttatttttactcttatgttgtgaacgcgtaagcgaataagcatgtgcatgtacatgcacaaaattaattactgaaatgagaaggaaaaaagaacacctctccccaagaaaagatcgatcgcttgaaaccttacttaacctttttcaccacatttcacgcgtcaactcgtctcgatcacaactataaaccctaagtccaccctctcctcaattcttcacagctcaatctctctctctctctcccaaattctcttcctagctctctacattcacataatttaaacaagaagaagaagaagaaggagacaaagaaaggaagaagaacaatatatctcgctgtaactcactaacacattcatagatcaagagaaaatggcccatttcatgaagctactcgtgacaattgcattaacaaccgtggtcacaatcgccatcgtcaccaccaaaaccaccaccaagaccgcaacatttgctctcgaagaccctttcaaggaccttacaccaccaggaacgatcaagatcagaccaagtcggttcttggcagaaaaagtcgacaagggtaaagaaccaaaagcccgtaacccaaacgcagctgaccattgcaacaaggacaatgaaatctgtagcagcagcgattacagcacaggagcaaacgctacaatggcttgttgcaacaacaagtgtatggatttatcaaccgacgacaaaaactgcggtttatgtaagaacaaatgcaagttcgggcaaacgtgttgtcgtggtcagtgcgtttacgtggcctacgataaacgccattgcggtgagtgtaaccatcgttgcgatctcggcgagttctgcgtctacggtctctgtaactacgcgtgatgaatcaatcattcattcacgccaacgtaaaaaaaaaaaaaaaaaaaaaatttaactaaaattatacggatgatttatttacatggacgctgattaaaaaaggtcggtccaattaattatttacttaataattaattaaagtgttgtgtgtatttttggattcccataatgttttgaggggtatataaaggagattattttttctattttcaatgtctacgaataaaatggaacatcctcgttccaatatatactgctgttttattactaaggtttataattggagtgtataaaaacactccaaaataatatcatgaataatgtttttatacgtataatacataaaataaaatctctttcctcatagctggtcctctgattactatcaaacatatgattcaattgcaaatttgcaattattaatgcaagaagaatgagtggaacattaaagttagatcaaaaactcttcattacaaacataaataaattcattttggtgctttctaaattaatttattgatcattttttggtatgtagctaggggttaactcatcaggaagaacattacctagatgatgtcattgtcaaagtcaataggttgacttatccgatggatactaatccaacgggtcaaaaagtgccaaatcgggtcaaaatcaaaaacctcaaagatgacccgtgaacacttgtttttatcttcctcacaaaatccacacgtccaaatcacaacctcaaaatctcacacatcaaacacgtgaatttgctctctttctggttcactcacctaccattactataagtctgaaagagtgattgaaacccacctcgaaaaatctatccttttttttgttttccttctccggcgaatccccggggagattggtaatcggtaatcacggctatttacgggataaagccacggcctttgagctttcatgtccaacgaaagggttgtttaatcataactaatcctttgcctcacggaggacgtggagctctgccgtctgaaggcggcagtccctccgatctcctcttcctcgccggaggcggttccacaaatagccactaaccctaaccctttttctaattaggtttttagttcttagagtcctgtattaatctgttatttcgagattataatatttgtgagcaatg

SEQ ID NO: 22714 - DNA, 3003 bp, Unknown
  misc_feature (1)..( 3003): 2750-1469P.txt file - cDNA_ID_2109499; gDNA_ID_1971906; Annot_ID_176987
tggttaatatatgtttcatgtaaataaataaagaacaaaaaaagcattatttaaactaattagataaattcagataagattctacgattatgaaaatgcgaaaagcagatataaataattcgatgccaattttgaatttatagatcactacactcatgcattcttgttatgttaagttgcattactccaaaactaccaatatcttctggagtaaccaaatagaaggagggaattttaaaacaagctatattcacacagcctcggatgtggtgcctgaacatattggattggttttgataatatttcaattattttcaattcaaataataataataaaactgaaaataataaaatccagtttcattgaatatttgggtattcctagtactaaattagttaaatcaataaaaatatatttgaaaattttaaatccgaaaatttaaaaggtaaaaaaattattttatttacttaaaaaccttgcaaacgaaaatattttgtatataaaaaaaatagtttacataataaaaatatttgcaaaaaacaatataatttagtcttagtgttaaatttacttgagtgaaaaacagttaaactttatatacctcaattagataagctattaaatctatacctcaatttttttattttattttttggttcaacgctatatcctacctaattagattggctaaattgtataagctagtgcaaaaagttcatataagaacaaaaaactgtaaaaggaaagaaatctacaatttcatgtaaaaaatccaacttattaattaacaaattttgaaaaggaaataaagtaaataataatggttatggattcaccttatctaattataaatacatctttatatgctctatcctctatgagtgtactatagagagtagagagagtagaaaaaatgggttcctccatattattggttttgtttactctcatggttatgctgtccatttcttatgaaccactcaaatgtaattatcttgaattttttttgtttgcttttcttcttgtgctatggttttgaatattcataattgcgttgtagggatgggcataaacgcgagccatgtaccggaaacttgctaccatcattgtaaccagacgttcgagagtagtcgccaatgctttaaatggtgtcaagaattagctcgtaaagatggtaatcatactcatttatatactaattaatgggatggaataaagaagttttgatgggtttcttaattctcctccttcttcatcgtattacatgatgaaatatgtaaaattgcagagtacaagatttatgggtacccttactcaaccaacacaaggcgtgtcctcgccgttcttcatgagaaaggtctctcttacgatcccatcaccgtcaacttgatagccggtgaccagaagaagccgagttttctcgctatcaatgtacttttcacatctaaatatctaactctgcttcatgattaatggttaggtcttaactagggtttccattttattggtctcttcttattgatgcagccatttggtcaagtcccagttttcctagacgggggtcttaagttgactggtgagtttaaaactacattttcaactaattaatgatctaatgaattttgatataatttgttttcgtcagaatctcgagctatatctgaatacatagcgactgtccataaatcaagaggcacacaacttctgaattacaaaagctacaaaacaatgggaacacaaagaatgtggatggctatcgaatcttttgagtttgatccactcacatcaacactgacctgggaacaatccatcaagcctatgtacggtctaaagacggactataaggttgtgaatgaaaccgaggcgaagctagagaaggttctagatatatacgaagaacgactcaaaaattctagcttcttggctagtaacagcttcacaatggctgatctttatcaccttcctaatatacaataccttatggacacacatacaaagagaatgtttgtaaaccggccaagcgtgcgccggtgggtggctgagatcacagctagaccggcttggaagagggcatgtgatgtgaaggcttggtaccataagaagaagaattaatcttataatcttgtgatgtactttcggtgatttctttaagtttgatgttatgaataaaaggcaaagcttttgcaaaaatcactcttttttttgccataatgatttcaaaattccaaagaataatatatacttcaatatacatgtcacaagattaaatgtcaaagttgtttataatgagcatttttgtggatgtggaaaatgtgaaaattactctgttcctttgaatgtttctatacgaaattatagttaggatttagtaatgtatttctccataattatgctaaatttagttagttacttcaatatgattaaatactttattgaccccaaatttgtaattgtaccagattgtcaaaagtgtgaaaccaaattttcttttcttttgatattgttttgtttcttattatctctcgttctatcgaatgatctaactcgagcatccaacgatctaactcgagcatctaacgatccacgtggacccaacaacgtcggtcagagtttgactagtagatgaaggactattcttgtggtcgttgtcacgcggtggctgatattttctcttatttttattttattttaactattttttacgttatatttaagtcttgaaccaatagaaacgacgaatcatacattactcagcttgactttgaaataatcctataacaaaagagcattccaagaattttatccaaaaaacaaaataaaaaagagtattcaagcttggtggcgccgtttgtttttggtttattcactaaagttactctgttttagttgtataaatacacactcccatttgtgtatttcttttcatcaatcacaaagatctctctacttcaataaatctccaccttactttaagaacaagaaaaacacagtattaacaaatg

SEQ ID NO: 22715 - DNA, 3003 bp, Unknown
  misc_feature (1)..( 3003): 2750-1469P.txt file - cDNA_ID_2109534; gDNA_ID_1971984; Annot_ID_58739
attgaacgaagacacttaagctacaaacttacaaagtaactgaaattgttaagctctggatttattacacgattaaaagaaaacaaaactagaagcagcaacgtacacgatactacttttatattttctgtcacttgtcaatttccttacactcccattcgagtatttttttgtgtggataatatatttatttttgttaacgtgaaactaaaaatttaatactagatttataacaaattacacgatagctagctaatcaaaactcacaactagtaaaaaaaaataaaaataataataataataataataataataataataataataataatgagagttaaattgttcatttttcattttaaaaaagatacgcttatacgaaacagagtgtgcataaggctatatacatcggttgattgaataaatattgtatattttaattgaattcagataaagtattaaattttaatttaaaaaaataaaatcaaccatttctggaaaaacacatggtcagaaacgtctatcagagtttttgaaaatatggacgattctgacttttctctattctttttaattactttgtattattttaataataagtatcttactgatgaaggtgccctaaacacatcgaacagttctgaaaaccattatcggtcggctgccaacaaaaacgttaagtaatttatagattatagacctacgacataatgtttgtttagcttgtttttttaccgtgttcgtatatatgcgtatttctcttcttcttttaaatgtttttttcgatttttgtttgatgatgacaccacaactcgttgcgtggaccaaaataaacaagtgtacagagatatctacatcaaagtcatgcgatattagatcaatggtctagaaaatatcaattaaaaaagtttccaaacatcatagtactacttgacgtttaactatcaaacgaatccaaatctagatagctccgtaaaaaagaaagaaaaaaaacgttctctcgtttctttctattattcaaaatattttcaccaactaaaaaaagatacatcgaaacaaatctctctaatcatatctaagttataacttttctttataaacaataaacaatagctttgatttgaagcaagaggagcaacaatggagatcaccactatcatattcctcatcatatcctctctcaccttctccatcttccttaaactcatcttcttcttctcaactcacaaactcccaccgggaccacctcgttttccggtcatcggaaacatcatctggcttaagaaaaacaacttctccgatttccaaggcgttctccgtgacttagcctcccgtcacggaccaatcataacactccacgtaggctccaaaccttccatctgggtcacagacagatcactcgctcaccaagcccttgtccaaaacggtgccgttttctccgaccgttctctcgctctccctaccaccaaagtcatcaccagcaaccaacacgacatccactcctccgtctatggctctctctggagaaccctccgccgcaacctcacctccgaaatcctccagccctcgcgcgtgaaagcacacgcgccgtcgaggaaatggtctctcgagattctcgtggatctgttcgagacagagcagagagagaaaggacatatctccgacgctttagatcatttacgtcacgctatgttttatttgttggctctgatgtgtttcggagagaaactgagaaaagaagagatcagagagatcgaagaagctcagtaccaaatgctcataagctacaccaagttcagcgtcctcaacatcttcccaagcgtaaccaagttcttgctccggcgaaaatggaaagagtttttagaactaaggaaatctcaagagagcgttatacttcgatacgtgaacgcaagaagcaaagaaaccaccggagatgttctctgttacgtcgatacgctgctgaatcttgagatcccgacggaggagaaagaaggagggaagaagaggaaactgagtgactcggagatcgtgagtctgtgttcggagtttcttaacgcagctacggatccaacggcgacgtcgatgcagtggatcatggcgatcatggtgaagtatccagagatacagaggaaagtatacgaggaaatgaagactgtgttcgccggagaagaagaagaaagagaagagatcagagaagaggatttggggaagttgagttacctcaaagctgtgatcttggagtgtctaagaagacaccctcctggtcattacttgtcttaccataaggtcacacacgacaccgttttgggtggatttctcattccgcgccaaggtaaacattattcttttacatatatagcccatagtaaatttaccaaataatccgtaaccataaagttatagccccactaagtccaatcatttttgtatttgattatgtgtcggattaggtactataaactttatggtaggagaaatgggccgggacccaaaaatatgggaagatcctctaacgttcaagccagaaagatttctagagaacggagaagcatgtgattttgatatgacgggaactcgcgagattaaaatgatgccgtttggagcgggacgacggatgtgtcccggctacgcgctttcgttgcttcacctggaatattatgtggccaatttggtttggaaattcgagtggaaatgtgtggaaggtgaagaagttgatctatccgagaagcaacagttcatcacaatggtcatgaaaaaccctttcaaagcaaatatttatccaaggagaaagtgatatttgcttttgtcatattatcaaaaaggcccattgggcttatttgtcgtatgtatattaaaaactttgtctcatatgtattaaaacaatttgggcctttaatgggtttcaatataaagatgtcaacacttttagttttcctttccatctttcatggcggagaagtagaacaattgcaaacagaaagaaaccctaaaatttcgaaaatg

SEQ ID NO: 22716 - DNA, 3003 bp, Unknown; identical to SEQ ID NO: 22715
  misc_feature (1)..( 3003): 2750-1469P.txt file - cDNA_ID_2109534; gDNA_ID_1971984; Annot_ID_177684

SEQ ID NO: 22717 - DNA, 3000 bp, Unknown; identical to SEQ ID NO: 5951
  misc_feature (1)..( 3000): 2750-1469P.txt file - cDNA_ID_2109538; gDNA_ID_1620834; Annot_ID_57939

SEQ ID NO: 22718 - DNA, 3000 bp, Unknown; identical to SEQ ID NO: 5961
  misc_feature (1)..( 3000): 2750-1469P.txt file - cDNA_ID_2109538; gDNA_ID_1620834; Annot_ID_169802

SEQ ID NO: 22719 - DNA, 3000 bp, Unknown; identical to SEQ ID NO: 8927
  misc_feature (1)..( 3000): 2750-1469P.txt file - cDNA_ID_2109542; gDNA_ID_1971923; Annot_ID_58561

SEQ ID NO: 22720 - DNA, 3003 bp, Unknown
  misc_feature (1)..( 3003): 2750-1469P.txt file - cDNA_ID_2109585; gDNA_ID_1971868; Annot_ID_176525
tgatacattctctatccaggaccccaacagggtgtattctgggagcatcaatgctgcctgaaacgactgcaacatgagaaagttcatgcttgttcatgattgtttgggcagcgagaagatccatatcaggtgtaacagtccatggcactttacattttcctccactcctcgaacagatgtcattaacaaaaatatcctaagccaaagaaatgcttcaattaatgatcaaagaaatagttatttcagactattcaatttcgtaccttgggtctattatttccttcttttcttgctttgctgaattcctgaatgtctgaaagtgtaagtataccgagaaagatattgtcaggatcaacaatcaaggcgcaggattgtttctctatcagcatacgagttaatgcctcttccaaagaagtgctcatcataactgtcgcaaatcttgttcgcatggcttctgaaacaaaaatactcttcggcagctcctcagattggttgagagaatcatcaaggcaaagagaactttcaacttcacaaaggttattcgttgatgattcatcatcagatgacgtcagagactgtacagcttcttggctctttcttttcctagtttcttttgtttctctagtttcttgtctctttgattgtccagatgtaatccatgaagacatgcctacagctcccagtagaggtaacactatacgataatcctgtgtaagttcaaatagcagtagtactgctgtaagaggaacttgacaaacccccgcaagtgtagcagccattccaacctgttaaacaatgagacaaacaggatcattggcaatgaagctacaaaaaaactagcatccattctcagttaacccgaaaaaatattctgttcaaagtattgataggtaaccaatcaagaaagtctgaaattaagacaattttgaaacattgaccacataagaacagtaccagaccataagcttgtggagatgccacttccaagatagagagattgaaatcagggttctgagccaaagcaagtccaataaactttccataggccattcctgctgccccgccaataaagagagaaggagcatagtatccaccgacaagtccagaagcccgacaccatgcggttgcagctatcttgaccgctaccagctgaagcaaaagatcagctgaaagacccttcacaaatggacgtttctccaacaaaatatccacattctgaaaaccccagtataatacttcagggtataccaaagctatgataccaacacttaatccacccattacaggaaatacagcctttggtatcccagcatccttgttaagactgtcaacagcagatgtcatggatgatgtacatcgagataatgccaacgagaccaagccacacagagcgcccaataaaagatagagtggaagttctgaaaatcagtgaccagctctcataagtttggtttctggttcccttgcgtaaaaagcataagaatggcaatgcatattacctccaggagagcggaagtcatagtcaggaaccttaaacgcaggttcagagccgagaccgatttcggaaaccacagaagcagtaacagcactaagaataaccatagaagttgtgtttggaagtgaagttgatgaatcagttgatgaagaaggccacaaaacggattcaactgcaaagaagcatccagccacagctgcattgaaccctgtaacaacatataacaaagtcctcttaacgaatcaatcaagagttccatacgcaagagagaacaacattagcaaatatcagatgaacaaaccagaggaaatgccagcagctgagccagcggcaagaagtgagaagccagtctgaggacttttattgaacagagaattcacacctttagcgattgacgctccaatttcaacacttggaccttccggccccagcgaatttccagtcccaagcgtcacacatgcggcaacagtcttaaggaaaggacgcaacactgcctttacgcgatcgagactagaatgagaatctccagtagattttccagcagattctcgaagctgattgaggatgctcaccaccaaaccgccgatagtcggaacaaggataacacgcaaccaattggaaccgatcggtgcctctctaagccacgaagctccacgatcaggaatcccatcccaggaaaagtctcgaagcaagtgaacacagttgttgaatagaaccacactaactccagtgagaacaccaaccaaacaagccgacgctatcgcaagctcctgagacggctgctgatcaaatccaacctcatcctgatcagtctcctgcttcgccgccggtaaacgcgggaaaattctaccgccaatagcgacggaaccgaaaaacggtgaaaggacgacattgaactgaaaaggaacgtcggttttgtgaattggagcgaatctccgggaagagacgggagatcggagggcagcacagagtggaagcgtggctgccatgaacggctgcttccgtgaagtgacgcgtgtttatccattaacggataatttgatcttaaatcacaaatcttacgtggctgatcttattattcaaacgcatgggcttgggccttgaggtaaacaggtttatatgggccaataacaataaatttgattaaaaataaaaggcctcttagctttaggttcaaacttcaatggagaagcagtggctgttgtccctcgcagttgatcttcttctcaatccaaaatccagctgataaataaataatttttctcttgtcgtcatattaaaaaaaagaaagattatctgtatttcaagtttcatgagcgtttgccaccacaacattgtcttttcgggttaatttcttcttcttcttccttttcttactaaattctcttaggtagttgtcgattcgatttctttgtcttcctcttcgcttattttcgttgaatctcttgtttacaccttttcctgaaaacaaaattgtgttttttgtagggttttagtcatacttaatg

SEQ ID NO: 22721 - DNA, 3003 bp, Unknown; identical to SEQ ID NO: 22720
  misc_feature (1)..( 3003): 2750-1469P.txt file - cDNA_ID_2109585; gDNA_ID_2926209; Annot_ID_202476

SEQ ID NO: 22722 - DNA, 3000 bp, Unknown; identical to SEQ ID NO: 15439
  misc_feature (1)..( 3000): 2750-1469P.txt file - cDNA_ID_2110032; gDNA_ID_2926134; Annot_ID_197099

SEQ ID NO: 22723 - DNA, 3000 bp, Unknown; identical to SEQ ID NO: 15439
  misc_feature (1)..( 3000): 2750-1469P.txt file - cDNA_ID_2110032; gDNA_ID_2926134; Annot_ID_138847

SEQ ID NO: 22724 - DNA, 3003 bp, Unknown
  misc_feature (1)..( 3003): 2750-1469P.txt file - cDNA_ID_2110032; gDNA_ID_1972121; Annot_ID_178982
ttttagtatgatattgtcctctttgggtctacatgttcaagccctcaagaatttgttattgggttacttcccaaaatgcctcatactagttggagttggacttgacttatatattagaaactctttttcttaacttccgatgtgggacctttggtttatacccaacaatcaaaatacgaattagttacgaattataaagtataaaaacgtaattaaactcagatgaatgaaaatccccaaactcagctttcctcttacggaaataaacgaattttcatgtaactaccacattgctcgatgtttattttgatcgcgtacaagggaaaaaataaaaatttgaaaaatgggggatttgaagtatttttccaatcccttattttactcgtctaataaataagaaatgtttcgctttatcccttaaatgtttacataaatctattgatatttagtgatttgagtatcagcattcagcattattgataactaaagtgggaaaaatgctcataccaaattacaaatgtggtaaaataaagaatttgtgttcttgctctaccgaattaaagaaaataaaaattattattctttaaacaagagaattttgctgcataagaccaaggaaattgtgtccgcgtgtaagaattgttgatcttacgtggtttgtctccagtcgattttaaggttttgccttgatcctagtgtttcttgctctctccgattagttggtgaggtgtgttggtagttgtatttggtttttggtcgcgttggattcttgctttcctccctgtcggtttgctattggtttgtcgtcggtgtgaggtttctccggacttattggtgcttttggtatttacaggttctatagggatgctttgtgaaagtctctcatgcctttgttcaattctagtgcttagattgttttttctccattaattttgtatcttctttcgatttctgtctctatatttggttttaatcagttttgctatattttggagtttagtttccctcttttgggcaaatgtttcagggttattgtgagaaaaaacaaagaaacagtgattattttgacggagatcgagagagagttaggagaaatattaaaaacaatcggagaaagccgaaaagaacgacgagatattgttttctttttcctaaattattctttaagaaaaagggcgtgacggggacgatatcactgagcaatcaaaggggtgatttataaatctaagtgacggcgatttagttgtttgataagttctttgattgctgatttggaagattttcttttaaagttaatccacatggcaaaaatattattattagaagaagataaaatattcattaatttttatagattttctgatatttttagctaaaacaattctaaatttatataatatttacgagtttaaaaaaagcatttacatacataacttaattatcaaggaaaaatattaatagttagagatatcaatgttacaaagttatcagaacgcacaaaaatatacagaaagaaggtcaatatgataaatcaaattcagaaaacgtaataacaaaaaatatccaattaaaataactaaattaatatgaggttaggtagcaaacgtctaaattacaacacaagtaaatttttagccattatggattaatgactattgataaaaaaaaaagtaaaaaaaataagtagaatagaatgaaagtagtgcttggtacattattatgattttttatttagtgaatgttttcagaaaaatttatttaagagtaagattaatggagaatttaacacaacaatttttttttgacttttttttcaattagtttgctagttttttaatttaattaatgtagaatgacacatatcattatttttatgataatatgtcactcatatgagtgtttgacaattttcatatatataatttcaactaataataatttagattaaaaaaaaacaaggaattcaatgccaagaatatcatataaaatatataggaaaagtattaaatttggttgacttttcattttagtcacaaacttttattaatcaacccgatttagactcgtcataaaatattttgatgaaacgcattaacgaggttaactatgtgttacttattatcagttatctccataatcaatctgctgataaatcaacacaatttattttaaaaattttagtcaacaaaaatactgatttaaagtatctaaaggaaaagttaatgtcttttcaaccaaattatttgttaaaaaatacatattttctaaaataatatgttttgctaataaataaaaagcaatttaaaccgaccgaatgatatttacttttgtactaatttggtttctattttcatcataaaccaaattttaataaaaaaaaattttttaaaaaaaacctatgaaacaataacgccggattggaaatagtgtttttttttgggatttttttaaattaacaatttgctctaatttctttatttaaaaaacgcagaaaaaaataataagataaaaagaaaagtgagcacgtagttgtcatttgcagatattatcatttgccaattttcttgtaaattcacctctttccttcgtctatctatcctcccttccgcaacattgtaagaacaccaaatcccctctcatttccaattttttgtatatcttcttgtttcatatttagatcatccaatctctaagaatgttaaaggtcaaattttaaaatttttttgtcggtttttttttcctctccggtgtcggaatccgacaacgtaaggatgattcacataggtttttaatttttgatatgaaaagagattcttctcgtgattggcccatttgttttgttttcaacaatgttcacgttttgatcgcaaatttaatttgatttccatgataaaaattggaactttcttatgttgtgatcatttacaacaatttgtgcgtgatgggttgttctcaatgtaggattttgtttgatgatcgttgggttttgaaagaagagcaatg

SEQ ID NO: 22725 - DNA, 3000 bp, Unknown; identical to SEQ ID NO: 2574
  misc_feature (1)..( 3000): 2750-1469P.txt file - cDNA_ID_2113272; gDNA_ID_1620838; Annot_ID_169964

SEQ ID NO: 22726 - DNA, 3000 bp, Unknown; identical to SEQ ID NO: 2574
  misc_feature (1)..( 3000): 2750-1469P.txt file - cDNA_ID_2113272; gDNA_ID_1620559; Annot_ID_160544

SEQ ID NO: 22727 - DNA, 3003 bp, Unknown
  misc_feature (1)..( 3003): 2750-1469P.txt file - cDNA_ID_2113679; gDNA_ID_1620613; Annot_ID_161969
ctctccatgaagcagttcacattatctcagctaaattcctaactaaactacatatcatgtccaattataaggctacattccatgacacatgaaaatagagcagcaactatcatcaattaacatagtttcttactctttagttcttcttccatgagaagcttttgacactccagaaacttgtcgtccctgccagatctgtggatcaagattgttatagttacattagcaaggctccaacttctctaaataaaaaagaatgtctgggaaaatcaagacggtaaggtgaagtacatgcctgattgaaatgatttcattcctcaacttctcaaccatctccagagaactctgattttcacctctcaaatgttccatcaactcctctgaggctgcaaatagcaaaagagagaaaagacagacacactaagaacgtattcacagacttaaaaggtctcttgttataattctcgattccaagtgtttgtaattgcaatgtgaaatcaaacctaactagagatatctaaaattcaagtatggaacaaaggaactcaaactcaaagaacgaatctttcgaaattggtacctgaaacaaaggtaaggaatttctcttcttgttccttattaatctcatcgtattcggaatatttcttcttctgaaaaaaaaggagatcgaaatcaaaatcgaacccagaaaagcgaaattccggagaaaccctcagaaattgacaagaaaattaaacggaagatgttgcagaaaacctggagtttggtgtatttgtcgtagagcttggcgtagagagcttccattttctgctcactgtagaagagtgaagaatcaaatcaaattgattacccgacccggaaagaagcaaaatcgacgagcttacaaattcgattcaagagagcaaaacacactcgctttggtttccagatttgaaggagaatgacgaaactgatgaattcaaaagagaccaactttataaaattcccaaaccgacgacgcctatgacactgagaagtggattttaattctagggcaacggtttttttcttcttctcaaagcactatttttcttctatctttttatttaattttaagttcttaattataagaatatgaaaaccaagttatccattggattcacacatttttttttttgatgaaaagatctattttggtccacacttgtgaccataattgtacatgccatgaaggtcacgagagtttcgctgggaacttagtacaaatttcctctgttataaacaatcctgattgattattgactacggattcctcttgtttcatcaacctaccaaaaaaaacaatgatatcaccgttgacgctcaaaactccttcatcttcatcctcttatgtctcttctcacttctctgttgctatctcttcttcaagaaacctaaggatggctttatagcgaataagataatgagatttttggggaacacggagaagaggagccaaaggacatcaagatggagacatgatggacgtattgttaatgcttatgatgatagatcctgaatcttggtgatgtcctaatgagtttaagccagagaggtttttagcttcttttggatcagggcaagacgatgcacttcagtacattcttttcggaagcggaaggagatgctgtctgggagtaaatctgagttacatctttgtaggaactgcgattggaatgatgttgcaatgctttgactggaaaaccaaaggagacaaggttgacatggaagaggccattcgaggattgaacctgaccatggctcatccccttaagtgcattcctgttgctagaaacctaaaccctttggcttgctcgaaccttaaaccctgtaactttgaatttgcaaaaaagttgttggtgagaggaagctctgctccgctttgtatgttcccgtgtccaagtctcccggtttaagtggctaccttttggtttagtttggtttattgtgtgaaattgtaaataattgtgtagtgttcttcggtttaaggcatatatcggtttcattgttcactgacttcactgacttcattcacttcaaatcttgtgtttatgatcttaaaaatgcagcggtttttaaggttgattttgttttctccgattcgattctctgtataatgcgatcccactcatatgtgactaattgggtttttgcccatataaaggaagcaaaattcaggtgatgaaggaaaaagatgaagatgtcggctttgaagtgaagaaattggagatttaacaaattcagaagtttgagggaaatttacagcattggaatccctctagacactgctggttaggattgggaatggaggaattaacagctgcaagatcaagaaatcccctaagcagctgaatcgtgtgaccagaaaggggctgattgttgtgaattgtgatcgtctgcttttcttttacttgagattcttgaatctgatttctgatagcgttcgagcgagagagagattttcatgtctcggaagctgatttctacaagagtttatggtcaagacatggacttcccaacatcacttattttgcttggccggacacaagaaggtgggttgggatttagagttagaccactttgacatgtttacttctttgagattgagctaccctattttggtatgtcttgcaactcctccattattcttgtttgttccaatgttttggtctcttaatcctatcctaggaatttgctgtacttgctctggagtcaaccataaatccagtagggaatgattgaatcacatccagtaacatgtttttagtcaaaacatctatctgagattcttagtagatataagaagtttgacaaaaatgaaatgcttatttatagaagagtgatgaactatcttggtcccacactagtaaccacgatgaaaaatacattatttgtatctaatatatacagaggatggtcgattcttgattaacgaatctcatgtctcatcttcctctttcactttgagcaattatggcagcaatg

SEQ ID NO: 22728 - DNA, 3000 bp, Unknown; identical to SEQ ID NO: 14606
  misc_feature (1)..( 3000): 2750-1469P.txt file - cDNA_ID_2113870; gDNA_ID_2684204; Annot_ID_191342

SEQ ID NO: 22729 - DNA, 3000 bp, Unknown; identical to SEQ ID NO: 14606
  misc_feature (1)..( 3000): 2750-1469P.txt file - cDNA_ID_2113870; gDNA_ID_2684204; Annot_ID_137281

SEQ ID NO: 22730 - DNA, 3000 bp, Unknown; identical to SEQ ID NO: 9714
  misc_feature (1)..( 3000): 2750-1469P.txt file - cDNA_ID_2113881; gDNA_ID_1972174; Annot_ID_179951

SEQ ID NO: 22731 - DNA, 3003 bp, Unknown
  misc_feature (1)..( 3003): 2750-1469P.txt file - cDNA_ID_2113928; gDNA_ID_1620797; Annot_ID_168509
atggaaacaaaagaaaattaaaagagatcacaggttggcaattagctatataacagctgttaatgcgaataacaacacttcacagctgtcttacgaactcacttctctatcactttttcttaattttctttcctttttaatacatttcagcaaataaaggttacgtccatttttgaatctaataaataaaaaagtgttctatctctaaattattggccatcgagatatctaaacgacaaattttgttataggaaatgactacttgttatgatttaggattcatatcgtcgtctgttctcttaggttatgaattctgaatttctgatacttattctcgattgtattacatatatatatatatatatatatatatgaccctgattagtatataaactgacaaactgttaccataaaaattaaatgatattttttgataaagtttgattaaaactaatgttactattgataaagtaaactattaactatgtatatactgaaaataatgtaagttgggtgcaaatattgatttgacttaacataaagttcaatgaaacgactaccatgtccataagtatgatattatatgccagccatgataatggaagtgacattttcatgcataaagaaacatgcatgctcctcagtttttttagttttttgatttgttaaataaaaaggctatggtgtagacttcgtgaagaatgtgtgttaagtgtgcgtgcgggcgggatggggtttggagtcgataaggttggtgaaaaagccaaacactgaaaacagactatccgtgatattgacctctctctttcttcacctttccagtttttgtctattatttcgaaacgtcaatttgtataatttgtaacattttacatctactctactactgtctattatttcgaaacgtcgatttgtttctattgatattattgggtaaacattttttttctttttagagaatagttaaaaatgttataacataaccaagtgaacctaactttttatcgactcatatgaacctaagcatgatttcgactctaataataacaacgtccaaacatatcatagaaattagtttacatttgtatataactatatatatatatatatatatatatatatatatatatatatatcaattcaaagaaacaataatttcggtgttggagcccaatttgcttgttgcctagctaggggtaattagatagggacaatgcgtaaatttactctctcttttcttttgggttcagttcctattattgaaacaaaaattacatccaaaatggatataggagttgtgaccgtatgggttgtcgaatggttgtgttatatacttatatgttatttgctaaacaaagttcatctagaacctccaattcaaagccagaaatcagttaaaaatcaatatttgctaaaatgttgattcggatcattcattcatttttataaaaaggaaaaaaattaatcggttctggttaacggtccaaaaatattatgtagattaaatatatataacttttcggtactaaaaaaaaaagattaaacaaccaagagtggaaacgaaaagaaaaacaacaaagaaaagatcatggaccataagaaaaatactagtaatacttaaaaccaaacataaagattgatctagaaatcggtttaaaataaaaataaaaaagaggaaattagataaagacgaagagtgggtcataactcataagaagaagtgcaagctgtgaaatgaagcattcgcaaaaaggaccactcacgtctacttcctctcatccttcttgtctcaaccacatcaactctcttttttagctccatttttgtcattaattaattaaccatacttacaattttaatgtccttccattttctatttttgtttcttaatttcctcaaattattgtgatggattcccaagacaacggagatcaacacaaaataaaacttgaaattgagcattattgacatcatccatccataaccatatagttttggtctttcaaaattgtggtgttttccattttttcgcagatcacatacatcgtatgaagagcgttcatatttcaaaaccggaacaagaagtcattgtatacgtcaagatattagtttatgttataatataacaatctcataaaaaaaaactcactatggaagtcaaaagtcaatcgttcaacttacttattatatttacatatatcaatgaatcaggattttttggtagaaccaaaacttaccaaacccaagcgacccaaactaataatagagtttaggtctaagtacatcatagaagtcaatacaattgtacagtaatacattggcttttagtctacttctatctaaagcaagattcacataaacattgaatttcatacaatttaataagtaaaaattcgttggaaaaaaagttataccgaatccattgatcaaagttaaaacaagagaccacacataatacaaccttatttcccccaccaaaatattctcatctccgcatactcacaacttttatacgcaccaccaaccgacccattttgaaaaagagaaaataaaccacaaaaacacacataaataatatgctgataacaatgtcttaaaaatctatttaccatttctagtaatcaatatctattgcaaaaaatatttataagaatacaaatgaaaaatgataaaatacaaatgatttctcaattacctaaaaaatataaaaatgtcttactttattttcagccactgttggaaagtacttgcaatcatatcgtattttgaattataaaactcagaaacaattattttccctgaaaagttaaaacttttaataagatatttataaaataaaaagaatagtctagaccgaaaatggggtcggttgtccatccaaaggagtgctataaatagaaccctccaagttctcattaggacacaacaactaaaaccacatttatcattacagtctgatttgagctaagttctctcatcataaactctccttggagaatcatg

SEQ ID NO: 22732 - DNA, 3000 bp, Unknown; identical to SEQ ID NO: 11145
  misc_feature (1)..( 3000): 2750-1469P.txt file - cDNA_ID_2113979; gDNA_ID_2214480; Annot_ID_133237

SEQ ID NO: 22733 - DNA, 3000 bp, Unknown; identical to SEQ ID NO: 11145
  misc_feature (1)..( 3000): 2750-1469P.txt file - cDNA_ID_2113979; gDNA_ID_2214480; Annot_ID_183306

SEQ ID NO: 22734 - DNA, 3003 bp, Unknown
  misc_feature (1)..( 3003): 2750-1469P.txt file - cDNA_ID_2114009; gDNA_ID_2214462; Annot_ID_182803
cttcgtggttgctggtccaaagccagaagggttcggacaagattcgttgaagagtttcttcaagatcgagaaatctggagaggatgcttacaagtttgtgttctgtcctcggacttgcgactctggcaatccaaaatgcagcgatgtcgggatattcatagatgaacttggcgttcgtcgtttggctttaagcgataagccgttcttggttatgttcaaaaaagctaatgtgaccgaagtttcgtccaagactatgtgagaggacaactctcgatcttttactttgactactcataataaaacctctatgttttttttttgataaaacacccgctctctgttttcttgaaaactacaaattgaataaaagctagtgaagcacatgcctatttattaaatcttcatcttctctcaatcttaatgcccgatataaatcaaagggatagagtggacgtccatttaaataaaaccagctaacaatacaagcccctaattattgttgtgtatttaataagaaaaaggaagcttttaaacagtacccgttctctagagaattctgatgatggtagtgatatagaaaatgataaaaataattaatactctagtctctagattgactaataactaatgttttcatttagtctaatgactttagttcagtttctctttacataatctaattgatttttttatatatttaaattctcttattctttaatttgaattttatttttgtttatataatagcaaaagtgactgaatcaatttacaaaatgatatttaggtaatttaaaaaacttttgaaaaattgaatctatgaaaggttagtttgcaaaaattctgcgtagaaatttatagaaaaatattatttttgtcctcaatgcatggaatcagttaagggataattttatgcaaaacaaagaaaggcttatgaaaatgtgtggcgttgcaaaatttttactagaacaaaagcaaagttgtggaaaacattgcgaaacgtgaggaacacactaatgttcaggtacgaaccggaatctttcggtttacctaatatgttatcaaaacagctactcaaagatgggcctgttttgggccaacgagatttgtttcagtcgatatcaacacaaattagtaaattaaagttctacgttttatcggtgaaagtcaacggtttcacagatccctggacctaaacagtttttttaaaaggtataaatttttttgctgaccaatatcgtcttcttcccgatctctcagcttcttccatttacaattctaccctttgcctcttggaacctttgaacgaaaatggcggaaacgatcggctcaggtacatctttcttttacttcttcacctttctcaattgaatctttcgtatgtcaacatgcgaatgttctggaactaaaaatgtatggacgatatcgattgattttgtatagtgattgattttagatatcgtcaaaacctttagtctttaatttcgcagcgtttttataattgtgcagaggtttcgtccatgtctgacaaatctgccaaaatcttcgtcgcgggtcatcgtggtttggttggatctgccattgtccgcaagcttcaggaacaaggtttcaccaatctcgttcttaaaacacacgccgagcttgatctcactcgtcaagccgatgttgaatccttcttttctcaagagaagccagtttatgtaatcctagcagcagctaaagttggtggtattcacgctaacaacacctatcctgctgatttcattggtgtcaatctccagattcagaccaatgtgatccactctgcatatgagcacggtgtgaagaagcttctcttccttggatcatcctgcatttaccctaaatttgctcctcagccaattcctgagtctgctttgttaacagcatcgcttgaaccaactaatgagtggtatgctattgctaagatcgctgggattaagacttgtcaggcttataggattcagcacggatgggatgcaatctctggcatgcctactaatctctatggtcctaatgacaatttccacccggagaattctcatgtgcttcctgctcttatgaggaggttccacgaggcgaaagtgaatggagcggaggaagttgtggtgtggggtacaggtagtccgttgagggagttcttgcatgttgatgatttggctgatgcttgtgttttcttgctggatcgatacagcgggttggagcatgttaacattggaagtggtcaagaagtgactattagagagttggctgagttggtgaaagaggttgttggttttgaagggaagcttggatgggattgcactaagccagatggcacaccgaggaaacttatggacagctcaaagctcgcgtctttgggttggacacctaaggtttctcttagagatggtctgagccaaacttatgattggtatttgaagaatgtttgcaaccgataagttaatggtttctcttctcatatatacacaactattgagtctcaggtaaatcagcttatcaccacattgtgatttaaacctttctttgagattcgagaattgcttttttttttatcaaaattgattcatttagagataagacttgcttctttatacaacattgtctgaggaattttaattttggatctccgagtatggtctattattagctctcttctatacaaattatcaaaacagttgtaagaagtttcaagaaaaacatttgatatctcactaatttggctatccttgcaagttgcaacgctaaaatgacaaataatgaattctcggcccaatgggcttacacaagccttgttaaagatagcgtgaacaaaacgcggctcactagccctaacctgtctctctttcgcttaccttcttcttcgtcttcgttggctcagtcacttgacttcacggccccgctcaagctctgacacgaaactcatttcaaattaatttaataaaaccttaatcacaaaaggggcaaaagcaatcgccggcgattatg

SEQ ID NO: 22735 - DNA, 3000 bp, Unknown; identical to SEQ ID NO: 14431
  misc_feature (1)..( 3000): 2750-1469P.txt file - cDNA_ID_2114026; gDNA_ID_2684118; Annot_ID_190868

SEQ ID NO: 22736 - DNA, 3000 bp, Unknown; identical to SEQ ID NO: 14431
  misc_feature (1)..( 3000): 2750-1469P.txt file - cDNA_ID_2114026; gDNA_ID_2684118; Annot_ID_137167

SEQ ID NO: 22737 - DNA, 3003 bp, Unknown
  misc_feature (1)..( 3003): 2750-1469P.txt file - cDNA_ID_2114103; gDNA_ID_1972144; Annot_ID_179327
aagactcttctcttgtgtcaaagctctccatctgagaccaagttcttgttctttgaagaatcacttcctgagaaaagctcttttatcaaaccaaatcctattggataagcttcctccgacagatctcctccatagtcgtgattcacactgttaacagaatagttcagaggcaacaaggcaacacaagaagaaaagagaaattttattattgatttgatgaaacagaagaagacgatacaaatcaaatcaaatgatatattaaaaagaggtgaataaaggttcagacttgggaagtttgtcacagtctgaagaaatccatccaatcctctgcttctcattgtcatagatcaccattatcccttggaaagatatgtctatcacacacatagacacgagatattgttgtcaagttatgaacaaaagaaacctgagaaaaacttagtatatatatacgtacctccaatgatattgtagccctcgagaccgatttcagttccattcagaatacccaaacatactcttcctttttcctgagaaaacaaaccagaagaaacagacttctcagctatagatttttatggagatacaagtcatatctaggccagtatatgtgtgacttacggtgattatgagatacgactcaggtggaacctgaaatagctgaccattcttttgattcccaaatcgtaaagtaatcgtcttgaagtatttcttaacctcatcaagtgatttcaaaggttttttgcctttccagcagactggtaagcttttatcatcttttgtgtccgtcaaaggcttcccattcaagtcttttcttatctgtaggagaccaaattagtcataaaaaagtggaaaaacataaacggtgaagctaatcttttttttccagagaagaaattatcccatacaagatcgagaatagcttggtatgcttctgcattgaagtaagtgtacgagcttccactatcgaaaactacgttaatgcctttgacacctgtggtcttgtcgttaaagagaagctctgctggtccagccatgtagtttttactacagaaaaaattcacaccataatttcaacttgtcaattataaaagtgtgagtaaacaagtggcagttataaagaagataatgctcaaagattgctcacctaggtgaattagtagccaatgaagtccatgtaactccagaagaaggaacaagctcatctccaatagagagaaagcctttaccagtatgacttaagcaatgcacaatcacattcttcgttatccccaaggactttagctgagttgagaggcctactttccctcttccaaggccaagtattcccgctgttggaggaggaggatgtggaccaggattctgctgatcatacccacatctaaaagaaaatttgattcaaaaattaggaacttgtacaaccgcaaatttagtgtttttcttttctaatgtgtgaaaaaaggtagaataaaactaacccaaatgtcaaacgaagattcataatggagccatttgcgagttttagaggaacctcatcagttacaagtgcaccaatagatgatgcatgatcggagtatccgatttcatagtcacattgatcctcagggtcagcacaaggtctgtcctggggaaggtcaagaccagaacacaagatgtgtgaacaaggcaaagtgttgtgattgggcttgtactgcttagcacgaggctgcaaagaaagagaaagaaattctaagatagaacctttgcttattatgtcacacactaaaaagcatatcaacgcttacctttgtgcaaccgttgcaaggtgcatcacactgaacccaagtgaggtcactgccagtgtcaatgtccaagtcaaagagcttaggtgggttgccaatgttaagcaacacataatagtacctgcaaagatgaattcgttaattacttcaacaatcaaattgggcgttttcaatacaaggtgaaaatcagaatcaacattgcccaaaatcttcaattcgtgaaagtagcaagctttgaaatcatctcaaagatcaatagaatgaagatttcacatcttgtcaagcaatgaaatagattacaagtgaagaatccacacagatgcaagagaagccaacaaagtatccgcaccaattcaaaatccagacataagtcaacacaatcccgttaaggaaaatcaaagaaacaagatcaaacccacgaatgggtcactgaaaagtagcataaaacagagaaattgaaacaaaaagatgcgaaatttggcacttacccaagaggatacacattcccggagacaggaaacacgacggtggagctaagtcgacgattctgtaacttcacttgagccgacgagtctttagtagcttcagaggtttgaaagcgagcacagaggatgaagacatagaagacgaagacgaagaagaagtaaaggtttcttctttgctgcttattcggattcatcatctcctctttttggcccccaagaaagcgaaaccaaatcccaccaaaaaggtttcttttttgacacagggcaacaaaaaggaggctttttctttgtagaattgctgctcccttataggagtgagtatttgtttatatatctgatctctctcacactcaatttcgtgcaacttgcagcagaggtttctttgagttcccgtaagctaaattgagaaacttggcatttggctaaaagaaactcaacgcccaacgctcactacacttagcgtgtaaagcacgcgccaaccaggattgactcaaaggcctaacgatcttcaaatgtacagggcccaatatactcggcccataaactctaaaactattcaaatgttaggcgcgtgacgttcacctgtgaatcagctgatagaaatcattatccaatatccagttatgagtgggtgactccaaatagatccaactggcaacgcattattgacacgtgtcttttcatttctcttcttccggcgttttctctccgccgtttcgccaccgtacgtgacaatg

SEQ ID NO: 22738 - DNA, 3000 bp, Unknown; identical to SEQ ID NO: 9726
  misc_feature (1)..( 3000): 2750-1469P.txt file - cDNA_ID_2114138; gDNA_ID_2684236; Annot_ID_192429

SEQ ID NO: 22739 - DNA, 3000 bp, Unknown; identical to SEQ ID NO: 9726
  misc_feature (1)..( 3000): 2750-1469P.txt file - cDNA_ID_2114138; gDNA_ID_1972175; Annot_ID_179973

SEQ ID NO: 22740 - DNA, 3000 bp, Unknown; identical to SEQ ID NO: 12574
  misc_feature (1)..( 3000): 2750-1469P.txt file - cDNA_ID_2116844; gDNA_ID_2214559; Annot_ID_134854

SEQ ID NO: 22741 - DNA, 65 bp, Unknown; identical to SEQ ID NO: 680
  misc_feature (1)..( 65): 2750-1469P.txt file - cDNA_ID_2121696; gDNA_ID_1620307; Annot_ID_152840

SEQ ID NO: 22742 - DNA, 3000 bp, Unknown; identical to SEQ ID NO: 691
  misc_feature (1)..( 3000): 2750-1469P.txt file - cDNA_ID_2121711; gDNA_ID_1620307; Annot_ID_152844

SEQ ID NO: 22743 - DNA, 3000 bp, Unknown; identical to SEQ ID NO: 689
  misc_feature (1)..( 3000): 2750-1469P.txt file - cDNA_ID_2121736; gDNA_ID_1620307; Annot_ID_152853

SEQ ID NO: 22744 - DNA, 3003 bp, Unknown
  misc_feature (1)..( 3003): 2750-1469P.txt file - cDNA_ID_2121746; gDNA_ID_1620307; Annot_ID_152856
gtttaggcattaattaatctaactttgggcccaaaacccaatattatttccgtcttttttagtttagaaaagtctttgttttttttgttgctgatttcctaatatcaaatttgtttcgtatataagataaatggaatgagaccgaagttttggaatgagtcacatgatccgagccagaccaacaaaggaagcatatgagaagcatgagaaaaaaatcacttaagtatcttaattttgttcatgtttgttgtgaagggcttactaagatattaataaagagaaaagataaagtgtgagattagaaagttgtatataagaagtgaatggaaattaaaggtttggggtaatgttggatggatcagcgacaaacgtggaagcgaggagatccaaaaaggaagcttcccaagcttcgcgaggcgtaggagtctacattttaagcatgccacaatttcatgcccttgtttcccaattttgcgattttttcatgttttttttcttttacgtacaaataacatttattcaaagttcagatgttatgatttatgctttatgcttccatacttaaagatttttagttatgatttatgcttccatgcttttactttttttgccatggaaccatttctgtaagtatataatcatcgattataaacctaaattgttttcatttttatgaaatatttacattcttagcaaaaaaaaatagttcagatgttattaagtgagtgtttactgtttatcaacgaattaattagtgtgataaaaatttgcaatataaatgtattgattctctcaatttaccaatcgttttatcttgaatgcatttagagatgggagttcctgtttttttttttgcaattggaatcataaaacgagaacttacgcaatctgaacaaggtcatttaggatagacattttaaattatacaaaatgacagtaatttgatttttgacaacgcatgatgttaacttaattttcttataagatttttttttttttttttttttaaaaacttttgatgatcacatacacgacattgacctaggagttagagcaagaaaattaaaaaaccctttgccaagaactagtaaccaaaacttatgtcgcatgaagcttcatttcttatacgttatatacagtataacattaatagaaaaactagaaatatttctttaatggtgcatgtaacatcattgggaattgcatgtgagtgggatttacaaatttacaatgtgagaccaccttccactcaatatatatatgttccaaagtgaaattttcgttttaatataacatacttgaatatagaaccaaataatatgtatcatgtgtgacgggttcaacgttttcaaatgtcctaaaagaaacaaagaaacaaagtttttgatttattattttaaaatcacaaaaccatataaagtttaaaaatcttgttaaacttcataaaatccgtctttaaaatttttaatataaaagtttgattcatattattgttctttcttaaaccaacatttcgttgatgaaagatggtcaaatgaattttttgttgtcaagctagagaacacctaaattttttccaattgatattatgtatgttaacacaaaaagagttatctaatacgattagttaatttatggatgattccaagtagaaacgccaacataaactttgactttgaggccgaattgatctgcttcttttatttctcttacaaatttgaaattaaattagtcaagtgtgatgataaaatacataacgtttgtacgcattagtatgttgtgtagcggagagactcttgtttataaaaacaatgtttggtttattctaattgtcattttattctttggatctttagttctcgcttagcgtctcgtgcatatttttcctcaaaatcatcaccattaaatgactcacgtacacaataatcacaacaacatacatatatatcaccatgccaaaatacatctgaaaaaaataaattcctagtcgctacactgtcatattttgattgatatttagactatttagtcattcagataacattgttacgaggaagtatatatacatacgtagcgttgtactactgtaactggttttaaatttatagtattaattttgttgatgttccgattgaaaaagtcattttaggaaagaacgaaaaaatagtttgaaagtgatttttttttaaaaagatataatcctacactgtcatgttttgattgatatttagtcattttgtgtgttaattaacactttattatagacagggttagttattaatttaaatctaaatgttcttgtaaaggcttccacttaattttctaatcaccatctgccgaccaaactactttatcaagtcacagcttttgtggaaaaatttccgttaattcatgagcttttctatttgttcacacttcacacaatcattaaattaaattttgcggctaatgttagaattatcgtacgacaactgatcacacgctacatgttctctagcttaaatttgcaacatatataattgaaacatcactcaaccccacaggctacaacatcccacatttaatcaagaaatcaatcagttcacaattactgatgaaattacgcagcaagtaaccctagctaactaggataaaagaaaacgatcaattctcgggaaaattcagtctctcccgaatcccaaaaacaaaagcatgcatttcgtaataaacaacgcactgattctgtttgattttttctacctttatcctacacaacactagttaaacgacacaaaactcaaaacacgaacacagttacttaatctattccccttattctttctttttgattataatagcatatcggaaaaaaatctacaaacattcaaaaaaacatcatctactcatctatatattcaaaccttggtccattcacatcacgaagtccatcgcctataatcatataacatatccaaaaccctaaaacgcaaacactaagataactatttcttgaaattaataatg

SEQ ID NO: 22745 - DNA, 3000 bp, Unknown; identical to SEQ ID NO: 684
  misc_feature (1)..( 3000): 2750-1469P.txt file - cDNA_ID_2121756; gDNA_ID_1620307; Annot_ID_152859

SEQ ID NO: 22746 - DNA, 3000 bp, Unknown; identical to SEQ ID NO: 683
  misc_feature (1)..( 3000): 2750-1469P.txt file - cDNA_ID_2121760; gDNA_ID_1620307; Annot_ID_152860

SEQ ID NO: 22747 - DNA, 3003 bp, Unknown
  misc_feature (1)..( 3003): 2750-1469P.txt file - cDNA_ID_2121771; gDNA_ID_1620307; Annot_ID_152864
aaaattccttgaagcactgatttaagtgctctcgcagctgttgctgcaatgcacataaggaatccaaacaggtgaaagcttggctcaccctgacaacacccataaattaaagaatatcaagcatagaatcaaacacatcacacacacaaacagaacaaaatctccattactcgaacttttttagcataaagttcacatggttaagagaagatgagagaaacacaaaatctagcgaatacaagcacaaaacaataccaaattttctcatgtgaagcataattcaacaatgtctgagcttgtcacaaagataaaagctagcatcattggccaaacatgaaactgaatcaacgatatcacgttcattgctccagaaccatacctatgttcccaacatatctagttcattgctcctacatcacatctacatcaacctctctaacaactcatccaaaagcatacataagggattcaaatttaagaggtcaaaagaagtgaaaataccccactagcaataacaactccggtgacgacagggacgagagtgaagtaagtcaaccaagcctctttcttacgcgtcatcaggtaagcaaacacggcggtgaaaaacggcgtcgtagcaccaatggcttggttaaacgaaacaggaagaaagcggagagagatgttaccaaagaccaccgacacacaaaaaacgagacttagagctgcgatcttaaagaactgaactctggatcgaatcgtctgcatcggaaccatcttcaaccaagcaatggcgacgtagctgagtaacgaacaagccgtcatgtgacacatggtgagaaagatcgggtacttgaatccgtaattgctaagcaagtacttgttcagcaacaatacaccaatgttcgatgagtaccaagacgcgactagcccgattgtgaaaaaccggccattcgtcgccatcttcatcgcttttcttcttcctaatcctgggtcgactcgatctgatgagatgagattcaaactaaaaccctaacgaatttcacgaaattgggattggtgggaatcgaatctggacaggagatggagatctctcggtcctccgatacagaattttgacgcgtcgtgatgatgttattccatcaatgggtaagatttggattaggttacaacacgcgaaaatgctggagacgaagaaaccgggaaagagaagaaagttgggatttttggagaagaagaagaagaagctctgcaaaaaggagagatctttgggctaaagctgcaacaacacttctctttccttttttaactaatttattttttctttcagtttcatgatattataattggtgcgttatgtaatgtttctttgggctaaagttttttttgtttggttacttgaaaaatcaaagtgtgaagatgtgtaacaatgaaggaaaggagccattgactttgttattggttattaccgaatctgagttctaaatttaatgatttacgttcatatactaatccttgaaaattcctagctaacgaaacatttcagttctgagcatatttaattgactaagtaaatcgaccacgaatctaattgtaattaacaaagcgtttggttagttaggcaatcgattttacattaatttttctaaaaatacgaactattcagagaaaagcttatctaagtagcagaagtttggcagaattatgatgaagttgaataaatttagcaaacgtttttgacaaagtgggtgttaagtctagtggtagaagaccaataaaagctttattagtggtgtagcaaagggaaattatgtaatatacaatagtttagaatcgatgctcgattcttaagtcaaaacaatggtaggatcatctgcatttgggcttgatgttattagccgttacaacttgtgaagatgaattacaactcgtataaataacaatgaaatttgcatatgaatcatttagattcaaatttgattttataaccactcaatttcacattacattagccacttataaaacaaaggatttttcttaggaatctcgccatatccataaataccatcttcctttgcttcccaagtacaatttctacatctagaagaatctctaaccgctttataaatatcgaacacacctttttttacttgttcttggctaaatccacagaagtagagtgtcgaattcataaaattcacgtaaaacatccaaccatataatccacctttttgtagaatatggaagccatgatcatcatctcttgatttacaatgaactcctaaaagataatcattgtcattataaatcacaaccctagtaagaggacctttcattggaaatacttttccatcatgttgtagagtttcacagcctatcaaagatattaatactataaagatgattataaacattgagtagaaaattgttaggaaatttatgttagacgaattcatcatgaagattttcttaatcatgatattgcattttctagaacttataatttatttatatataatgagctaactttacaaaaaaaattataatttacattaatttatgttgaataacctaaaatagtcatgaaatcactagaagtttttgtgaagtaaataagaaagtaaaagttgctttttgttcccaaaaaaaaaaaagactaaaagttgcttaaataacccaaaatataatagaaatacatcaattaggttaggtattcatatccaaaaaattaaattgacagtaatgatccaaaaaatagtagatttattagaggtgggtctgtctaggtgtccaggtgaacaagtgagaggagagagttaatagttttgtctgagaatctgacgatcacttaactccaaaacccagtggcaatcatgtaattttactgtaaagtttcaaccagaaatctctttttttctctctctctctgcgctgcaaagcattgatcatcatcattcatcatcttcacaagtctcgttttcataatttatatgaggattcgtcatccgggtctatacgaatatg

SEQ ID NO: 22748 - DNA, 3003 bp, Unknown
  misc_feature (1)..( 3003): 2750-1469P.txt file - cDNA_ID_2121782; gDNA_ID_1620307; Annot_ID_152868
taaagagtagaagcaaataaaagagaaaaaaaaactatataccgaaacagagaagcagcggcaggaaaactcaagactgaagatcactttggaaactgatacttgagatatcgtcacgaaaatgtaaaatgaagctcaaagtcatttcatagctgctggtcaaggtaaggatctctaggcggattcgagccaagatactccgagacctcagtaacatacgttttcagcttcgaggtggttcgggtgagccaatcggtgtttgtctgatccatctcatccttcatattcgccatcttctcttcctcttccaacatgctgacccatctcttacccatatacattttaaccgcatccacaccttgtttcacgacttcatcaggcgggacaacaagcgggttttggtccaagttcagtttggtcaagttcacgagcgtgccaaaagcgtctggaagagaatggatctggttgttgctcaagtcgagttcttggaggcttatgagatctccgaatgaagcagggagatcttggagatcgctgaagttactgctcaggttaaggtactcgaggttcgtgagcagcccgaaagaatttgggagaccattgagttcgttgaagtgtgcatcgaggtagcgtaaggatctcatttcaccaatggaagttggtaatgatctgattttgttgagatggatcaagagcttctctagtttcactagctcgaatccgatgtttgttggtaagtaggtgagattgttgtagctcgcatccaagacaaccaacgatctttaaataaaaaaaaaaacagaagtaagaaaaaaacagaggaaacagagtcaacctttaaagataaaaaacacttacccacaatggcagatggaatctggtaaagttgtgagtttgttacaagagacattcaaaatcttcaactttgacaataaaccgatcgaatctggtaatgtctccaggaaattagtggaaacatcgagttcgagaaggttatgcaaaccagctatcgaatcaggaatagcctgttacatacataacctttgatcaaaaacaagcaacacacacttctaaatctatctcaatctagacactaccataagaaccgatccaagaatctacctctatgctaaaagactcaaaatccagagcaaagtttacatctttgacaagcaaacacacttttgaatctatcacaagtactgatccaaatgtcaaagaattcaccctaaagagtcaaaatccagagcaaagtttacatctttgacacataaacatatcagaattctaacagatttgatcaaaagattatgaatttgaccattagggacttagaaaaactgacctgaagctgattgttatagagattaagaacaaggagaccttgaatctttccaaatgcttcaggaagcaacttcaatttccgaccagacaaatcaactcggtccaatggattctccgcagcttgttgcagtatactcacaacctcttcattgacttcaacctccgcagcttcctcctccgccaccgcggcagcattcttctcggcagactcatagatcctcacgagcctctcctctgcttctttcaaaagcttctcataagattcatgaagctcgttaagcttaaggatcgatttataccaaatcttctcttgctccacagcttctctcctcttctgttccttctccgccacgtcaatatcgttaggagagagagcgatctcttcgaaagattccgacaaagacgcgtcgatctcacggagcctagcacgagctctgtcgacggtttcgtgatcgggtcttggtcctagggttcgaagaacagatcgggtctgagaaacgtcggcggttgcgttagtcatggaggcaagaacatcaggatgagccaagtgaggcatctgagtcactatctcgatagagtggtttgatgatgaagaaggatcggatttggatggtggtggctcgacatcggaagaggaagaggatttggcggtgaatgaagggagacgatccaagacataagagagaacagggaagttcttagggttaagctccgtcgccattgttgggagcttgatggaagagacgattgggagattgaggaagaagaagaagaagaagaagcgattattggttcgtgtctcatgtccttccgtactattagcatctctattgccaagtcaaagtcaaagatcgttaaattacacgtggttttgtattaatacaagacaagtgtcaatgttatcctacaaagaagaaaaaaatcattctaaaaacacttcttacacaaataataattttacacttagtagaaacaaattaattaaggttttagaatagataagataaccaagaagtttagagaaaactttaattaaggtttttgaaaaagtgaataatttttgttgttattttgtcttcattttaagattgtgaggcccaatattggtgacacaaatgttttatgggcttgagaatgatcttagggaaaactatattgttattcttttggaaatgaaaaaaaaaagctcatttttgagactatgcaatggagactctgttttcgatatgtatgataataataataagttaataacttttggaattttactgatttttctgtaatctcatgatgattcatgatgatgaagacgatgttatagttatacctaaacatttgcttattttcaacttaaaaatgtatttattttataaaattcaacttttaaagtaaaaaaaaataaaactcaatatctctgatagtgacgacacagggagtattaaaatcgaaaaacgtcaacaaaaccggtggaaagttgaatgggtcgaaaccaaacgcatatagccataaaagcattgtctccattatagattctccatatctgagaataaacaaacgattggataaaccgataaagtacatagaacttcgatctttttcacaataacccaaaaaaagagagaaagcaaaaaaaaaaactagagcgtttcaattacaatg

SEQ ID NO: 22749 - DNA, 3003 bp, Unknown
  misc_feature (1)..( 3003): 2750-1469P.txt file - cDNA_ID_2121801; gDNA_ID_1620308; Annot_ID_152880
taaaatcttcccaaaaccaaagagtagtttctaagattttaacagagacacaaagagaaaaaacaaatgggcgggttcatattgggccaaaattaacaatggcaacgatgtgtaaaataacttcgtcgttagtctctgtttttcgctatcctctgcagcaaccgcttaatgcgaaacagagagagatttccattgtatttttaatttaaaataaaatatataaaaacaagaccaatgtaacaaatgcattgcttagatatatataactctaaaaaatattcttacaagatagtaagtttggtctattgtcctataaattctagcatataactggtaacaacatgaaaaaaaaatgtaaaactatacatagattacaaaaatgtaaaaattaaaagataagattagcaaataacaaagatattccccttttaatcaaagatcagtaaaaaaaatcgaagttataattacatactaacaaaaccaaaaacaaaccacctcgcgcaacgcgcgggtctcctccctagtgactttaattagtgccatgaaatatgtttttaggaagttgcatggtccatgcatatttaatttgtaaattaattcataagatccggtctttcgcacgatcgacacaacactaaaaaaatatgatggaatcgcagagataattacacttcatttttttcatgttagagaaagaaagaaagaaaatgaggacctctccaagatgtatttttctcacttgaccctctccaagattaagggaataatctgtataaagacacgtgtcattccttgatggacgattgggtttgaacctttttggtattatcctctcttacgcccaattggatatgccatataatatgcatagttccttttggattttataagaaaacctttgtttaaaaaaaaaaaaaaaatttatatgtatttctttgtaaatgttggatcatatgcaaatgttggatatgatcatttcagttaaagtctccaaaaccacaccattgtctaggcagtaaaaaaaaaaaggggacacaattgtgaaagtttttgaacacttatttcagtcgaagcaagtttgagtttagatgtgggaccaataacataggtaaaagatcaacatctcgtctagaacactatgacctagccaaactatatcacgaaatttacatatgtccaaatttatatttctccttcccctttattatcatcgataacgtaaactatcaaaagcagaaaaatagagagacagagagaaaaaggaaagagctaccgagacgtgaagagaccatatgcgacggcgcgtgaacgaacgccgttgactatgtgcctcccgaccacctgaatgttcttcgatttggctgccattaactctatttctgtacacaatattgagggagagaagagtgagagagagttgtttaggatgagtattattaatggtgaattcagtagttgagagttgagtgtgagtttttataataataatattagtgtggaagagaagagatgggaggatacacaccaatacgattcgtgtgttgtggtgctccgttacacaacgatacacaacgggaataatttatattttaaagttagtatatataaaattttgtaaattatatttatttataaaatattttattttatagtttacaattgttattaagtaacgtcctgtcaaacccgtcccgccaaacccgtcccgtaaaaaaactattattttattaatattaatcttatttatgatatgtttatgaattattgtctaaatattttagttgatgtgggacgtacaactcacacattttcgtcaattggttaatatatgctcattttttaaatttcgagtcacaaaatatgacggaaagaattgagattttttaaactctatatattatataatgatgttaaaaaattatgatatattaaactttttataagtttaaatattaataatgttttataaagtttaaatatataaataataatatttaaaaagattatattttgagccttttaggtaatgacataataactctaaaagcaaggatttaaaagatttaaatatttaattaaatatttttattcctaaataaataatatcagtgtcatgacattgtaaataggttcaaatacatgatttatttatttaaacaaaaaacgtttagtaagaataatatttgttttaacaaaatactttgttttaaaatattgttaacaaatatgtttatgctaattttaagggattgatttgaagtttgtttggattaaatttgattgataatgtggttgacaatttaaatcaagaatttaaagtaaaattaattattttggagaaaagatttaatgctaatggcattgaattataaataagtccaaatccaagatttatttgttaaaatgactgcaaaaatgtatatttagattattccccaccaatgaaacgccaccgttttgcgtctgaaggctatgtattttgtacagtatggacatggacctgtaacgggctcttcagaaggaagcccatcttctaaaactaaaggatgtaaatttgtgtcattaatttcccactaataactcatttatctccgattatctaacgcacacatcacactacttctcttccactaacatttttttttttacgtaacatattaatgttcatgagaagattcatggaacaaaacataatttaatcaagaaatttgaaaaataataaattaggatatagaaatgatttgtgattgttatttgaggaagatgagaagagtgtggatagtgaagaaagaaaaaaaagagaagagtgtggacagagtggaccgtgcataacacacgaaaatgttacgattaccacgaaaaggttatctctttggagctttgacacgggcctcctcaaacaaaaacaaaaaaacctagcttctctcacaaaacgcatgcaacaacatcgaaattaagaatcaatcaaagcttcttcgttcgatcacactagaaagaaagatg

SEQ ID NO: 22750 - DNA, 3000 bp, Unknown
  misc_feature (1)..( 3000): 2750-1469P.txt file - cDNA_ID_2121817; gDNA_ID_1620308; Annot_ID_152886
ttttttgattaattaggttcaaccatgtctcatctttatgttattctcattctccatatataaatatattatccataagcttggccggctctccaaccgttctattaacaatagcactaagcaagaacttcaatatgaccactctcattttccaccttcgatcaagcaacaacacagctgagaaagtagccaagctaattatcactatctctaaacgcttgtgattctagattgtacacgttataagtaccaggatctatggaattaagttgagtaaaaacaaagagtgatagtcactgactcaaacaaaaacgtcttggtcagtatatataacttactaaaaaaacaattaaacttgttataccatttgaaatttactactcatcaatcatcatgtctgttaaattttcagtatattataaaaacgcatttccattaaatcaaagttaattatgccaattttcagtattctattgataactcgggctaatccacatcgaagctcgaccaagtcccatgcatatggtctaggtgatcctctagaactagggcggttgacataaatttcgtacgaaaacaatacttttatcattcagtactaaaccaaaaaaagcggtttctttacgagagaatgtatttgaaacaagatacggagaaaatacggaccagactaaaaataacaaaggataaaaccaaaatcaagaagaaacttaaaagacaaaaccttctgagcgcaagagagagggccaagttgcgaagacagtatgggacccaaataccgactaagcggaaatctaacttttaacttttcctaccaatgaaacattgacacgtggaaaagcaacgtcgcccactttaccctccgcactttgaaatctttgataagcttatcgctctcccattggccgtaggctccacgtggcatctctctgatctctcttctgctaatccttttttacccaaactggcatgaccccacccctaaacccctattgtcctttctaccaacaattacttaatgacttatataatattctaattatattttaattatgtaattaaataactattgatcccatctccatagtgacatgtctcactttttcttccacaacaaaatgcgtcactcttgattcatcatgttcgtagcaaaatccacgttattacaaaaaacgttatacattttgaaaggtaatccataaaatagtgagatggatcaagttttctacgcaaccctcgtagaattttagcaatgatccaaagctactgtatatatatagttacgtttcgtaacacaacatgtattttaccatgattatgcctcttttttttttctttccacaacatatatgtatttacatccttatttggtttaggctgagtttgttaacatagcatcaccaatagggacaatttttttttttattacaatctaaatatctaaaatataaattcacatgaaattaatgtttctaatagagttcttcaatcttcatgtacaattgcacatttttgtgaaattattattactttatcattttttctttaaaattaattcaccgagtaccgataaatgtttatattgaatacgatttagtaaacgacatatatgtttcgtcacatttttatcactatttgtaatatatctgttaaatttgatgatgtagtttctgtttttgaattgaaaacttacaaagtttagaaaaaagaatgtaaattagaaataaatacactttctgtatttttgaatactataataggctaaaatcacatcattttctaatgttgctttaaataatatatatcaaataaaggcttaaattacatttatataagaaatattgtaatacaaatatcaatttagagctattaatttacaattacaacctgttgcccaattgatgaataaatcaaacatgtaattaaccaaactttctaattgatcaggaatcaatttagctaaataataagacataaatttggccaagaaaaagaagagaaaacatgttaaataggtaatgggttttaatattgggatagttacctttatttgaaaactattaaggtttgatttaagacacgagtcactcgagagtcgcatctcgccagtcaaaaactaaattaaaaaactatatagacccaaaaaataaaaataacgacttttgtatttatactggcaagattctcattaaaacccagcaaaaaaaaaaaaaaaagacaaagaaggaagaaaatttgagtgggtgagaattttttacgatagaggaagagacagcatcatctacttgtgttgtctgtgtacatatattacagtaagcgttgcaatataacttcttgaggatcttctcacattaatgggtcaaaccttttgctcttccttttgattaatttagtgtttgacaatctcctcctccttctccttcttcttcaaagttttgtcgcagtatctattgttcttacagagagaaaggtaggcttttgtgtccatcactcattttcgctcgtttggttaagcttcatctgccatgtggttcactgttttgatacttttgggctcttatacctaatgttgatgtaacacaacgatacataatctaatttgttttcgagtggaaaatagttgaacccagttgagtatttagccaatacgattagaggatttacttgttttttctcttttcatgttcttcatttgcttttgaagatcttcctctttatgtttgtgtctcttcgctattttacttgcttgaagaaattgagtttctcatctcgcttaaatttggctttatatacagatttagagatctcgattcctaatctacttgtttttgtattcaatttgcaggaaagctttagtcttttaccagtttgatccaattctgggtttcactgaaaaaaagttgggagtttgattcttctaactgtagaagaaacagagtcaacagaagaaaactaaaaaagttgagatttttctctcacgcgctcaagaacttgagtatg

SEQ ID NO: 22751 - DNA, 3000 bp, Unknown; identical to SEQ ID NO: 701
  misc_feature (1)..( 3000): 2750-1469P.txt file - cDNA_ID_2121832; gDNA_ID_1620308; Annot_ID_152889

SEQ ID NO: 22752 - DNA, 3003 bp, Unknown
  misc_feature (1)..( 3003): 2750-1469P.txt file - cDNA_ID_2121839; gDNA_ID_1620308; Annot_ID_152891
acatggttgagtatattagtaaacaataacatttgaatacaaaatatcgattcaaattgagtttctctatatatggtttttatttgttttattctgtcccctgtaaaatatgttatctctcaagattaaaccctaaggtacaaagtgtagactatcataaaagtgtggtggtccatgagaggttaacgaaaagtatttgaggatttgaccagagggaatcctacaattgcgtatgctctaatcaatactactatagtattatggctatattgttatataatatattcagaaaaatcatatacttccaatccaagttgaattgacaaaaactaatccaaacgttgaattgattcattttaattgttaaaattttgatttcttgatatatacgaaaaagtcaaagctagtaccaaaaaaaaaacacatggtatcacaaaactctttgttatttaaagggatttctaaatattagttaaaatcctcatgattagtgaattctagaaatatttcaaaattttgcttcgattttcaaatcaatcaaaatatgcaaaccaatataaatgtatacatataattttggtaaaagtgttctatattatagttgtcctgttattgtgatatatattctttttcttttcttcactctatctttcgaacctatacgttcaaaacctattcagcgcttagaccataaaagggtctcattccaaatatatatatatactgatagattgatttatggttaactaaataattcttacctggcaagtcccatggttcgcacttgtagaggtctacttcagggataatctctagctcgatctcttggccgttgatctttctcttgagatagtaagtgattagttcttcgtccgttggatggaacctaaaacctggaggcaacgagaccggagccatgtatatactcttcaacaatattgaaacctctctatcaatttaatatcggattatataacaaaaaacttaacgaacggtcttgtttacgagataaactccaacaagaccgatcgtttttgtttatataaatagttttataagtatggttgggtagtagagagaaggagaatgatgatacgaaaacctcgagagaaagaaggaaacagagagaagacaaatgttttgtgttttcagggcttgaagggtatagggttataaataaagaagagaaagacagaatttcatataaaaatagtggcaggaaagtgaaagggatgatgccaccctcaaataatatatggaacttataatataaaagttataaaaagtatggctatacccaatttgtctctcgtaattttgtttcttccttacacatattctgattcttactgtcgttttcttcaagattcataggtaggttaatgcaaaaccgtgtttcttcatcaaagtggtcgcctcaaataatcacattcttctccaagtatggtcggtttggaatgtatccacgtggcggaacatcattggcttcatggggggaacgaatcttggtttaaccaatagaaactggtttcaaatctttgtctggcggcgcttctaactgaataaaactgtctcctttgtatcgtatccccacttgcgagaatcctttagttccttcgtgattgccgctgatcaatatgccatcatctcaattatttcttatatctaatctcttttctgaaataaaaatattatacttcattttgtatcatcttcattgtgtcgtcacaagtggctcgagtatgatcgtttgattggtcattagtgttagtttgttcatcttcccccatatatatctgatcttgtgttcataagttatgtctcgggagtatgttttaataccgcccaaaactatattataaccttttttcagtgtaaaaatatgaatcacttaaacgaggagtcgaggatgagagacaagctcgctcgttcacgagcatgtggctctagatggatatgaaacacatgatatagtgacgcaaacacaaacacaaacacgagcacaaacgcacacattaattagattcatatgcaagttcatacatagataaattaaaggcatagatatataaaaccaaaatttgtttaaaggtatagagatgaagaataaaggtccacatggtagatcatgtgggtccagcttgtaagcatgtgaagaaatccttggaggcatagatgggccaaccccagcatcacttctcagcttttctcatcatcatcatacacttttctgtcattatgcaaattccatattctagatctatatctaattaatcacacatataataagcattagcatatataacacatgtatataacaaattgtacatacccttctttacacttttccctcacatgaatccatctttttgttctttacttttatttatttctctttcacacacatctataagttaatgtactccaaatatctttaccaaataaatgtatcttaaattcccaagttgagaacatgaactatttgaatatagtttcaaagaaagtatttagaaaaaatatataatatgtaagacaaaaacccaaacttctgtctctttgtttatgctaagctaatttaaatttttaaagtgttattaacatttcagagtctagtgcatgtttattttctcctagaaaagatgagtgacaaaaataccaaaagagaaaggtacatctgtaaaattgataaagagttaagaaggaaaaaatgtttaaatcataaacttaatcgcatacacaacttagcttcaataaatttttgaaaattgtcaaaactcaaaaatggggagaagaggttaaacttggtttaaccggttcgttcattatacttccgggttagcattttgagcggttcttttccggtaaccaaaccggatagacattcgagttattgttcaaccggtttcaccgtcaaacgacgtcgttgtcacagtactgtccctcacaaaaacctcacaaaacctctctttcgttctcgtctcctccagaaccagtacaaccatg

SEQ ID NO: 22753 - DNA, 3000 bp, Unknown; identical to SEQ ID NO: 697
  misc_feature (1)..( 3000): 2750-1469P.txt file - cDNA_ID_2121851; gDNA_ID_1620308; Annot_ID_152894

SEQ ID NO: 22754 - DNA, 3003 bp, Unknown
  misc_feature (1)..( 3003): 2750-1469P.txt file - cDNA_ID_2121867; gDNA_ID_1620308; Annot_ID_152899
ttccttttctaattacttgataaactttaatctaaatttattgtggtgtcattttatcaacctcacaaactaaaagctaaactacatctctttgtaaaatagttcacatatgtcactattacattaattttacttttttatgaaaaacataattataagatcaaatcttatacctaatattcttatcacctctgtttgatcctaggtgaaacaaaaaaaaggtgaatcatctgatcatttatattgtaagaacaaaatttttttgcatatatgattcgagctagtttgtaacaaaaaaagcgctcaaatatgttgttggatgttgaagaggagaatccaatatatatgagaagtaatttttaaaagatcaagatatgtgttttcacatttcacaagctttcttaaaatattatagaccaaaataacagttgtttttttacattattacatgtttgcaatttcaaaaattaatctcacttacttatttgaaaatggaacaaaacctctataaattaatattctatctcataaattagtaacttctataattttaataaattctttctgttccaagttgggaccagtgtaaaaatgacataaatcgataaaataatattttttttcaaaatcatatataaacatatggtctctacaatataaataattaataattgtataaagttatcaataaatatattaagtgaaatataactctagtatttttatatattgtattaattcttggtagagtttatttctaatatttttactacattgaaaaggtttgcactatgttttaaacttaataattgtttttctacttgtaattgatttttgaaagatattaattataaaggaaataactgtgtttgagagagtatatatatattatatgataggattaagaaggatgttttatcttcattggtcaagatggaaaaaatagttaacatgatctctcatcttgaattatgtaataagtctatgcatttactgatccatttgaaatagcagaatatgaaatcaaattaattttattgagatggaagctaatgaactattaaatatgaagaatttgaaatcctttaccttttgcttatgtgatattaccaagctatgatgtgagtttgtatgtgatatcatgttttatatgtaatatttcgaaaacaaatatataaacaaataaagagaagcaaatgaaacaaaactttggcttttttatatatcatttgtcatttatcatttacaaacctaaaagtcaaagataaaccaaaggataccctgatttgttaatgttatgatatttgagcaaaactgtggagtataatatattataactcattgaatataaccacatagtcataacaaatcaaaataaaataaaagtttccaaaacgtagtcataacaaataacaaaattatttaaaggttttcaatttttacaagataaagtatattaaaaatgataaaatagaataatatgtaactttgttaacatcttggaaaaaatagaaaatttaatatgaagttgtgtctacgaattctatttatgttctagttattgtacatattcaaattaacgatgctaaatcattcttctgatattgagttgtgtcacatgttaagtatatttattttaattttcttagtatcataatgttttctttcttgtatgattaggtgcacatggaatatatgtcatactattttaaaattcatattttattaattcttttgtcatagctagccatcatatataggtagaccagtatataatagaaaaaaagaacacattcaaatgattttgatttcttctaacactagattaatcttaacttcacctttttttttgtcacagttaacatcttatataacttcatttcaaatgtctatattttttaatgtctacataaatatacatttcatcacacgatttacaatatgaatacatgtttataagcttttagatcatggaatataaaatagtgcactttttaattatgtcgatatagtctttgatttttaaaaaattaaagatgaaaaattagaaaattatgtgatgcattaggactcaataatagagactatacataataacaattgcagttagttcttagttggatataataggtcagtaaaatatattattacaaacatcaactctgcactacgcaagatgtagtaaattacgaaaatatatgataaacaaattcgcatactacattatgactacaatagccaccttccctatacattatgacttctaacattgaaaaaatttgcaaacatttggtgtaaattaacaaattaaaaacatttggtctaatgtatgaagaaaaaactagatattccgctaatttaaacaaacatttggccttataagaaattttaggtaagaaaaaattctgagaagtcttttttattcacatcacatagtcaatattcaattcaatgcatataaatttcatgtaaagcttcttttttcctcggatcccattcattattttacttaccattgaatactttcaccgtgtagtctttttttagaaatcgttgaatatcaaaaacaagaagaagaaaaagaaaccgtgttttcaatgtgctgtcatacgattcatgaccctttatgaatctaatacagagtttgaaacataaactaaacttggaagtttgccaaaaaaaaaaaaaaaaaaaaaacttggaaataacacttctcaaaaagatattgggtcaaagtctaaaactgaaaacgaaactagaggcattattctctaattcaaacaaagtttagggcttgggaagaaatattcacaaaaaggaagtttccgaaaattcttttatattattccccaagcaaaccattcaatatcattgattattgatataaaacccatataaaggtgtctctcatcatcctccattcccatacatcactttcctcgatctcactttctctctcttatcatcatctcctggtattctctctctctcatctccgtgatg

SEQ ID NO: 22755 - DNA, 3000 bp, Unknown; identical to SEQ ID NO: 704
  misc_feature (1)..( 3000): 2750-1469P.txt file - cDNA_ID_2121883; gDNA_ID_1620309; Annot_ID_152907

SEQ ID NO: 22756 - DNA, 3000 bp, Unknown; identical to SEQ ID NO: 709
  misc_feature (1)..( 3000): 2750-1469P.txt file - cDNA_ID_2121887; gDNA_ID_1620309; Annot_ID_152908

SEQ ID NO: 22757 - DNA, 3003 bp, Unknown
  misc_feature (1)..( 3003): 2750-1469P.txt file - cDNA_ID_2121918; gDNA_ID_1620309; Annot_ID_152918
atcaaaatctattaacatatttaacataaaatatattgtaaaatatacaaataatctaacgtagctgcataatgtgcttaattagctcaaatgacaattacaagtattaagctgattgattttatttttttaatcgatcaacttgagaaagagaaaagacacagttttaatgtggactggctagaggtttatcaaaaactgctttcatgtataaaatttattaaactcagggattattagtagttaacaaataagaataagataaaaacagcttatgagtttgtatgactgtcaaaatgtaatgtagaagtatagaattcaaagaagattaagaactcaaattataaagaataactctctttattagtttaggaagattctctcaaaacctaaactctcttaatctctcaaactcataagttgtatcacaccttgatacctccttatataataagcttttaaccttatcctaattattaaataactcctaatattataagataactcctaacaatatattctagattatctcctagaataataaagcttaatttccttttctctttagtaacttgctcttcaagttacttcttcttcttcaagcttattccaacaagaagaagttcagattgatgatattccaaaatagtgatatatattcgcatgagatgtaaatgaatttcgcaaagatgtgagaccaatacattcttatgttttgcggaagagataaaaatttactttgttaaattacaaatatttatgtatatactttttccaaaagaataataagctttgttacttgataccactttcttaaagaaaaaagaggggagaaattttatcatcgaaaagcaagaaaaattatacttttatccaccattcaataaagacaccaaattttcttctcaaatcgaaaaaaaaagtgttagcaaaaagaaaaaaatccaaaaaaaaaatattcataaaaccaaaatgttaaataataaataaataggtaggcgaatcagtttaagagttgtaggttctgaagagattgatttcagctagcttcatcgtaataataaaatttcaacatttgattttactgtcgaacgaactctcaagtctgaatgaatgtctaatttatcttaggtatttttgtcgtatgttgttggagtatacctaaagagcacgtgcatgggtacacgtgcatggcaggctttgttcgacttcgacaaacaagagatgtgaccataaccgttggatctgttttacctctttcacatattgtgaaaaattctgattcatgaataactaacaaaaatgactatgtccgtatatgatatctgatgggagtgaatagtgatcccgttaactgtgtatttaaactgaatacaactattgcaaagaaaaaggtgatagataaagttataattttcttattgatcactaatgtcaatcaatttttttaatacattgttttgttacttatactgcataccttcaaattaataagcattatagagattgtgcaattgataaatcagattaatgtttttatttgttggcaaagcaaatgtatcttattgtaactagatatacattacaatactttgtaaacataattcatttaagataaaatttacggatatataaaaacatatatatatatatatatacatataacaatttctttatgctatctgtatcaaagtactccttgaatccaaaaagattaactacactccactacagcctcatcattctttaggcagattgatcgatgcatttcgtattatatactctacaagcttgaaaaaatcacaaggcgtacacaattttgatctcccagtagtttgtttacatatgcgtaaagccctttctagtgcctaatattgttgtatctagatttttgtttatttttattttatttttggcaaatgaacctttgatgctacgaaaagatcttctaataaactgttccttttggtaaataacttcacattttatccccaaaaaaacatatagaaagaagtgtaaaaaataaaataaaaaacaaaaaaaatatagtaagattgtttttttgcactgagttaacatgagcatgtaggaacaaaaagtaagtaattattggacccaaaaaaccagaaaaaaaaatggagaggaaagggcaacacaaaaataacgagataatcattctcaatagaaaagatagaaatatcaactttctatgtgtcataacgcactactacaacaaaattacttcgaatatcttggtaatttaattacattttttaacagctcgcttcgaatttgcaaggctattaatcgatttttctaagatttaatataaatgaagcatttgatgctgtatgatgcataaatacatgattatcatttgtgaaaaaatgtaattaaaattactcttagcaaataccatgtctatacaaaactaaggatgtatgaacatgaaataaaatgaatcaaactaaaagaaaattgtttattatattgaaataattcatagtgaaactgcaaacatagggtgcctataaagtaatcaagggatgttaaattttttctatctctgcattttgaaattttattggctctgctgctatcactttcagcttatgattttccaccgccatccactttgctcttttaaaataatctcataaaggaaaagaaaaatacaattaaccacatattttaatcaaaatggctgcaacagtttaacatatcaaggtgctaatatacccacacacacacacttatatataggagctaatatagagtggtataggttaagacaaaagccatatataagtggagaacccaatatatctttgtctttgttgttttttccttctcgttcatagttaacttgcagatttcttagtatttctaatctttttcttatattaaccttttgtctccttctctctctctctctctctgaactatacaaaaacctacttttaatttctcttccaagaagtcaagaacccagaagaagacatg

SEQ ID NO: 22758 - DNA, 3003 bp, Unknown
  misc_feature (1)..( 3003): 2750-1469P.txt file - cDNA_ID_2121929; gDNA_ID_1620309; Annot_ID_152921
tgtctataaaatatttgtttgtctataaaatatttgtttttgtacgaaattgcatagattcgtttgagcatttcagcccaagctttagaggaagaaacattggttacataacgaactaccaagcccattcaaaagcccattagtgtataaaacgaaagccctaatttctccaatacgcaaagtgagtgtcgaagagagagagataatcgaagaagaagagaaatgaaattcacagattctccggtgatcgatctgacggtgaacggcacaaaactctcaatccaacaagacaatggctctatgcacgtcggaacttccgtctggccttgctcactaatcctatccaaattcgctgaacgctggtcaacactagactcatcatcatcaacaacatctccaaatccatacgccgaactcttcgatttccgtcgccgtcgaggaatcgagctaggaacaggatgcggagtcgccggtatggctttttacttactaggtctaacggagatcgtactcacagacatagcaccagtcatgcctgcgctaaaacacaatctgaaacggaacaaaacggcgttaggtaaatctctaaaaacctcgattgtttattggaacaatcgagatcagatctcggcgttgaaaccgccgtttgatttggttattgcggcggatgttgtgtatattgaggaatctgtagggcaattagtgacggcgatggagttgcttgtggcggatgatggtgcggtgttgttaggttatcagattaggtcaccggaagctgataagttgttttgggagttatgcgacatcgtttttaagattgagaaagttcctcatgagcatctgcattctgattatgcttatgaagaaactgatgtttatatctttaggaagaaggtgaagaagaatgaagctgaatcagtgtcatgaagctagttttggttctgtaatgttgttgttacattgatatgtaatttgtttcttgttatagaattcgaattatctcaactatttatattttcttagatattggctactaaaagatgacaaaggctgaaatcaaatttttgtaacgatttttttaagaagtatacaagttttgttgtgtgtttttgaaatatatacaaagtaagttctcttgcccaaagaaatatgtgaagtaaccaacattgtgtttctatattagactgataaatttgttcacaaatgtatttgtagaactctcaattgggtgattgtatttgcgagttttattccacatcgttgtggagcggctgcggttgaagaaccaaagttcggattagaaacagctcgaacaagccaatcccaaatcaaaccgcatacatacgtgatatggtatttctatagtgaaggaagtgtcagggtattactttcacctttcaatgttagctctctactcatatcataatctatggaaggaaaaacaaaattaaaaaatagaggaaaaaaaatgatctatatatcggacatgtaatttttagagcacacatattatcactagagaatcccatctaagcacatgttatgatgtttgtagtaagagttctcatatatatatgtatatggtgtaagacactgatgacagttctcatatatatatgtatatggtgtaagacactgatgacagtaaccaaatatgccgttttgagcagccacattcaacaatttatgaaatataatcaaaatctaaattgttcttgaaatcaaacttaaacacttccatctttctttgttctttgcataataaagctcttcatgagctattcaatttctatcttaatatttctcaagcttaatgggcatcagtctaatcttgtttattacaatttgaagttcatgatgattaaaagggggagctaaaccacattttctatatgctaaggtcgtagctaaagcatctagaatcattttcactaagaaatatattctctcttccaaactacacgtttactcttatgaagattggaaaatcagagtaaaaaaaaatgaatcgattggacgacaaaagaaattaataaacaggcttagttatgggctaatttggataatgggcctttatagaaccaaatcagtgaaaactactataaaaaaaagtaagcggttggatttattacatgaactgggcaacggtcaggtccaagatccaaacacaaagcgacaaaacacaagtccaaagaagaaaaaatatatttattttaaaattaaatttgataaatgcaaagcgagagaaacaaagagagagaaacgcgagccctgaatcaaactccctcgattttcacaaaaaccaacccaaagaaaaaaaagaaaagaatctgacaattcaccaaacaactctctcaaagtcttaaattaaaattttttgtcaatcaattcacaaactcaaatatctttttatttttcaatataaattttcgaaggaaaaaaagaaaagtagaaaaaaatcatgattatgaaagaaacgaatagtcagaggcaaaacactgttgttgttgttcgttcgttcgttcgattgttgttgctgttcttcttctcacgatttcatcttttatttcttttaatattaaaattgttctcggtttatattaatgatcttgtcgatattgcgagactaaaatgtttaatgtttttgattttatttgtgaaattcccaatcacattcttagtagtagagagagaaaggttttttctttttggtcttttggtggacagatttttattcttctttacttcttcttcctctttttcgtcaaaccataaacaataatccaaaccctttgttcttcagatatgttcttctcttgacacacacctaatctttctccaccaaaatttccgaccaagtctcatacttttgatctgtttttcaactttctcatcagcccaagtaagtatttttttcttacccatgactgaaatcaatttcattagtttttgtaatttctagggtttccaattttgtggatttggggattgttgcagaaaatg

SEQ ID NO: 22759 - DNA, 3003 bp, Unknown
  misc_feature (1)..( 3003): 2750-1469P.txt file - cDNA_ID_2121939; gDNA_ID_1620309; Annot_ID_152924
ggaagtcatgaataataatctgtattagcgattcctgaagaattaagatatgtcagctctctgttttcaaattagttaaacaaacaaattttaatatgaggtgaataatcttctcatgtctctcgttttccagggaaagtcgtataggatccatgcatcttcctacaacaaaatattaaaccccaagcctaatcacattcaaacgtttaaggccaaaacatctattacccgaagtaatatttatctaaacgatggaaaatacattttttcactcaaaagagatgggtttgttattaatatatgcctttaagcactttacataccaaaaatattcaattgaaataatctcatttatccggttttgtaatcttattattataatttatgatttttgtaccaccaaatattgtggcatacctatatatgatctcattcctctttattttgaagtgcctagaacactagtcttcttcttttcatggttacgaaaatgtttacagaaaatcatggatgattcaagaaaatagaccactttttgagatacttttccgtaaaccctaagtatatccataatatctctacattgaccaatgacaaatagtagtttagatattgatggacttatgggagctagtttttattattaactagattttaacccgcggtataccgcgggacgatttatttttaaaagtaatatatattaaaacttgcaaattttatttttacaaaatatttatattttacagtttataattgttattaagtaacgctataccacgaattcatgagacaattgttaaaaaaactgaagttttgacccctattaaaacagcatattaataatattttaaaattttataaatattgattcaaatacatccaccatataacccaattccaaaataaaacacgttctgtaatttctttacccgtcccatgattatttttttaagtagtaatttttaaaattttagaattatttttatatataaaagttttgcaaattgtatcattctctaatacatttatattttatagtttaaattaaattaattaaaatttagatatcaaatcttataagttgattttgattggctattatttttaaaaattaataatgtatttcgtttttaattaattaaattaattaaattagtatttgactttttaatccttaaagagataaattaatttactctttaaaattttatttctaatggcatacctatgtaattacttacaaaaattaaggttacatttaaaatgtacttcccaaataatatagtaggataaattgttttatctatgatttatgaatatccacatcagttctgtaaaaaataaaactaaaagaaaaaccaaggagaaaacaaatcgccttgtaaaaaaccgtttttgataaatgtaacatttaggttttgtgttagttaagatccgaaacaagacaaatcttatacacgccataatccagtatgtcgaaatctacaccgtattaattattgctactatgaacaaccattctatccgatcatagactttactcttatttgtcgttattatcataaaatgtcgtttaaataaattatttgtaggataccaattctttaattatattagttcaaacacgtataattttggtggtttttgaggatgaatatcatcaaagataaatgcattttggtgaaataaataatcaaataattattttaaattatctttatgcaccactatttttaataaattggactcttacaacgttttccttaaaaaaaatcatggatcttaaaacttatacccaaacaaatatgtagaaaattattattatatatataaatatatatatatatatataagctatacaaaatcttattatatagtagtagcgcttgattctaaaatagcataattagacgaaaaagcatgcattttgtaacattttatactttgtaagtaaaacacataaaaaataattttatgaataagaaatccacataaaaaaaaaaagaagtaacatactgtgaaaaattaggaaactttttgaggcaccaattttttatgccactttcaaaaaagcattaatgaaaatttgtttaaaatatcattttaaaatttgacgtacaaaagtacaaaacctcatacaatttcaaaactttacaaagactcaataacatgtgttatagagactttataaactttcttataacatactctataattttttatatccatatatttgtgatatttttgaaaatggataaaataaatttgatatttttataaatagaaaatattaatggtatttttgaatttttcccaaaataattattagtcttatactccaaaatgtaaaaaaaaatcactttttattaaaaaaatacttacgcatttgcttaattgctagtcgtcaaagttttgtcattttatgcaaatactaaaaaaatgtagaaagcatttcctctttatttttgggacaaccaagaaaggagcatttcaatagtgtatacatagacaaaaatatttctcatttcctatatttgactctttaaatctttaatagctcttgtaattttttccattcattgtaatacagccataatgtttaaaaggaaactgtcaattataaacttatactagaatataaaatatggtattgaattgaatattttcaaaaataaaatattaaatttacgaaaagaataaaaaaacttaaaaatctctctctcctatctctcaaccacaacttatttttcatgtcagtatccaccaacacatatatacggcatataaaagattttaataaaaccttggaactatctatatctattcagacacacacgtctatatatatatatacactcatatactactttcactgtatcattcttgttttctctaaatttttcaaaaaacctttagaattttcatttttttacgattccgatgttaactgtttctccggctccagtactcatcggaaacaactcaaaggatacttacatg

SEQ ID NO: 22760 - DNA, 3000 bp, Unknown; identical to SEQ ID NO: 707
  misc_feature (1)..( 3000): 2750-1469P.txt file - cDNA_ID_2121943; gDNA_ID_1620309; Annot_ID_152925

SEQ ID NO: 22761 - DNA, 987 bp, Unknown; identical to SEQ ID NO: 712
  misc_feature (1)..( 987): 2750-1469P.txt file - cDNA_ID_2121994; gDNA_ID_1620310; Annot_ID_152941

SEQ ID NO: 22762 - DNA, 3000 bp, Unknown; identical to SEQ ID NO: 718
  misc_feature (1)..( 3000): 2750-1469P.txt file - cDNA_ID_2122018; gDNA_ID_1620310; Annot_ID_152949

SEQ ID NO: 22763 - DNA, 3000 bp, Unknown; identical to SEQ ID NO: 718
  misc_feature (1)..( 3000): 2750-1469P.txt file - cDNA_ID_2122018; gDNA_ID_2926224; Annot_ID_203432

SEQ ID NO: 22764 - DNA, 3000 bp, Unknown
  misc_feature (1)..( 3000): 2750-1469P.txt file - cDNA_ID_2122026; gDNA_ID_1620310; Annot_ID_152951
atgaaacattattctgacatacattaaaaaattagtttaagaatatttttgcaaaacttatgcgatgtgataagctcactttttttaggtgacatgttcgatcataaggtgccaataattccctagaaatagattaatctctatgtaaaatatcgaatcgtctagtgacaagtacatggtatacctacctattcacttattatttctatttttgtcgtcctcatgcatcttatgttataatatcaaatgacggaaaatgagggatgaattctataagctaagaaaactaaaataagggggaaattgcaagaagaatgaaagcaacctttcaaatatccttatcttatccaatccttttcaggccattgacttattttctaattaacctaattatatatataagaaaaagctaaggcatcttatatttatatatacatatatcaattgattgctaataatgttttgattaactctgcatatggcatgttttccagcgatttaagttcacaaagaagattttcgtttttgtcatcactaaaaattatctagttctttctactttttcagcgtacaataatctttttttctatcaattggtacgttttttattttctcaattttaattttgttttctaggtacatttttaatcgaattgcaccaaaatatccaaacaaatcaataaaacaggcagaatgaggtattaccgtattagttaaacgagaagtggctactttcctcagcgtgattaaaatgcttatgggttcagtttcataattctcatatacggaactacgcatttgacctcatgctctctataaatattaagatctgatgttgagagcccattagaactaagtttacgaatgagcccatgatagtttaacttgggcctaattagtgtctaatctgcttctaacgttaccgagtcaaacgcggtctaaactaatttgtagagtagtgtatttgtccaaagcgtacccacacaattgctgagaaacttcaaaccctaagtgtgtgtctagtattttgcaatatacgacgcataaagaaatatcctaacattgacaacaacaaaaaaaaatcttagcggagatatagacgtgtgagacaagagctcacacgtgttgcacattcgagacttgttgataatgacgacaacaagaggttctagaatattcgtgttggtttcattattattagcaaataagaccaagtcaacaaactaacttaaacattgtggatcgtccacttgtccgactcttacgtcaaacccatcattgttccacatatctccacgcgtcaatctctctataaatacgaacaaatgaacacgtatcaattcaactcaaaaagtaacaatttgaattacttccgcaaatctaaaataatatctagtgaagcgaatatgtgtttctttgataatcggtgcgatcagaatctgacggtggtggtggatgtggcgtggtggatggaggctgttcctccacaaatcatttctccggcgaagccatcggtttctccgattcttgagacgattttagaaggcggagagaccgaagaagacaatcaagaacaagaaaacgaggacgtgtaaattgtaatgatcattttgttactcggtcttgggtttaagatagactcttgttgttgttgttgttttttctataactgtataagatgagattttgtattgtatcttttgtacaatcaaatctcagttctttgtgaaattttcattcaactttcacatcttgtacgctcggtgatctgttgttatatgctcacgagttggtaattaaagacaaatcttaatatactttctaaccgaaccgggacgataaccggtccacgacaaaaaatcagtatcttcaaatatcaaaccaaacttaaacctgaaaccagtctcaccgctatttctgtttggtgcgatcattttctcaaccaaaagaatctaatttacattaatttttaataaagacatgtatgatttatctgcaaactaaagcagtgtacgcatacttatgtttcaactttcgagcatcacctaaatatgaaacataaatatcacgtgcgataagtattaagctgcgtcctataaaaaagtatacaaatatataaagatcacttgatgattagttaattacactactactattcctctctatctctataaatatcagcaataacaataatttccacatagatcttctcaacacagtcgaaagctgccgaagtctaaatcgaagaaagagtatatttacaaatcatggctaggatgatcggaccattcgaaactgtaccggcgattcttgtttatccgatgagggtttcagcttcgccttcgctggggacaatttatgaggaacacgatgagtaaaattttaacaagacaagatcaaaactcgagtgtttaattattttttaatccattttaatgaaatattcattttgaaatatatcttgatagtgctttctatttcttggttgatttccactttaaactcttttttatcgacgttattatgatctcctatataatcagacataagagaagatgtttcttaatgacgatcagtgcaagatgtttcttaatgacgagcagtgcttcttgtaatcgccggtattaatggatgtgtttctttgttttccgatcaacctccaaaaccaatctcgtgtctccggttttgtcatttcgtttcttcttattttgtaaccgtgatattgttgtgaggccttgggcctattgcctgcctagtgctactgataatgatttctttgttttatgtgattaaaagtaataatcaatttcccatggtaattaatcaagtttaatactaatttataatatatacaaataaacgttttggtgtttcttcgtcgacgtcgctatctccaatctcattactcccctttctcaatgatcataaaacctacttcgattctactccttatcaactgaatcaccgaaaaacctcaccttttttctttttccgatcatg

SEQ ID NO: 22765 - DNA, 3000 bp, Unknown; identical to SEQ ID NO: 22764
  misc_feature (1)..( 3000): 2750-1469P.txt file - cDNA_ID_2122026; gDNA_ID_2926224; Annot_ID_142502

SEQ ID NO: 22766 - DNA, 3000 bp, Unknown; identical to SEQ ID NO: 22764
  misc_feature (1)..( 3000): 2750-1469P.txt file - cDNA_ID_2122026; gDNA_ID_2926224; Annot_ID_203434

SEQ ID NO: 22767 - DNA, 3000 bp, Unknown; identical to SEQ ID NO: 717
  misc_feature (1)..( 3000): 2750-1469P.txt file - cDNA_ID_2122045; gDNA_ID_1620310; Annot_ID_152958

SEQ ID NO: 22768 - DNA, 3000 bp, Unknown; identical to SEQ ID NO: 717
  misc_feature (1)..( 3000): 2750-1469P.txt file - cDNA_ID_2122045; gDNA_ID_2926224; Annot_ID_142508

SEQ ID NO: 22769 - DNA, 3000 bp, Unknown; identical to SEQ ID NO: 717
  misc_feature (1)..( 3000): 2750-1469P.txt file - cDNA_ID_2122045; gDNA_ID_2926224; Annot_ID_203440

SEQ ID NO: 22770 - DNA, 3003 bp, Unknown
  misc_feature (1)..( 3003): 2750-1469P.txt file - cDNA_ID_2122063; gDNA_ID_1620310; Annot_ID_152963
cgcagcttaagtggggaagggggaagtgggactggaagcctttcacggttgcaaggtttgggacgtgctgcccggagacacttatctgcgatccttgatgaattttggggacatttatatgattttcatgggcaattggttgctgaagccagggcaaagaaactagatcagctgtttggcactgatcaaaagtcagcctcttctatgaaagcagattcgtttggaaaagacattagcagtggatattgcatgtcaccaactgcgaagggaatggattcacagatgacttcaagtttatatgattcactgaagcagcagaggacaccgggaagtatcgattcgttgtatggattacaaagaggttcgtcaccgtcaccgttggtcaaccgtatgcagatgttgggtgcatatggtaacaccactaataataataatgcttacgaattgagtgagagaagatactctagcctgcgtgctccatcatcttcagagggttgggaacaccaacaaccagctacagttcacggataccagatgaagtcatatgtagacaatttggcaaaagaaaggcttgaagccttacaatcccgtggagagatcccgacatcgagatctatggcgcttggtacattgagctatacacagcaacttgctttagccttgaaacagaagtcccagaatggtctaacccctggaccagctcctgggtttgagaattttgctgggtctagaagcatatcgcgacaatctgaaagatcttattacggtgttccatcttctggcaatactgatactgttggcgcagcagtagccaatgagaaaaaatatagtagcatgccagatatctcaggattgtctatgtccgcaaggaacatgcatttaccaaacaacaagagtggatactgggatccgtcaagtggaggaggagggtatggtgcgtcttatggtcggttaagcaatgaatcatcgttatattctaatttggggtcacgggtgggagtaccctcgacttatgatgacatttctcaatcaagaggaggctacagagatgcctacagtttgccacagagtgcaacaacagggaccggatcgctttggtccagacagccctttgagcagtttggtgtagcggagaggaatggtgctgttggtgaggagctcaggaatagatcgaatccgatcaatatagacaacaacgcttcttctaatgttgatgcagaggctaagcttcttcagtcgttcaggcactgtattctaaagcttattaaacttgaaggatccgagtggttgtttggacaaagcgatggagttgatgaagaactgattgaccgggtagctgcacgagagaagtttatctatgaagctgaagctcgagaaataaaccaggtgggtcacatgggggagccactaatttcatcggttcctaactgtggagatggttgcgtttggagagctgatttgattgtgagctttggagtttggtgcattcaccgtgtccttgacttgtctctcatggagagtcggcctgagctttggggaaagtacacttacgttctcaaccgcctacaggtaacaaaaaccgcagtagttcattgaaaatcacagttttgcagtttgaaaatattgacatgtatggatttaaacagggagtgattgatccggcgttctcaaagctgcggacaccaatgacaccgtgcttttgccttcagattccagcgagccaccagagagcgagtccgacttcagctaacggaatgttacctccggctgcaaaaccggctaaaggcaaatgcacaaccgcagtcacacttcttgatctaatcaaagacgttgaaatggcaatctcttgtagaaaaggccgaaccggtacagctgcaggtgatgtggctttcccaaaggggaaagagaatttggcttcggttttgaagcggtataaacgtcggttatcgaataaaccagtaggtatgaatcaggatggacccggttcaagaaaaaacgtgactgcgtacggatcattgggttgaagaagaagaacattgtgagaaatctcatgatcaaagtgacgtcgagagggaagccgaagaatcaaaactctcgcttttgattgctcctctgcttcgttaattgtgtattaagaaaagaagaaaaaaaatggatttttgttgcttcagaatttttcgctctttttttcttaatttggttgtaatgttatgtttatatacatatatcatcatcataggaccatagctacaaaccgaatccggtttgtgtaattctatgcggaatcataaagaaatcgtcggtttgaaatgttaaatctcctaaaccggatctctgcacgtagctgacacatcgacgctagattactgacacgtgtccttatcaatatttcttctcgaaacgtcttactgtttcataaagtccttcaaatttctggggaactaagaaaatccagcagagtaactaatccaatgggttatgtaatctacatatcgttcccggcgattcttctccttctgatcgtcgctatcgccttttatctcatcggacgaaaaatcggccggagagaagggattcaatcaacgtcgcagttacactacggaccgccgttggctaattttccggcacctgcaccaccgcataaagctatggagaagccaccggagccggtttagtgtatgtatgatgacgtaataatacttacgtattacgtaaacgttctatatatgtagtttgtgtgttaaataagatgtaattgggccgatgctgaaaccaattttaaaacaactctttattgggcctggggtttaaggaaacacttcgtgccgtttaaattccgtactcacctaatgcaacctagaaactacgcagcgttttgacggaagaagaaatattcgcttcttcttttacaacttttgtcccacaacgcagaaaagtcctctctttctctctctcgaataataatttttcatttgctgcgtccttttggtgcttgaagcgatg

SEQ ID NO: 22771 - DNA, 3003 bp, Unknown
  misc_feature (1)..( 3003): 2750-1469P.txt file - cDNA_ID_2122063; gDNA_ID_2926221; Annot_ID_142407
ttaagtggggaagggggaagtgggactggaagcctttcacggttgcaaggtttgggacgtgctgcccggagacacttatctgcgatccttgatgaattttggggacatttatatgattttcatgggcaattggttgctgaagccagggcaaagaaactagatcagctgtttggcactgatcaaaagtcagcctcttctatgaaagcagattcgtttggaaaagacattagcagtggatattgcatgtcaccaactgcgaagggaatggattcacagatgacttcaagtttatatgattcactgaagcagcagaggacaccgggaagtatcgattcgttgtatggattacaaagaggttcgtcaccgtcaccgttggtcaaccgtatgcagatgttgggtgcatatggtaacaccactaataataataatgcttacgaattgagtgagagaagatactctagcctgcgtgctccatcatcttcagagggttgggaacaccaacaaccagctacagttcacggataccagatgaagtcatatgtagacaatttggcaaaagaaaggcttgaagccttacaatcccgtggagagatcccgacatcgagatctatggcgcttggtacattgagctatacacagcaacttgctttagccttgaaacagaagtcccagaatggtctaacccctggaccagctcctgggtttgagaattttgctgggtctagaagcatatcgcgacaatctgaaagatcttattacggtgttccatcttctggcaatactgatactgttggcgcagcagtagccaatgagaaaaaatatagtagcatgccagatatctcaggattgtctatgtccgcaaggaacatgcatttaccaaacaacaagagtggatactgggatccgtcaagtggaggaggagggtatggtgcgtcttatggtcggttaagcaatgaatcatcgttatattctaatttggggtcacgggtgggagtaccctcgacttatgatgacatttctcaatcaagaggaggctacagagatgcctacagtttgccacagagtgcaacaacagggaccggatcgctttggtccagacagccctttgagcagtttggtgtagcggagaggaatggtgctgttggtgaggagctcaggaatagatcgaatccgatcaatatagacaacaacgcttcttctaatgttgatgcagaggctaagcttcttcagtcgttcaggcactgtattctaaagcttattaaacttgaaggatccgagtggttgtttggacaaagcgatggagttgatgaagaactgattgaccgggtagctgcacgagagaagtttatctatgaagctgaagctcgagaaataaaccaggtgggtcacatgggggagccactaatttcatcggttcctaactgtggagatggttgcgtttggagagctgatttgattgtgagctttggagtttggtgcattcaccgtgtccttgacttgtctctcatggagagtcggcctgagctttggggaaagtacacttacgttctcaaccgcctacaggtaacaaaaaccgcagtagttcattgaaaatcacagttttgcagtttgaaaatattgacatgtatggatttaaacagggagtgattgatccggcgttctcaaagctgcggacaccaatgacaccgtgcttttgccttcagattccagcgagccaccagagagcgagtccgacttcagctaacggaatgttacctccggctgcaaaaccggctaaaggcaaatgcacaaccgcagtcacacttcttgatctaatcaaagacgttgaaatggcaatctcttgtagaaaaggccgaaccggtacagctgcaggtgatgtggctttcccaaaggggaaagagaatttggcttcggttttgaagcggtataaacgtcggttatcgaataaaccagtaggtatgaatcaggatggacccggttcaagaaaaaacgtgactgcgtacggatcattgggttgaagaagaagaacattgtgagaaatctcatgatcaaagtgacgtcgagagggaagccgaagaatcaaaactctcgcttttgattgctcctctgcttcgttaattgtgtattaagaaaagaagaaaaaaaatggatttttgttgcttcagaatttttcgctctttttttcttaatttggttgtaatgttatgtttatatacatatatcatcatcataggaccatagctacaaaccgaatccggtttgtgtaattctatgcggaatcataaagaaatcgtcggtttgaaatgttaaatctcctaaaccggatctctgcacgtagctgacacatcgacgctagattactgacacgtgtccttatcaatatttcttctcgaaacgtcttactgtttcataaagtccttcaaatttctggggaactaagaaaatccagcagagtaactaatccaatgggttatgtaatctacatatcgttcccggcgattcttctccttctgatcgtcgctatcgccttttatctcatcggacgaaaaatcggccggagagaagggattcaatcaacgtcgcagttacactacggaccgccgttggctaattttccggcacctgcaccaccgcataaagctatggagaagccaccggagccggtttagtgtatgtatgatgacgtaataatacttacgtattacgtaaacgttctatatatgtagtttgtgtgttaaataagatgtaattgggccgatgctgaaaccaattttaaaacaactctttattgggcctggggtttaaggaaacacttcgtgccgtttaaattccgtactcacctaatgcaacctagaaactacgcagcgttttgacggaagaagaaatattcgcttcttcttttacaacttttgtcccacaacgcagaaaagtcctctctttctctctctcgaataataatttttcatttgctgcgtccttttggtgcttgaagcgatgaccatg

SEQ ID NO: 22772 - DNA, 3003 bp, Unknown; identical to SEQ ID NO: 22770
  misc_feature (1)..( 3003): 2750-1469P.txt file - cDNA_ID_2122063; gDNA_ID_2926221; Annot_ID_203289

SEQ ID NO: 22773 - DNA, 3003 bp, Unknown; identical to SEQ ID NO: 22770
  misc_feature (1)..( 3003): 2750-1469P.txt file - cDNA_ID_2122063; gDNA_ID_2926224; Annot_ID_203444

SEQ ID NO: 22774 - DNA, 3003 bp, Unknown
  misc_feature (1)..( 3003): 2750-1469P.txt file - cDNA_ID_2122067; gDNA_ID_1620310; Annot_ID_152964
cgccttttatctcatcggacgaaaaatcggccggagagaagggattcaatcaacgtcgcagttacactacggaccgccgttggctaattttccggcacctgcaccaccgcataaagctatggagaagccaccggagccggtttagtgtatgtatgatgacgtaataatacttacgtattacgtaaacgttctatatatgtagtttgtgtgttaaataagatgtaattgggccgatgctgaaaccaattttaaaacaactctttattgggcctggggtttaaggaaacacttcgtgccgtttaaattccgtactcacctaatgcaacctagaaactacgcagcgttttgacggaagaagaaatattcgcttcttcttttacaacttttgtcccacaacgcagaaaagtcctctctttctctctctcgaataataatttttcatttgctgcgtccttttggtgcttgaagcgatgaccatggcagcaaatctagcgcgacggctgatcggaaaccgatcgactcagatccttggagccgtgaactctagctcaggtgcggctagttctgtcgctagggctttctgctcctccaccactccgatcaccgcaactctcttccctggcgatgggatcggtcccgagatcgccgaatctgtcaaaaaggtccctcatcctaatctcttttctgcgcagaatttcgagttctggaagtcatagttacgagataattgtttgattgaattttgtacgataatttgtgggaattcggcaattttgttgatagtttttgcgttttgtactgatccaggtgtttacaacagctggtgtaccaattgagtgggaagaacactatgttgggactgagatagatccgagaacacagagtttcttgacatgggaaagtctcgaatctgtgcgtagaaacaaagttggtttgaaaggtccaatggctactccaattgggaaaggtcaccgttctttgaacctgactcttaggaaagagcttaatctatatgccaatgttagaccttgttacagtcttcctggttacaaaactcgttacgatgatgttgatctcattaccatcagagaaaacacggaaggagaatacagtggccttgaacatcaggtttagtttgttttaagtctattgatcgaatatttcaggttagttcttctaataaatgattctaatgatggttttgttttctcctgacgcatataataggttgttagaggtgtggtggaaagtcttaaaatcattacccgtcaggcgagtttgagagttgcagagtatgcttttctctatgccaagactcatggaagagagagagtttctgctatccacaaagccaacattatgcagaaaactgacggtctctttctcaaggtctgcccgttttataactccaagcatttcttatacggagggatcaaagcaatgattgttatttctgctagtttttttttttttacattttgttctgagaccatttttattttgcttccgtttttcagtgttgtcgtgaggttgctgagaagtatcctgagatcacttacgaggaggtcgttattgacaactgctgtatgatggtaagctatgacaccgaatctactattttttcgttaattaagttagtggtcgggactcgggatcaccttgtagatttagaagtttggtttcttagcaacttgtatttgagttctgcttttccactgtttttacatgtggaatatgcgactgataatcttgagatacctgcagcttgtgaaaaacccagcactttttgatgtcttggtgatgccaaacctgtacggtgacattattagcgatctgtgtgccggattggttggaggactaggattgactccaaggtaaaaacacttgttccttcatcttgtgtaatagtgatctttagtatgattatgagctacatcatcttaaggccttattatctttgacgcagttgtaatattggagaagatggtgtagcccttgctgaagcagttcacggttctgcacctgatatcgctggaaaggttggtccttcaaacaatatatcattccaatttcatcatttacgggctaaagagtatcatttatgcatccaatgttgaaagattaatatgtgtgatttttaaatttgttgttgtctttctgttttgggtgatgtagaacttggcgaacccaaccgcgttgcttctgagtggagtgatgatgttgcgtcacctgaagttcaacgaacaagcagaacaaatccacagtgcaatcatcaacaccatagcagagggcaaatacagaaccgcggatcttggaggtagttcgaccaccacggaattcacaaaggcaatctgtgatcatctctgaacatcgtaaaatccaattctttatcgaatcttcttttgggagccttttttatagcctcgaattcttcttgttttcttgttttacgattagaataaaagaaaaagcaaaaaaacggctcttcatgagttttgaagttattgtttctgccttaaaatttctctgccgtaaggcaagaagattcataacactggaaaaagtgatgttctttctgaatcgatcagaagaattttgttttgttgcttgaattgtttacatactcttataacttcaatcagtttatcaatttcatacatacatccaaacctttttttttcttttcactcgtagaataaaatgagtaaattactatgattatgaatgaaatgacaaaatcatcaaatgaagaaaactcatacatttgtaaaccatttcaatacaaattagtcggtccacaaagaaaagagtactaatttagtttaaaaattatacttaaaaaaaatctaaaaagagaataataatgtgtcgttggtgcaccaacttcccctcgagctaagattataaaggcaagacgcttcactcagcagcagtaactaaacttgcctccaaaaaccaatcccagatctgaatctcaacctaaacctcagattcatcatcatg

SEQ ID NO: 22775 - DNA, 3003 bp, Unknown; identical to SEQ ID NO: 22774
  misc_feature (1)..( 3003): 2750-1469P.txt file - cDNA_ID_2122067; gDNA_ID_2926221; Annot_ID_142408

SEQ ID NO: 22776 - DNA, 3003 bp, Unknown; identical to SEQ ID NO: 22774
  misc_feature (1)..( 3003): 2750-1469P.txt file - cDNA_ID_2122067; gDNA_ID_2926221; Annot_ID_203290

SEQ ID NO: 22777 - DNA, 3003 bp, Unknown
  misc_feature (1)..( 3003): 2750-1469P.txt file - cDNA_ID_2122129; gDNA_ID_1620311; Annot_ID_152988
ggctcactggcaatgttgctcattactctctatccacggttgccttctggaccaaatgacaaccgttgtcacctccaggcaagtttaaatctcttatttattctttgcatcgctcttttttgtctaatatgtcaattctatagaagcaagagttgcttttctatagaaaatgctacccaacaccaatcactttgtcgattgtgatatcaaagacatgctaagcttggaagttggtttcaaacttttgttgtgctatttatgcttttgcaagaatacatctgacaaggtgaattttccttttttttaggcattcaggcatttatatgtccttgcaacagaggctcgctggctgcagaccattgatgttgattctggtctgcctgtctatgcccctctagaagtcacagtaaaagagacaaaactttattcagaaacaaaattttgcgagataacaccgtgcattctgccagagcgtgctattgtaagaaaagttcaacatcttgccttgcatattttttatgaacaaactacagaaggtttcttgatttgcatgtcacactgctttctacaagattatgaaaaaaaaatagttttctggtagaagcacatttgtggcaactgcaagttgaaacatcagaaaactaggccatataccagcttgtctcaatgctggtttaagttttttcatgaaatacttgctcagccattctacctgtttgtttcgtccacgtcacctaaaaatgtatttgtatcctgcagctaaagagaatttgtgtatgtggtccccgatactggccccaacaaattgagctagtccccgaaggtggttgatgcatttgcttatatattccttatttgtccttggtcatttcgtctacctggttttaagataatttatttttatccaatgaaatatagagaaaaattggtggagctttggggacaagagtgatcccttcagttctggtgttatatatgtcaaaaggaaagtaggagcttgttcgtatgttgatgatccagttgggtgtcagtcactgctttcgcgagcaatgcataaggttgtatacgccatcatatactcttgactcagatagattaatattcagtcatagaaaactggttctgatacacgtttgtatgctttctgtgatacaggtttttggtttaaggactctgggagaatctaatttgattgctaatagtcatagagaactggattctgatagtgttgatcacttggtcagcactttctcatcagatccaagcctaatagcgtttgcacagttgtgctgtgacaaatcttggaataacaggtaagtactgttttatccggttgattcacatttatttgtgcttttagttccataagtcataacagagttcggtagtttgcttggcaaactcagaagggcgaattctaacatattcattgatccagatctgattctgaattcaaggagttctgtctgcaagtgttgtttgactgtataagcaaggatagaccagctcttttgcaggtgattgctacttacagccacctaaccctactattcaatgtttaacggaacaattcttgatgcagtttatttggcaatgtgtattctaatattgagtatacgttacataattgttgtaggtttatttatctttgtacacaaccattggttcgatggctgatctgcttgtcaaaagcgatagtaacatgtgtgattcactttccatctcaagcctcaaggtactgttcctgcaaagatggaactgaaacaaagaacattgattcacattttgacttttgtaatcagctttgatttcctaattttggatctaatcttatggtctcaggttgctcttgcctacaatgaggcagtatcaactggaagattggcctcctcaggtggctttgtacagtcaatcttcttagcatcgctgagaaagcgatgtgaagaggttttgaattgctcaacggagctgaagattaatttgaggaattatttgacctcagaagcatggccttatgataagaactcaaagttgcagaaagatataattattctctcatggtatctaaaatggttcaacgtaccatctccatcgatcatcaaagcagcagtggaaaagatcaaatccaagtccaaaaactcaacttcggcaatacctttgttgcgattgttgttaccaaatacgcatattagtgtgattggtgaaattgatagggtctttttcccctcgaattaaacaattgtattgtgaaaacatgattttgtattctcttcgtttgggctaataagctgataaattttgtgagcaaagctatcatggtcaatttcaaactcaaatgtgcatgacaaaagcataatataaaataagctaaattttaaaagatatttagttgatgttttttaaagaatatttatgagatcaatttttttaaaaaagtattagaatagacatggagttaaatggaagtgttaagatcatacactgtaatagtgagatggtttaaatatggtttgacacttgtaaattcaattataaaattttataatttgtcctccatatttgcaattgcattacgacataacctgtttcaaattcttcttagtcgcaacatggacaaccttttaccgagcattgagatgtgtgactggaatgccaaggtgttcagaatcatcttccattgtgctgaccgcatctccttcactcatctcgagatttaccggagtggacaagtctacaagtttgtgcacgggactcctcactatcttgtggttaacgtgacgtgagagggtgttcagattcgaattcaggagaaatagagtggatatttagtttttctatgttttattttaaaattgtagtagatgtgtatgctttgacattagatgtttatatctatttttgacaaacgagatgtaaaagaaacgaaaatatatatccagacacaagattttgggaggttattttgtttattagattgttataatttagtcgttaaaatccatg

SEQ ID NO: 22778 - DNA, 3003 bp, Unknown
  misc_feature (1)..( 3003): 2750-1469P.txt file - cDNA_ID_2122135; gDNA_ID_1620311; Annot_ID_152989
caaaccatttcaaattttcatttcaaattacaggttgcagtgcttgacattggtgtgccgtcagtattatttgttacaaatagcttatctgactcaggttctccgatcaagtcactctatgtgaaatcctcttcagctccaacaggctcaaaaagtgatccaactgatcacaactccataaattctgaagatgatttactcttgtgtgcaatgaccaaagatggacagaccattcttttggatggcaatactgggaaaatacttgcctcttgcctgagacctctaaagaacccaactgcgatttgtatgcacattataggtattttatctgatactaacataaaagtgtgttttcttatgcatctagtattcataaaaataattctattttgcagagaactgctatgaaaactatgaaacgcccagtgaaaaaccagctgaaaatccatctgggaaggataaacatgagaacaaatctcatataatcaaagctagtgagagtcattcaccagacggtgaacagaatgctgtcacagaaacaaaacttattgatcagatatttgcgaattcattatttctcatgtgttctgaggatgcactgcgcttgtatactgtaaagtctctatctcaggtatatcacagtatttatcctttttatgatacctaaagtatcttgctggctctttctgataacaaggacttgctttcaatacctagggaagtcttgagagcattatggaggtaaatcttccaaggccgtgttgctggatgggaatcctaaaaaaagatggaagggaatgtgcagtactcctgttttaccgaacagggcatattgaaataaggtgactttcaaatatatgtcagataaaagttagttaccaaaatacaatcttgtaactatttagtctgaaggctactatagatggaccattgattgctcagaaagaatggtttcttaattgaacagatctttcccgaatcttgaagttgtgggagagagctctttgctgtcacttcttaggtggaacttcaagcctaacatggagaagacagtatgttcagatgatttcggccatgtcgtcctggtgagatttcttagaagagagcttttcaacatgtgatgtattaagtatgccaagttaaatcttgatgtataagttggcatgtagaataatatcataagagaatgtttttgttatctcagatgttaaggactaataaaaactaaatctacaggtaaatggttgtgaagttgccatcctttcgtttttggcccacgcaaacggcttcaggtactggcttactgtttgctgttccatagaactttcgtatgcttagctagcaaagtagcaattaagttaccaatacctaacttttcattcatctcaggctcccagagtctttacctttgcttcatgacaaagtccttgcagcagctgctgacgctacctttagccatatctctgttcataagaaaaatcatgtatgttctgctttcacatgtgaaccctttttttgtaagctccactgttttgctagaaaagtttctgtgaccacaggatggcgctcccaaattcctaagtaacattatcaaaggcttcagatcaagcactgaacagaagatggaccaagtacaagatttctcccacctggggaacatcttttctaatccaccatacttaaaaccttctgataccggtggcgacgacgaaaagattgttgagctaaacataggtttgtaatatctacactaagttactcctccccgggttcctgcctctgactaaaaattgttttctgtagatgacatcgagatagatgaacctgtgatcatcttgccgttgacagagaaagacaaaaaagaaaagaaaggtaaaagatctgtacgcctcaagttctagtatcattgtgaatgcatgagacgattcatgaggtttctttgcagataagagaacggataaggaaaagctgttcgacggtgcatccagcgatgcacaacccaaaacaagaacagtggatgaaattaagtccaaatacagaaaagctggggtgagtcatgaccaatttgatatacccaactagcttcttttttgtgcttccatctctaacatagttgggtaatttttccaggaaacctcagcaatagcttcacaagcgaaggacaaacttcatgagcggggagaaaaactcgaggtcatatattacgctgcagagatttcatcttcatttatgtttccaagctatgtatgctaactacaaaaacatctcctttctttgttttatctgccagagaatcagccaacgcacagctgagcttcaagacaatgctgagaactttgcatccatggcacatgaacttgctaagcaaatggagaagcgaaaatggtggaacatatgagagagttgcagccattgtgggctcttccgtatataaactaattatcttttgtgtttccacaggtgaaaatttctttttcatgtttatttatcaatcaaatctgtaaaatagattgaccaaagagagcaacccttctaacttgaaaagttgcttgtgagctgatttgaggctgctttgactgtctatcagaattttaaatttaaaaaaaaaaaaacacagtttgttttgtcctttacttgatcccacagctttacttgacgacacacttttgtttgttatgagttatgacacatttgactaatgcttaaaaccctaaatcccgctttattccttctccttttctttctagttacacaacacagaacagaacaccacacattcgtacttacatatctacttataattgaaagaggacctcatatagaaatagccttcgagctagaaaagcacatagaagactgattacgagagatagacgacgacgacaaggatcaaccaacacagaatccatctctctatctctctacgttatctcttcattcagagagtgcaaatagaacgacagagactttttcctcttttcttcttgggaagaggctccaatg

SEQ ID NO: 22779 - DNA, 3000 bp, Unknown; identical to SEQ ID NO: 741
  misc_feature (1)..( 3000): 2750-1469P.txt file - cDNA_ID_2122205; gDNA_ID_1620313; Annot_ID_153063

SEQ ID NO: 22780 - DNA, 3000 bp, Unknown; identical to SEQ ID NO: 743
  misc_feature (1)..( 3000): 2750-1469P.txt file - cDNA_ID_2122240; gDNA_ID_1620313; Annot_ID_153073

SEQ ID NO: 22781 - DNA, 3003 bp, Unknown
  misc_feature (1)..( 3003): 2750-1469P.txt file - cDNA_ID_2122249; gDNA_ID_1620313; Annot_ID_153076
tagagatgtggttcgtgattaactgattgttattagtgtcgttattgtgtcaccgttgttattaaaattagataaaacgagtgtatatgtataatgtatatttcaaaatgtttgatttgtaattttctatacatcaacacgaaagatccgaagtttggagtgttcaattgcccaaaaacaaatccatctagcctcgtccaaaaccagatggcagatacagaaccggaaaagaaaaggttccatggctacgctacgcaatgcaaatgatttgaatctgatgctaaggctatgtcgctgtataaagatttctagtttccttctgattcaaaatcatgacagtttcaaaaataaaataaaaaatcaagaatcgtatcataagttgtgaatcaaacgattgtgcaaatatataattagcttgaagtagtttttgcatgtaactaccaatcgtcagtgatcgatgctgcaccattgtcaaataaactacacatttttcaattaccaccaagtataagttaggctggcgaagtaacaaaattgaatctattattagaataaaatactaaatatcattccaattgaagtaacaaatatattacgccaaccttatccaataattccaattaatatattttgaacaaagtaatgaaaggaaaaaaaaaacgcatcaaccatagttggcaaaaatagtcgctcaacgttaaaatggataaatttatagtatactgtaattttcattcaattcaattgtcaatactatacatgcacgtaaatccatttttgtctctatgtatataaatatacatgtagctttttatgttcagatgggtaaatgtgtgaattgggttggttacaatattaaatgttgcatttactgtagtctatctaggtgacttaaaaatgcgaccaatcagtagctgaattcttattaaacaataaatacacccaaattttaacagatgccgttactaattaaccattttgtgattggtacaaccactctgatattctttatccatgttgttgtgacggtagatttcgtttcttagaacattcaaaattttgtgggggatatagtatgaaattatgtacggtgactttgaaaccgtgactgattaagtgattaagttttggaggatatgaggctaaatatttgtttgaaacgtatttataaactaagttttacaaagtttattattagattaataacaaaaacctaaacaaaagatattcgcctcaagagtcaagaacattcattttctctttaacctttcatctattatttgctccaaatcacagcagagaccataacaaaaagctgttgtattttagtatttatatgcttcttttacaacatacaaaaaaaaactttatttcgtcttcgttgtcttaccaagtgggcattacttatacctaaagatagaagatgtccagcttctatcatcttaggcaatgtccgtgctcataaccacttttctaagtcttacttataaccacttgtctacttgaattgattggtgtgatgattaattggccattgatagaagtataattaggacaaagtaaatatggttttaatgatatctaaccccttaaataatcatatactccttccctttcactatttaaatgtttaataacgttgcatgcatattaataagtcaaaatattattcttaaaaacgacaagattatgacaatactaaggagatactactatacttggagaacaaaataaatgtatacaaattgttagccaaccaaagaataagtatacgaagctcatgcatgtatgacacaacgacacattctgataacaaccaaacacttccgaatttaacaactaatgaataacattacaaaaacaatggattttaaagtctttttcgtgtgtgtatgtaaatgtgttgcactctttctccccacacacagagtcacagacccagtggccactggccagtgcccttgtaagctttttagataccttttgcatttttttccaagccccactctaaatatatttataatatataatattatagtggatttgttcgattacaattacatgttattattttccaaatttaaatccgaattttagatactaggttgaaaaaacggtattttaatactcgtttgggatgaagtacgatgtatttttggctgctcattttctaactgaaaaaaaaaattatcttatttttatgtagggactattaacaaaaaggctaaaaagagtttagaagaagaaataggctaatcttttgataagaaaaatatacagtttctgattcaaggtttagaatttatatttgttggattagcttttaggcttctgagtttagttttaagggtttggaatatataggactgataagcgtatggtgcaaattgcattgtatatcccatcgaattattaattaacttagtttcattaatttgtcaagtttcatttctttcattatgagaactttgtaatcagaagtgagttataaaaagtgtatttaaagtcacatctaacttgtcattattaaactacaaatgataaacgtaatccaaaaaagcaacaattagcttatcaagacacatttacataaaaagcacatgcccctcacgggatcaaaacatcccaacttaccaaaatccgcaaagtaatgatcacggagccaacaagggcattatagtcattccacgttatctgctacggttacgagaaacttgaccagcgatgaacccgagaccattgccgagctctattctgctccattgcccatcaccatgtgacgaccttctctctctaaattctctctgtactctgaaaaaaactctttttttttttgtgtgggtttcttaatgatttgttatgaccctgttggattcaaaccaaacccacacgagagaatgatgagaagtagatcaccggttttgtaattctttcaacgactctttctctacatttctcccaaatctctgtctcttgagtttgatttagctaaatcaagcaatg

SEQ ID NO: 22782 - DNA, 3003 bp, Unknown
  misc_feature (1)..( 3003): 2750-1469P.txt file - cDNA_ID_2122253; gDNA_ID_1620313; Annot_ID_153077
ctaaaatgccattttctcccggcgtgtaggggagtgagaacggcgattctaaagaaattcggaggaagaaggcggttttatctaaaccggcaccggtttgctggataccgatcagaaatcgtgagatcagtgttttgtctctgtcctttagggtgggcaccatggagtcctagactagtggaatccgccgtgttaggttgtgttcccgttgttatcgccgatgggattcaattaccgttctcggagacggtacaatggccggaaatctcactaacggtggcggagaaagacgtgaggaatctacgaaaggttttggaacacgtggcggctactaatttgtctgcaatacaaagaaacttacatgaaccggtgtttaagcgggccctcttgtacaatgtgccgatgaaagaaggagacgccacgtggcatattctcgagtcgttgtggaggaagctcgatgatcggtcgtacagaaggtcaagggttttaagccaacgagaagtcgacatgtaggattctgtgtctgaatggatgctaggctggaatttttcggactgtttcggaattggttaaccgggaatgtctcgagtggggtccacaacgtgaggggattaactcgggcacgtgagatgtttactgagctggcaattattgagtggaatattaacgtgccccagggaagtgaaagtgtaaagtattgctgacgtgtaattcttttgatgagtaggcatataaattcttttgaatatagttgatcgaaatgcaaagttatatcaaatgtcaacttcagtttaacatttaaaagtaacaactctatcaaattaattttcttatatgaatttactaactacaactacgcagctaaataatatttggtgtcaattagcaatataacaactaacaagtttagtataagaaattttgggtctagattgattttttttcaaatgacataaattatctaagtaaggtgtaatatccatacaagttactttagtataatgccgtttaatatccgaattgtagttttatgaaaaaataaaagaaataaacatttatcttcatccagagaacaattttaaatgaaaaatccaacataaaatttatttagttagaatacaaataaattaatttacaatcgtttagttcattctcggaattctgacatcggatgtaagtaaaatgaccaaaactcaacagtaatatgaccacatcaagaccacatcaaaactcaacactagacacttacgaaaccatccatggtcttgtctttgcaagaccacattatttccattggtttttttttccttctctaacaacatataagctagaaacaacattattcgttattgtgttctttctcataacaagtgtttttcattatattgttgtaccaacttttatcgaattaagtttcctatataaaattacttattaactactaccacatagctatatagtatttggtgtcaattagcaagaagtttgatacatgaattttgtgtaaagacagaatgacaaaaattgtttaactaagttgcaatatccatataattagctttagtatcatgcaactttatttcacagttgtagttttattccaaaaataaaagaaataaaccacaattatttgggtttaaattaaactcaaaagctcttgtttatcttcacacaactaatttttttataaaagaaataaatccagtataaatctacaatttgttttaaagaatacaaataggtaaatttacaatttgtttctaaattcttctataagttctgacatttgatctagctaactaaaatgatcaaaactcaacacattaaaaaaacgctctgatcggatctaaaaatttagttgaccatctttaaatatattttatggataaaataagtaagaattaggaagatataattgggaaagtaatgaataaagataaaataaaaaggatggtgtttgtatagggaaagatgaaagacagagcaatgtgagcaagagacagctagtgtgtcagaagaagatgcatatatcaataaatgtattgtctattaaattcttatttacacatattttttgaggcccacattactttcttatcttatgtcttgtagacatcacaaaacaataaaccaatcaatattattgtaatactataagttacacaattatctatgttttaaacctttaattccttctactatcgaatacacttaggttgatctatattcttttaattacaattagcggaaatacaaaatcattgcgacaacgagcacagtttggaatgattatcatataacttgttagagtgaaattgtactagtccaaaataccaacttcattctatatttcatacacaatatgttatttttttatgaaaagaaatgaaacgtaacaatctcgcttgacttgactgtatgagcattattttctttacaagttatttgatacatgtaatgtaaccccacagttagagaaagtaacaaatatgtgtcgtacagttgttttgttctaaaatcgcaacaaaaacaatgaccattaacataattttggttcgaacgaaagtgacacagtagctcatctataatgggtatggtcattgcctcattggtcaagtatcatccctggcactaaagattggttaattggggtctgctggatccatattggacctattatctaatatgaacgaaaattatataaaagggcctccaaaaatttactttactaaaaggcccaatattatgttggcccgactttgaccatacttctaggctcttttttttttgtttggacatcatttcagttcggtctgaccgtttacgggtttttttttcttccaaaccaacaattccttaagtaaaaaaaaaaacataagataaagtatcattcttattttaatagttttggtccgccagaggcataagcatacaaatattcttttctcctaaagttttaagaacagagcaaggttaaaaaaaaaaacacaagtcgcaacaatg

SEQ ID NO: 22783 - DNA, 3003 bp, Unknown
  misc_feature (1)..( 3003): 2750-1469P.txt file - cDNA_ID_2122292; gDNA_ID_1620312; Annot_ID_153012
accgagcatgaccgagcttcctctcatcacaatttctccgacagtttctccatttctctcaacgctcaaacccgattcaggatccaccacgtcgatttcagtaaacccgacggttctcactccttgccgtgccttcaatctcgctcgatcgcttgccggtaaatgattccattttggcttccacgcgcacgagacgattacaccggcggtttccgttaatccgtaaccgtgactgataacgaaaccaattgattcggctcggaggaggacggtagctggaggcggagaaccggcggttaagatgttgacgggatggttaagaggctgagattcctgagtcgcggataacatgttgagcaccaccggagctccacacatgtgtgtgacgccgtgatcacggatcagacggtagattaacggcgcgtcaaatttacgcaaacagacgttagttcctccgacggcggcgattccccatggattggtccaaccgttagagtgaaatatcggtagagtccataagtaaaccggatttttcggtacggcccaatcaattagtgaatcaactgacattacgaaaattcctctgtggcagtgtaccactcctttaggagctgaagtcgtaccggaagtgtaattaagcacaaccggatcccattcgctttcgggtcggatccatttaaaacccggatcacctctttcgataagatcatcgtaagtgtaactgaattttgaaagatcagccacgtcagcaactcctccttcctcttctttatcggcgatgacgacgagaatcggcggatcagtcgtcatcatcgagaccgcttcaacggcgagatcaacggagaagacgtcgacgaaaagaagcttagattcacagtgacggagaagaacagagacggtgcgtgcgtcgaggcgtgtgttgatgttgttgaggattgcgccggacatgggaacagcaaactggagctcgtacatagccggagtattgggagagagaacagagactacgtcagacctgccgattccgattgaagacagagaagacgccacgcggagacaacggaggtttgtttcacgccacgtgtaaacggtgttgctgccataaacgatggaggtacagtcaccgtaaacggtggcggctctctctaaaaaacctatcggcgtcaacggcggcgagtttgcggcgcatggcttcatttcctccatctcttcctcctagtggtaatcaaagactctactgtactgtactgttcttactgtttattatataatgacattttatttccaagtgaacaatccacgtgatgaaaaatttgtaaaacaatattttgggtttagaaattgagaacaaatctaaaccattagctggaaattaattatcttcagcttccaccacattataatcatagacatttgttacctaccctacacaaccactagcgtactaagtcttaaaccaatgttcgaaactactaaatataattagatgttgatttataatgtattgttattcgacaccacaactttctttgtttgctgatcgtcactcaaagtcacattaattgtaatcttactattacgccaatatagattgttaaacaaacaaacaaaaaagtttatagagaataaccttaaaatatcgcttaatctcgttgcaatattgtttggtggatctaaatgtcgtatgtggtaatttcaatgttaaaaacaaatataattggcatattatcttttatgttggtatggtatttttctacacttttataacatgaaatgatttttctttagataatattgttaaactttgtaaaagaaataatggttgtaatattgaaaatgatgttaatatttatgtactattctcttgttaaacattcattttaattaggctattcttaattaagtatagtatgtgatgttgttattaacatttttacgataccaagatatattaatttgtcattttttccgatataaatttgatcatttgtatagaatattttaaatctatatattgaacttaaattttaatggaaatatttcttggtttagtacgtacagtatatattatttagagaatttttctgatatccatcttttagtgactaactaatttacttcaaaggttttgaatgaattttaaaataatttacttagatatatatatatatatatatatatatatataatgactaaattaatctactttaaaccatcgttaactaacagttttggtcgaactattttgacgaaaaaaaactgaagtaaaaaagttccaaaattggttacaaacggataaatggaaaccataatttcaaccaaactctacagaataagaaaaaacaattatgaagtcagagataagaaaattgagagatattaaaaacaatttacattttatttttttgttaaatttcattttctttaaccaatataaatgtttcaaaactttagctccgaatagtaactgcgttttgcgctatgggagaaatgcggtgcggttcaaatagtaatgaaaatacatagatacatatgtatatgtagaaattttgatagggttacagcactgttgtgatacggttttgagtgcggttttagttacctttcacagccttaattggttcagggatcaaccgatcgtccgcgttcgcgtcgtgggtcatgtgatggtttagccatttcgaattccaaagcactcacatgttttatcccttttatttattacgggatatgctttgctacattttcctcacgacacattaatacattattaatgagattggactagtggcgggtgcaaaattatatgggaaggggaaagatttttttgttctttttttttcagccacattaaaattatgaacatacacaaccacttgagtactagctaattccaaaccaatgttcaaaaaaaacccaaaaaaaaaccattatagacaaacttaataaatagcgttggagagagagaataaacatgaacatctaaaaagggaaaggagaatg

SEQ ID NO: 22784 - DNA, 3000 bp, Unknown; identical to SEQ ID NO: 735
  misc_feature (1)..( 3000): 2750-1469P.txt file - cDNA_ID_2122300; gDNA_ID_1620312; Annot_ID_153015

SEQ ID NO: 22785 - DNA, 3000 bp, Unknown; identical to SEQ ID NO: 734
  misc_feature (1)..( 3000): 2750-1469P.txt file - cDNA_ID_2122307; gDNA_ID_1620312; Annot_ID_153018

SEQ ID NO: 22786 - DNA, 3000 bp, Unknown; identical to SEQ ID NO: 733
  misc_feature (1)..( 3000): 2750-1469P.txt file - cDNA_ID_2122339; gDNA_ID_1620312; Annot_ID_153027

SEQ ID NO: 22787 - DNA, 3000 bp, Unknown
  misc_feature (1)..( 3000): 2750-1469P.txt file - cDNA_ID_2122378; gDNA_ID_1620312; Annot_ID_153030
tatcaaagaaccatattatactacgagctagcgaaaaatctatcatcgtgaggattgaggaagccattcaagaactacaaaagtttacagaaaaatttgtacctcgtgctcttgtcctttcttgctagacaacaaatttattatttgccttctggactctaatataatcacaacaacacatattgctaggtgcaatatcatcatattagcactttttaattctatggtatatttttgttttgtaaccatatatattgtccattcacaaagtcttttctattacacatattcatgatgagaaaattgatttgatctaattactagagaatcatgcagaggcataaaatgatctggaaagcatttatttatcatttgatttgataataacattttatggaaacacctatctttaccaaagatttggaacaaatagaaaaacataagcaaacaaatatatatagtcggactaaaacaaaaacaaaaagggggatttgactgatggaacaaaagttaaaatcggtggattagaaatctgtgaaaacgtggaggatgcttattcactggtgaaattgagggatcatatataaatatgaataataatgctagtagaataagttctatttatcacttgatgattacaaatctataatatgctttcaaatttctctcctgatgtgttgatatatattacagtctttttaatatcaaaaaggtttttgtcttctctcattcattcattcatcgttaatacttttgtttttgtgtgacatattttcattattcttcttgaattatgtcagaaatagctagctagcacgattggaaagtttattcaaaatccatcttatttgttttgtacttttgacgtcatgaatattatgttgatgttttttcccaaaccacaaaaacaaaacaatcaaagtttttcagaccagaaaacactatatgttggggtttatactgttcttcctaaattagagttcgaattcaagagtagtgatcatataactttcgttttcctttcaatctttcataaacgaatccaagtaccaagttaaatgcatggttacgtattatatactatatataaatgtaatcatgttaatgttacaaatcaaatcagaagaaacaaagttatacataaaggagaggatgttttgattttggtcgaaaagaagttcaacgtcaatcattgaaagaatgaagtaaatagcagccaatagaaagggaaaccaaactacaaacatatcaatattacataattttttaaatataattaattatccatatccacacactaatctttcattcaaattccatattaaaaaaaaacacagaagaattattcttaaaggcaaatttgttctttagacttatgaaaagaggaaactcctccaagtgcaggtggaataaatcctctgtttgaaacgacttcactactgtattatttcttaatttattttgtggctcacaataatctgttccttcattgcttcgtcactcaatatatgctacagcacctacttgttgtactcttctgcttcacatctcgtgtttttattctggaaacattcgtttttccagagaagagaagacgcaagaacaagttttcaaccatggagaatggagaatgatttacttttagcataaagtcctcaaacgtattagccgcatcaacaacactctttgatgtgaacacaagtcttaagttacatgcaaagtgttacttattcattaattctagtatagttcttatactttagaacttgaagggtacaccataataatagctaaagagatcaagatcggtgattatagttatcaaatttccaagaatatgtgaacacttcatagattatgtaatgaactaatgattacaaaaaaaaaaaaagtacaaaggcaaagctagaaacgacttttgaatcaggaaaatctctctgcaggtttgtttggtccggcgggaaaatttgatatataaaccgaaccggataacatgaaccacccggtttttaaattttgctggttcttgaccacgacgaagtcacttgcttaacaggctggttctgcttcgtggtctggttctttaaagctggtccaaataataataaaataattaaaagatgaaattcctttcttgccccttttgttcttctcctttctccgtctctctctctctctctctctctctctctctctctctctctctctctctctcttcgacttcttcgtcttcgtttcttcatttcgaagctctctctgtgtgtgatggcgtgccctagaaactccataacatacaacgccacgcgctgcgcgtgcggtatcggtcagctactaaaccggagctccgggagctgcgagatcttcggttggccgtcaacaatctccacagacaaagatgtaaactacagcgtaatatcattcgccgagactttattcgctttcgataggatccgtaagttcacgcaatctcaagctattttcttagaagctacgctcgtgatgcttctctcctggttagtcttttgtttcttcctgagattcaccaaactcggcgatggtcgtaatgtctggtttaatctccgttggtggattactcgacttgacgtcttcttctccactagacattggctcgttagtgctttctctactctcattgcttttgtctccatgaattggtttcttttgagtaaaccaattaggttcctgaatcttgtaggatgatcaacaaattgtcaagaaacgtaaaacagaacttggtggaacattttctgttgcgagctggattgttttcattggtttattcgctgcgtgagtttgataacttcagaatttagtgcttcctttggtttttgttaacttagtcagtttcttcacaggctgctttatcaaatcataaccaagagaacaattgaagttcacaatgtgagagctactggttctccagatttgatctcattcgagaacgatttggagtttaacatcaccgctgtttcggatatg

SEQ ID NO: 22788 - DNA, 3003 bp, Unknown; identical to SEQ ID NO: 20525
  misc_feature (1)..( 3003): 2750-1469P.txt file - cDNA_ID_2122494; gDNA_ID_1620751; Annot_ID_166802

SEQ ID NO: 22789 - DNA, 3000 bp, Unknown; identical to SEQ ID NO: 20526
  misc_feature (1)..( 3000): 2750-1469P.txt file - cDNA_ID_2122494; gDNA_ID_2926183; Annot_ID_200433

SEQ ID NO: 22790 - DNA, 3000 bp, Unknown
  misc_feature (1)..( 3000): 2750-1469P.txt file - cDNA_ID_2122556; gDNA_ID_1620300; Annot_ID_152580
tgatgctggttcaacaggaaactttgctaggtttataaatcacagttgtgaaccaaacctatttgttcagtgcgtcctgagttctcaccaggatataaggcttgcccgtgtggttcttttcgcagctgacaacatttccccaatgcaggtactgagagaaactcatctgtgagggtgactcattcgaacattccctttataaaataaatcttactacattctctgtctcaattgtaggagctcacttacgactatggatatgcgcttgatagcgttcatggaccggatgggaaggtgaagcagctcgcttgctactgtggagcgctaaattgtaggaaacgcctttactaacaaaggctattggtgaacttattttttggtcactctattttggggagtacatagatagcaactatctcccaagtggaagaacccttcacattttatttaagggactttagcttcttctgcagcgtacgtgctgcctttttcggcattgttgtttcctgaattctattgttgccattggcatcttatctatcgggtcaacaatattaatcatctctttttcttatttgctgtgttaacctaaagatttgatgtgactggcttatgatagatattagatacagtagacgtagcatatcgtttgtcaaaacaaatttgatttcttaatcatcaaatacctatcaaataccacattcaagaaacataaagaaaacgtaacaaatcagcaagctaaggttgatgatcttcaacattcctctggatcttccttggctctggcacgatactgtcggccaggtctttttgtgacatgttgagctgtttctggttcatcttcttccatagcagaaatggtgcagtcttctatagtatcaacagctattgcaactcttcttccctcacaatccttgtctatattttctactttactctcagccattggttttctctttggtacgaaagccactgatcttggaagctccatcagagggtctacaagggactcgtctttgctcctaatcatgttgagaaagtccatgtatgctttcctgttggattcttcatcaacctcacctgactcgaatgtatatcgagtgtattttgatgggttccgcatataatctggaatcccagtcggatagactgcctctactttatcttcgttaggggaacttgcctccatcacagaatcgttgtcaccttcagtcaaggtcctatctttgacatcagaactaaacctaacacgctttggcgacttagaatcatcagcctggttttctctcctcttcaatatcggtttcagcccattctcatctgaagagccaacatgtgactccttgaaagcccccagcaagttatcttcagacaccacaaaaggtttctcgttttccgtcgacatggacagattatcctgaagttcctgcaacaagacaatcttctcttagcaaacacatttggtataaaaaaacacttctctaatgataatcaacatgctatcacaaattttacaaagtggaagagagtaaaagtacctcagagacatgtaaagaattcaacttgttaacagcttctgcgtcctctttaagcctaagctttgctgctatgagattagctcgagggtccttctctctttcattgaaagaagctggaagctccacccactcgtctgcttcagtctcatagtcgtcattcacatccttcatgcaacagtacactttttcacctaatgccactttgtcattatcatctagctcttcctgaaaatatagaaaaaccaaagcttagcctcggagatactaaaaatatcaatgagagcaattcaacaacacaaaaagactatagatataaatacctccatatcaagagtagagtccatcccaattgagtttttgatctcccactcttcgtcatcgtaatcactcggcttctgcaattcactagaccttcctttttcctcatctatgctcaaatcatctgattcatgctcctgctttccattatccgagaagctgttcaatgattcagaaagttccttttctccgctccgttggtttccatcgatctcgtcttccgcgagacaccagagagagctcacaggtgctgaagacgtagaagatgatgcaagagatccaaaaaccttgtctatcctcactctgaaactctcatccattgcaaaaacgaatttttgggacgacgatggcaaacgctggggaattttattcggtgttgggatatataagcctatgtggccaaacacaaaccgaccttttcacatcgtaccgtagtgtgaactaatgggccagattaaagtccagttatgttattgggcttattaaaaggcctaacccatttaacttgaaattcgtcgttaatctcaaccttctctcacctcagttccacgcgtaagcgtgtgcttgctgatacaggctgaagaatcatttcgatttcttcacacttttttttgtccgatttatgatccgtacgttggagcgtaacgtcagttctaagagcatctccatagattataatttttggagtttttcttcactgaaataatataaacaattcataaaggaggagagaataacataattaaggaaacgtttctgtgtaaagaaattttgtaagtttgcataggtggctgtttataattggacaattgaaaaaaagaaaaaaataatttaattacaaaattaaattataataaaatattaatttcttttgtttttgagaaactttgaaggtttctcatcatattcgactccaaacactaaccaaccttcttctagattctcaaagctggaaatggcctaaggttttgtgtgtggataagggtcacttattaaagtaagtaatggattattaaagaagaaaaaggacaacattttcggaaacaaagttgagagttttgagagttgaaaaagggcaaatctttcttctccttcgtcactctaattgagttgactaaacacagttcgagttcgagagacaatg

SEQ ID NO: 22791 - DNA, 3003 bp, Unknown
  misc_feature (1)..( 3003): 2750-1469P.txt file - cDNA_ID_2122584; gDNA_ID_1620300; Annot_ID_152586
ctgagacattaaaatttggagcaagttgcagggaagtggctggagaaatggctgagtctcagaagaggatgcaggaaactgcagataaactaggaaaagaagtagaagtgtttaagcaaaatgagtttgttggtctaaagagaagaagaacctgagcatttgcatattagtgcccttgcaagtgttggaaggtaattatcttttattttaactcggcaattccaacattttacacttcttcatcggataacgtgtatagactagttagattaatggattaattgataggtgactgcaaagctcgtgcccctaaattttctcccatgtcaccttcaggtttagatgagccaaaagcagacatactttgtttttaacttttgaatgtggttgagaattatgaatctacttagtgcgctcatcacatggtcgtttgattaaaagagtaattagatttaagtaagacaaaagatgtttgtgttaggcaataattagaaaaaggattaattatgttaagcgtccaagaaaatgcctttccacgttgggcgcacatgccttctcttctttcttccctttttttttctttctagtttctactaaactaacacaattagaggcccaaaccctcagataattgatcatcaaattatttgcatcaagaatagttcgagatgagttatagagaattgctagtttcgtcaatttgagactcggaccatagaacaaaacatccttccaatttccataaaactgatatagttaagaattgggatatgcatgtgttcacttgtcagcttgtgtatatctccagttgttcgaggacgttacatacaacgttcgagaatggtattgcaaatgccgaagtcacttaagagtagtgatggtagtgaaaaaggcggtgatctgactgggagggcttaattagggctcttgacctaaatcctaattaagtaggattcgtataaatattttgtccattgatacattttatatagttcttacatgtactaatattccaccgtagaccatgagaacgtagtactaattaagtaaagaaacctgtggtctgtggatatcggagaataataagaggcgatagagaatagaagcggaacgtaaatgtaaacaagattcaatgcatcaagattggactttagaatataaaattaaacgagaaaaatgagagttggtcaaaagtgagggaacataaattatagggcttgtttactccaatgaaattaagattaaagataaaatttcaaaagcataaaagattgctcacatgcaacccaaattcctttgttctcaataatgcatgtttgttttaaaatagtatatagcaaatgaatatgaatggagtattttggtcagaatatatataatttgagaaactgaatttaggaagagacgatatcatattcatagccaagaggacaaacacataaatgattaaattataaggaaatagatagatgccttgggattagaaagtgggagatgaaagaaaaagggtgtggcaatattcattgaagttgcagcctataaaattgggagcacatgcactacccctatattgtttttgactaatctctaattaattaacgctaacacacattgtgattattgtacatgtagacaaatgggacgtatatattataaaagattaagaaatgatacgatccactatcaccgtccataacgttggtcgtgtagccaaacataaacataaatggtctttggtcttcctctgacacaaaataagatcgtcttagaaaggctaccacttgcttccttagatactcatatcaaatatcataatctctctctaatgcatgagacttcaactcttttaattttgtgttggtcaaaagtcaaaaccctactctgacgtattagtaatacaagattaatacacatataatgatataatagctgcttaagtaatgactttcctcctcataatttagtcgactaccttccatcatgcggccatcattgcacccttctttaccaattattaactttaaccaaaacaccaaactcattgtttttttatgtgttgtatgattgataagacggaaagtgtttgcgttttcatatatgcaataatcagggtttgcttctctttttcatgttaaattcgcagttcatgcacattccatcattcaatatggaccatcacatgcagtagtatttggacgcgttataccaaatatattctctgaattgaatagtttatctattacgttatctctcgttaatttgttaatcaattcggacatgttattattattagactcgggacactggtatctaaggtaacatgctaatcatggctcttatcattcctaatccctttgtttcagcttattattgttgatgaatgatgattatgtgtatctatcgatatttatatataatatgctaacggattgtatttgtttaagttatttttgataatgatcctaatttctttgttattctttcactctcttctctaatatatacatcacctaacaaaaagaagctcttatgtattactattgtaattgattgagttgatatattagcacttgtatgattaaaggcagtcggaactcagcattatattttagcagaattaaccatgtataaaaatgaaatcactagtgtagaacaaccttgagaaatgcatgaaacatgctatcaagtggtaacttaatcataattatatacttttgattgactgataattgatatatcatgggccacaattaactcaacacagagccatttttaaatgttgtttcaattggaataaaaagatatataaaagaattatacacaatgaaaaaagagagagaaaaaggaaaggtatagctcttatataaaagggttgtggtaagggatacttttccaagaccaacacacattccctctcttccttcaactagaaaaaagatagatatatcggacatttattgatctgtgtatgcataaaggtatagtatcattattagaaagatg

SEQ ID NO: 22792 - DNA, 3003 bp, Unknown
  misc_feature (1)..( 3003): 2750-1469P.txt file - cDNA_ID_2122635; gDNA_ID_1620300; Annot_ID_152601
ccaccaacattcaattacgctcaaccaataaattggttctgagagcccttgatcatacttgagagttagcgaacaagaacgatggaggattatgtcggtagaaaacttctaaccaagttgtcataaaaagacgatcaagcgagtagaaccacccaattactgtcgtaatcaacaagatgcccataaacacacgaaatatttacaatcaaatatatagcataagaacacagttgtctttcacaacattgacacacaagagtcaaaatgcttactacccgtttcagacattttgattacacaattacatttagcccttagtagcaaacacatacataaactaaatccacgatcaccggcattcccattaccgttgatcgcaaaccttaaaaaacccaaagtgaaatgctgctgatccaaaagagattttcggatacttgtggcagcatcattcactgttctacacaacaatggaaacatcaaaagagaaataaatacctcttttttcttcttttttttaatggttttttcaggttcattgatgatatatctcaagaagagcaatcaggacaacgtatcaatccattctcattgcattcaggacatctcttgaccctatcttcatcctcatcaaacagtttcttgctgccactacaattggaacacggaacaaatcgaatgtccccacagcaatggcaaacaaaccctggttgtctcattggaaactctttaagaatcttagcaagctcaccaatctcaaacaaactcttgatcacatcagcaccaccaacatacttgcccataatgaaaacttgaggcaaagacacagacttctctcccattgcaatctgcaactctttcctataagcgatatccatggagacgtcgcgctcatcgatccaaacccgaaaccctctaaatatcattctgacagcatagcaatcctcatacgtccgtctaatccctctcaagctagtaaaatacaccacaatcctgtcctctgtcccgggaagacggatgaccgagttgtttaagctcgaaaaaggcgatatccgcgattcgggtaaaagggatttaccggatttctgcttctgaggaatctcagctaaggcaggtttaacgggtttggaagtctcgaataatctacaaaggtttttgactttgcctttaagagaagttcccatcgattctacgggggtgtagaatttggtaatggaggtggtacgattgagagaaggattgagattgtgggatttggggcccgaatccaccactgttcttccgtgaattgtaagcgacctgttgaagaacgacgtcgttgtagccgatttcgtcgtcttccctgagaaatcagcgtttttctctaatcccgccatcgaaattagatcaaagaagcacccctttcgacggctaatttggtgtaaaacctaaaatagtcaacaaaatcaaaaccctaggatcaaattcaagcaaattgacgaatacagaaagagaaattgaaaaacataaattgaataatcgtcgatcacctcccaaggaagaaatggaaattggaatgattggaaaagaatcagcttctctgatttgagtcgtaaaacgatcgggtgctgcgtttttgagctgatgaattctcacctaagattaaagaagacgagattgatgaaagaatgatctgatttttctggaaatttgggggtttgtttgtgttttggaagaagatgtggaggagagctccgaattagccttttgtctgtctgcctttgttgcaaagcaaagaatttttctgttttttttttaaagatataattattatgtctaagttattaaaggctctttaatgatatatttactcgatgctccttcgaggaaaaacgaatttgaaaaaataacaaaagtgggattaaattgcgaggaaaagtcgtttactggtaaaacgcggttgtcttattaagaaaggttatggttacagcgaaaccagtttctacggtcggtttattgctattgattctacgctcggtttagagatagttgtctgtattctaattgaagagtagtgtatttcgctttctagtcttcgaccattaggatttttagttcacacaagatcaattctctaacatttaaaatcaactagaaaactcaaataacaccgttaaaatagtgattaaaccattcaaaaattaaacgggttttatattgtttgatatgaaaactgcaggtttttcgattgttttttttgttttccgattgttacacaatggaaaagaagatcaaaaatcaattgtttttaaaaaaaatattattctgtcatatttttgcaacaaacatgtgtttttgcaatgttacatcggtgtcaaattagcaatgtcagatccaaaacaaaatgtcatattgtgaaaaaaataaccctacacttaataatacagtatgaattttggatcctttaagaaaaaataaaaactcgataaaaacgttgctgtcggtttgcaccgaacgattgaagttaaccaagccagcaagcaacccaattcttctatttcttcttcacctttagatttttcctcgcttaatttctcaataacgctctcagagagaccatttgatgaagcttctcgcttctggaatttgaaaaggtacaagttgcaactctctcttttctttcttttcttcctgggtttattatatagctggagttctttgtcgatgaatcgggtggtgttgttgttgtttggtttcaatttgatagaagattggcttgaccttgatttgctttgttttgattaggatttgataagacgagttcatagaagattaccgcaagttcatcaactttttgtatgtggtttcagcttttgaagcaaaattctgataactatacaaagattccagcttcatatgtgattttccttgttattcttagctttgctatgaagttgagatatatgagtggaaaattcgtattaaaggatatgccttttggttgttcatttgcaggaacttgttatg

SEQ ID NO: 22793 - DNA, 3003 bp, Unknown
  misc_feature (1)..( 3003): 2750-1469P.txt file - cDNA_ID_2122700; gDNA_ID_1620301; Annot_ID_152620
tgatgaattaaatacggactgattcgatttcagtcagatttgcatcatactacacaactatttatattttagatttggttaaccaacttataaaaactttaaatactacacaaccatttgttttttagatttggttaaccaacttataaaaacttaatttatataatcttgttggtttttgttaattttcacatagttgtccaattgttcccacacatctcagtattgatatccatcttcttatcttcgttaaccacctaccaaatgtcacgtggacgctccatttcggtttctatccggattcgcggtggattctcctcccaccccaatcatcggttcatttcagcatttggttatatccaaattattttaaccggtttataccgaaactactcgaaccagacaatctttgattggtagaaagagagccacgtaggattatctcttctaatggcaaattaaccaaaaacgtaactgaagatcaaaagagaaagagagaaaaaagacgatgagagctctaacatggacggcaatgtcgccgccggtgatgtcacggacggcgacttctacggttaacttacgacgtatcagcctacggagagatcgcgtctgtgttagagccacggcttcgtctagcgccacggtttccggcggaggagtagtagaggcggtagaattggcagagataggagaaagaagcaagaaatggaagtggaaaggagaatattctgttaactactttgtcaaagattcgccggaggaagttactccggcgagtcaaactgttcttttggttcatggctttggtgcttctattcctcactggcgaaggtattaatcattcatcattcatgttttaagagtaaatgtatgaatcttgttgagatagtgtttttttttagttaagtatcaataaattgttgtatgtggaagatttttatgtataggcattgcttttaacaagaacgaatgaaactacttttgcaggaacataaatgctttgtctaaaaaccatacagtgtatgcaattgatcttctcgggtttggtgcttcggataagccacctggttttagctataccatggagtcatgggctgaggtaaacaatctttgaaatactctggcatgtttttgttgtttaaagaagtgttttggtttggtttggtttgatttgatttattttggtgtagttgatactcaacttcttggaggaagtggttcagaaaccgactattttgattggaaactctgttggaagccttgcttgtgtcatcgctgcctcaggtctaaacccttttcactatttgagtttgtttctacgtctaatgatataaacttcgattacttgagctaaagatgtcacaagtatatgaatcttaggtactaagtttctcatatatttggaaaaaaaaacagaatcacgaggagatctggtcaaaggtcttgttctattgaattgtgctggtggtatgaacaacaaagctgtctttgatgactggagaatcaagctactgatgcctttactcttacttatcgacttcttactcaagcaaagaggaattgcttctgcactcttcaaccgtgttaaagacaggtatgtccttattcactttttccctgactttgaaacgatttattcgagagctctaacgcattgacgaatatacgaaacgcagggaaaatctgaagaacatcttgacaaatgtttacgggaacaaggacaatgtagatgacacccttgtagaggtattgtcattattactcactctcaatgacaaagaacaatgaaagttttattcactttttatgtgaaaatgttatgttagatcattgctggaccagcaaataccgaaggtgcactagatgcttttgtttcaatcttaacgggtcctcctggaccaaatccgattaagctgataccggaaataaccaaaccggttcttgtcttatggggagatcaagatggactaacccctcttgatggtccagtaggtaagtacttcacttcccttccggatcagttacctaacttcaacctctatgttctacaaggcgttggacattgcccgcaagatgatcgtccggatcttgtccatgagcgtctccttccatggctggctcaactttcttccacctagtttcgatttgtttagccgtgtacacttgtttataaatgtaaaacaaatctatctaattggaaaaagacagattcaaaatgatatttcttgacacattttgtggtgtctgaatgtaagttgtaaagaagtcatggtggtagtaacttggtaaaggagtttgtttttggaataaacgcaaattacatggtttgtaactgaataccaaatgtcaaagccaaaaatatactaaactaaaagataggcttatttagtcaaagctcaatgctattgacttggtagtcatttttggtaaaagaatcgttacaaatgtagaaagtgactagttaggttgatgaatgattgatggtcctatacaattgataatttgctacttttgttggtaggcaagtaaaagacacttaatgagctgctagaagctatttttggccacaaaatctacaaatttgtttggttgttgaatctttaaaaggacattcatgctgcaatatcatcaacatagtgaagatgataattttcaaacttgaaattcaaaagtgtatatatatgaatatgatgattgaatattgattatcagtgtgaatgaaaaaccattgttataaattttcagttttcatcaaaaaaatgatgccaaagaagaagagtaaacaaaacaagacaaaaagagttaaatggagtggtccaataaaaataaaaataaagaagacaaaacaaatttgtattaaaatggttagatgtcgttgggtgccgggaagtcttcgttggagtctattatttaaatgcttcaccgatctctcattactctctagtcaatatcccaaaatccctaattcatatctttgaaactgataaagataacaaagaaatg

SEQ ID NO: 22794 - DNA, 3003 bp, Unknown
  misc_feature (1)..( 3003): 2750-1469P.txt file - cDNA_ID_2122710; gDNA_ID_1620301; Annot_ID_152624
atcctactatcttagtatttttttaccgtgttttagttagatttataaattttaatcactttcttattattgttagactttatattttgttaaacatgatctgattatttttattattaataaaactcaaacatatcttttctcgcgatttcatgaagaaaaatattttaaatttgtttatacaatatttctcaaacaataaatcaaactcaaaatgatgaatattataaattgttgttgttattttagaaaaataaattttaatgaaaaaaccctcaagtttagacttatccattttaaaactctcaacttatttttaaatagaaaaacccagtggtcagtgttttcacactcggtccgaccggttgaaccgtgacccaaacatttttctgatttaggtttagtgctaaaacccgacaagttcaaaatcaaaaaaacccacaaaaactcactattaacctatgatccggtgaaccggtcgggtgtgggttttaaaatattctctttattttggaatataatatgagattttagactttattcaatcatttttagaaatcttttcagttcgtaaactcattttatggtttacattttgacgaagactttacaatgccgccttaaaaatgaaacgaatggtgagtgagacacccgatattagttgtgtaaattcacgatgttttactagtttatttccgtcattggtgatctactactatatttgttatggtattagacgtttagttggatttaaaaaatttaatcactttattattattgtttgattatatatatatatattatttattttttttattattattttttggtataaatgattttatattttattaaacataatctgattttatattttataaacatgattatttttattttttaatttataagaactctaaaatcttattaatattaaatttattaaataaattttaattaattgacttatggtccaacctggttaacccgatgacccaataatcgagaaggtagtcgggttcactgtccgggtcgggtttaatcttggaccatcaatcatctttaaaaaaacaattgtcagaagattgaatatttggtaaacaaagtatatagagttcagaagatataaacaattaaattgacacaaatatttgtaaaatatttaatttttagaaagaaataattgtgataaggaaaatacaaataaatatggagaaaagacactttgtaagaagacataactgcaaagatattttaattaaaaaaattaaaatatttaacgaatagtaacgatgaaaaatgcaattataaacgaggaaaacgatagggaaaactctctgattcacattagggcaaacatgcctcatatatatatatccatacatgagaccgtcacatgaaacccaacttaagcccatctatagatacgtaagcccatattctatatccaaactaagcatgtgcatttgcttgaagtctaatcttgaacactttaatcatctttgaaactcagtgtgtcctcccacactacttcaaaaccttaatagccatgatatgagccaatcacctcgtgtcaagtatatatgcaagtttaattcatccataaaacatagaatatatgctttgagataaaatcctatttagcaaggatctaggcacttagattctttccaaaacatatcaacatctctgctacaccaatttttttgtgagttaatctcagtgacctacgaatgagtgaaaactctacttcacaagatattcaatagcgataagatcgtacaagatacaaactcgaacattcacattacttaacatcaataggaaaagaaaaaaaatatgaccaaaaaaagaaaaccaattggaacctaagctaaaccgagtatctatggtcataagacactatcactaattacaggattccactaaattactcgtatgcgaactacgcatgtgcatttaatttgcttgcagcctaatcttgaacattttaatcttctttttaactcaagagtgttgttctcccacactactttaaaaccttaataaccgtgtacacgtcggtaattagtcaagtaaaacactccaatatccaataattaaaaagagcaaatttagggaacaaacatgcgcacaaactttcaaacatcaaccatgattagagtgcacatgtacaccatagacatttttccttgttaatttactaaattaccataaacacttttttctctcttttattattccttttccacccatacccactttttaactttccatttttaaatcattcctcgtgaaaatagtaaaactcctttatgcaataaagttttcttgaattttacaacgtacaaaaaaaaaaaaaccgcgtggcattttatgtggttatgatgtgagaataatttgtgaaaacgaaactcaagtcaatgaataaaaagacgaaacaatgctatgataagaaaagaaacaacactcgaaaaagttcttctttttcttccgcacatgtctgactctctcataagcgtaaatcgctctgtcaaatatctctgaccagagagacagagttgcctccacgtttcttcagacaagactcacgctcttccctttcaccacattcccttctccatttctcaatctcacttaccttctcgattcttgctccaatttcgaatcttccgagtgaaaaaagcttcaaagtttggaactttctagtgtttattaatctgggtctgctctgagtttcgtgtgtagctgcatatgagcttaaagctcgagtttttccatctgggtttggaattctagggctagtgattggagattttgggaatttaggttgattttagtaggtttgacttcaggttgcgtaatttaggttgattttgatccgatttgtggaattagggtttgtttgttcacaaagcttcaatttttggagtttaaatggatcgataacgactgtgttagaagaaagtttgctgcttcagattcgtattcgatatagaaatg

SEQ ID NO: 22795 - DNA, 3000 bp, Unknown
  misc_feature (1)..( 3000): 2750-1469P.txt file - cDNA_ID_2122743; gDNA_ID_1620301; Annot_ID_152633
ctgacgttgtcagattttgaaaaaagacaggtaagagttagattcatatactactaacaaatcagcttggcgcataagaaaatagcttaagtagcgttggttttatcaaatctagtttttaagaagtagcaaaacataaagctggaactaagcataaaaattttgttttgataggcgaaattcacttccttctttggaccaaacatcacggcagaagtcggtaagtagtgaatcaattctccattcatgtttatgaatttcttgttctcggttcttaaaaaattattattgttgttttgctttgaaggtaaaggagaaagtgagaatctctatgaagtaagactgatttccaacctctccaccaactctgtatcttctacctcttgaacatagacaatcatgtatacggcgacgttttcagtcaatgttattttggtcttgtaaatcaattctatataattatcctatgtataaaaagttcatactatttacagaaatgggaattggaactagccttgtcgaatggtaatacggtcggaaggggacaagctacgattgcaacgtgttctagagtaattttgatttgagtaaacaaaatacatatactgtatattattcatatcttggtgaacaatacaaaatatattagtttgttttaaattaccaaactaaagccttaaaaaaagtatcaaattaagcacataagttagaaaagaaaaatgtgttgtaagaaagaaaaaaggttaggaaagaaatatgcgacagaaaaaagagttttatgggcttacaaataagaaaagcccaaatgggccttgagtttgagctttacataaaattcattctactaaacttaagcaaaatcattccttcttctttctctgaaacttttgccttgcttgcttgcccagaaagtcgccgagaaagttaaaagtagaacggcggaggaaaaaaaaacgaagaggaagaggagagatggagtcgcagaagaagatagctcatgagatcggaggtatgaagaacgatgctcttcgctttggtcttcacggcgttaagagcgatatccttagatctcatcctctcgaaacggcttacgaatctgtaatcaatcacttcacaatctttttttttttttttattgatattgaggaattagaaaattaggctaattaaggaacttagggtgttgatgaataagcttcgtgttgattcagaaatttgagaattgggattttttgacggggtttctgaaattagtttttttttttcctttctataaacttgtttattgtgatttcaggggaagcaatcacaagaagaaatgaagaggagagtgatcacgcatacttatggagctgctcttcctttgaagatggatcttgatagacaaatcctttctcggtatggatctttaaatctgtagcatatgaaattctgaattacactgattattaggtatgagaatgtatgagaatcttccttaggctttatagaatactgttaagattgaaatatggtttcctaatgctagtaatctatcttgattaggtcaattgctgttctgaattttgaaatattgttagtacaaatgtgtatatgaatcatcataatgattatatcgaaaattcggaatcataatcgtgtagtgctacttagaattagatttgcagaaccataaacgcgtagtggatactcttaaattagtagcaatatgtagattgaattcagaaccataaacgcatagagcagcctcttcttcattgaatatttattggtgaattgaatatttattgtatatctttttatgtggagtattcaggtttcagagacctcctggaccaattccttcatcaatgcttggccttgaagtctacacaggagctctagataattttggttttgaggattacttgaatggtaattgttttacaccagttttcccatttggttgtgcattagagttttctattcctacaatctttgagcatttctcaaaacatgaccgtcacatactgcttgcattgtgtaaccaaatcatcctcatccttgcatagagtttaactctttgtttagcatataatagaaaagtgtctcaacttgtttatttcgtttcgcttactagtctctactttgtagattgttccactccaaaacaccaatagacagtgacaaacctttgttccagttagactgtcacaaatcatcgagcattgctcaaaaattgactgtcacatactacttacttacattgtgtaaccaaagttgaacttttggttcagtatataagagaaaaatgtttaaactttttaattctcttagtttcacaatttatattgttctgacgatgaatggtgtataatctacagatcctcgcgaatccgagacgctgaaaccagtagactttcaccacgggatggaagttcggcttggtctctccaaaggcccagcttccccaagtttcatgtagtcaccaccatcaaagtatttccttcgtcaggtctcatatgctttttaatctgagtaagatcatgttatgaatttccaccagccctaaaagaatctacttgttgtttgatctcttctctatactgtgtctcctttgctctgaacatgataaaacatatgaactgtgtttcagttcttatctctctcagttcacaatttgttggacttgcttagttatttaaataagattatgctcctatttcattattatgttactgacaccaaaaccttggatactagattctattagaataaataaattgcatatggattaatactctaaacaaaacaaaaacaaaagaacaaagtaagattgttttagtgactcggactggactgttaacatcggataaatctgaaaaagtaaataaataaaaataaaaaccctattctacgttttattcgtctgggaaaacaaaaattaaattcgatccccaaaattaataattccgtcttcaccgagaaaaaatccagagcttcttctcctccgacgcgatg

SEQ ID NO: 22796 - DNA, 3000 bp, Unknown
  misc_feature (1)..( 3000): 2750-1469P.txt file - cDNA_ID_2122747; gDNA_ID_1620301; Annot_ID_152635
tcatggttgcatgcatatacaccacacacattcatcaaatggtagcaacaagaacattttcgaaaacatatgttagagggactgtaagcacatgatcaaaccactcaacttttccccaaatttcacgttttttgcgcctttcaagcgtaatcactgcacaccagagcatcttattagacccactataagtcatattctccttccacaaaaccgccatctttccaccaaaattagctaatctaggacaagcaagaataataggtagttgttctaccaaaccctccaactttctccaccgtcctagctcagtgtcataccatctgaaaacagtgccacgccatgttttttcgacagagtacaaaacgttctctatctcacaataatcatatgaagacttataactacacatctctgattcaacaaggtcccatatacctttcttgggattgtaagaaaccacctttctcttagcccctacataccacttttcgtcaatacataagcttttggagtaaatgttgtgttttgtttcgttgtaagggataggtacatgatcccaaacttgtgtttttgtgtcgaacacctcgaaagtgttcttcaagttaagagaatctccatctttgcaacttccggctacatatatctttccgtcaaggacgccagcagaaacttcaactagctccactggcaagcttggagcctcgcgccacgtgtgagaccggcaatcaaaaatcgagacactagagtaaggtgatatggatctgccaatgttgtagatattagaaccaaccgccacgagactggaacgttgcacaagacgaggatgtggaattgatactgtagccaaaacatacccacttgacttcttcttattacttgtttcagaagatagggcttgatcaggtttcaagcagagagtaaaccagctagggctctcaaaaggatttaagtataagcatacatatagacaaccctcggtgcggttcaagagtgaccgttccttgtaaagctccggtgaagctaggagagatcgaaagctcttggagacaaaggagagaatcggataatacaatcttgagactcgtgcgatgcagcttattatcaaagcatcgggaagtgacggatttgagttcgattccggcgctggcgaaaacttttccggggacgacattggatgagtttaagagacgaaaatggctgttgaacttggagaaaacaaatttagggttggactttatatatagagggattaaaaccggttaatgcctttggttaaggggagaaccggttatttgttttgtatgttttgtttggttaagcattgagtagtgagttgttgatagcttcatttatgaacaaccaaaaaggctctatttgtatgctaataatgatcactcgaaatctctaggtatgaaacgatccttatagttgtgagatgtgagttagttttaagaatttatgtatgtattctatatttcttattatgatattgtatattcagtttttgtaatgtcggatttcttttatggtaaagaattatgcttatcaatcaataagtgacataaattaattagaagtgaaacaagggacaaaatcatagtttcaaggctcgtaacgcattcatcaaagagtagcagcaagaaccttgacgaattcatattgtctagggactgtaagcacatgagcaaaccattcaacttttccccatatttccaaacttccgcgtctttcaagcgcaatctccgcacaccaaatcatcttctttcggcgcccaggcaaatagtcgtcccacaaaactgccatcttcccaccataatcaaccattctaagacaagcatcaatagggaacttaggtaatcctaccatacccttcaagtctctccactctctttcctcactgtgataccaccatacggacgttgagatatctccttttacaatagtgtaccaaacattccctatattgcgataacaatcatataaatacttattatgttctatgcttggtgtaaccaggtcccatctaccttccttggaattgtaagcatccacacctttgtagctcaccaggtgcaattttccgtcaaaccttacgattttgtagtgaaagtcgtgttttgtctcgctgcaagggacagacaaaggatcccaagtttgtgtatttgtgtcaaacacttggaacgtcatggagtcgccatctttgcatcttcctgatacatatatcttttcatcaagaacgcaagcagtacatgacattagcttcacccgcaacctagggccctcgtgccacgtgttagacgtgcaatacagaatctagacgctagaggaaggcaattcatatccgccaatgttgtagatactagaacaaaccgacacaatgctcgaagaagatgactcaagaggagtatgtggaaatgggactgtagccaaaacatacccacttgactttagggttccagtatgtttacggaaaagagtaaaccacctcggtttctcatcttaaggatttaactttaagcacacatagagacaactctccgtgcggtccaagagtgatcgggtcttgtaaagctccggtgaagctatgagagatcgaaagctcttggagacgagggagagagccggataatacaatcttgagacccgtgcgacgcagctcaatatcaaatcatcgggaagtgacggattagggttcgtttgcgactgcatcgtgtaccgcttcttctccaactttgcagagaacttcaaggatcggtctttataaagaaatttccaaaaccggctcacgtctttgcttaaggaaaaaccggttcaactttccatagtcaatagaatccgaaccgccaattgattttgattgttgaccgggtttagtagaccgaatttagaataggtgaaccgtggccagaattttggcggccgatacacttctttacctcagcctcacattactactctcacaaaagatacacagagagagaagagaagaggaagaaaatg

SEQ ID NO: 22797 - DNA, 3003 bp, Unknown
  misc_feature (1)..( 3003): 2750-1469P.txt file - cDNA_ID_2122789; gDNA_ID_1620305; Annot_ID_152789
acaacaccttaaacaaacatttcagtttgtaaacttcatacgaatgattcattttctgtcggtccagtaccaaaattttaaaatagtttggaatctttgaaacttagattattttttcgcacttaattgtgataggatatttcctgttttaatcagttattaagtcagtaaattgacaaattaaagtctgtatttagttggcatgtcatgtgagaacacataccgagacaattatccaacataatagacaggatttaatttgttgatcttctagacaaacgtgagttaactattacatatacgagtatttcattaaactcatagcatatattaaaaaagataccaaattaccactcttcactatcattgtttgtttcaaactttcagtttcagattaccattctttaacagaaaataaaattttatatttttcattggctttgatttctttgaatgtgaaacaagtatgtatgatgacacatgagttacgtttgtacctatatattatcatggtaacttaaaccgtaataaaaaaaatgtgtgcagaggtataataatgaaaaaaagagagaataaactaataaataataaataattggagaaaataaaatagcactacatatgttgcatgcagccagcaaagtaacatgcagtaccatgcaagtaaacataatgtataaggaccaaataccacatgggttcttacagttggactttgcttatttcactcacatttgtcactattcttttcttgctttcgtcatttacaataattctgaatcggcaattttatgttcctttctttattaaaccgatcaatagatgaaatggaacaccctaaccaaaaatgaaaagaataaataatgacaggagtacccacggacaaaggcaactagtcgcaacatagactttttagttttaactctttatttactaatcggagcagtttagctttgaacgtacccaagtcataagtatgttataggcccctaccacaggaacaaagttttatttacaaatagaataattcattaccaaaaccaaaaagtttatgcaaatattagtctttcagaaaagagaaaaaatgggcatctttgttactttagctataaaaaatatgaaaacaaaattcaaagaatcaatcaagttttgtagaaaacataattcaggaactaactggtgggatccaatgtccatatacatatcatatataattgatatcctatctactttggcactgaaactcccctagacatttttttttaaggtgttatttcaatctttatttgtcggcatatatatacgcaaacacgtacatttgtgcgtatatattaaattacgtatctatcgaatttttaaaaatgcttttttagtctccctccccttttaaaagctgggaaggggttgttgaaacctctttaattaaatgtttaacaattatatactaagtatgatgttcgatcatctgatcatacaatattgtatatcttatagttctgaaacatttaggaaattttagtgtccatttttattcggcgtgatatacgtatatgttgtataaactataaattgaaattaacggttcattagaaccaaacttaataatttgtctaagcataattgttctacaaatgggtaaacattttataaagtcattaactcattatacagttagggatttaaaaataagaaatactcaacttcggatttggtaaaagtaatatatttaatcggctacgtagtgtgcaaagatacttgccgtccatattgaaatcatgaagaaaaaactattcaacatcaaaggatcaaatcaccataataacatgaaaaataagttcagttatatttttaatttgtgtaccaagttatactaagactacattatatatgagaatttcgagaagctatcattggatatggtctaccttctatgcgaaccaccgagttgatgtatacaatgtggctcgagtggcgaagtagacaccacaccttagtcttcaagaccaagtcttcatcactcttattctcacctacttcaatgtttcattactaattttgctttatatttatatatgtgtaatgggaaagttcctaggtcaagttttttttttttttttttctaattttaaaatatttcacttttagttggagtatcatatattaattacttttgccgcttttgacaaaactatagccatctttgacattatactataaattatttgttcttacgtcaattaatcaaatattttccaacaaacactggtcttcattatatttaaaaatatacataacctgaccagaattgcgttttaacaacggattttttttatggctctaagataaaataaaaagtcgttgcatagctagtcgttattatttcgtatttagaattgatatgtttagccacgtgaaggagaggaactaaaaacaaatataatattaacataaatatgttcattatattagagaatttctcttcaatatcaaaaatgtaactggactacaatttggaacttacaagttagtcgacgagataaatctgaaacgatagataaagctcaccggcaagcaaacatggcacgtgggaagctaaacttgttatcaaagttattcttcaacattttgcactgaagaattttcttaataaaatcagtgaaaaaaaggcaaaagggtaattctcatttcacatttgtttccacaaactacttttgaattattatagagttgtctcttttttcttaaaatagaaattaacagttcataatgtaacaaaatcctgcatttttaagaatcttaagatcattcccacacgtaatgaataataaatagtagttactttaatcgtcgttctactagttgggccatactttggtattattgggctcaaaaataattaatgggcttaaggcctcattagaaaacggcaacgccattgaaggagtctacggtgaaggaaagaagctaacgtcggcgccgtcgttagttgccggagacgcgatg

SEQ ID NO: 22798 - DNA, 3000 bp, Unknown; identical to SEQ ID NO: 674
  misc_feature (1)..( 3000): 2750-1469P.txt file - cDNA_ID_2122823; gDNA_ID_1620305; Annot_ID_152799

SEQ ID NO: 22799 - DNA, 3000 bp, Unknown; identical to SEQ ID NO: 674
  misc_feature (1)..( 3000): 2750-1469P.txt file - cDNA_ID_2122823; gDNA_ID_2926241; Annot_ID_142877

SEQ ID NO: 22800 - DNA, 3000 bp, Unknown; identical to SEQ ID NO: 674
  misc_feature (1)..( 3000): 2750-1469P.txt file - cDNA_ID_2122823; gDNA_ID_2926241; Annot_ID_204078

SEQ ID NO: 22801 - DNA, 3003 bp, Unknown
  misc_feature (1)..( 3003): 2750-1469P.txt file - cDNA_ID_2122929; gDNA_ID_1620306; Annot_ID_152830
ccaaaaaaatcagataaaagtcttacaacatctgcattaactatttttggtgggtgtctaaataaattaattataataaactttttaacgttatttaattatgaatatctttaaaatgtgcaaaagtgtctaaagacacttataaataaatttgtttatatcgacaaaaaaaaaaaaaaaatttgtttataaaaattctgaagacactcacctaacatattagtctaccaaaaagccgttttttttctttactaaatataaaatttattgatcaacaaaaataactatttacaaaagaaacaaaaagtggagaaagaagaatagaagtagatgctcatgggcaggttccaatttgtgtgaacgatgtgtatcagtcacagcgaggagatatggtttcttattgctttctcaataatgtgcgtaaggtgaagaagccaactatgttgatggtgtcgtgtgtcgcctaaaagcccaaccttataaggaaaagtagcggacaaaatctcttgaatgcatgcttttcagtatttcgctattataggctaattaatgaccgaaactttggtctttcatatgtgtcttattattattgaaaaataataaaatatgcattgaagagattttggatacaaaggagagatacttagaaattggattattattattattacttttagattaatatgtgaattcttattaaataaaaagggttgtagaagctacaatattcttaacacaaaagattgttcatttccaaaaaggataaaaacaagaaaaaaatctactaaaaggaaatatgagcatagatgaatatagtcatactttagccaaactcacataaggttttgaatcctgtgtgttttctctttgcaggaattgcatcatgaattttctgtctagaaccttgaataaggcatgagtatgtggaatgttgttgtggtaccgattgttctctccacccaaatcgcataaatgcatgggtgaggtagagtcttagatggctagccaaactgagaatgcgttagtgtggaaagtaaaaaatgattacagcccagtcttcttgttgttttagaccaaataccttcactaacttaatattgaagaacaatatgatctctagttacaaggagcaagccaattatgatctagtttcaaggaattggctaattatacttaaaacccctaaagtctaataggaaaatattagatcatgagggaagctaaacccttaaaactgtgagcgttagtccaaccaccatggccagtcttgagggaagctacttgaaatatttgtttgtggctcccattttgtttaacttttttattactacgaaactaaacttgaattaatattgccataactttttcataagaggataggaaaatctaatatgaactctatcaaattatatgtttcaagtaagaatacttaaaatgtttagctgagctccattatttttgaaaacagctaaaatattttttagattctattaattaaaattaatacataaatgatatgatacaattgagaaaatgaaaaacgcccccgaatataatacgtatgtggcttcataatcgtatagttgtaggatcgacccagcacaccacagccgtcactagtatttaatagattacaagcagaaaaagaaatttaggtctatttaattagtgaaaataaaaaaataaaaattaaataaggcaaataaagtttagatgtacaacttgaatctttaaacctttgacgtatctaagatgcaaacaaccaacttttctaccgaaagttataagataatgaggccaacattttatttatagtaattgaggtcgcaagcatgggattggcccgcttgtgctcatgaacggctatgcacctaatcacctacaaaatatcaaaacaggaaaatctatgtaaagtgatcatggagatcataaacttcctagatgcttactatgacattcagaaacccacttgaaatgctaggaaatgtattagtagacatcaagaaaatcagaattctatatttaatagtcatgtatggacacatactctattgtgaaaaccaaagatttattagtgaaagttagcatccaaataatcctgatttgcttaactttcttaaaaatccttaacagtcttcaaaatctactttacccaataggcatccaactaatctgaattatagtagatttatcttatagtcagtgtcgtgagtcgtgaccagagttatagaagcttaatgcagtcttaaaaattgtactcttttcaaaaaactattttcgtatttataaagttatcatcttggctatttgtgatggaccgaagggatacgattattgggttttcatattttggtgtttcggtcttttcctttttagtattggttttgagagttttctttttaattatgtttaagtcggtttgtatgaggatctatataagatcctcttataatcaataagaaatcaaacctccaacaattaacctaattctctaagagagacttggattaaaaggaaggttttgcttcaatatctatcttgttctacttcaaatcacggctccaattactagatctaagtcaaaggctttagctcataacacaatgctatttgatctcagcattcttatttctctaatttctaaaagaccaaaataacgcaaacggcacgcagtttagctctcaatacccgagacaacacttctcgtagtccgtacttaaacccgccacgtagttcactttattcaacttaaaaaagcatgacgttttggtacatctatcttcttcttcccccttcctctctcagcttctctcccaccactaaggaggaacgttccaaagatccctttctcagagaattcccagaaaaatcttcaacaattgaaaccctaatggagaatcattcggatccttgaatcctttggtttgtctctcacctccatttctgaaatttcattgctttgtgattcttctgcagattcgttttgaagagaagaaagaaatg

SEQ ID NO: 22802 - DNA, 3000 bp, Unknown
  misc_feature (1)..( 3000): 2750-1469P.txt file - cDNA_ID_2122935; gDNA_ID_1620740; Annot_ID_166400
gaactccgtctctatatcttatacctttggtagacgacattcactttgtttcactaggaaagtaaatgcttagttttacctcataggatggggtggcctgggaaccataaggcaatgtcattattattcaatcaaatccaaatagtaggaatatgattccaaagagcgttctattgggaacttaacttccacatgtgcttgcaacatggtacttgatgtatcatgaatctccatgaaagtaactgtcttaaatgcatttatgtgatatcttgtgtaatgcatatttttcttatatgtgatacttctagctgtccagtgtagtttgccgtccatagtgatcattttcttgcttttgttgccgcaacttatgctgacattttgtttttgtgtatatctaacagggaagagactagttctcttagaaaacaattggacactcagacaaaggagcttaaccagagaatgcgccaaatagaagaacttaaagaaaaggagaggatagcaaacgaaaacgtgagtgaatttttgctttgccaatgtgtgaaagctgattttctcgtgcatcatttgtctttatatgacaaagtatgtaacactctgttgcaagtgtttgtttaaagtttggttccttgggatggtaggttgaagggcttatgactgacattgctgctgctgaagaagaaataacaagatggaaagtagcagccgagcaggaggctgctgctggtggagctgttgaacaagacttcacgtcacaggtgcgttataagtccttgggttagtctagtgcaggaggccaggagcattgtaattaccctaggtggtttgtaatggcttatagctatgttgacaagctcagcaactagtgttgagtcagttagctaaagctaacaagctaagagacttttaggagaatgagttaggagtattaggttctgggattgggaattgcactgagggtagttctatatgatggttttttgttctccggtactggatcctatcaatgcgctctgttctgtttttatgtacacatttcctgggaactaaggaatgatagtcttaactcttattggctttgtttgttcagctgtatgtgctaaaagaagaacttgaagaggcaaagcaagcaataatagaatcagaaaagaaactaaagtttaaggaagagacggcagcagcagcaatgggtgcaagggatgcagcagagagatctctgagactcgcagacaatagggcgactaagttgagggaaagaatccaagaactaaaccgtaaagttgaagaattagaaacccatcgagatatgaatacttcaaacagagctagatatgcgtgttggccatggcaacttctcgggattgattttgtgggaagtcgaagaattgagtcgggacaagaaagtgcgaacgagatggaactcgctgaacctctactatgagaaaaaccggtactgtataccaaaaccatactctctgtatttgtttttgatttttatgtatataccacctgaaaaatgtttttaaaagctttaacacgttctcatgttgtaatgtttgagttaaagaagtttaatttggaggcttggcgaaaagtaagatgtttcccacacccaaacagtgatcaataaaatataaaacttcccattcttttttgctcgaaatctttagagtgcaacggctcactcaaatgatgaatctcttaaagttatacatgactaaagtatatcacaaatgatcctgattctagactggtcttgccatgacctgcttcagaatttattttagtatatactaaaatatatacttagcgaataacacctattttgaagatgaacccccaaaggttaaaaacctaaatagttatccaatctaaaatcatatatttatgtatctcagtttcttagctaaggttgacttcgttacttcttcagaagttattgttgttcaacttaaaacatacatattcaatttttgaaaatagagcactatatatagtataactatttttttatttaaaaagtttaagacagctaatattataggtttttatgcattaatagatatcagttaatatttactttttctctacactttttttctttcgaaatgaccaagtctagcatgggagagaatctatgttacagactggtagataagtttctagatacatttttaaaaaacatggtagtaaatataagcagaaaatactgatttcgattcaaaaagtaaatgtgatatatatagtttccaaaaatacggtgatatttatatttatagccattgactattgaacccttcaaccatgtaaatcaaaccctcgaggttataatgagtaaaaaaaattcttaatatttatcttcttggttggtgaggaggagtcataatgagtaaaaatttttgtccatatgagtaattaagtacccaaaaagccaattaattgaaaaaatctataaatgtataggaaaaaaatatgagcaacatccccgttttggtttcgattttccatgtgtgctaaatcactagtcatatcatagaaaaatcttataaaaatttctcaaaacaaaatcattttttattgaaaaaattgagcttacgaaacagctttcagttccacacgtctgctcttgaatactggagatcgccggaggaataaggatctccaaaaaacttatcactaatttgatcgaaaagcgtttctcgtctcaaatttttgtggtgttctacttgtaatgtcatttttacaaatccaagttttcttttcatcaccttcgtgttttgtcgtctagaaaatttatggttaatcacacgttgaatgtagcattgttgttaatctaggtgacaaagcaaattgagtcttttaatcagatcattcgtgctttgttttgatcgtatagctcaagaaattaattacagtttgttttatcgataaacaggagtgagatggtgttgatgacaattggagcttataatcaaaagttgtaataaaaacctaactatg

SEQ ID NO: 22803 - DNA, 3003 bp, Unknown; identical to SEQ ID NO: 21347
  misc_feature (1)..( 3003): 2750-1469P.txt file - cDNA_ID_2123031; gDNA_ID_1621093; Annot_ID_170779

SEQ ID NO: 22804 - DNA, 3003 bp, Unknown; identical to SEQ ID NO: 21347
  misc_feature (1)..( 3003): 2750-1469P.txt file - cDNA_ID_2123031; gDNA_ID_2926160; Annot_ID_198690

SEQ ID NO: 22805 - DNA, 3000 bp, Unknown; identical to SEQ ID NO: 6437
  misc_feature (1)..( 3000): 2750-1469P.txt file - cDNA_ID_2123035; gDNA_ID_1621093; Annot_ID_170780

SEQ ID NO: 22806 - DNA, 3000 bp, Unknown; identical to SEQ ID NO: 6437
  misc_feature (1)..( 3000): 2750-1469P.txt file - cDNA_ID_2123035; gDNA_ID_2926160; Annot_ID_198691

SEQ ID NO: 22807 - DNA, 3000 bp, Unknown; identical to SEQ ID NO: 6438
  misc_feature (1)..( 3000): 2750-1469P.txt file - cDNA_ID_2123046; gDNA_ID_1621093; Annot_ID_170785

SEQ ID NO: 22808 - DNA, 3000 bp, Unknown; identical to SEQ ID NO: 6438
  misc_feature (1)..( 3000): 2750-1469P.txt file - cDNA_ID_2123046; gDNA_ID_2926160; Annot_ID_198696

SEQ ID NO: 22809 - DNA, 3003 bp, Unknown; identical to SEQ ID NO: 17869
  misc_feature (1)..( 3003): 2750-1469P.txt file - cDNA_ID_2123057; gDNA_ID_1621093; Annot_ID_170788

SEQ ID NO: 22810 - DNA, 3003 bp, Unknown; identical to SEQ ID NO: 17869
  misc_feature (1)..( 3003): 2750-1469P.txt file - cDNA_ID_2123057; gDNA_ID_2926160; Annot_ID_198698

SEQ ID NO: 22811 - DNA, 3003 bp, Unknown; identical to SEQ ID NO: 17867
  misc_feature (1)..( 3003): 2750-1469P.txt file - cDNA_ID_2123063; gDNA_ID_2926160; Annot_ID_198701

SEQ ID NO: 22812 - DNA, 3000 bp, Unknown
  misc_feature (1)..( 3000): 2750-1469P.txt file - cDNA_ID_2123078; gDNA_ID_1621093; Annot_ID_170795
aaaagacggtttccgtcttggtttgatgagataaaccctacaagtagagttccttgttgaacaaccaagatctcggtggcacgtgggtgggtgtgaggtgggttctgaccgttgggtgcatagtctatacgaacaagtgagataccaagagtgtttagtcctccaaggttgttaacattgacggttgtcacgttggacccaaccgcgttatttgtatttccaggtctgttgaggctcgagaaaaagaaatcatccgcgaaaactatccttggatccttgcaaaactttccattcacaaacactagacaaggttttgataaaaatagagtattagtaatgcataaatcaacatacaaatatatttaataaattaaaaaatgatcatgtgcttaccgccatctgctggtgtgttgacaccaacacaaaagtcttgaagggggcttggatcggaagcaattactaatggaagtgtcaaagcaaagagagatagagccgcaagaaaagagagactttttatcgtcatatgtatgtatggagacgatttgtagaagacaaaaaggtttttgttagtttcttatttgtggtgtcaatgaagatgtgataaatttatgagacaaagagttcaatttatagatgattttcggtttgaacaagtccatatgtatgtatattccaatgtaattttcattgtctataagtttgaaacggtaaaatgctgttgaaaccgtgttccctcaggtcatattatattgagaattatttaaattattgtattgttaccattgttaagtgtagctttcattatctcgaagtttgaaatggtaaacctttaactaaaccgtgttgcatcaagtcgtattatgtaaggagttatttaaaacattatcttgttaccatgtttacgttagtagtatcttaattaaacacacaaaagatcttcaactgaaaaaggaggcacttgaaatttaaaatgttaagtgtcggcattgatagagttatataagttacttatactgcaagagggtttattcaataatatgattgtttctcaggttttcatgaactatacctgatgattttgagaatatttgattattttatttgcatgagttttagagttgacattgagagtctttgacaaatgtcaaatgtgaatttttggtggttttgggttgcttgattcgttaagcgataaaacatgaccatatcaatatatagatgttaatagactgatcattgaaagagagaggctgttactacttacttgtcacggaagaatatcctagttttgtagagagattaggaaacgcatataagaagatactgtgaaatttaaacgcatatatatatatatatatatatatatatatagttgtatagttatatagcgtaaagtagataatgtgaagtttcattgaaagattttggttttatattaagattacaaacaaaacattatatctttgttttgacagcttaaagaactcaacatcatgtctgatcatgtccctataagatgtgcaaaaacgactatcggattcatatcaaaacaaaatttggattatttcccctcaccactgactatctcatgtacacggacatacagtttgtatattatagctagctcatgtgtttatatttcaccaaagttttttagtttcgacattgtagctcttataactcacttaagttctacaaatatatgtttcgagtactaatgagttttctaatcaatttgtttttgttaattatttcattgaccgattgaaataagacaagtaaccaaagaggccacgacaaagatttcaagatacaaattacaaatacttcccaaatcccaaccaaatccgtaatactggggatccacacaaaacaaaaaaaaaaaacaatacaaatatatgaacggagaaatgtgggcttttatttccatcattatactgccaattgggcttttacattaataactttggccgacaaaaaaaaaaaaaacgaaacaatccaattcccgaatttaccaagacgcgaaactaagtggactgtgcaatctcttttatacatttttaatcgatcgtctaacaacatataaaaagcaaattcaattgcaattcaacaacgaaggagtaaaaagatcaacttccctcctgctacgtggtccactcttattagcacaaacatcactaattttcctgcgaaaaatagctgtgtctatatatttaaacctttttaattacatcaattcaataaaaacagaagaataaataaataattccgaaaatcccgatgatgactgaaagagatatgcccgatcttccacgccacagtagtggagctgtggagaaagaagacaaaactgtaataatgttcattattacaattttcactgacagtttttttccataaaaagaagctaccacaattactactagcagtaaaaataaaagaaatctgaaatataataataacaaccaaaaagtgaaaaaatcaaaccacaccgtcccactaagaggattaaacggtaatttgctctatcacgtaatataaatgacgtggcatcatcgtgtctagtcagcttcttctttaataacctcttcagcttcagctatcacactgcacctataaaatcaaccaatctcgttttaaccccaaaccagaagaagaaacaaaaatcgaaattctcatcaatagcaaaaaaaaaattactcttagattttcctcaaaaaccttaatcaatcgccgggaaaatgaatattccggtgactatttcctccattactgtttctaataacgctgtttccgacaatcgtcgtcatgtttcccgtgaaaatcgtcagcgttaagaaaaccgtcacttatatttttttttcttttcttcttcgtttttgtgaagatgatgatccactgatttgagagtagtagcttgagaggtttttagtagatttcgattttgcgattatttttgtttcctggagagatctcatttttttgccacttccgatgatg

SEQ ID NO: 22813 - DNA, 3000 bp, Unknown; identical to SEQ ID NO: 22812
  misc_feature (1)..( 3000): 2750-1469P.txt file - cDNA_ID_2123078; gDNA_ID_2926160; Annot_ID_198704

SEQ ID NO: 22814 - DNA, 3003 bp, Unknown; identical to SEQ ID NO: 17861
  misc_feature (1)..( 3003): 2750-1469P.txt file - cDNA_ID_2123100; gDNA_ID_1621093; Annot_ID_170806

SEQ ID NO: 22815 - DNA, 3003 bp, Unknown; identical to SEQ ID NO: 18089
  misc_feature (1)..( 3003): 2750-1469P.txt file - cDNA_ID_2123126; gDNA_ID_1621100; Annot_ID_171328

SEQ ID NO: 22816 - DNA, 3003 bp, Unknown; identical to SEQ ID NO: 18089
  misc_feature (1)..( 3003): 2750-1469P.txt file - cDNA_ID_2123126; gDNA_ID_2926167; Annot_ID_199233

SEQ ID NO: 22817 - DNA, 3000 bp, Unknown
  misc_feature (1)..( 3000): 2750-1469P.txt file - cDNA_ID_2123142; gDNA_ID_1621100; Annot_ID_171336
accgaagttgcttgctttattatgctctagctcctttttaggaccaaaaaagggtactgacaaagtgaacgaacacagtactcctgtccacccagaaatattataaaaattaatacaatgggctctccctttgcaatattcttcttagaaatttcaatattgtacatcagatttaagaacttctcatagatagagactagagaggagtgggcaactaatattcaagttttcctttgagggaacatatttacaaacatctgagatacaaatctgttttgtaaaaactgtttcatgtttgtaagaattttgtgtttgtacataaataaagaagatgccatctctacaaagggaaagacaattccatgcttttacatctcattctcttctttctttactcttttacttcttttgaaaacacaagaaagataaaaaaaaaaggaaaggttaataaagtatttgtttcactatttataattttatatagtctgtctcttctctggtaccaaaacacaaatcttttccatgcaagtcacagtttttgtatccattatctcatcaccttgtttcaatattctaactaaaaaaacaaataagttcaaagggacaaaagacatgtgtcagttagtcagaggatattgggaggtccacgaacgtccttaatctttggatttttccgacttacgagatattatgtgacgcaaacgcgtttctcctctttttttacgattatgccatcccaccaccgtacaaatcccctacgcgcctccacgcgtcgcttcctcactcccgtcttttccacacacgcgctagtcggaatatcttattggattaactctatgaattttcatatgaacaatatttataacatttttttatttggtattaacattatataaacatgatatttgggaaaagtctttcgtttgaaaaattcgtacgtgacaactaattttgtttttttttggatggtgaaagaattatcttggatttgaggcacacacttttgtttatggaatctaaaactagataggtgcacactatccatattgccatcattgttgtagatttgatctttgtgcaacttttacttgtgtatacatcttaatttccgcattcaaagattttcaaaaccactgcgatcagtttcatccaatcttatatcaacaaacatgcattggaaattttttacattaacaataagtcaaaccattttgaaacataaacctataaaacttgacaatatgggaaaaataaaggacaaaatattctaaaaattgaccaaattatagtcttaaacattaatttcaacgggactatttcgaaaccgtttttaaaagccgaagtcttattaaatacaaacgaaaaaattaactttgacattgggtatattataatgcttgtcgataaaataaagtgttttttacttaaatgttacatttattttagtatgctccataagtttgatatatcatgttatccttgttaattataaatgttaagcttgaatttgttgatgattccttcctaatttttttttttatgatgtaactgactaacaagtttttttttgtttcttaactaaccagggggttgatttaatttatgaagttaacataaaaaaaaaattacatgaccatggaagccacagtcaaaatattctattatggaagtaaattttttaaaaatgtattttctttagtaaataaaaaaaacgaaagcgacaagagtagaaaacacattacaagagtatattagtctaccctaagttaataagttttatgtccacacgctatttcggcaaaacttcacattatgattactctacttaagcatttcattaatggtaagcaattagacgttaacagagtaattaataaataaacagtggtagtgcagctactgccgtccaaaagtcaatggtcagagtggcattcaagtaaataatccacataaatgggggcattttattagctccaagagagtcatgacaatttgcacttttattatatctcaatctccttcttcttcctcaagctgattcttgagtatgcaaggaaaacttctcttttgtccccttgtcaacaaaaatctcccattcaacaaaatttcttcagcttctctccttcaaaaggttagctttcatggtgatctctgtagtcactttctcctttttattttcttgtcaaaacgattcaatttcatttgtttctaaattgaacaattgcttcttccttagctctgctctcatctggttttaagcttttggtcctaggggttaggaatctgagcttatatgtgccttttttgattgtttgtttttgaaaggatatgacttgtttgatttggttttggcgcaaaaagcgattattccctgtaacccaacatcgatttgtctacctgtccctttgtttgccttgtgttgattcaaaagtactaaactttatcctgatgattgtgtaaaaatcttgacttggagcctaggttttaaagctttgaaatcccttagtttaacctgattctggtaaaaaaccctgctttagggtatgactccaaccttcgaatagatgtaatttcttctgtagagagagatatatagagagtgtaaagcttccattttttggggttccttttatctggcaatagaaatctgaaggcagtagcaaaaaccgatatatgatttctgaaagatgtcagatctgttttctgataaccctatgatgacttgagtgattgattgtgagagcagactttgtcgcatatgtttgagtttgtttagagaaaaattcacaactagaccttttttttcttcttctatcacaaatcacagtgtctgtatttagttgctttactctgttgtagctcacttgttgtttttggatgttttcatggaggcaggtttttattctccttggtttgaacaagttacactgtagagagtgatttggctaaaagaagattgattcaggagctgtgtagtgtattgctggggtttttccaatg

SEQ ID NO: 22818 - DNA, 3000 bp, Unknown; identical to SEQ ID NO: 22817
  misc_feature (1)..( 3000): 2750-1469P.txt file - cDNA_ID_2123142; gDNA_ID_2926168; Annot_ID_199258

SEQ ID NO: 22819 - DNA, 3003 bp, Unknown
  misc_feature (1)..( 3003): 2750-1469P.txt file - cDNA_ID_2123162; gDNA_ID_1621100; Annot_ID_171344
ctttgtcggttgatctaactattaacacttgatgccaagtctaaagagtttattagtttttaaaacccagtttaccaataataagtttcctttgtcggttgatgcactagtcaaactatcaaagtcgtcaagtttgctttgttgacaaggcaaagctactcttccaaaacattgatccattcttctggaaatttgcaataacgtctcaagaccaatgcaagtaataatttaaccatgccatgttatcaacaaaagctgcttctctgatttctagagtattattttttaaccattattgaagtttgaagatttcttattattgctaaatggtaaaaccatcttgaggggaacaatttgataaaactgtgtgctgcttcctgtctccgaccaaaacatgtttaaaattagattcggaccaaacaagttgtcaatttttagtacaaatcaaaggttcaaatgtcaataaataatcattacattttaaaatttcgaaataaaaggacaaacatgtaaaaaccaaaaaagtgaagcactgatatttgtcatttctgcctataaaatgtacacttcccactcacacggtcacagaaaccaaattcgaagaagaaacagagaatcatcaaatcaaatccctaaaaattgatttttgaaatggagaagaacgcatcgacttcgtcgttgaaggacttgggtccgagtggtctagatctaaccagcgcctttttcaaaccgatccacaactccgatccttctctcccttcaaaccgacgtaccaaagtctccgtcgtcggagtcggaaacgtcggaatggccatagctcaaaccatcctcactcaagatctcgcagacgagatcgctctcgttgacgccaaacccgataagcttcgtggcgaaatgcttgatctccaacacgccgctgctttcctccctcgaactaagatcaccgcttctgttgattacgaagtcaccgctggatctgatctttgtatcgtcactgctggtgctagacagaatccaggcgagtctagactcaatttgcttcagaggaacgtcgctctcttccgtcatatcattcctccactcgctaaagcttctcctgattctatattgatcattgtttctaatcccgttgatgttttgacttacgttgcttggaaactctctggctttccggtgaatcgggtgcttggatctggtactaatctcgattcttctcggttccgattcttaatcgcagatcatctcgacgttaatgctcaggatgtacaggtcagttccaaccaaaattagggatttttgttataaagctgtgatttgttttggttaaacattgcgattaaggagtcattagctggatttaatggtttagtatgataaaaatctatgctttagtggttttatactgtattgttgagaagatcaattgaagagcaaaagtgtgtttggattggttgttgtaggcatttattgtgggagagcatggagacagctcagtggcattgtggtcaagcattagtgttggaggcattcctgtcttaagctttttggagaagaaccagatagcttacgagaaacaaactcttgaggatatccaccaagctgttgttggtagcgcctatgaagtgattggactcaagggttacacttcttgggccattggctactcagttgctaatctggctcgtactatcctccgtgaccagcgcaagatccacccggttactgttcttgctcgtggattttatggtgttgatggtggtgatgttttcctcagtcttccggctttgcttggaaggaatggtgtggttgctgtgaccaatgtgcatatgactgatgaagaggctgagaagctgcagaaatcggcaaagactatattggagatgcagagccaattgggactttgaatatccacatctatatatgcatcaatttcaattttataactagtatcccacgggtgatagtgtcgatgttgatcactatatgttatgtaaatgcttgttcatgcagagtaatcccaactttgagttctattttgaaatagggtatttgcttacaacacacttgagttaccacttaccagtaatgtgaaaatgcgtggttttggcatgaaattattgtgcatattgcaaggcaatcgacacaaacattagtatatcaaaaaatatgatgtgtagaaaaaaagaaaagaaataaatttcttttaaaaaatggaaatagattttgtaagttcttaacaatcttttttttttggttcaccaagttcctaacaatttaacttcatgattccgatatttttggcgcgaaaatacctttttcgtgttattgcgtttattgcaagacaatcaacacaaatattaatatatcaaaaacatgatgatagaaaaaaaattggaaagaggttttaaagttcctaacaatctaacatcatgaatactcacgacgattttggcacgaaaatactattttctcgtgttattgcgtcttttacaaggaaatccgcataaacactaatacgtcgagaaatagaaataaatagattttatttatataaaaaatccctaaaatcatcaaattccagattattgtaattagattatctctcttataattgttacttaacagcttgatgtggctgtgagcctgtgacatttactttggagtctatgagagcattgaacccaaccaactaaaacaaaaaatatgagatggcaggcaagaccaagactcatatagtaaaaatgttttgacaatcaaaaaccaaataagcaaagagatctctgactctctatctgaaatctcaaaacggagaacgcgagggaacaagagattaaagcatagtgagaccctaagagagagagctttaggtctagaggggatcttcacaattcacacaacaactacgagataggatcgtgcgcgtcaaaagaagctggtactgctgattccagccgaagattagtctccgcttctggttgttccggtggagactcgtcggaaatg

SEQ ID NO: 22820 - DNA, 3003 bp, Unknown; identical to SEQ ID NO: 22819
  misc_feature (1)..( 3003): 2750-1469P.txt file - cDNA_ID_2123162; gDNA_ID_2926168; Annot_ID_139980

SEQ ID NO: 22821 - DNA, 3003 bp, Unknown; identical to SEQ ID NO: 22819
  misc_feature (1)..( 3003): 2750-1469P.txt file - cDNA_ID_2123162; gDNA_ID_2926168; Annot_ID_199264

SEQ ID NO: 22822 - DNA, 3000 bp, Unknown
  misc_feature (1)..( 3000): 2750-1469P.txt file - cDNA_ID_2123166; gDNA_ID_1621100; Annot_ID_171345
ctccattaagttgcccagagacggttaagaatgctggtttcccaaaaaagtcctgaggagtgatacatccatgaaattcgttacagctgcaaggttatattctaccattcttaagctacaaaatatatggagctggaacacacctgagaccaatcgatcaaccctccctttgttttcggaatcgcatcaatggaagtatcggtgttctcatgggagctaggaatctaaaaattgaaagtatagtttaagtgtaatgttattctttcttccatgtggagttgagaacttttaatgggttattacagaatgttgagatgtagagagctaaggtccttacaagtgtagtgacacagaactgttctcctgctccttcacaatccgaagctgtgataattgggcttgccacccagacaaatccactttcttgaaagaacttgtgtgtagcatatgccagagtattcctaactcttgccacctaaacaagatattttgcatatttaagaaatatagaacttggtgattatcacaaggcagtaagttcaccgtcaagtttcactaaagtgaagcctgaaaggtgagcagtagaagcagtgttcacataaaatagacaaacaacagtttctaacaagagacacgtttctgcgtgagataatacataatatcaccaagaagctaacaagagtcgtatacagtatggaatttcaggaaggtataaaaggaaagttaccgccccaaaagtgttggttctaggacgtaaatgagccttggttctcaagaattcccggctgacccttttcttctggatcggataggaagagtcacactctccaacctatgataaaacgagactaataagtgacaaaaattcaaagaaacatactttcaaacttaaggaactaaagttcagcatccaaagtagaagaagaaaagacataccacaatgattttctccaccttaagttccactttttgcttcgttccctggctagctacaatagtaccttgtacagatactgatgctccagtcaagatcgaaccagattctacctattatccacccaaatggaatgtggcaaacaaaacatgtctaaggattatcataaggtttacaagaattcaaagctcctaagttctaattattgttctcaagtcacagaaattacctgatcatacccttctgcatccgaagtcatcacacattgcaaattcgataagcatgaaccatcatttatcttccaacaacaacaacaaaataaaaaccaaaactttgtcagcaaatcaatcaagagattgataaaaagatgaagaaaggttgagaatttacctcaatgaatgtgacactgctctgagatcgaagtgtacgaacccaacccataatgttaaggctctgcccgacccgactcagtccttcgtccgctcctcctttcacttcagctatcctcaactttttcctgaattctccaactttactcccaaatcgtttctcgtaactctcaactttatttccatcaccggagccgagagattccgaaacagctgtgcaaaagcatctccggcgagaattggccggaaaagcatcgaagggagggagaacacggcggcgtagaggacggaagagagaataagaagggttagaaatggtgaagaatgataagaagcggagagtagagttttgagttagacggagagatgtcgccggcagaaacgtggccgccattgtaatcgaatcgttcactgttttaggattgcgcgagtcttcttcttcatattggaacatccacccgacccaagttggttaacccgaccaagattggtattaacccgccctgtaaacttttagctaaataagcccatttagagtctagaggcccatcacctacaaatgttttcaactatgaatcggcctattgaaaagaaaaatcttttgccattagaaagatagaaattcagggtagcagcaacattattgttacatttaaaagttaagtcaccaccaagcagtgtgtcttttagtaattgtcttgtgtcaaactggagcataagtgtatggatacaaaaattagtattattgcaatatgattgttgggtcacatgatctggaaaagtaaaagcagctcattatagggtactatgtattgttaagaggctttgggttttagcactcatatgcgttgacgaatgtcaacaatctttagttgacacgtggaaagtaatagagacccacatccacatggaagcagttgagatattgacccaaaaaggtacacaactaaaactctaaaaacacaaccccaaccacttggcatcggatctctcacagaccggtgcggttgctcacctgcattcacttctcattgtcctttcgttttgttattgtacacatctatctaatctatctattgttccacatgttaatgtaagtaaaagacaacacaataaaaccaaacaaattaagctctaaatatcaattatttacttacttttaggttgaagatgctacccaatagtagttgtgatatactactcataatgagagagaatttggtatatacaaaggcaggcgagacaggtgtgaccggttgttgttgatcttaattaggttaccattataattaacccgattaattatatatcctctgtaaacaagtttggttctcattttttttacctgaataactgtgattaagtcaacgagcattattgttgcatttccttgtgtaataatgagccacattattgttgcatcacacacttatgctaataaagaaaacaggttctacacactagaacaaaaaaaataacagcaaaaagatattagcaaggtaagcataatttgatcatataacaaaagagaaacgttatgatctctattagacagcttaaccaacaaagctaaccccactttcctcttcatatttaatctctctttctctcctttcttcaacaaatatctcctgctcttacatctgagtctttttctttctaaccttctgattcatg

SEQ ID NO: 22823 - DNA, 3000 bp, Unknown; identical to SEQ ID NO: 22822
  misc_feature (1)..( 3000): 2750-1469P.txt file - cDNA_ID_2123166; gDNA_ID_2926168; Annot_ID_199265

SEQ ID NO: 22824 - DNA, 3003 bp, Unknown
  misc_feature (1)..( 3003): 2750-1469P.txt file - cDNA_ID_2123184; gDNA_ID_1621100; Annot_ID_55848
gtcgctgataacattttcatcattggaagtctctggaagtaaagtgctctgattattcaactcaccgctacaagtaataatagtctgtacattcccatcgctacaatcatcttccatccttgattctacattggctttctcttctgtttggtcaagaagattatccgtcgtctcagttcctattttaccaagatcagtagtatctatagcctctaccgtcgcggtattagaagtcaagatggaattcttttcctccacagatgcctcttctacagccgttggtgagtcatctttaaccagaacctgctcctgtccatcatctgtctttaccacagaggactctcctggagtatcatccacagaggggttgggttgtaagttcaccgtttcctctttggaaagacttctttcatgggatgtctgaccaggctctactgtttccattgtgcagcctagttcatgagaagtgtcagatttcttgatagtatcctctcttacaataacttcgtcctgtccaactgaattcaaaagcattgcaacagattccgacgaagtagcctcagaccaaacattattgtgcctagaaatggcacaggactccgttgcacctgaactaaacactataccactacttccacgagagaaatcctcaatccagttattatcttcgttaccctcaataccaagaaaagcttcagattcacctaaactatcaaacctcagatgcgtgttgagtgtatcatcaaaatcaaactttggaagagcataaggctgtaaaactggtggaaatttgttgttggcttcaccagctaaatggagattctggttttgaaagtcactgtcatcataatccatgagtttattcctgaaatcagagacatatataaacatcaaacaaccaaaagaaacaaaagcataacacaacaaccgtgaaacatatttaaagaagcgactctggtcattttcttgtcgagtggagtaaaacagtaggaaagcgaaaagtaccgacacaagagtgtatggagacgctacctccctccattcggtgacaagaaaacctggccgtcagacctcaactgttacctaatcgcacgttcatctactactgctccaccaacaacaaaaccatacgcgtcaattataaaatctcttccttctcaaaattcaagggcacacgaaaacctaaaagagtgaactttcttaaaatgataaattgaaacgctagcgaagaagttaaactcaccggaaaattcaaactgacggaggtgacctagggttccggcgaagaaacgaggtttggcgagtgaagcagattgggagagaaatgcccgataaattatattcgctttcctcggcaaatgaaatgagtctggtttaagtaaagcccaaaattaaataaatatttggagagaaaataaagatggatactgatgccgcttaatccatagtgacacgtgtcgaattttctggatcgtgtggctaatattgaacttaaacaaaaagacgcgaaaggttttttacttttaaattaacgtacgttaaaatttagtgtaatttactggctagagttccgttaaaagaaaattaaatgaccaagaggtaaaagaaaacaacttttgtttgacgtgactgtggtaaaagttagaagatttattgttgaaatgactattgactactgattagtgtaatgaagatgattggttggctaaacaaaatggaaagtgtcttaaggataaaattagagaagagacatgtcactcactaactaatagatagaggcttttgtgtgttaggcaattgacggattggacttttggaccatcagatcaaaaggaatccattgggatatttatatgggcttaggcccactttataatttttttctgttaggtttttttggtattttggtttatgaatgatagtatttgtaccatagatggtttggtacggtttcgtattggtattggttcgacttcaagttttaatcaaatgtttatttaacttgaaaacaaaattggatttaaaatcaggtttttctttctgtttgtttagtttggattcgaattcaatattttgaataggaaaaatgaattcataattttaaaaaaaatatagttcattttcagatcgattatttgagtttggacgtttggttcataatatcagtttactgggatggaataattttcaacttttaagcggtagtgggtggaaaaacatttgtcagggatcggtttaatctaggattgagcattccacttcgttgttctatactgcaaattaaattcatgataataaaaaactatccataaaccatatactaaaaatattacttttaaaattcatggggcggagaaagtattataaacaaccatcctctctgcaaatttttatttaatgtcaccactactttggatcacttttctaagatcttaagttttctgtttgttgcaattttattacatgtatatgccaatatctcttacacaccaactccaaacaaagcagcggtggtacatgaattaactcctaatccctattaatattttaggcgtttagcacctcccaaactaaaaaatacaaattgtaaccaaaaaaaatatatatagatataaaagaatacgaccatctatcataattggtgtgagacaacattagtttaaatgcaggatattaacatgacaacagaacactcttatcttcacatattatgaaataccttatccatcattttcatagcattataccaattggttgtctttaatcatcttcgatgtcactaaccctcaaaattcaaaagaaaatgaatagtctaaataattggcggtttgggcggcatccaattgtgacaggccacgtagagtgggaccaacaacttcattacctcgtttggctctttgctatatataaagtcaagcattagtatgcccaaaaccacacaaatagaaataacttgtaatcaaccaaagtcgaaaaacagagttattttgtcggatcaaaatg

SEQ ID NO: 22825 - DNA, 3003 bp, Unknown; identical to SEQ ID NO: 22824
  misc_feature (1)..( 3003): 2750-1469P.txt file - cDNA_ID_2123184; gDNA_ID_1621100; Annot_ID_171348

SEQ ID NO: 22826 - DNA, 3003 bp, Unknown; identical to SEQ ID NO: 22824
  misc_feature (1)..( 3003): 2750-1469P.txt file - cDNA_ID_2123184; gDNA_ID_2926168; Annot_ID_139987

SEQ ID NO: 22827 - DNA, 3003 bp, Unknown; identical to SEQ ID NO: 22824
  misc_feature (1)..( 3003): 2750-1469P.txt file - cDNA_ID_2123184; gDNA_ID_2926168; Annot_ID_199268

SEQ ID NO: 22828 - DNA, 3003 bp, Unknown
  misc_feature (1)..( 3003): 2750-1469P.txt file - cDNA_ID_2123194; gDNA_ID_1621100; Annot_ID_55855
gagtcttttggattcggttacgatagttctctattcctcttcaaaccctagagttcgtgtttctgcgatatccatcggtttctccttcatatatccatcaaacgccaaagattctctaattctctctcgagatcgtctgcaatttcaccgtgaatcatcagggataccgcggtggtttcgattctatttcctcgattcgaagcttggagagtttcagcttctgaattgaagccagtgattcaattgtttggagatatctgagcattgtccctgcgatgtattcgattcaatccaacacgggcgttctcgtttcgtttctgagctttgtgggaaattctcgttgatttgatttcgtcttgaagagcgcgtgagaggtttcttctgtcgaattttgttgaagtccaaccagagaagtaaagaatcatattttgtaattactttttgtttttgttttggaaatcaactttctggcctccatttttttggcctgggttaaggtttttttcaaagagagtagattctggtgtgttttaataaattagtaatacagattgtatttttattcattatcagattaattccaatggcaatatattacaagtttaagagtgcgagggattatgataccatctccatggatggtccttttataacagttggtttactcaaagaaaaaatttacgaaactaagcatttgggaagtggtaaagaccttgacattgtcatctctaatgcccaaactaatgaaggtttgtcttcctccttcttatcctattcacctagaagatattgtgcaatgtgttttgttgttatctaggttggattctggtctgattgtgatcagtattcacttatcaaaatatatggttattacttgctttgtcaaaatttccatggtttatggctttcttccgaagtaatcacatttagcactgttaatctggccatggattgttcagtatctaactgcttcagtaaaatggatgttatgtacctggtacttccttgttagttgaataaaaaaaataaaagtgaagttcttgcgtactgtattagcttatatgttaaatgtgattacttctgagactactgttcttgattggttgtggttgtgaatcattagaaagaaacccttaactacgattctctgttggtatagttgcaatatgtggtggccttcatacttatttttttttttgcaatttcagaatatctggatgaagcaatgttaataccaaaaaatacttctgtgctaattcgccgggtccctggacgccctcgcatcagaattattaccagagaagagtaatttctctataactttaatacctaatttctcaactgagttgttcaatctttgtgttctttcgctctaagctgcgcatttcattattagttgtgtgaaattataccagattcccatgtgtcatgatgtaaatgactacattttgcaggccgagagtcgaggataaagtggaaaacgttcaagctgatatgaacaatgttattactgctgatgcatctcccgtgagttggctttctcagtttttattggcatggaatccttctacacaaatattgatttacaacttaatctaccttataggttgaagatgaattcgatgagtttgggaatgatttgtattcaattcctgatgccccagcagtccattctaataacctatgtcatgattctgcaccagctgatgatgaagaaaccaagctaaaggcattaattgacactccagcactagactggcatcagtaagtaatcttcttgaactgatggacattagcatgctaaatgagatcttgacatacattttgcataacattcgtatttttctttcatgttacagacaaggtgcagatagttttggcccgggtagaggttatgggaggggtatggctggaaggatgggtggccgcggttttggtaattatattcctgtatatgattgacttatatgcttcagtctccccaagtatttagctttgagactcggatgttctgttaattattattgtccaaatattttgtttgctctttcattgaaatgtaagatatagagactgattgtatttgtttgagtaggaatggagaggacaacaccgccaccaggctatgtttgccatcggtgcaatgtttctggtatgactgacttagagaatctttatatatttttaatttggttaagtaatgtctcgagtgtgtacggttattaccgagaaatgaatgttctgaacatcattttctgtctcaggacattttattcaacactgctccacaaacggtaatcctaactttgatgttaagagagttaaaccacctactggtatccccaagtcgatgctgatggcaaccccaaatggctcttactccttgccaagtggcgcagtagcagttttaaaaccaaacgagtacgttgtcactaaattaacatggcgagttgtttgttagtaccttcacataaattattagtaatgttgatcacttatgtcaattgacaaatttagggatgcgtttgagaaggaaatggagggattgacatcaacaacacgatcagtcggggaatttcctcctgaattaaaatgcccattgtgtaaagaagtgatgagagatgctgcactggcaagcaaatgctgcctcaagagctactgtgacaagtgttagttctcttgtcaaattgccaatacttctgattccttttgctgttccacaaacgcctttttatgtaatcattatctacaattcaggtattagagatcacatcattgcaaagtcaatgtgtgtttgtggagcaactcatgtcctagctgatgatcttctacctaacaaaaccctaagggatactataaaccggatattggagtctggtaacagtagtgctgagaacgctggcagcatgtgtcaagtccaaggtatttcatactctcattcgcagtcttttatatttgtgtgtaccatcattggtaaactaatgagtattaaatctagatatg

SEQ ID NO: 22829 - DNA, 3003 bp, Unknown; identical to SEQ ID NO: 22828
  misc_feature (1)..( 3003): 2750-1469P.txt file - cDNA_ID_2123194; gDNA_ID_2926168; Annot_ID_139994

SEQ ID NO: 22830 - DNA, 3003 bp, Unknown
  misc_feature (1)..( 3003): 2750-1469P.txt file - cDNA_ID_2123194; gDNA_ID_2926168; Annot_ID_199274
ggagggctacttcttcctcagacgggttagcaatggcatggagctgctgcgagtatctcttatcactcaaagcgtaagcatttcacactgagtttttcccactgttgaaaggtactttataagtaactgcatatgtactttttgtggctttcaactttcaggtacacagtatttgcaacccatatggacagtctcgcagagttagcaaccatctacccaaatgtcaaggttcttcatttttatgtagacatcagagataaccgcttagacttcaaggttctgtctgtcttcctttcgtatgagttcgagactttaggtactgctgctgaatgttacattgttctgatcagtttcaactgcgagatggaaccctacatgttccacattatggccttctattagctgaagtggcgggtctgcctagtacagtgatcgatacagctaggatcataaccaaaaggatcacagacaaagtattacccaaaacttaataaatatgctagcatattaagctctattgttctcatttcatgatgttgaacaggaaaataaaagaatagagctaaattgtgggaagcaccacgaaatacatcggatctaccgagttgctcaaaggttgatatgcttgaaatactctagacagacagaagactcaattcgtcaagcactccaaaatctgaatgaaagcttcactgaagaaagactctaaatagtttataacagaggacactaggatacattcacgttttaattgcaatgtctataagggttctacattactagtcccaagtgagctttcgatttgttggctttcagaggctaaaggtaggagcaaatctacactcttgatattaagtagggaaaaattaatcatcaaaaataagtaataactaagaaacattgctttatggtcagaatcaaagaactcaaaacttgaaacaaactcttgaatgtgaaagtcttccatcccaatgtaattccagaattccgaaacacaatccacactgaagatataccagttcgagaaaaaacaaaacataaaactgatcaccggtaacgacggagagagatactgttgttcttcttccaggttgccctgcgggaaggtctgttcttgtggttgttgtgaccctttccacgaagaccacgattcttctttccttcggaggtgagacctctgagttctctgtgcttgtgcacagggttgcagatccagttgatccttggatcatttcggacggcattgtgtgcagggtctacaaggataatctcgtagtacttgtaggtagagtcctgagaaaaccagagaaccaaaccattactcacttgattccatactattaacacatttacaggatggcatagcaactagtaactaaaaacagtgtgatgcatacctcattgagccagtaggagttaacaaccctaaggcctcccagtttgcgaccagcacgttcctcagcaacagatctcttactacgctggaatttgagctgtgtcactccctggttggtgggtttaccgtacacgatacccttaggcactggcctcttgcgtccaccacgtctgactcgaacacggtagacaacaaacccctaatacagagaataaagagaagtcagcaacacagagagtgaataactcatcaaacaaaagtacaatttttttgatccagggcttaaaaaaaatgtatcaatcttagacaggaacagagtccacaaaagataaagagctgttcagtcagaagaatgaatctatgtagctgggttcaggaagtattctatcataaagcgcagacataaatgactacgcatcaagacaccgcttaaccagcaatcaatcgataaggcttgattcaacaacattacctaaacctattaaattgataaccaaaatgaagagaagaagaaaaagacctgcttggccttgtagccgagacgacgagccttgtcgggacgagtgggacgaacaagacgaacaatggaaggctgctggcgatactcccaacacctaaccctctgaagaaacctcatcacatccgactgcttcttcctccatagctccgacacgtatttgtacgcacctgtaatcaaaaatcacatttcatccttaattaacttctagaatctaatgaacaatacagaaacgacatctgagagagagataatagtgagaaacatacccattgcgattttccggcgtcgcagtcacttctttcttcgaattaggtttgtgctttaaatagatggctccatgggaattagggtttccatcagacaaagaaagcccttattgggcctttttccgttagctttatgtattgggccttcgctacaacataaaacatctctaattgaactgtatggcccattataaatttatgtaaaaggagccaaaacgcaagagaattaggtgaagagtcttttggattcggttacgatagttctctattcctcttcaaaccctagagttcgtgtttctgcgatatccatcggtttctccttcatatatccatcaaacgccaaagattctctaattctctctcgagatcgtctgcaatttcaccgtgaatcatcagggataccgcggtggtttcgattctatttcctcgattcgaagcttggagagtttcagcttctgaattgaagccagtgattcaattgtttggagatatctgagcattgtccctgcgatgtattcgattcaatccaacacgggcgttctcgtttcgtttctgagctttgtgggaaattctcgttgatttgatttcgtcttgaagagcgcgtgagaggtttcttctgtcgaattttgttgaagtccaaccagagaagtaaagaatcatattttgtaattactttttgtttttgttttggaaatcaactttctggcctccatttttttggcctgggttaaggtttttttcaaagagagtagattctggtgtgttttaataaattagtaatacagattgtatttttattcattatcagattaattccaatg

SEQ ID NO: 22831 - DNA, 3000 bp, Unknown
  misc_feature (1)..( 3000): 2750-1469P.txt file - cDNA_ID_2123204; gDNA_ID_1621100; Annot_ID_171357
aaattaagtactaaaatttacaagaaatcacattttcctaaaaaagaaagagaagtcgtaactggtggtattctagggccttttggatttgaaatcatgaatattagcccatttagcttattgtggtttaggtactccattctcacattaggacttcaagccttaagatgcaatcacatgaatatgaactgtgagccattttctttatgcaggttgttgttaagtgggtatgcagattttttaaaaaatacagtcatacagaggaaacaactgtgtgattaataaaccagcgtaaaagcaaaaactacactcttagtttcacatttttggaataattagaaacattaatgcagaactgtaactatttttagccgtcttctcaaagttatctgcaggtttttaatttgcttttattctcttagaaaccttattgtacttaaaaaaacttatatggatcttaatacactttctaactatgtgtgttaataagagttatatatggtttaataaatcattgtctgtgctaataagagttataaatggtttcaaaaaaccctttttaaacatagattatgttgttttcctctgccattaaacttagacgcatcttaattactaactcaaaaacaaacccctctcgctctctctctttatatatatctataattatatgaccttaccgatatttacttatagtttagttactactaagtttgatatgagacaagaacatgtctcttgagatatcttcttcctagcttctactgtgatgtatctggattctcgatcaccagcatacctatctaccctgcaacaaagcagaaacaaaatccaactacttaagcacaaacctcaacaagatcaagcaatgtaatatcataacaacgttaccatatatccatgaaaatgataagtttcaattagggagatgacttcacctttttccttcaccaaaagactcctttgcatcgatcatcactgcaaatggaatacaatcgctgttacgggttttgtatcattaaagcagcagtaccattaggttacgtaaagctaacatagaatgaaacttcataaaatctgtaatagcacctaaaggtctagactttcatccatttcatactatctacagatcaatgtagctaaagggcaggttgatccaagctttcatcgagcaagtaagtggactgatcaaagctaaccttagccggagaagtggctactctgaagcaatcagcattcatcccaacgagacccaatccagggaaaatgacctacaatggcagacattgaattgcctaagaaaatggagacactaaaaaaacgtagtcattgttttgaattctctgtgaggcaattcgtcgaacacctggtgacttacatcgagatgtttctgcatagcttttgccctcttccttggccggcgagatgacctgttcccactcatgctgaacaaatcttcttcgatctcgtctcgagctagagcaacccaaagcctatgattctcgtttgcaacctcaccaccgcctaatccgggtgattccgccgggattcctctctgcctgttcgatttcggctcaattcctgcgcctgatttctgattcttcacctccgaacctcctcctccgccgccaccgcaaacctccgccgtgaacacgccgtttcctttcttcgaaccaccataagccttcctcggacgaagattccacgtcctcttcgcttcctcctcctccgtttcttctctctccttcaccgacaccggcacttcctctctcgcgggagaaatctcatcggatttcagcttcttcaggttatcgtgctctgatgagggagcaaaggaggagaaagagagacgcggctgacgacttgaccgtgacgccacgacacggttagaaacagccaccgtctccgccgattgagaagcagacctctccgacttggaattcgcagacattggtatgagattataccaaaacgtattcacctgagagatgatcaaaaaccctagaaggtaaaaagcagagaggagagagagagatgtaggagatttacggaagctgatgcatgcgtaagtttctaattatgtttttattcatggggtgttattggtttatgatttcaaaagacttttagtgttttaaagtgttatttagaatttattgttattcgatcacgatttgttaaaagtatgttatattttgttggctaaaataaatcattagttaattattttatatcctgatatatcaacatcaattatcatccttctgatatggggattaatatatgttaacaataaatccagaaaattacgtttagatttagacatataaataaagagatcttaaagaaaagaagagaaaaaaaagaacccgtaaaaagcttaaaagactacaactgcttaagtctatcaatgatgatcaatatattcatgtaagtgctaaataggttaatttctctagtgaattcgattttggactaaaaatcaacaaatattagatcatctagtgaattcgatttctctaggccatcaaagaatattattagttaggtccaaagacctaaatttatttttgtgtataaatttaataaaatagaaatttacattttgatatttttaatattattttggtgacaaaatatttagaaattttttatatttttaaatattcttttattttcatatattttttattttattttacaaaaatttaaaaagaataaaaataaaaataagttcataaatattaattagcaagatatctaatctccattgcttgtttaaaatgttatgtggacgcgcaaatagcttcgtatagattatgttacaaaaagatttctaaaattaactatgtttaagttcgtattattttagttaaggcccatcagagaatattagttaggcccaaaacagtgacactcaccgttttggcatcttctacacatgagcaaaactagacgcaacgcaatgatggcgactaaaacctcagagcaaaaaacatg

SEQ ID NO: 22832 - DNA, 3000 bp, Unknown; identical to SEQ ID NO: 22831
  misc_feature (1)..( 3000): 2750-1469P.txt file - cDNA_ID_2123204; gDNA_ID_2926168; Annot_ID_199276

SEQ ID NO: 22833 - DNA, 3003 bp, Unknown
  misc_feature (1)..( 3003): 2750-1469P.txt file - cDNA_ID_2123239; gDNA_ID_1621100; Annot_ID_171372
gtaactagttgacttatggtttctcgtttaattagttaaaaagagaaagtctaagcatttcattcgaattctttctcattgcttgtacacttctgttgtagtcattgagcatcaatgagtttctgaaacctgcggatggaaagagttactacagaccaagaggtggttaccaaggtggaagggaaggacgtggaccaagagaaggaaaccagagggacggtggaagaaacctgagggaaggagggagaaaccagagggacggaggagctgcagcacaggcaccaacaccggccattggggacagtgcacagttccctactttgggtaagtaaggcaatctctccggtttggtccttcagcttctgtctggactcgtttctctgtaatatctcactcggtttggattttgttcttctgattctatttttattgttatactcttccctttagagagctgaaggttttttgttttgcgaacccaattttgggagttttaagttaaatgaggccaaaaaatcaaccattctccttttgttgtttaggtttcaattatatttaggtgggactttttactaaagaagtttattaataatccaagtaccattacaaagaatttaaaagcttttggacacaagtgaaaaattgaaaaaccaaatacaaaagatttaagaagcaacgttgtttagatttcttacatgcaaacgaatgacataatatggttaagtgttaccaaagcgaattaagaggagcagcagcctgattgctggttaacaggttgtcctcggatctggaccgttggtggcttagatcctcctgcaggttggctcgccattctgcaagacagaatccggttaaggctgctggtctacaaatggtctgcaaatgtaataaatatatgagctctgaatacaataatgattggtgagttacctggtcttgattgcagcagtcatggccatgaaagcttcttcgacattggtagcattcttagcacttgtttccaagaatgggatcccaagttcatcagcgaaagcctgtgtagacagaacaaccattacagtaaatccttgagacaagacacaagagtgtcaaagaacctttaactgtgacgaacttctgaagcatattaccttagctgtctcagtggatacaactttctgtgatgtgagatcacacttgttcccaaccagtagcttgttaacattctcacttgcatagcggtcgatttcatttagccattgcttgacgttgttgaagctttctagatctgttacatcataagtcacctgacaaaaatgaaagtttagtttcattaatggatgtcagaaaaagggagataatgtaagtgtgacaacgaacttacaataattccatgagctcctctgtagtaactgctagtaatcgttctgaaacgttcctggcctgccgtatcccactgcataattggtgatagtaataaggagagtgatcatatatatatatatatatatgcacatacaacaatttcaagtgattggcactagtcgagacaacttacaatctggagtttgatggtctttccatcttgttcgactgttcggattttctgcaaaaaacatcatcacaaaattcaaaattaaaacttttctgtttcatgcatgaccaatagataaagtgtaagaagcttacaaagtcgacaccaatggtgctgatgtagctatccaggtaggaatcatcctgcacatacaaacaaattgagacactacttgagaagatcaacaacgacacttaatagagttacttatttgtatgtagcctatttatgtatacaaatatcataagctaggtgattaagagagaaatgaagttacttacagcaaaccttagaagcaagcacgactttccaacaccagaatcaccaatgagcaaaagcttgaacaaatagtcactgcagatcaaaaaaattagaaagaagcataagacacatgtaagtaagagagtataaatcatttttgacatttctccagctatattaagagcttatgacatatttcaaagttgctaaacattgtgaagaagctcatagatttctaaacgccatattcaaaacacaatctcaagcaccataatcaaaatcgactatggattcacgtcacacccgtagaattttcaaactaagagaatcatctgtgtattgaagagaaacaacagatctcaaccaattttattctagatctaatcaaaattccgatcaacgaaacgagactccaatcacgaaattgatcagacagattaacaaagccagcatcaacataaggttaatttcatgaatctccttgtaaaaaaatgatacgaagaaaatctatagagaaactaaattacataacatgttataaatttcaaaatcgatctgaacgattagagaagaagaagaagaagaaggttcttactattcaggattcatgattgatctcggagctggatcgatctaccggaagaaaaataaaataagaagagagattccgccgattaaacagagaaaagagccgtgatcttcgtcggtgatgagagactgagagagagagagacgtaacacgatcggtttgttgtgtcgacgacgtggttaagaaatgagaaagggccacactacaactattgtttttaaatgcttcttttttttggttgcattgctgacgtgtcttcgccaacccagaagatgcgtggacgagaaagtttcaatacgatacaacaaaaagaaaaagaaaaaagaattgtatttacataatgggcctaatgaaaaaacttatcactaaggcccattaaacattttctcatcgaccagggaacagagaacgctgaatcatcttcttcttctctttcattttccgagtctctatctcttgctttatcaacagttcggtaactacgacaaagaaaaacaggcgggaaaccaaatcaatggaggattcttagctttttctctgtaactcccattatcgtatcttcagcttagtgagatagatg

SEQ ID NO: 22834 - DNA, 3003 bp, Unknown; identical to SEQ ID NO: 22833
  misc_feature (1)..( 3003): 2750-1469P.txt file - cDNA_ID_2123239; gDNA_ID_2926168; Annot_ID_199291

SEQ ID NO: 22835 - DNA, 3003 bp, Unknown
  misc_feature (1)..( 3003): 2750-1469P.txt file - cDNA_ID_2123300; gDNA_ID_1621100; Annot_ID_171386
caccctttcatgagactagagcttcttcaagctcaatcttgtcctgatgccatcactaatcatgttcaccttctacaaaatcctgcatcaccaccaccaccacctcagtaactttatgcttctttagtggagtcataaactgtaatacttagggttcaaaatcaaatttgaaatgaaggtttagattttggatttcttttgtaacattttattaaccaaaaacccaaacattgaaaaaggaaaaaaaattgtgattcaaagattttaaactgggtccaagcagaaagcgagtctaacatgggccgggtctgttttaaactgggtccaagccttctaatcttatcacgtgagcgtcacgtgctctctttttctctctctctctctctccctctggctgacgaatcaccggagaacccaatttgtttcattcctttcccgttttgcccttccctgttcttttattcttttcttatctacaaaaaaaacttcgagcaagaacaaaaaaaaaaaactgtccatgtaccacaccatgagattagttgtcagatagatattcgcgagacgagaagctccaattaaaaaccctagagctcatctctctctccaggtacggccttttcgtttttggctttcaccggcgtggatctccggtgacggggagattcggaatttcggagagattttagatcatgtatagggagagaggtatggttggatcgaagtcggaggtggtcgatcggaaacgaataaacgagattcacgataacaggccttcgcattcgatgtctcagcctgtcaatggaaaaggcaaggtaacatcgacctccgttttgatggggaagcagcaattgcatgataaggaatcttcacgttctggttctatctctaagactaacatttccgacggttagattcgattttcccctctatcgctatttctctatgtttatcgtattcgcagattgtttatttcgagttcttgtcctgtgttggtctcctgatttgggattcaactttcttaaaattgattagaaatttcttaatttgacctattgttcttgaagaaatgttattcattttgttgttaacaaaagctagaagcttgatcttagacgcagtctagttttggttgctgtgtattcattttgcttatatcgagcaaatcattgttgtttgcttaagaacaagttataagaatgatgctgatgaaatgttttgtgggcatttcttgtggtgataatagctgtggatatatcagacacagacagcgaagaatcagaggtcagtggttctgatggagaggacacctcgtggatatcttggttctgcaaccttcgtgggaacgagttcttctgtgaagttgatgatgattacatccaggatgactttaacttgtgtggactcagccatcaagttccttactacgactatgcccttgatttgattttggatgtggagtcttcgcatggtaagtcttacccatgaattattagtatgtaattgtgtgtttttcataatataatagccgaaaacttggttcgtctttcttttcgttttgtgtcttcaatgtttgatttggattgacgggttaacaggtgagatgtttacagaggaacagaatgaattgatcgagtcagcagcagagatgctatatggaatgattcatgctcgtttcatattgactagcaaagggctggcttctatggtaaagaacttttttagactcaagttagatacttaacatatcctatagaacatacactgattgttgttttctttacaatggttttgcagttagacaaatacaaaaactatgactttggaagatgcccaagagtttattgttgtggccaaccttgtttaccagttggtcaatccgatatccctagagcaagcaccgtaaagatatactgcccaaaatgtgaagatgtctattacccacgatcaaaataccaaggaagtatcctttttctaatctcagtggtaaatgcagttctgtgcggttacacacacttagctttactttgattgtcattagataattttatcatgctgttttcgttgctgctatctttggtttttgtcattctttaacacacaaaaaaacagacatagatggagcttactttgggacaacgtttccacatctgttcttgatgacgtacgggcatctgaagccacaaaaggcatcacaaagctacactcaaagagtgtttgggttcaagctacacaagccgtgaaggaaacaaggaagaagaaatgcacccttgggttttgagaaacaagaaatgtgtgtaaacaaaacaaaaagaaaaagaccatttgtatcacagaaggtgaaactagttccatctctctctctctctctctctttttctttgtttttggtattgtgtttaggtttagataaaacattagcagcatggactggtgaactgaaatcccatattattgtaatactttaccttattgttcctttttgctttcttcttcccactaccaaatagttatcacaatttccccaaattgcttgtaccaatgttgtgagcttattcttgtttatctctcttatgattttgatgtcagttccatccggatacaattgttccataaagcccattgggcccaacaatccacaaggccaaccaaattcgattatattaaaagtttcggccctttataaatcaacatgtagctttctttgaccagtgaacaagaaaaggtttctcctttttaatttaggtgtataggtgtgtgctcctgcttgcatatagattacgtaagagtctctctctctctctctctctggaagagggccttgtgattgttttcttcttcttcttcagcttctaatcgaattcgttatcgaattgaaagtttcgacctttcgtcgttgtccctcaatacgctctattcttttgattagcatccctaaaactaaaatcgcagagagaatttctccgtttggatctctaccaaattggggcgcttttgggaataatg

SEQ ID NO: 22836 - DNA, 3003 bp, Unknown; identical to SEQ ID NO: 22835
  misc_feature (1)..( 3003): 2750-1469P.txt file - cDNA_ID_2123300; gDNA_ID_2926168; Annot_ID_199305

SEQ ID NO: 22837 - DNA, 3000 bp, Unknown; identical to SEQ ID NO: 6407
  misc_feature (1)..( 3000): 2750-1469P.txt file - cDNA_ID_2123319; gDNA_ID_1621093; Annot_ID_55546

SEQ ID NO: 22838 - DNA, 3000 bp, Unknown; identical to SEQ ID NO: 6407
  misc_feature (1)..( 3000): 2750-1469P.txt file - cDNA_ID_2123319; gDNA_ID_1621093; Annot_ID_170755

SEQ ID NO: 22839 - DNA, 3000 bp, Unknown; identical to SEQ ID NO: 6407
  misc_feature (1)..( 3000): 2750-1469P.txt file - cDNA_ID_2123319; gDNA_ID_2926159; Annot_ID_139656

SEQ ID NO: 22840 - DNA, 3000 bp, Unknown; identical to SEQ ID NO: 6407
  misc_feature (1)..( 3000): 2750-1469P.txt file - cDNA_ID_2123319; gDNA_ID_2926159; Annot_ID_198656

SEQ ID NO: 22841 - DNA, 3003 bp, Unknown; identical to SEQ ID NO: 18132
  misc_feature (1)..( 3003): 2750-1469P.txt file - cDNA_ID_2123338; gDNA_ID_1621104; Annot_ID_171529

SEQ ID NO: 22842 - DNA, 3000 bp, Unknown; identical to SEQ ID NO: 6221
  misc_feature (1)..( 3000): 2750-1469P.txt file - cDNA_ID_2123338; gDNA_ID_1620864; Annot_ID_170411

SEQ ID NO: 22843 - DNA, 3003 bp, Unknown; identical to SEQ ID NO: 18132
  misc_feature (1)..( 3003): 2750-1469P.txt file - cDNA_ID_2123338; gDNA_ID_2926185; Annot_ID_200525

SEQ ID NO: 22844 - DNA, 3003 bp, Unknown
  misc_feature (1)..( 3003): 2750-1469P.txt file - cDNA_ID_2123342; gDNA_ID_1621104; Annot_ID_171526
tgctggttttgggttctcttttcaactcacacttcttcaaaagcgaatttgcttgtaacatgttaatataaaattattattaaatctataggattgtccttaatgggccggccttttacgatataaaatttggttcaaataaatgtcgaatacgtcttttcgttcagcccatgaattgactaaacaaaggggattagaatccaaacaatcaaatttcttctatagtttagtttagaacaagaccatgaccatgaccaatattatatatatcgattattcgtttttatatgttctatatgcttaaaccaaacttaaaatgtaaaagaaaaacactgtgaatcattttcagagttatgatgtattttgttaggaaaccaaacccctgttaaaaactaatactgaaagtctgaaactatgacgatattcactttcaattggattttttttttctatttgatttaaggaagtacttttgaacccgaaaactaactgaaacttaaccacacacaaaaaaaaaggatttgtatcttatattgaacactacagaatttcgacattagattttttatgattttggttttcataagagtttaaaaatgtgatcatctgttttggacactgcaaatagagattttaaaacaataaaccaagtagatataatagtccgtatagtttgtccttatatataacattataggtgtaaaacacggactacataaaagtggacacataaatgcaaaattgttactacgaaactttacactgcatgtgactgatattttacgctcattacatttggatcattcgtagtgataaattaattcagggtaacatggcaagtaagtgagaacgtggtcattaatttcccccaactagttactaaaataactaaggtaaccttcgaacaaaaacaaaactttggtaaaccaaaatacaaaaacttaggtaacatgacaatgaaagtaaagaatatatagtacttgttgataagaatatagtactcgttaataaaacgctgtcggtagaagcgggtttggacgcaatcgcaggaattagatggaaaacaaacaaaaaagaaaaagaaatagagttttagcaaagagtcaaaaagagtcattttcatatatagtttggggtcaatgtagggctataggaggataagttgtgactttaagagtgaatgagattctttctcaaatgaatggtgtcaaggactagtattcattttttcttctttcgtctccatccacctatcaatatccccaatcttttttacatttttgaaatgttttttgttttgttttgttttcctcaattttagataataagtagacgaatctaatccctactaggcctaatccctatataatacacgcattttatgtcatattagaaagcaacatgttagttgaaaagtttaaagtgttttggtttcagctttgtacccactattagattttaattactaatttttttttgtaactgatttatcgtttttagtattgatagatgttaggaactttatatcaaaaataaggtgagacctaatgtataaaagagaagcaatcaacacattaccaattcagtttaaatagaaaatttgctaaacttaaccccgcatgcccttgcgtaaagcattcaaagcacaagtgaaaataaacccacacttcagaagttatatgttagtcaattgtctaattttgattgctattttccttttctctttctttattttcttcatcgccgatgtggtgttccacaatctattattcacgtttacttaggttttgttaatatatattttcttcccctcctacgtgttttcaacatattttcattaattttctctattttcattctgggaattagatctttaacatcgtcactactcatcactgtcaccagtaatgagaaaaaatacaaaataaaaccacacactctcaaagctggatttcttgtcattgaactatcgctaattaatactgtggaactcgtagaataatcaagacgaagggattgcgtagaaagagaaacgaaaaaaaagaaagaagaaagtgcattgtccttgtcatgacatgtggaagtatcggtcttatatggtccattgagccacactcatttagaatctcactactttttcaccattttcacatctatacacgattatagcatctatatacatttactttttcaattattctgctattatgggttttggatattcatgtcctaatcattataattctcttaaacaaatatcgaatttcgaatattttttaaggttattggctatatgtactatatttctatagaatagtttttgttaatatcatcgatcgatcttcagtcttattttgaactatctaatatattcagtggcttttcatatggacataaaacctaggccagtgtcgaaagttcataaacttcgaagtcaaaactagctataatggttatctttgaaaagtaactcaaatataaggagagtagaaattctacacgtaatgctgtccgagacatttaattatggacgatgtgattgcagaaacaattttgttttcaaaccctctcttgatcaaaaaggacatttaaatcattgcatccacttcaaccacacacattcatttggctgtaataacatttcaaagattcttacaaaacaagtgaaatgtcattaaatgtccttttagaacaagatgctaacgacaatctacttggccacttgacttgtataccaaatttctcccaactttttgttcacagaatttgcgtttacaactttggcgtttgtgttttgacggattcgtctaagtgggacaatgcgcgtgtcggacatgcgcacttaagagggtagagacagtgagttctttagctttccttatattctctttcaaaccaaaaaagagactactattttttgtacacttagactaaggaaagcaaagtttcatattcctaaaaattctggttttataagtatcaaagacaaattcagtctccatg

SEQ ID NO: 22845 - DNA, 3000 bp, Unknown; identical to SEQ ID NO: 6210
  misc_feature (1)..( 3000): 2750-1469P.txt file - cDNA_ID_2123342; gDNA_ID_1620864; Annot_ID_170414

SEQ ID NO: 22846 - DNA, 3003 bp, Unknown; identical to SEQ ID NO: 22844
  misc_feature (1)..( 3003): 2750-1469P.txt file - cDNA_ID_2123342; gDNA_ID_2926184; Annot_ID_200508

SEQ ID NO: 22847 - DNA, 3000 bp, Unknown; identical to SEQ ID NO: 6211
  misc_feature (1)..( 3000): 2750-1469P.txt file - cDNA_ID_2123349; gDNA_ID_1620864; Annot_ID_170417

SEQ ID NO: 22848 - DNA, 3003 bp, Unknown; identical to SEQ ID NO: 18143
  misc_feature (1)..( 3003): 2750-1469P.txt file - cDNA_ID_2123353; gDNA_ID_1621104; Annot_ID_171522

SEQ ID NO: 22849 - DNA, 3000 bp, Unknown
  misc_feature (1)..( 3000): 2750-1469P.txt file - cDNA_ID_2123353; gDNA_ID_1620864; Annot_ID_170418
cggtaaagacaaactctcgatgtctctgaaagatacatgtctgcatcctcaggcgagtctcttcataagcaaaaaccagataattctcttttgtttcttcgtttttatgtttcgtatatgcatgagaatcttgagcgcttaggttagatataatgtaggggatcctctagagtcgacctgcatttggtactcatgaaaaaaaaaaaattggttgattatttttccaaacataaacgatatactagtaatcttgaatgcacaacacatcaatatatgaaaaaatcattaaaatctcaattaaataaagagctacattatgattaaacaaaaaaaaacttcatggcgaaataccgataaatatagcaggagcgatatgctattctatagaattaattttcataattagatagttcataatagaaaatagttaagaagcagtaggatgaacccgatcatgataaccaatacaaccccatagagcaaacgcgatgaggatgatgaccataaggatggtggcaacgattgttacgatgaacgaagtatccatattgtttcttcaccgcaccaaattttttatttttttctaacctttcctcgtgtcttcttcttcttgaaattacatttatattgtaagtaaattggaaatagtggaagtaatttacattttgtcatcaagaaacatactagcaaattttttgaaattttacatttagtctcttaaaaatattacctaggagtaaaaattttgtaagtaaatcgggaaaagtggaagcttttacatttgtcatcaagaaacatactagcaaaatctggaaaattttacatttagtcacttaaaaatattaactaggaatatatataatagaaattttacatcttttggtattttgttggtcgtcaaagtaaacatgactatgttgattcgcttgtgcggttgtacgaagacaatgtactgtagagacaaactcttgatgtcgacgctatctggagactgcagtcttagataaccttttcatcgagttggaaataattagagaaaccaaacaaaatgcaagaccaacttaattctcttctcttgtaattctggagcttaagttagagattgggtgttgtcatattaaatttgttaatcatactgattactttcactcacatttgttcttgttattgtttatgttaaatcgtcactcacattgtatgcacatgtcagattcagaccaatgttaaaagtgcattattttgtttggaagcgtgtgagaaaacaaaaagtttatgtacataacataaatccaaaagtactactcgaataaagtacaaactttatatcttttaaactccacgtaataactcatttttgtttgttttaatcaaaaattcaaacgtctaaaatttcgtcttaaataagaaatgatattaagaaaaatatctttggattaataacagatcaccgaaaattagaatatggttttaccaacccaattaaattctcaaattaattggaaagagaataatgttgacaacaacaaaaaggaaataaatcgcatgcaatgaaaggaatgaatcttcttcttcttcttctctattaacgcttcttcttcttctccttcttcatcaccctcctccacttctctcagtcacaatggcgaccaaaaaatctctgaaatcacgtctccaagatggagaaaagcttctcggccactttcttctctccttttctccggagcttgcagagatcgctgcaagagctggatttgacttcattgtcgtctaccttgagcacggtgccggcgggattcgtgaagcgcttcactgcattcgagcaatcgaagccgctggttgctccactgtcctccgtgtacccgacattagtcaggcttgagctaagaaagcgttagatctcggacccgacggcattatgttcccaatggtcgaaaccggaagatctgcatccgaggcggtctcgttttgcctgtatcgtcctgacggtgttcgcggctgtgcttactccgttgtgagagactccagcttcggatttaacgaagggtatttgggtaattacgctgataagctcttcattatgtgccaggttcgatcctcaaatcccctttgattttcaattttattggacgaaattgttaaattgaattctaaaatgcctacttgtgaaaaaaatggaagttagaatttttatgcaattgatatattttgtgcagattgaatcagaggaaggtatgaaaaatgtgaaggagatcatagccgttgatgggatggattgtgtgatgatggggccgagagatctgagtgcgagtttggggttacttaacgatccaggaaacccgaaggtgaagtcggtcatgagggtggctgagacggcggtgttggcctctgatccggcgaatggtggagcttacttggcagggatggccacggctcaggacaaaaccggtgatctcaaggcacgtgggtatcacgtggtgctcgggtcaaccgatgtgtcgctgtacaagaaggctgtggttgatgaggtcaacgcttttaaagcgtagtgtcggaattagattagagtctgaataaaacgggaattagagtgctttgtaataagtgatgagtttatgtaccccatgattatcttctactttgttagttatgtctactactttgttagttttgacttttgagcaagtcttgttaagattcgcattatccaaaagaaaatttaaagccgcattaacagtgtttagctctggtgttactaaagaaaaagtgattatgcgggtcaaacacttctcaaatagtttgctttgatttctttggagaactgaaatgcatgccgtttcgaaatattagaatgcatgtcgtttcgtggatttcagtaccagtaaaggctaatgctgatgcatcgttgcattttaaaaatcgtgtcgtttttcattccgttttagtggccactcttcgcaaccagataagaactcgaagattttctttttctttatcaaaatg

SEQ ID NO: 22850 - DNA, 3003 bp, Unknown; identical to SEQ ID NO: 18143
  misc_feature (1)..( 3003): 2750-1469P.txt file - cDNA_ID_2123353; gDNA_ID_2926184; Annot_ID_200505

SEQ ID NO: 22851 - DNA, 3000 bp, Unknown; identical to SEQ ID NO: 6203
  misc_feature (1)..( 3000): 2750-1469P.txt file - cDNA_ID_2123373; gDNA_ID_1620864; Annot_ID_170435

SEQ ID NO: 22852 - DNA, 3000 bp, Unknown; identical to SEQ ID NO: 8162
  misc_feature (1)..( 3000): 2750-1469P.txt file - cDNA_ID_2123402; gDNA_ID_1621198; Annot_ID_174762

SEQ ID NO: 22853 - DNA, 3003 bp, Unknown; identical to SEQ ID NO: 17668
  misc_feature (1)..( 3003): 2750-1469P.txt file - cDNA_ID_2123414; gDNA_ID_1621198; Annot_ID_174767

SEQ ID NO: 22854 - DNA, 3003 bp, Unknown; identical to SEQ ID NO: 17661
  misc_feature (1)..( 3003): 2750-1469P.txt file - cDNA_ID_2123471; gDNA_ID_2926139; Annot_ID_197369

SEQ ID NO: 22855 - DNA, 3000 bp, Unknown; identical to SEQ ID NO: 8168
  misc_feature (1)..( 3000): 2750-1469P.txt file - cDNA_ID_2123471; gDNA_ID_1621198; Annot_ID_174791

SEQ ID NO: 22856 - DNA, 3000 bp, Unknown
  misc_feature (1)..( 3000): 2750-1469P.txt file - cDNA_ID_2123497; gDNA_ID_2926139; Annot_ID_197363
caaggacaaagacagcttctgttttgtcttcatgtgaatttatattaacaaacagctgcacgtgcatttagagacagcatgggcgaccttacggttgaagcaaagtcaacccataagatctctattctcagatcacattgtcactttatttctttcttaattttgatttgattctgttttctctttatttatgcatgtagtagtcaaagtatgtgattaattaatgttataagtacgagtttctatttctcttaatatagtattcttacctcaggtcccacttcagtgtcggctagtattactgctgtgcaagaatcttcgccgacgcagtgtaagttgtttttaacactctgtttttcaccgcactcctcaacgttacttccccatgatgatggtaaaaactccgatgtaaaatccaagtcagaccaactgctgcaggatgtgccgctggtggtggaggatcctgtggttgttgtcgtgttcttggttgtgtactgatgaggttcaaaatgtgatatgtcctcatgcaggtccttagacgagtgccatcgcacgatgtctttgactcgaataacggtgatgcttgcttggttttctgctttgttcttggttgctaaccgccgagaaaggctccttggtaagatccccgatggagcggatttgatggtgttggaatggaggttcttgatggcgttaatcacagcctgcaatgcattggattgtttcctctttggtatcattgggaaagggttgagaggatgccgtctgggaatcgatttgaacccgtttgaggaacatgagttggaatcttccaagagacagtctttgagcattctcgaccttagctccatcctgaaacactctttggctcaggtacgaagctgaacttgaaaaacactgaactgacgataagaaagtgtcttaacaaaaagaaaatatcttgaaagacgggagtgggctagtgaaatgcttaggagtgttaagatgtatttatgtgtggctgatgtgagtttatggaaagagagaggcagcttcttgatgaagatctcaagatgatgacaggcttagagaaagaaaggaactgagttttttgcttaatatataattaagttagttggtagagaataagacaaaatatgtgggacctaggatgtttcgctctacgtgtagcaagatttggagcttctgcttatgtgcttgttagtttataattttataattgaaactcaaaaaggtttgttggagctatgctatactcagttcttgtgtctagtcacaagatccagagacctggcgatgctattaaagtcggtactgctaataaatggtttttacttttttcaaaaattatctcaattggtaaaaaatgaggtctcgttttctttgtttttgttgataaacctaaaaagcttttgtgttacgtattgagcagatgaccgaaagttgtctgtgtagccttttgtcttaccttcttatttacactgcatgttgactgttgagtaattctgatttttggttgtgttctcagctaaacggtgaaagccatgtgaatgttcctatcacttctgacagtatacctcctctatggggctaattgtgtgatcaaggctacgttgctgtttgtctgcaagttcccatcaccgaaacccaaaaggttcatccagatgcttgtgtttatgcgattttctatttgactgcaattgtttctccgtaacaactttatatcgtgaaagacatccataaatgtgctgagatgcttcgtgcagactacaggacatgggcataggattttgtggtaatcatggtcagccagcagaatcatgtgtagaacaagatgggctgattgaagagaatgaatcttaggttcatgatcatgatgactatgttgacagcttgtgaatgagatgaatgcataggacttagtctgccttttgaggtgaagctgagcaatcactgtgcaaaggtaatgatttttagtccttctttttgccttttggccctgtctgtaactctacttttgcctctttgtttattgtttttgctatagatgtgctataagtgtgaacataaatccttaaacagcatcaacatgtatacactcatatccagcccatttccgcaaagacatatcttcagcataactattcactgggaacacacactgcgctgcaaaatctttgatgtgtcaaaatagctagctttcagaatgaactcacgacactgatgacatgagcccattctgaaagctaataatgcttgactcatcgccatagttatgctctctgcgtattgctactgtcagcaaatgcgagaactaaaaagaaaaaatgtcgcaagcttgaaattgtgttgcacgatctcttcatctttgcattcaatttctggtttcttaagagttctttgcacaatttatactcggagttgtcttcatagctttgtttactaataaatttctgctattttttggttaaacgaactgtgagtgtgaagtgtctcgtttgattaaagttcttactaagcatacataagcaagatatatttgtttgactgatagattttcagtctgtccaatcctgcatgaactgaatatcatatacattggtatattgcatctttgaccaataaaagaactggcgactgctctgcatcgatgggatgaacacatttataagtacttgtcatttcagtggctatctctatgtatggtagttgtttaaatgatttaatgattttgactagaatctgttgcaacgcagcgtgtggtgaaacgtggaggctcgttgttgcatgaagtgtatccaggtccagatttacttctttatacatttgcgaattcctttttccaattagattgcctttcccctcattcttcttcttttggcttgtaaaagtcgctttgcgtgtatttatgcgattaagtctctcgtcttcggtacttctacgaggcttctgactataagcattaattttattgtcaatcacgaagagaattttcgtatg

SEQ ID NO: 22857 - DNA, 3003 bp, Unknown
  misc_feature (1)..( 3003): 2750-1469P.txt file - cDNA_ID_2123497; gDNA_ID_1621198; Annot_ID_174798
taccaaggacaaagacagcttctgttttgtcttcatgtgaatttatattaacaaacagctgcacgtgcatttagagacagcatgggcgaccttacggttgaagcaaagtcaacccataagatctctattctcagatcacattgtcactttatttctttcttaattttgatttgattctgttttctctttatttatgcatgtagtagtcaaagtatgtgattaattaatgttataagtacgagtttctatttctcttaatatagtattcttacctcaggtcccacttcagtgtcggctagtattactgctgtgcaagaatcttcgccgacgcagtgtaagttgtttttaacactctgtttttcaccgcactcctcaacgttacttccccatgatgatggtaaaaactccgatgtaaaatccaagtcagaccaactgctgcaggatgtgccgctggtggtggaggatcctgtggttgttgtcgtgttcttggttgtgtactgatgaggttcaaaatgtgatatgtcctcatgcaggtccttagacgagtgccatcgcacgatgtctttgactcgaataacggtgatgcttgcttggttttctgctttgttcttggttgctaaccgccgagaaaggctccttggtaagatccccgatggagcggatttgatggtgttggaatggaggttcttgatggcgttaatcacagcctgcaatgcattggattgtttcctctttggtatcattgggaaagggttgagaggatgccgtctgggaatcgatttgaacccgtttgaggaacatgagttggaatcttccaagagacagtctttgagcattctcgaccttagctccatcctgaaacactctttggctcaggtacgaagctgaacttgaaaaacactgaactgacgataagaaagtgtcttaacaaaaagaaaatatcttgaaagacgggagtgggctagtgaaatgcttaggagtgttaagatgtatttatgtgtggctgatgtgagtttatggaaagagagaggcagcttcttgatgaagatctcaagatgatgacaggcttagagaaagaaaggaactgagttttttgcttaatatataattaagttagttggtagagaataagacaaaatatgtgggacctaggatgtttcgctctacgtgtagcaagatttggagcttctgcttatgtgcttgttagtttataattttataattgaaactcaaaaaggtttgttggagctatgctatactcagttcttgtgtctagtcacaagatccagagacctggcgatgctattaaagtcggtactgctaataaatggtttttacttttttcaaaaattatctcaattggtaaaaaatgaggtctcgttttctttgtttttgttgataaacctaaaaagcttttgtgttacgtattgagcagatgaccgaaagttgtctgtgtagccttttgtcttaccttcttatttacactgcatgttgactgttgagtaattctgatttttggttgtgttctcagctaaacggtgaaagccatgtgaatgttcctatcacttctgacagtatacctcctctatggggctaattgtgtgatcaaggctacgttgctgtttgtctgcaagttcccatcaccgaaacccaaaaggttcatccagatgcttgtgtttatgcgattttctatttgactgcaattgtttctccgtaacaactttatatcgtgaaagacatccataaatgtgctgagatgcttcgtgcagactacaggacatgggcataggattttgtggtaatcatggtcagccagcagaatcatgtgtagaacaagatgggctgattgaagagaatgaatcttaggttcatgatcatgatgactatgttgacagcttgtgaatgagatgaatgcataggacttagtctgccttttgaggtgaagctgagcaatcactgtgcaaaggtaatgatttttagtccttctttttgccttttggccctgtctgtaactctacttttgcctctttgtttattgtttttgctatagatgtgctataagtgtgaacataaatccttaaacagcatcaacatgtatacactcatatccagcccatttccgcaaagacatatcttcagcataactattcactgggaacacacactgcgctgcaaaatctttgatgtgtcaaaatagctagctttcagaatgaactcacgacactgatgacatgagcccattctgaaagctaataatgcttgactcatcgccatagttatgctctctgcgtattgctactgtcagcaaatgcgagaactaaaaagaaaaaatgtcgcaagcttgaaattgtgttgcacgatctcttcatctttgcattcaatttctggtttcttaagagttctttgcacaatttatactcggagttgtcttcatagctttgtttactaataaatttctgctattttttggttaaacgaactgtgagtgtgaagtgtctcgtttgattaaagttcttactaagcatacataagcaagatatatttgtttgactgatagattttcagtctgtccaatcctgcatgaactgaatatcatatacattggtatattgcatctttgaccaataaaagaactggcgactgctctgcatcgatgggatgaacacatttataagtacttgtcatttcagtggctatctctatgtatggtagttgtttaaatgatttaatgattttgactagaatctgttgcaacgcagcgtgtggtgaaacgtggaggctcgttgttgcatgaagtgtatccaggtccagatttacttctttatacatttgcgaattcctttttccaattagattgcctttcccctcattcttcttcttttggcttgtaaaagtcgctttgcgtgtatttatgcgattaagtctctcgtcttcggtacttctacgaggcttctgactataagcattaattttattgtcaatcacgaagagaattttcgtatg

SEQ ID NO: 22858 - DNA, 3000 bp, Unknown; identical to SEQ ID NO: 9335
  misc_feature (1)..( 3000): 2750-1469P.txt file - cDNA_ID_2123511; gDNA_ID_1972069; Annot_ID_178527

SEQ ID NO: 22859 - DNA, 3000 bp, Unknown; identical to SEQ ID NO: 6887
  misc_feature (1)..( 3000): 2750-1469P.txt file - cDNA_ID_2123597; gDNA_ID_2684224; Annot_ID_191894

SEQ ID NO: 22860 - DNA, 3003 bp, Unknown
  misc_feature (1)..( 3003): 2750-1469P.txt file - cDNA_ID_2123597; gDNA_ID_1972047; Annot_ID_178267
aaagtgatatatattgaaaatatggctacattagcggatccatcacagaaaaagagttttgtggaaacaaaaaggtgtggcggctacatcattctgatttatattattatatatgcaactccttcaaattttggttcaatggattcaaatttcaaacatatttcttggtcaagaatcaatatgcatctagatctctgaggtaatcattcttttcttatttgatttacaatttggattagcaaggtttccaagataatatccaatatcacgtgtatttgaggttcacctaccaaacttgattgaattcaataaacaatgagctcgaatgatgttgagattgttgactattttggctctttgctttcttctatacttgtcaaaagtatataatcattgattccatggattattcatccctccatagttattcaaacttgattcatattcactttttacacacaacatagaattataataatactaggcattgatcacatgtaggatttgagacggggtcgcgtaagggactgcgctccatccaccaagacagtggtgcctgtcatgaagcgtgagccatcgctgatcaagtagataacagtggagtagaggtctgtgtccgggttgagccactggccgaggggtgcagcgtccttgaccagcttctgcgctcggtctcttcccacagaagctgtatactcatcatccagatgcagccctctagagatcatgttgacccgtatcttgtgcttcccgagactcatggctgatgcctgaaacccaatcatcaacaaacatattcaagttacgaacgcgatgtgtctaattaggagctaggatgcatacccggacgagctggtgaatagcggcagaagttgaagcgtaggcatcagcgccagggtaaagcgccctctctccgctggcgatagtggccatgaagacaatggagcctcctgatccatggtccttcatccttgtggctacagccttcaagagaaaccatggagcggtgagattgatctttgtgattctgtggaactcatcttgagagacttgaagaatgtcctgcacctttcctgcaagaaagaaagattgttgaataaaggaatgatcaacacacaagagcatcaaaggcagggtagtgaaaaacaagaagcaaattaaaccttggtaggtataagagttgagaaaagcatcgaaatggccggaaagttcccatgccttttggacagcggcatgaaaagcaacttcagagtcagattccatgtcgagtgctataacatcggcagggaaggctccctcaatggaatctctaatcttgtctacaatgctccttagggaaccctcatttcccatcattaccaacctagcaacagtacattgcattttttgaaggttaactatagacaccaaagtcaaccacaacacaaatcggggctagaagaagaaacacaggataggaggaaagaagacaaaatgagagactcacttgcaaccgtgtttggctagatggaaagcgatgtttcgggacacctcgtcgccgttggatgtcatcaacactctcttcgccggattttccattttgccaaagtaactctttataaaacaattcagcagattcaacaagacttaagggagggagggagtgagattgattcgatcgccaattctaaataactataaagagtggctgcaaaagctcttaccggaactgtgtctgtgtgttaccaaaacggcgaaacaaagcaaataattaatgcctaaccacatgatccaccacgttctgttgttaccttctttaatttgtagatagaagaagatggtgattgataacggagatgtatttttttctttaataaaaagcccacttcaaggcccagatccatttctgtactttgtaggttttccaactttcccggcgccggaagcaagcgtaagttatcactgttccccaaccaaattccatcatatcctattatcctactactaatggatccatctccaagattcctaatttcactttgctacaaacttatttcgtgtttttggtttataattaatagccgttgttggttatgaatatgtaagcataaaaggcatttgggagctccagacagacaatgaatcatcaacatcaggtactctgtctttcgtttatgtttctgttccattcttttgaaatatatagaggaggaacttgttattagctagtccattgatcaacacacaaagagtgagaatgaaagcaattcctccaaccaaaaggatgctttcccttattgatttagttggaccaatatataaagagaacaaaggagggtgttggtaggtaacaaaagattctaggtggtgggagggtagtggatttttgaaaaccgtgtgttgacttaatgaaagaggtgtagagtaatgggattgtgagagtgttaaataataaaagactaggatacgaaatcattgtgacatgtcaatttttcaagtgggtggtggaatccgcaacaaaatataaaataagaaaaatgctttgcttgcttgcttgctctactttgccttctttttgcaaccaacatgacgttatgctggaaaggaatcaaattgttacttggtcatgcacctgtgaacgttacggagaggtctacctcaagataacgaatgatctattatactagtaaataccacatcttgcttgagaaggagaatataatcccctttatgatcatcaaattgaccccaaatcttcacccgacttttggtagtattcgaacaattataacagaatctaaaagttgctgtgcccgtgccacgtcatctctaagaatctttagtggcacgtgctcgatcaactaatgaaaacaaggttcggttccggtggcctaccatttttatcctccttcaacttccctctccctctctcttttaggaattttcctcagaaattggaggactcacactcttctgggtttctgctgcagccaaatcaccaaggagatacatactacaaccatg

SEQ ID NO: 22861 - DNA, 3000 bp, Unknown; identical to SEQ ID NO: 6887
  misc_feature (1)..( 3000): 2750-1469P.txt file - cDNA_ID_2123597; gDNA_ID_1621111; Annot_ID_171789

SEQ ID NO: 22862 - DNA, 3000 bp, Unknown; identical to SEQ ID NO: 14765
  misc_feature (1)..( 3000): 2750-1469P.txt file - cDNA_ID_2123597; gDNA_ID_2684224; Annot_ID_137529

SEQ ID NO: 22863 - DNA, 3000 bp, Unknown; identical to SEQ ID NO: 6884
  misc_feature (1)..( 3000): 2750-1469P.txt file - cDNA_ID_2123612; gDNA_ID_1621111; Annot_ID_171797

SEQ ID NO: 22864 - DNA, 3003 bp, Unknown
  misc_feature (1)..( 3003): 2750-1469P.txt file - cDNA_ID_2123626; gDNA_ID_1621111; Annot_ID_171803
gaagccgaagctagaataagagatccagtgtatggatgtgcaggtgccatataccatttacaaagacaagtgagtgaactccaagcacaacttgcaaaagctcaagtggagatggtgaatatgcaatttcaaagatcaaatttactagagctgatttataacatggaccaacaacagaaacaagaacaagataatatgtcctttgagagcaatgatttgggattccttgaagacaagtccaacaccaactcatcaatgttgtggtgggatcctctttggacatgttgatcattactaagattttgactacttcgctttaaggccctctctagaactttactcagggttagttagcatacacaaatgtaacattgtacggtgaataaagaaaagtagaggcggcttttttaaattgtttttttgaccgggttttcaatgttttttcctgcggtttttagacacaaaccggaaagtataccggatctaaacaaccgcagagcggaaaaaaaaaatctaaaactaaacgacgtcgttcggctctttatcttgtcaccctcctcaggcgacggcgacgatgaacctccgttccaaatcttcccgtatcttttatgaaacgcgaccgactcttcaaggcccaaagaaaaagagaatagtcggcgggataggggtatgtttgtaatttggcaaacgaatccccatcatagctttattccttacttcattcaccctagccgctttactctcttgcgttatctccgaggtaagctttttcatcaccatctacgatctgcctctttctcttctgctgatctgtgttgaatctgtttcgatacttctcgtttgttgttgttatttcttggattcgattctctttgtttatagatcgtttggaatttctgatcggtggtgtaaagttttatcgatttaggagaacaaagttttacagtgcaatcgtattgttttttttcttcatgccagctgatgataaactataggatcgatctggttctgagatttttgtactgttcagtggattgttgattatatcttttgatgtatgtgatattaattatcgatttgattgggtaatccaagttgtggaaactctaggattgtttgctgtatatctcctcaattgctgatttgtttgaatttagctcgcttagctcagatgatagggcaccacaatttttgtggtagaaatcggcttgactctctttttctgccaacaaaaacaaaaaatagtctgagtcaaaccattgtagcagtacctaaaatctcgtttgtgaaccgttgtagcactacccaagtcaccggaaaggtaaaacaatgaagccgtgggattaaaccttcacagatctgtgttaccaaaccctcctcttcgtcgttcagtccgccaaaccaagccgacgagaaaggttgcgggaaaaggtacgtcgcagcttctcgtgtttgtggtggtgtgttgctaagaatattgaaccagaaattaaaccaatttaaaccaagagaccttacgtgtatttcagtattgaattgataaaacccaaacttaataatcgaagatgggattgcgttatacatttcagacaacaaagtgattttaactcaaggcattgatggtggagtgaatgtcgattacttccagaagatcgagtcttggcctttctgattcacagtattcaacattaacgtgtgaatgtattcacagggttctatgataatgattgtgaagattcttgtgaaccttgattatgtagtgtcctagtgtcttctattccatcagttgcacatgagagtttaccaaaactttgaagattatgttgtgggcagaaaataaaccaactgataaaaagccttttgtggtactttaacattaagagaattcaaagcctagttataggaaataaattataaaagcatgaaagatattgttttctttgcaagtttggtctgaaagagtgtattttaaatgggcttactgtgggtagttattgcagaaacgctgaatttaaatgggcttactgtggcccaatagatagatactgtgagtctgtgatgagcgggttatttgtgggtgggcattggtttatagaaacgacgttgtgttcaagttactaaatcgcgtgtgttttttacttttctgcaactaaatcgtgtttcttcctaagaaccctaaatctgaactgtctcatcttctccgatatcagtgagatcaataaatcatcttctcaccctagacgacagggaaactcggggattgattcggaaaaacgagttcgtttttctgcaaggtacttttcttacgaaacaaatcgtaattgattcacaggttctgaatcttctagttaagagtaatgttgtctacactcactgattgcagcaactgattcaagtttttcaaagtagtagatgatctcaatctaaatcggtttttgatagtttatgcttgtggaatttgatggttttgaatcttttgatcttgcatctaaagtagtttttcaaactttacttatttatgccaatgggtttctattttgatttcggatttttttgtgggctgggtttttggtggacaagtttatgattatctggaattgggctagttaaaatagcccagattaacagccctagatataccgtagggtattttcgtaaatttagtttatagatttttgtttgttacggtggtctttcccgcaccataacacttccactaactccgtcgtcgtcccgccggtttcacagcttgttagtgactcagcaagacgtcgaccgaacttggtcgccgccatctctctttatttttacgtggttcgcacaaaattaagccacgtgttgatgtcgttaattcctcacacaactcacttcgctttctctatcaacattcatctttctgctacttctcgaacctcctctcttctccgatcatcttctccttactttaccttagctcgctctctctgttttaactcctctatcagatttttatcctcagatatg

SEQ ID NO: 22865 - DNA, 3000 bp, Unknown
  misc_feature (1)..( 3000): 2750-1469P.txt file - cDNA_ID_2123639; gDNA_ID_1621111; Annot_ID_171808
atacagggactcaggcgagcaagaaccctttattcttaggggttctgcctccaaaagagagattcccagagaagtacattgctgtggtatcgggtgtaccttcgacacttcatcctggtgcatgtgtgcttgcagtagacaagcaaagcccacccacatttgccttgtactgggataagaaagtgcagtttactcttcaggtaatgacaaatttaagttcatttttaatatgcatggaacagcttacatatacagaggatgtgaaaagggattgtggttagtgatgaacttgtgtactggaaatggaacagggaagaacagcgctatgggactctatgttgttgatatgccacagaatcaaggtgggatacggaggtgttgttcgtgggatgaatctgggttcttcagcccttaacatcctccaagttgttgattccgacactgacgattaagaaagctggatttgcttgagatagtggaggtgcattgttaggaaatgccatcttcattttgccattgttagaaggaagtagtgaaattagttctctttggatagcaacttattcttgtgataagtacatattaaggatgcttttttgtaaccacttaagaatcagttgatggacagtacaacactgaagatggattcatcagaaaacattcgaaattgatatttttgtttgccgatcatgaagtttaatgagtctctatctacattaataatgggaacagaagcaacagtagaatcatgttttttttttcacttctcaaaagactgctaaagttcgcattactctgtctctttctcaaggttactcatgcgtattagttctgacaattcactgaatatgaaattttaaagcaagaactttggtctgcagctgctcttaaaacgaacatacaacacaaacttgtaagaaatctcgactaactacacttacgtctttgcttatctgactctgaataaaatggaaactgaatattttagcaaaacagtggtgtgaaaaacctttaaacccaaagatgctcctccatcgtgctgaaaaccatgcctatctaactaacggtaagagtcacacaactgcataggaaaatgaaaaccaaagggaacaatgtatcaggttctaataatcaccgactagttgtatcacagttccttgtcttcaagctgtgctttttctgctgccttttcagtttccctctacaacaaaagccttgagcgattcaacgtctctttttcctgaaatcacaaatgcaagtatgaaaaaatatcacttatagcattactaaactaaaggattgaaaaagtccaaatatgcatgtggtggtcgtgtgtgcctaagcaagtttacctttatatttcgaaacttcttctccattgtaaaatagcataaatgttggatacgagtgaatttcaactttggtgcaaacagctctgctagtaccacagtctacttcaccaacctcaatttcatcgtctccctccattgcttttcccaagtcttcccacaaattccccagtttcttgctggacactcagatccagtttatcaacaagggataaacaagccaaactgctaagttgttaggtaattttatgaaacaaggatactaaccagtgtttacaccaaggaacacaaaactttacgaaccacgcagtatccttctcctttatctgaaccaacaataaacatggagagagtaaacatcttgttgtgtctgaactaagactgtagaagctacaccaagaaatgcaaccattctgaagttgagctttgttattcgacagggtcagctttacaattagatctaattatcaaactccaaaacaagaccaaagtatctatgagaactacataatatcctgaaaatgctccaatatagagtatgtaaaatctgaaagatcgcctaacacatttaaatttctggtagatatagtctaagttagctggacatcaaacaactaaactaagctgagatatgagtctctctactcaaatagatcagaaattacacttacgagcaatgcaaacaatctttgaaacgagctaagccgttttcaatatcgcatcgtcaaaggagcacagaacacatatataaatctacctgattccagtaaaacacttgagttcacacaaatgaaagtactcttgggatatagagaaaaagggcttcagatcattaccttgtcagaaaaggtttctggtgtcagtgtaatgacttccgctttaactaattcaatcggtataaaaaggagaagtataatcatgggagcaacaagccgagcacctagcgtcatcgcagcaaaaccccaaattttgatacttcaccagtcctgttaacttttcttccaaatttgcaaaataattgcatttaaccacactatttccaaaataataaactacaaaggatcaatgcacagtgcactgaaagggagcataagaaacaccaaaatctaagacaaaaagattatgaaacaacacacgattaaatagattgaagttgcaaacccgagtttaactaataacattaaaagaatgaaactttcaaaacctttcaaggttttactaatcaattgctagcaaaggcaaaactccaaaccgattacaagggacgaaattaggatttggttgagaaaacatttcaaaagagaaacgatctattcatctgatctgaaactaatacgaaagaattgaagcaagattcattggagggatcagatagaagagtagggatatcaaatcttagatgtgtctgaatcgcttaccttctgcaacaccaattccgagagcagaagaaagagaggaatgtcaaagcatgtttggttttagaaagttaagtcccctaataataataacttaaaacacaaatacgtaagcccattactttaggcccaatactaacatcatgctcctttttttgttgggtggatcttcttcccatagccatcagcttcttttactttcttcgtttctttgcaaaagaccagcgataattatg

SEQ ID NO: 22866 - DNA, 3000 bp, Unknown; identical to SEQ ID NO: 6890
  misc_feature (1)..( 3000): 2750-1469P.txt file - cDNA_ID_2123646; gDNA_ID_1621111; Annot_ID_171810

SEQ ID NO: 22867 - DNA, 3003 bp, Unknown
  misc_feature (1)..( 3003): 2750-1469P.txt file - cDNA_ID_2123652; gDNA_ID_1621111; Annot_ID_171813
tgatactcccaaattcatcaaaaaccatgtgaaattaagttcctcaagctaaatttatatgtctaattagtactataccgtggctttgttgacaagaaatacagcatcctgcataatctgaggagcagaattatcgcttctcatgatccgccgaatccgattcatcggaaacttgatcttagcatcttccgcgcctccatcgtcctcttctcgatttttactcgtcttcgtcggaattcctacactctttccgttacccctcttgctcacgacgccgttacttttcttcgcctcatcgcctcttattgcttcttccacagagtcactgctcgatgattctgagatctcgtaaatctccggcttcttcttcacaatgttaaccttgttcgacgtcttcttcgttctggaaccggagctgcgtttactccgaccactcgctttattgacgacgacatcgctcctcgccttcttctccttgggtttctttgacgacaccattaattttttagaactacagtatgtttcaccctttcgcctgaataaatcgatggatatttacatgggcttatttgtttgagccttttaggcccatttatcatatgatcaatttaaggaatggacatggtgatgttgaggaatgaagatgcatgacgactacttcaaaataaattattggacatgctttcactgtttcgcatacacctcgtaaaacattgtatagtttatggagaaataaataaattagggtaaatgtacttgggataagataatgtttttatacaagcatccaaaatacattatcttgttcccgacataatgtaaagaaattttagggattagataaggaagaatgggtaatgttggagtatgagacagaagaggtgtccgcaagctggaaccaccacgtgttatcaacaacacgtgtgagtctccatgaactctctctgcaatatttaaacgtggcctagctcgtgttctttcaatctccaattattactctattaataagagaagacgagttttgctttcgatactgtctttcaactattccgacacaaccaaagcttctggaaacgttgtcgtttgttatcaataatggctgttgtagaagaaccgatactttcaagattggatcgtattgatttcatggtgaggaagttagaggagatgaaaggaagctcgcctagaagctcgagcccatcgactccatctagtgggactcagccatcgtcaatggatctgtcgtcaccgaggagcatagggaaggtacactgccgttcgatggaacaagtcagggaggagactgagcggaaaggaactttgctagagagacttaataatgtagaggagcaagtgcttaagctgtgttcacagtttgaggaagaagttgaagaagagaggaagagagaagataagacggataaggaaaagaagaccccgaagaagaagaagggattgaggaagctggttgataaagttgttggatcttcttctcccactaatatccattccaagagctggcgttgttgagtcattgtagtactttattacatcatcatgtatacttcaacgtaccacgtttaaatgaaagcttctcttcttttttctttgttgaagcgctagtggaaaaaaatatctttaggtctctcactctcttgtttgatcgtttgtttgttgaggttttttgttgtccagtatgcactttttaagtgaaaacaacaatgaattttcagtgtactttctatttttcagagtgcacttttcaagtgaaacaatgaaaatttgaaggaaaaacaagtacacacctataaatgattagaaaaacgaagatgtgtgtagtcatttccataaacgtaacgataaattctcagtggagatggttaaaataaaccgtaaatagttaaaatttaacaaatgcccaaggttttgtgtagaatagaacaatttaattttatatctgttctccgggttttcttgcttcccgatcaaattggggtgtcaacattttgatctaaaaatcagtgacatcatatatgagacttttcaacgtgtttttttttgtctaaaaaaatttcatcattctcttgtcaagtattatgtaaggttaacaaatctcctcataaattttttaaagatcgaaaattttctaaaaatatgtaaactttttttcgtctatggtttcttaaggtgtgaagaaaaagaggctgtttacggagttcactctgtttgacacttcaaccaacttttgtctttatatgtttttattctacaccattaaatcaaacttaagacaatcatatgcatttctttatccacaaaattgatttgcttattgtacttcatcatcccgttgtaaaatttataagcacaattttcgccaactatttattccgcaaattgaacagctgattttatttaaattaatgtgatctttatcacaacaaattcacaagtcacctgctgctggtgacgcaagtatccccctctctgttacaatatctcacgatcattcaattgtatccataaagatgatgtatgttactatcaccaccaccaccaccatcgtcatgaatcatgatcatcagacaacgactacgaaaaaatcataagtctacttttattagacacacaaatctgtgaaaatggcgatttagttaataataattcgctcaactttttcttaatcaatcaaaggaataaaataacaaataataataagaccattttttacttttccccttctttatgcaaaattcggcctcttaattttcaaaattttcgacctccgatctcccatctccgcttccatcatctttaggatctctcaatctctttcttcactgatcgattagggttttcgagctgaaatcgatactcctccaccgcgaagaagcgattacctagatttttcttctaggtttctggcggatctcgccaagttctccttattctcttcagctacggcgaaactttctctagctccactcctccctcgccaccatg

SEQ ID NO: 22868 - DNA, 3003 bp, Unknown
  misc_feature (1)..( 3003): 2750-1469P.txt file - cDNA_ID_2123707; gDNA_ID_1620739; Annot_ID_166361
tatgtaagtgaagacttggtgtgaagccttggagcttacgttagaagagcaaaaggcccggggctagggtgagctggggggggacagcgtaagtgagcgaatgtgtgtaagcccagtcaaagatgactgttctaagcggggggagccacccacctttgaatggtgttggtcctacggaccgtgaacggatttcgcctctggcctctgggcacgtcggaaccgcgtgagttcaccggggtggagcacggtccgccaaaaccggcatagattaggtgctattgatggaacatggtaagcctatctttctccatatggaagtgctgcgagcacttagagatgcgggtagaggaagcctcaaaaagcgaaggccgagctgtaggtcacgtgacctgcaccgagttggtggctgactgggctttttccttgatcaaagcagatcaactcgccttctttcttgttacccaaaactaaagttggtcgaatggtttttttcctgccccggaacgtcgaatgaaatagggggccgggttctctttctacaacccttttgatatgataggcctggctacctttcccctatcccttatgattagggggctgttaagcccaagaacaaccagtcttgtggtggtacggaaggaacggactccgcgaacgtcccgcgccccggaaagaaagtctcaaccagaaccacattccttttgcgtgcggatgtagctaagtgtctgactctattggtcatagtttcctgctgttgcggctggtgctcgtttgcgcgcgcgtgaaccaactcaacaaagaaggaaaggatgcccggggaggcatctgagaatgattcgagccgtatgaagggaaactctcacgtacagtttgttttttttggggggggcaggagcccgacagggtcccccactgacttggcccgggcctaagttaaagtgaagtggtgggcctacccatcccaaccaggggtatgctgggattcgcgaagagcagcaccttacgatgttcatgaccaatcggatcttgacgtaccagtaggtaccagaggagatcgctatgatcgttactgtatccgtatcgaagagatgcgacaaagtcttcggatcattgtgcaatgtcttaatcaaatgcctagcggcatgatcaaagccgatgatcgtaagctatgtcctccatcacgatgtcgaatgaaactatccatggaatcgtgcgtcgtgtgaaacgtagatcatcgccgttcttaaccaagactcaggttaagctccgtctcggaaccttgtgggttaggagtaaagcatcccggggttggcgcatctcattgggcgtagagaagcattgggaaccccaatttatttcttcggagccgtttcttttcccgtcccccccaccccggcatagcgcttcgcttccggttcttcggaagaatcaacttacttctaccttcttcattgatctgggggaaaaggaaccgtctaccagttgggaagctagacatcaagtaagtggcttgatgaggataactaagctgacacgccggagttggctgctggcacaacagggtggtgccttaccgcaccgcaggcgaacgcgcggtagcgttcgtggtggtgcttcaggattccaatgtactgcgtccaagatcagaacgagcttgccggcggaccactgccgtcccattcttgagtgagctggagcgcagccatcttatccactgaactagctagaagctatcgcttcgggtcgaagcactaaaagaaaagcaccgggaaacgcggcggcataggaaccacgggacccccaccctactagtaaagggaaaacggaagtgcgctcctgcgcaccagctgaaaaaagccctttcccctttctctgataataaggaaagcttcttagctccaacctatacaaggggtttttatgtcctttttataggttgggttgttggatacgggatcctcgtagtaggctggaccaacatccagccgagagagggcagcctctagaagcaacaggttgggaaaccaagagaacgcttcgccttttcttatcttctttctgccctaggagtagaagtagcacaaaaagagggattcgcattattgacccaatgataaaccactaacaccttcctcgttggggctccgcgcactgggaaaacgcttgacgcgattgggaaaccggccactagttacaaagctccaataaggtatcgagagggctatcacagtcaggtgcgaagaattacccctatttggaaagtacccttcttcctatttagggggttaaggcgagaaatggcttgatgaatcgttccgttcgccatgcaccggccccattcacttgcttatcgtagaggctgtaagtacacagtgccccacaactatcaatagtatagtggggttgaaagacgagagtgcccgccctttcttttctttcaagtgggccacttttttcccgaacgcagtccgggatcaccgtggccgtgtatatatatatatatatcttcgatgctgtcatttcgaaatgtccgcttcaatcgctctttcacctccccccaaaaaaagcaaagttggcttaacgagcgcagatgtgaggaagcgggagcaataaaacaaaaaaatatctttcttgtccttctacttaaggggcaaagagaagcgcttttgctactgagaaagcgaacggtcagcgcgaaggttcaagacttttctgagcgttagcgaagctagattctcatagcgaggcgcttcgagttagcgaagcctgtagtagcgccgaagccctatgtgctataatgctgagccaaggacactccgccttattcttataagaagcagtcaactgagttctgaacgaattagatccttggtaaatggctcaatctatagatagaaagccttatgatgggaaactaccacgttaggtttggagagagatgggaccggttatataatagagggagcagatgcaagcttttttctttcaatagccggccaaatg

SEQ ID NO: 22869 - DNA, 3000 bp, Unknown; identical to SEQ ID NO: 14092
  misc_feature (1)..( 3000): 2750-1469P.txt file - cDNA_ID_2123774; gDNA_ID_2214698; Annot_ID_189589

SEQ ID NO: 22870 - DNA, 3003 bp, Unknown
  misc_feature (1)..( 3003): 2750-1469P.txt file - cDNA_ID_2123774; gDNA_ID_1971666; Annot_ID_175034
ttagtaaggtaagccaggtaagccatgtcagttggtaagaaagtaatcccttccagagttgtaaggttagtaagcttttcccgtttataggaatgggtttctaagcctaggaagtcaaggaagttgtgttggtctttcccctggttccttgttcccctgttgcctttctcttcatttcattgacgggttggagaaatgttcacgacgtaagtcagtggaagcaaacgggcaatcggctgcctaaaggaccccatttgtggttgaaggctaagttcattcttcgatatatatcactccgctatgctagaagactgagcagcttcagtttattaccaacctcgagttcaacaactattgggtaaagcctaaaccttactcctttccttctatcggaactggcaacagatctctagatccgatgcaactagaagtcagtcgattccgtctgaaaatggtttcagtccaaaccttttttgtcgagtgaaactccgcttcttaagagcttctttggacagactcactcccttactcgctgggttggcgtatccaaggtagcgccagcagcaagcgtaggggttactacgtaagtgcgttcgttagcgcgttacgttttctcgcttgctagacacgacaactaaggatagacgcgctgggatagcaagcaagtttgttgaaagaggggcagtagattctagatctgctgaaaaccaggttatagggctatatctttattccatggtagggctaggggcagggtggtttaaaataactccttttactttccctcctacaattacaatgggaagggacgagacaaagccttcttttaaactaaataaagtaggattccgctttcactgttctcaaggtatctcctgactcgaagattagggcttcttcccagccggaggcatccgaaactggagaatcatcaaccctcgcataaagaaacaactaaactatacgcggcaggttggtcaaaaagggaaagaaaaaggtgacatacattctattcggggacataatagtgattcctatcgagcacactctgttatatcgatcccaatcaatagtttttgggggaagtcgatggtcccccccatgctttatgacatcttttctcttctccgtagtgatcagtgtatgcacgtagcatcacagtcaatcttttatgcttggttccggtcgcgctcttcttctaactgcaggagcccgacagggctgtcttactctttttgttgctaatgaataacctttttcttggtgattcatttccaagggaataaaagaaagacctgtgactcattgtctcaatcataacttcaaacagaacctcactgtagagagggagacccccgaaagcgtaagaacgacgatttttgagcctgagggtgaggttctccatcgacgagtgagaaaagggcctggtctcggaagagatgcagctaacgtgagtaatagctgaacagttgcctaatgcatgtggtcagcatcagacaaggttataaaatacatctttacatcccggtcaaagtaacgaaaaaagacgagttttagcaactttttcatacagttttgccctcttttatataaaaaactaacttacgcaaatagtaaatgagaggaccttagcacttttcgttatggagtgattcatctaaaattcccggggttttgtgaatgaattcaactagaaaatctcaattgcacgggattcgcgattcggtgtaagttcaaaatttatcgtgctggacgaccacggttgagttttgttgtggatccaactccaagcgtttgcgggattttggatagatggaatactcttgcaacggagcttgtctgtcaaatctggtctggtatggtagcggttcacaatggcagctcattttcctggaatccgggtgaaagatcttttctttccaaggtctttgctttctattcgacttagcgatggagtcgggtcggaaataaatactaagtaaaggcagacttacaataatacgcaaacaagggtcccgcgatgtcttgtacattctaagtactttgcctgctaagacgtgacaaacaatcgctgattctttactaacgagcccagtagccactaaggcgatccgaatgaggaaacgccggagtgaccgagtgtcttcaaaaacactgcgccaagagaccaagcggagcctctcggtgaatgtggtaaacaaattgaaagccatatcaatcggtataaaatgacaaaccttttggtatgtaccacaaaacactaagaaagaccccgccggttctactctccttgacccgtggacaaacgccacgtgatggacggcgcccggctctgacgaagaaccagtaagattaggtattgcctaatccgtaaggttgtcatacccttatcagctttctgaccaaacctctgtgttgccactttggtaaggaaagtccaccaaccgggcatagtacctcgttagcaggaccactattgctccttttaaagctttgtgctcaagtgatctgggagggtgtcaaacctcccccagccccttattcaggggatggtgccagggagtttgaactgttaacaaaagattttctcgatacaaagaagagccccactcctagaatagttagccactcagtccacagattcggcttagtgaaaatagccctagaaagatcaaggtgcggaaggataatttcctccgttaatgatagctataccatagagttttccatcaaggaaagacaatgccttctcttctccatcctccaggtaccagggaagaactctatattccgggtccaaggatgatggttgcaacgccccgcgcttccaccaataagaggtgcgggggatggtgatatcccttgaaagacataactaacttacaagacttaaaatgaaaagtaaactaacggaacaaggcgccggaggaacccccttctaaaagtctaagagctagaaggcggggtacagcggttgcttcctgtaagatttgaatagtcatg

SEQ ID NO: 22871 - DNA, 3003 bp, Unknown
  misc_feature (1)..( 3003): 2750-1469P.txt file - cDNA_ID_2123815; gDNA_ID_1971666; Annot_ID_175065
gctctgcctgagctggagttgtccctccagcgagagttgctttcttccttgcttgatcggtaggagttgccgagatagcaggtattagctgttagccgtcggactcatttaaaggagtcctatcgggctacactagtctaagggcagttgagtaaccgattcctacgcttcctccgcttacctccgtcgcttaactattaatacgtcgcttacccgcctccgcttacccgcctccgtcgcttgttatctgcttcccttagctaaaacgttaggcgatagtgaaagccttcactctcttatatttacgtacacgtgggaagaagacctagtaattgagtgacagcattcctggaccaattctataaacagccaatcaggcatatcatggtacaggtgaaagaaacttatccaatacagatcttatcacctgcccatcaacgctcaaccgtctgctcctctcgtgcgtgtaggaataatcaaaagaggagacagcatgcctattattaagaacccaattctactaaaaacgataacaacgattcgaggttctcaatcaaggcagaaagcaagaaacccatccagctaggaggaaagcaaatcaaggagaccaatcagacatctagattctatagtacgcgtatgtgtacgtacccaggctaaaacagcaaatcaaacttggctatcgtttgagagcaacctatcgctaaacacaaaccaatccttttacacagtccattgaaaggaagaaaacaagggtggaaattcatgttcctttttacacagacctccaaaactcgaataggccaatcttacttttcctcattctagaggttgcaagggaagaaaacaagattggttctttatgaaacctggttcaaagcaacgaactccgctctctcccgtgggcacattcctattatagtaaacggggacttctctctttattcctatgcgtgctttacttgactcctctgaattcagaacaatgacttttaggctatttttccccaccggcaagaatgaacttctatgtgttaagcaaagaagaacagaagatctattccagtagttaggtacaatcttggacggccggggacctacttcgcgggaccgcctaaaaggacttggtccacacgcggcgaagtttctttgggcggcgttttatcgattgatatctaaagtgactggaattcgaatcttcttatataaggaattatcgattataaacttcttatataaggaattatcgattataaacgaggatgaaagaagttaggaataaaaacccgatgttgtgttctcatgcccggtcgaagtccaaggccaacccggtctgttgccaatgagttgtgaggaagtccaccgtcaagtgcgggatgtgaggccacgtcaactgtgtatgttgctgcgaaggtcaaccaagtcgaggaatgcgctgcggaaaaaataaaagtcactgaggatttgccttcgcggataccaattgcttggatggatgcgtttgaaagcctcgagatgacttgcagaaaaaatgctttctaggtttgtcttgtgtctccgtaacaaatggtccatttattgattaatgggcgaacgacgggaattgaacccgcgcatggtggattcacaatccactgccttgatccacttggctacatccgcccctaccctccccgcccttaattttgtttcactgtcataaaacctattaaacaactcatttacatttgtatcttagcaccaaactaaaatgaaattattctctgcctaatcattaataatcattaatgaaggggcccgcctcaccactccacttcccctttttatggaagcaaccaaactcaccatgacaagggccagcgctcttacagcgaaaggctccttttctctagccaaaaacattatgccatcaagccaagccagctcccgaatgtctttaatcgagagaggtacagaatagtcgaagaaagtaagcaactgcgacaagaaaggacttataagataacatggaaaatgagatttcacttctagttatccgccaaggaaatgccggaggaattctatatatagctgagcgatgaccgtttcgttgtgcatcttggatacagtaccgaaggtctgctctactaaaactttgtcataatgagagcggggatcatgaagattgaaactattcatgttgttttctataaactccaaggcttctggtcttatggcccagggtgattgagatcaaattttgattaggcgcgcatccggttcgtttaccaataaagtaaaaagtttattttgtaaatgtgctttccgctccattattataatgtcgaatagctcgttgtttagggcactttgatagtgatgaatgttgactgcgtggtccaaataatctctgaaaaaggtttcgtatttaccgaagtggaggcaatccatgaactaatttttgaggtttcgtatgcgcgaaaagagtttcgctctcaacttcgacgttctctgccctatattgtccagccagggatgtaaatcaagttggctggttaaaaacattggtccagcttaagcttgacgttgaatgggaatttagagttccaatccagctagaagaagcgttgttagaagcggcaaaagctatgagattcgaatcataggcaaggagttgtgtcaagaaaaaacaaaagacaatcgaaatggacaatcgacggatggcaaaaagatccaataactgagaaagacaaaacaaagattcttttcgataaaatacaaataagacaagatatatgagcaagaaatctgccaaaggtcttcgagattttgtatttatatgtcgctctattaacagagccgtgtataccggaaaaaaaaataaaagcgttatcgggtttgaacaactgagttgttataatgttctttttcattttaataaagtgactccgtcgcgatgttttttttcctcttcttatgaaatatgaaattttcattttatttcttcaccgggcttggaccatg

SEQ ID NO: 22872 - DNA, 3003 bp, Unknown; identical to SEQ ID NO: 18364
  misc_feature (1)..( 3003): 2750-1469P.txt file - cDNA_ID_2123863; gDNA_ID_1621133; Annot_ID_172546

SEQ ID NO: 22873 - DNA, 3003 bp, Unknown
  misc_feature (1)..( 3003): 2750-1469P.txt file - cDNA_ID_2123870; gDNA_ID_1621133; Annot_ID_172552
tcatgtttctgttcaagatatggcggcaactctccatccctgatcaatcaaatgttgctctctagtatatattatacatgttgttacatctatatccaaaaaaaagtgaaaggtttagaaaagtgaattacttgacacaatgggaactcgagcagccgcagctacaggtaggacaaggaacaatgttttggtagtagaaggcagagagtgaaacgcagcattttggcgatggtgatgaccgaaactgcgagtatacacacactgcctcccatgttgctgcactcaacaccacatatcttatgttacataactcaaaaaacctatgtataacatgtttctacatttctcaacttctttttgtaattatattgcaatttatataattttggttacctagagcttgtgttttgcgacggcccttatcagtactaaacttagtcggggacacggatgtagcattgtcgcagctataacccgggacccctatatcgaaattagaaggcatattgaactcctcagggccatcaggagagcttccaactgtcatgtgaaaagcagagacgtgattggcgtggtcctgagacatggaagtcaagacgcctccacggcaacaattggcaacttgaacgttgagagaagcaccgggaagaaggtcgactatggttggtcgctcgagacagcagtgaggaaggttaccgctggaggcaaaggcagagcaattaccttgctccgtcgtctcagctcctttcatgtcccatatcacttcttggttgagccaatgccagctaagcttccaccctggcttttccacgtgtcgatactcttgcatgttctctaacgttacttgtacctgcaacattacattttcaacattccaagcattataagctttagtttttactttttcgtttgcaaaattaatgtaggagtatctttcaattttaggtaaaatcagtaaacctaaacttaacaatatataataaatttgaatcatcattgaacaagggccacattactttataagacataacagatttcataaaacgtcaagagaacaaaaaaaacgagaaaagaaaaccaaactttacaagctttttataatcagaaaatgattttgacaaaatcaactttgcaggaaacaaaacaaacttttgagtaacttcttcgtctcaagcttaatattcggacactaatttagttattttcttttgttatatcattaagtatttttttttataaacccagattctcccaagaacaaaaaaaggaaccccagattatctgaggctcatgcgggtcctataatcagacacagaaataaaacttacgagaaaatatggagaggaataaaaaaaaacaagagaaggaagaagagttacgtggtgttggccaggtgatgataaaagaagatcccatttgataatgatttttccgaacggatcaagaggatcgtatccatctgcaaccattttatcaatcataatcataaaccctacaaaacaattttcaaagattcgttttgtgataagaataacaaaaagagtctaaaagacttacgtgtgggtgataagattgaacagagaatgacagtaacgacgagcaaaagatttagcattgcacccatttttgtctcacagacgatgaacaaattaaacgagaagatcaaaataaactagtcacgtcgaatttcagattccgatgaaaatatttttttctaaaacgtgaattttgatttggctttgggaataagaaagagagagataaaaatctcaagagttttaagtgtgacgcctcgggtttctctgtgttaagagagagagatagagagacaattaaagcaaagaagtcacacagtgactgtttagtgtttgcaacgaagagttttgcatttgtgtacacaacaacaacaacactcttcactctttttctttctatttttggatttttgacttacttttattttttattatcaaggctattagctgtaaaataaaatcatttttaccttatttgtacactcttctaattcttcaagttttctggtagtttagtaggtgccagctattatttttgaggaatgattcacgtacgttatcttcttgtaactttttaattttctgtatttttatggaattcaatccaggggcattagcaaacaaaatcatttgattttcactaggttatcagattaatttttgaggttaacaaagatttggacatcactacatcagtgaatatatatagcaattatttgattatgcgaccataataatattgtatggtatcagttattctagagcgagcagcttgctctatctcttatggcattgatgaaaactttttaactaagcaaccattatataaaattacgaatagaggtcacaaatgattcatatgcaattaaacatgttgaccaaggggaaataaataaagattagaatttaattagagaagaatgtgtcagaaagagatgcgtttttcatgagcgtcaacaccaaataagctcttttcacgccttccttaggcatttcgtttaataaataacatagagacgaaatttaattaacaataatatgccgttataaagaaaataacagtttttattgacaatgtaaaagcacaacgattattaatttattatctttcaatttatatcttaaaatggaaaaacaaaacccaatattaatctatcaattattcatcttaccaaaaaaatctatcaattattcaaaagtagtgattagtgaatgaatatatttcatccttcatttgaagtgtggtgcaagacgcgcgaaccagagaaataactctaatccggtttggttcgatttataagatcaaaatggtttaaattttggttcattaagtttgatcggtttggttgtggttttttattgtttcccaaactgccgatgaatagtcaaagttatgtcaagtcggtgatcggagaactttttgacgccgagagagagacagagaagaagcgagagcgagagagaaatg

SEQ ID NO: 22874 - DNA, 3003 bp, Unknown
  misc_feature (1)..( 3003): 2750-1469P.txt file - cDNA_ID_2123892; gDNA_ID_1621133; Annot_ID_172556
ttatggcctcaaattgctgaatgtgcaaattaaataaagaaaatatttgtttttctacttgttctttatttttttttggacaaatttgtacttgttcttttaattaagaactttatgttgcagacgtcaaagaaaacaagaactttaaaatagaagttttctcgtaacgtagatgaattatgtatgttcatgcaaatgtgtatagagatacgtaggtctacattaacattacatatactaaagtgtatagagatatgtatactgattagggttttgacagatttgaaatgaaatgttcaattaccgtataaaagtgggtttagctgcaaattattatgcatcattgtttccttaattaggataactaattgaaatcttactgtgataattaattcacaaaactaagggtaaattatacaacgcttttattaaagcagccaataggttctctttgttgttcttttctgatgacacgtagaccccatcttcacttattattgtgaaataacaacaaaaagatgtcacactatagctagtaaacaccacaaaacttgcatagcaatttcttaaagtagacactagacaacgaatacagtccgtataggatatactgtgtgttattactttaaaaaggaaagaaaaagaaacagttgatatacctttttctttacatttgccaatataccaactaatattgtatacaactcaatttcgaaaggtttaacgtacgaatcaactaattattaattagggttgtaaattaagttctaaatcctgaagttgtcagcaaaagacagtgaaagtcctgaaggggatgagatcataggaataaaggaccaagattcatgtctgttcctactacttagggaccattattacactaactctctgttaattctccttttcatacttttatctataaatatatatatatttatcaataataacaccattttgtaagtatatatatatacaactcattatcaacatagaacagagtgtgttttgtttcttcttctctgctctgcttttctcttccttcacatacaaacaaaggaataataaacgaaaacgatgtcgttgattgcgtgaatatatctcaattcttttctttcttttcatagatcatcgaatttccaattgtcaatttttaacttgattcttgataaaagactcatctgttcttctccacgttcttgaaaacaaaacagaggaagaagaacaatctgaaggagttcaggctcctgattcttctttctccagttcgatatttgttctaaaattctccaaagagttaagaagactcatcgacttcaaatcaaggaacggctcaagattcgcatgccacaaggagaaaatgaacaagtcaagctcatggagcatatacagtcccagagagggagatagtgaagggccatggagatcgtcaacgtcgatgaatgcgatctcatttgggtttgtagcgacggcgatactcatctccatgttcttgatcatggccatattcgagcatctctttaggcctgagaattcttcatttgattcaccacatcagatcagacaaagacagagagatgggtccagtcagttccagaaacttgctgatcaagcatccatggtaagcacaaaaacaattaaaagttattaaagcatttctcaaaagaatttttgtcctttttataaagccgagccgcattaacttgccactgttgagtttagtttttcgtttgtttctgcaaaataaaattgcttttcttttcggtgcaaaaacctttgaaaagtcgaaaacattcgtcaaaattaatacaaaaaatataacccaactttggaaagtgaaaagcaagacacacaagttgtagtttaattctttgctttcatatagaatatttttttttcaaaacatctttacgtacttgtagaattgttctttgttttatagaattaagtcgcaattaacttgttttaagttaatgataaggaatgtaacggtggcaggttccggtgagtacggtggtggatgtatcggtagtgatgccaggggagaagttgccgtcgcacatagctttgccggctccgttaccttgtcggagagaaggcattcattggcctctccgcctctaaatattactatagctattttcttcttcttcgtcttctgtaatttttatttatttatttctgactcataaagtagattagtattcgtaatatatttcaatatgcattcccgttacgtgaatgatcggccaaaaaatatttccttttttttttttttttttttttgtcaaaatagatactcattgtaaatttaagattaaacttttgtaattatgctttttaattaacattttatgtctaactaatcaatttgggataaatcacttttagaagttagaaccagagtttttaatagcttaaaaagttaaaatatactgtgtatccaatataatgaagctccattacaaagaaagagatttcaaccccactatatatatactaggttcaagtgtagtgacatagtgttcatgagtacgtgtagtgttgagtacgacaaagttgaatgatttacgccttcacatgtattatcaacagttaaattccaaatgtaataaagttatgggaccatagttcaaaactttttatttatatggtttctacacaagtggaaacaaattaaggatgaaaaaaatcccaattagatttacatagagggattcttgatcttatttcgtatggtgcaatatcatcctagattcagatgtaacttacaggattttaaagatacagtatgatttctatcaatttttcttctcgaattcgaaaagtataagatacaatgggccgataatgaagcccattactatcagtgggcggatttataaggccgagacaaaaaaggcaccttttctatcaatcgtcgcgtagaagctaaaggaaagctgactcaaagattcaaaatttgaactgcaacgagagagagagagaaagagaaaggaggctatg

SEQ ID NO: 22875 - DNA, 3003 bp, Unknown; identical to SEQ ID NO: 18351
  misc_feature (1)..( 3003): 2750-1469P.txt file - cDNA_ID_2123940; gDNA_ID_1621133; Annot_ID_172574

SEQ ID NO: 22876 - DNA, 3003 bp, Unknown; identical to SEQ ID NO: 18350
  misc_feature (1)..( 3003): 2750-1469P.txt file - cDNA_ID_2123944; gDNA_ID_1621133; Annot_ID_172575

SEQ ID NO: 22877 - DNA, 3003 bp, Unknown; identical to SEQ ID NO: 20502
  misc_feature (1)..( 3003): 2750-1469P.txt file - cDNA_ID_2124035; gDNA_ID_1620746; Annot_ID_166679

SEQ ID NO: 22878 - DNA, 3000 bp, Unknown; identical to SEQ ID NO: 4941
  misc_feature (1)..( 3000): 2750-1469P.txt file - cDNA_ID_2124042; gDNA_ID_1620746; Annot_ID_166681

SEQ ID NO: 22879 - DNA, 3003 bp, Unknown
  misc_feature (1)..( 3003): 2750-1469P.txt file - cDNA_ID_2124057; gDNA_ID_1620746; Annot_ID_166685
tttgagatggtgaccgtttcaaagatgtttacacttttacttacttctttcaacggggtttagtataaaaaagaacaaaggaaaagtagcgaatactttttgacgcaaatataactaacaaatattttttgattcaaaagtatatgtacgtctttgaaggtttttttttaatcttttcttcaaaccacacgagaaaagacaaaaatgcttgcaagtcaaagataagaataaattcactcgtttcttgaagtattttcaaatagacactagtattttcttgaagtccaaatgttagaaaaagaagtttgaattcttccttgagtattagcgcgagaagaatcacaatttttatgaatatttacaaaaacaaagtggcaaaatatccaagatccgacatggagttctcggaccttattcacaaagacacaaaccatagctaactataagcgtaaaacgatcacttataaatatagagacacatatctatttcttactaatctaaaatcatttcttcttccacaatactaaaagcaattatcaaaaatatatcaaaaccagtcttcatctctaaatcactctttcgcttaattcaatcatttcatttcttcctcgtctattcaaaactcttcgatgcaacgtttgttaacaccttgctcaaaaatcgcatacacaacaagatacattgcaaatccaaccctaccttacccaaacccatgtgatattttcatcaatcatcgtgggatcgataccaagaagactatttcaggcctactatatgattgtttcactagacaacgtttgactgctttcttggatagtaagagtttaaagcctggagacaggctttttgtcgagatcgacatggcaatcaaagcatgcggggttggtattgcggttttctctcctcgttactgtgactcttacttctgtctccatgaactcgcattgctcgtgaagaacaagaaaagagtcatccctatattttgcgatgtcaagccatcggaactctgcgtaaaagacgacaagacacgtccagctgccgagatccggaggtttcaattggctctcgaggaagcaaaatataccgtaggactcacgtttgatacatctaatgggtatgctcttgtttttctacattatatatatatatatatacatatatatatatatatatatatttatcatttttaaccatatgaatgcaatatatagttcatttttacatattaaaatattaggattgcttaaaataaaaacatagcattttattttataaaacattcgactgtttttttgattacaggttcttttacgaatttgttagaaatcatacacgcaatatagaaataacaatcttatatctcataaattattatttggtaatgtaaatgtgcttgtttctaaattgagttttctattgttcagagactggtcagagttcttggccatggcatcggatgcagtcacgaagaacttgttagaagttgaagaaaggattggagattaattaaggagcatcaacaccacgtacaagctgaccattaccatcaataaaattaaaataaaatgaaggagaaaaaatacgctaattttccttgattctaatataatttaattgatgataattctattttaatttaattgatggcaattaagtattttgtgaattttaactactcatttttcgatgaacttcatcctcgtaagaagttagttaattgtgtttattgattctcttgtcacaaagtgatttattttgtaacctatctaatcatatagaaataattttaaagagaagcaaaatgtaatttcccattattatgaaatgtttctcgcatttttttttatctgtttccttatttttaaacaggtttgaaagttttcaatgaatccaaactgttgtaatatttttttttttgttgattagtcaatttaacattagaaaaacaattagtcaactaaatacttgagtaaaaacataatttattgaacataatcacaaatgctctacactgtattactgttaatcatatcaattgaaagaagctgttaaaaaaaaaaaaattgaacataatcacaatttcttttggtatatatatcgagtgatcgaatttttacaaatacaataagcaaaattttcacatccttctagaagcattctgaattaaaataaataatcttacatttaggacgaattccaaatttatatataatccattctgtattaaaatatgtatcatttaaaaccttgtgcaactaaatttgtttggattcacattttaaaatcctcacatttcgcataatgtttcaatatataaatctattcattgcttgatcattatacatttctgacgatatcttttttattctcacttgcaaatattttcaagaaaccaaaatcaaaatttattcccaatccaaacaaaactcataaccctaattccatagatcattcttgtcatggtcattcgtctctcatatgtcttttccttccaatatggacctactcatctattaaactccaattaagaataacttctacccgttgaggtgggcttacaccactttccctaaacggtactttgttatgttgtttgatatttcttttctagtgtctatgatatatcgatttaatagccgacaagagaaaaaaataacacatactataacaataacattgattataagaagatggatcgattaggaaaaataattaaaaaaaaacgacgacgaggatgagcataaaacataattgaatggggaccactaaataatagtattggtcagtcactaatgtgaatccaaccatgtgccaactcttaactcatcctttgctgtcaccgaaagcttcgaatccaccaaaaaaaaaaaaaaaaagtcaatatgtctccttcacgtctctgcctttatcttcttcttccttcttctccatcatcatcagagagacgaagacgaagaagaagaacttcactggttattctctctccgtagccaaccactatg

SEQ ID NO: 22880 - DNA, 3000 bp, Unknown; identical to SEQ ID NO: 7668
  misc_feature (1)..( 3000): 2750-1469P.txt file - cDNA_ID_2124091; gDNA_ID_1621156; Annot_ID_173504

SEQ ID NO: 22881 - DNA, 3003 bp, Unknown; identical to SEQ ID NO: 18588
  misc_feature (1)..( 3003): 2750-1469P.txt file - cDNA_ID_2124101; gDNA_ID_1621156; Annot_ID_173507

SEQ ID NO: 22882 - DNA, 3000 bp, Unknown; identical to SEQ ID NO: 7674
  misc_feature (1)..( 3000): 2750-1469P.txt file - cDNA_ID_2124179; gDNA_ID_1621156; Annot_ID_173535

SEQ ID NO: 22883 - DNA, 3003 bp, Unknown; identical to SEQ ID NO: 18576
  misc_feature (1)..( 3003): 2750-1469P.txt file - cDNA_ID_2124222; gDNA_ID_2926150; Annot_ID_198026

SEQ ID NO: 22884 - DNA, 3000 bp, Unknown; identical to SEQ ID NO: 7640
  misc_feature (1)..( 3000): 2750-1469P.txt file - cDNA_ID_2124222; gDNA_ID_1621155; Annot_ID_173454

SEQ ID NO: 22885 - DNA, 3003 bp, Unknown
  misc_feature (1)..( 3003): 2750-1469P.txt file - cDNA_ID_2124274; gDNA_ID_2926150; Annot_ID_198006
ttcaaaaattgagaaatctagatagacataaatgaatcatttaaatttcattagcataaccaaacaacttatatattttattcatgttttttactttcattcttttatttgtattaaatgtttcagttactacaatatattattacatttaacaaactaagtaccgaccaataactaagagcaatgaagtgctaaaacgacaaacagtttactcatgcgtaagataaacgtgaagaagttcaaaacgaaacaaacttgacaaaaaatgaacaactttgaatgtaactgtacacagagccagaaactacaaaagtaaaaaatcatggtatattcgaagatgaaggaagatcttcatgatattccaaacatggctgagttctaaccatcgtcgccgccggcattctactccgaccaatccaaacatttccgatcgtttcactcttctccgactctctttccatatctcttaacctctttttcctcactaacttcaccgaaacaatgatcaccacaactacaataaccgaaactccaatcccggttaaaacaatccaccaccaattcctccgaaccaacaccggttcgtgtttcggtttgactttctcctggtttaggacaacaagtgcgtaatgcccatgagaattcgtagtggcacactcgtaattccgtatcgtattgctgatgttcaacaacaaaccattatctccaaagacgatgcatttgacttttgagcgatcacgagaagcgtgaggatcgaatttgatcaagattggcttgtctctcttgatcgaaaggttcaattttttgagatcattcgtgttggtcgcgtcataaccggtgaatccaataaccggagaaacaaatgagtaattatcagctaaccggaagtaaaccgatgaagagttatcaccgaaactctcaaagacaaaagctattcttttagcgtacggcgacgttttaaccatcggaggaatcaaaacaccactaaagtttgttccttttctccagaatatactgttacggaccgtaacaaccgatgctttgatgtcggaaagatttgacggaagtgaaacatcgtacaacgagcctgtgtgtcttcttgtagtcgcacgagccgcgtatgaacggatcagatcgtccaaatctgaaatgttgttgatgcaatgaaccatcgtttgtagattagagatgatgcagaagacgaagacgatgatgatgagaccaagctttgtagatcccattgccaagagaaaatcaagaacgacgatgatgaagaagaccaaaatgagttttggtgatcttcatcaagattagtaatataaaaaaaagaagctatgatatgattttgattaaaggatatgaatagaattgtgatccagatagataagaatcaaagtggaagaagcatgattgagatttggagacatgattgagattgagattgaggttgtgatgagggaatataattaagcacatatacacactcaaaaggaagtaagaggacatataataaaaatgtaacagctgcatgaaatatggatttgatgaatgtgtatggttgattaaataactattatatagaaaaaaaagagaccgtactttgatattcaaacttgtaagaaaaaaggggagagaaagttgggtttgagctgtattaatggtggatgctttttttttgacccaaaattatattgaagttggagtttatttttttttctaatcaaaattttgtaatggaggtgataagaaaaaagaagatgtcggctatgattatatgccgatgacgtaacgatcatgcaatttctttggttttagtattcttacgattcacatgtaatatgattataagaaaatattgaatttttgttcaaccattctgtcaatttagtgataaaattaaaatagctgtaaaataataatactattaccacattgaaaatttatttttttcttcatattttaaaattctcatctttaatatctcatcgtggactattttgatgtgcgaacattttttttttttttttcgggtaaaaatgaacaatattttttatgaaatcgtacataaaaccattcattttttctttaaatacagtcgaaaattagattgtcattgcaaatgagtaaactatcagttttactataaaaaatgtatgtatatttattttgaattgaaatgttaatgcaccaacaacattaatataaaccattatactattatgttgtaaacttgtgattattgtatctcacatctatggactcaaataattttaaattctggtggaaaaattagatagcgaactctttgttttttcatgccaactcatcctagatgaatacgtatgttgattatattaatcatacaaaaactaccaaataagattaaataaaacttttataatatcaactattttgttatattaacaagagaaatggagttttggttagtagttgaaagcgccagcgaagtattagggtggaagagctgtaccatcactcaattttagtgggtttgttatttatttctctctttttgccacatttcttttatcaaaaagaagtttcgttttttcattcacttatacaaaacataatttagagttagatatttaaagttcattgttcgaatttctctttttagttaatctcgtattgtcctcgtaactgtcttatagtttggttagaaacaaaaatcaaaggtttgcattcatttgccattttttcctcacctagaaaaagacaagagttatcaaaaaaacaagatgggcttttagtgacccatataatagatgggcctaaaaccccacagaatgcgagcattctataaacaccactgagttggatttctaaagataagaggagcgaccaataagagcgcgaggagcttccacgtgttactacacgaatcttgtttagtaaaaagcgcagctgcaaaaaaaatcgagtagagaagaagtaggcagacaaagaagaagaagaagaagttctcggcgtgcttcaatg

SEQ ID NO: 22886 - DNA, 3000 bp, Unknown; identical to SEQ ID NO: 7648
  misc_feature (1)..( 3000): 2750-1469P.txt file - cDNA_ID_2124274; gDNA_ID_1621155; Annot_ID_173474

SEQ ID NO: 22887 - DNA, 3000 bp, Unknown
  misc_feature (1)..( 3000): 2750-1469P.txt file - cDNA_ID_2124288; gDNA_ID_2926150; Annot_ID_139261
ttgtataactttgaaagttaccaatcacaaaaactttatcaaaagtgttattaaaagttttatactcacctttttttaataatttctttgtatagttccttctaacagctttgcactattccgataaatctaacagctaaaaatcttgtataccttttggttaccaatcagacccatcatataatgtataagaaaattgcaactatgccatcaatcttgtttcttgtcttttcatgttttggagggtccatactcaaaacaacaaatcaatatcgagtttttatgtttagttatatacactatcattactttcaaaacaaagaaaaaagcctttaacaaaaaaacaagtgggtgtgtataaaagtagatgtcggaccacagttgataagaatcaaataccgaaagccttatggctattattctatgtgataattatgtagatcacacataaaaaaagttcaccagctcattactcatactcacttacatgatcaagttcaaattattaaaatgtaaaagtcttcatgtaaacaaatcgggccgttctaagcccatataatgaagcctgttatgcacctaaacaaatagggcccttttatcaattagggaaagaattacgggcctaaacagctcagaagttctgtcaattaaactctgtgtttccttagtctaataactaaccgataaaataggtagtaaaaaagtcaacgatagttatcccaaaaatgcaatgttaatatttttgtcaaatctgattggtgttggaaagtggactatctataaatccatctttaaatgatagacagagacacagagtagaagactttacagctgtacgtagctttttgtataaaccacaaaaatagtcagaaggcgacctacactatgtgatcatataacactccccatatatctttcaagtcttcgtttacgaggttaatatttttcaacgtttaggatccaggtttcttttagattcaagttgtgaattagaaaacaaacaaaagaagaagttttgagagcacgtcttctaacatggaagcattaaacttgacgtatttttatggactatattaatcgatatgctgggaggatgatgaaaaaataaagaatttatatataaatattagttatttaggtaagtatgaaagataaataatatataaaccaaaaaattttttttaaaaaaattaattacaaaaatgctattgaataaaaataattgtaatattcggatgataagtatataattatttgtttaatgttttaaaaactatgatatcgcgataagtttataaattatttgttaaaacatatttatcgatttaaaattgtaaatcagaattttttatttatgtatattcagcacaataaaaggaaattagacttttttatataattaacatgataataattataactacatgatatatagaatgataacatgctaatatattatataacagaataatatttatatgaaaacgttaagatattcgatacatgaataatgtttactgtaacggataatttatacataatatttactaataattgttaacgaggttaacctgatgataacaatgaaaatatttagtaacaaaacaatatatgagactttaattaaaaaaaagaaaaatacagaagaataataaagtaacttcattagttcttttactgttgaaatagtccacaattcctacacctaatttttcagtcttctgagcatataaagtgatattttcctatttttatttactttttaattgtattataataatatttgggtatttttggttattataataatatctgaaaatattattgatatttttggttatttttatatttttactaaaacaaccgaaccgatccgaatccgaaccaaaatcgaaccaagtttttagaatatctgaatggttctcaacctcttcatatccgaatagatttgatatccaaaaaagaaccaaacagatagggatacccgaatgaccagacctagtattattgatataaaaaaggttgctcaatgtataatttcatttgactagctggtctgttttcgtacaaacacactcacaaaagtacgaaaataggaagtcgtcttagttttagaaaataactattgctgcttattggcatatattgaaaaatcaaatactactagtaatcgtaagttctaaatttgaatgtttttttcccgagtaattgaattgttcttagtaattaagttcacaaatttggaaaattgcgatatctgagaacgtattaatttacctgtcggtaaacagtcacactcatgtttctagatttcgtatattttagtaataatttggttagtctccttatctgcgagtcaacgagacccggtccgctcaaccgtactacagtctaaattctagtttcacgcgcttacttacattacatacgcgctcatctcttctttactcaaaagttttaaaaaacgaatatcaaatcaacgctaacaaagtttgattttttgcttccatcttcttcccctccttaagttttcaaatctattcatcaaattttcttttgtctttcccttaagattcccgggaaagccaaggaaaaacgctagaagaaaattaacataataatgttaattgttgcttaaaccttccagctcaagtttggtagtaagtaagcagacatttaatcccccaagaagcaattgaagaagacttttaattcttctgaattttctttccaaaaacccctttttagaaaattggttgcatcatagagattggttcatttattcccaccggagaagatcatcaaattcgtcttctcacctatatcgccgacgacattcttcacggttcgtttgatttctacctgttggttcttcgttttatctgaattcaatcggagatatatgtttttgagttcgaatttgataaaaaatcgaaacttttttgatttgaatcgcagttggaaaaaaacaaagcaaaaccctagaaatagtggctgatg

SEQ ID NO: 22888 - DNA, 3000 bp, Unknown; identical to SEQ ID NO: 8176
  misc_feature (1)..( 3000): 2750-1469P.txt file - cDNA_ID_2124376; gDNA_ID_1621199; Annot_ID_174824

SEQ ID NO: 22889 - DNA, 3000 bp, Unknown
  misc_feature (1)..( 3000): 2750-1469P.txt file - cDNA_ID_2124700; gDNA_ID_1621127; Annot_ID_172344
aacatataataaatgcattatttatgatcttatattaattttcttcagtattaaaaaatatttttattagactccaacgtcatctcttggtatgctaaacattatcttcgagacttgaacatgtggttcttggtgcattatattggttaatggttattcaagcgtattcaagttcctcgtaatttagaaattctccgaccattaagttcgtcggaaacaaaatgttttcttgtagaatcccctgttctcactttccacacagaattttttcgagcaatttaagttagcaacttcatgaagttctttaaacctagagataacgtttttttacactcgagaatttcctgaatatggtaaattcaaatgacaaaatcttataaattgatagaaatctacaacaacaaaagggcgcccggtccaagtttcttgtaccaaagctattgacacaagttctaataaaaaatcctacaaaagacaaaatatggaaatatttattgatatttgatttacacataagactttaaacctttgcggggtatcgggtagccaactctttttataatgttgaaaattaaaatgaagaaatagaaagtcacaatctctaaattatttgttttgtcatacaaaagagattaatgtgactttgtagagaatatttatacgtacatataagcctaagcatgatcacttacgctttataatgtttcaaggctttgcaccactcccaccgttgctaccatcttcactcacctttgcattgatgacaaatctcgtttcaaagtttttagtagtaaaaagaacttcgctttgtacgttggtaccgactcccataacggaaacactaggttttccagtgttgttagtggcaagagttgcttcaccttcacgtagaggagctggtcttaaaacgccattaagaggagctttggtgccaatagtggctccactttctttgatgggagaaactcctacaatgacaccaataacaggagttttagtgccattagtggatccgccttctgttacatgagacggagcaactcctctaatgccaccactaagaggagctttggtgccatttgtggctccaccagtaacattgttagtagagtttccaattggctgttttttattcatgagtttggtattattggccattcctccgatcttacgtgctccaacattaccactcaaagctgcaatgaataccaccacaagtaacttgatgatattcatcgtttttggctctaatttttttttataatctaagataatattttgtttgtgtagctttgagattgtgttcctaatatcattcccacatgtatataaataatgtgtattttgtacttacttagagagaaatacatagatgtgaagagagttttatacgttttaataatcattcattatcttatagtgacaaataatgactcttcttcgcttcattgaaatttcagagatgcaatgtccacaagaatcatgcacacttgagccgtttaacgtgtgttgattcagatggatgactatgcgaaagtatagctacaaaatcacctaacagtcaaaatttaaaataattttccaacataaatgtttcgtatcgtggaaagtataactttcttttaaaacaaagacggtgattgcattaactcgtaccaaatcaataccatgggcaacttagagcatgtccaacggttaaggccctaaaaatttctaaaaagacaaaaaaatagattttattttaatagttataatctatttttttaatacagatagaccagtaataaaaatacatgtgttattttgtttgtgagctcgtcccttacttacgggttttaagagtttctctctcatgttcctactaacttttgattattttttactttttttattgttagggcctcacctaaaagcctccggttggggatggtctttaatgcattaactttcaaatcaatatgggattgcattcactttctttttgggtcttcaaaaagttcaaaaacctcaagtaatttccctacttaaattatccttaaaatctgaaaaaagagattaatcaacttcttaaattcttcttatggttttggtttacttttactttttttggcatatgatttatttattaacattgaaaataaaataaaaacaacttaaaaagttgggtttaagtttttttttgagctttaacacttgaagaatgaaatcataagacttttaagttataaaatcgaatatggacttaaatatatccggatatccgttatccggttcaaattctcggattattcgtatctatatctttattcggactatccgtcgttttactatctgcatatgttggccggctatccgtttgtttggataaaaatccgtggtaaaatatattaacctcatgcgtactttggtctactaataattagactataaatattattctaattttttggtgtgttattattggagttgtctcctaccaaacaaaaatgcgaaaagagtcaattttgaattttgatcattttgataaaaagtaaaagaatcgttttattaaatatttttaaatgatctttttttttcaaaatcaatcaaacccgttatatctagatatctattaaccggcctaaattctaggattatttgtatccgtcgtttaactattcgtatatctggccggctatccgtttgtttggttcaaaaaccggatacggatatccacggtttaaatagattaacctcatgcctacctacttttggtattctaataattagactattctaattttctggtgtgctattgttggagttgtctcctaaaaaaaatgcaaagaagagtcaattttgatcatttaaaaatatttaataaaaacaattcctttagtttaattggtatactgggccatcaatgggaccgaccaccaagagttgtgcaagcaatcggattatttagcgtttttgatgagttccagtaatctatttgcttttctcaatagctttaaaatg

SEQ ID NO: 22890 - DNA, 853 bp, Unknown; identical to SEQ ID NO: 7100
  misc_feature (1)..( 853): 2750-1469P.txt file - cDNA_ID_2124745; gDNA_ID_1621127; Annot_ID_172362

SEQ ID NO: 22891 - DNA, 3003 bp, Unknown
  misc_feature (1)..( 3003): 2750-1469P.txt file - cDNA_ID_2124777; gDNA_ID_1621144; Annot_ID_172948
tcccacgtaggtcactaaactccctttgatcgactttctgaatgctccattatagtgtcattaaagtttagttccattgagtaaagccatgtaccctccaagaagattcgaagtcacacagtcacacatgccttccagatgatccaaccagtatttgttacgtttttcgttggattctcaaaacagtacaagacaacattcaattcccgacgtctataaatgtcgttaatccattgttaaataatttaacaacgaagtaaccacaatcaattaagcatcgttagttgtttaactaaactagtttttcgtacttaagagtcgttcgtagttaaagacgtttaacccgtcgttaaattaatgatgcacgtatataagttttaccaacgtttatgtcaatgttaatttaccacattttggcgtcgcaaaatgacaattaaataaatcattgcaaattcataaagttttgcttaatgatatctactatttagcgacatatatgtttttttatagctaccacttatttttgttttcaaggacaacccctaacaacactctgtatgactgtatgtgattctgtaagatctcatgatctcatatcaaacttttttttttacatgtgatgaattctattattaaaatggaacaattatttacaattggttgggggcaaggagcttttatggccaaataaatgtaatcaccttagagaattagtacaaagaaacttgagtttactaagtgtgggaaaaccattaagagagcagatgtctacaaaccttttcgatatcatctagctagagaggaatgtctctgatgcttatgccaatctgccgaaagaccgctgtagaagttactgagacattgttgtgcaacctaatgtttctttctttccacatcaggaagataaaatttgtaatgactatgttcaatgattacaaaaataagaagagacatatttacatacatgagaaaaagaagattttcctggtttatttttgggatgaaatctcaatgtgtacgaatatttagttgtttgattaaaataaagatttctaattaagagaggaaattaacaataggctaatgatgatgtcttaatcttttttttttttttttttttgatgatgtcttattgttatgctggatgagttgggggactgcaaggtggcttcttataaggttcctttttctggggtcccctttttgacttgcttcgctttactcttgctttcatttggacaacaatttcattgctcctattttcatctccttctctattccctaatttatgttttagatgaatcaaacaaagcaaaaaagaattatgaatctttcatacaaaagaatcttcacataataacatccgaatattgtatgatctaactaaacctaaaattggttaacatacttagtctatgttattggttccggatcaagcaacgtaatgaaaacgaacgtgttaaaatgttttgactcaccgagcttccgatgctttggttgtttggtcgatatagcttttacttctccgaagaagaaagaagacaaaaggagcagagctgcgatgagaatcacgaagaatggtgcctttcctgtcattgtatatcttactgtccaaaaagcctataattttctaacttgttccatctatttatatagttaaaaatatccacctacccaacttgatttcacactaaaatgttgaaagaaattaaatctggcacataattgaaaactgttacttgattacatgtcctgtttgttatttttttttgttgtttcaatattcattttagatcttttcttactctgaacataataaaataaaatagaagatattttcttactgaaatatataattttgagatgcaaggtatactataaatagagaaaaaggtactgaaaatgttaaatttcttgattccgtactttttattttatttgatataaaaagaaagttgactttaatagagaaagatcataggaaattacacgaaggtttggcaaacaagtcatggtagagaaagtcaactagacgaatagttttgattgacaaattaaattaaagcctcactacagctgttgccatttcctcatatattcctagaaaaaatgttcaccttcacatgtgagtgcaccttatttcccggcaaaaagctctactacagtcacaacgacgaattcatttgagctctgatatacaatagccaccttactgcaaaactagacccaataaaccctaaagaacctctctattatttttttcgggcaaaaaccctagatacagcctagataagttcaatagattagatacatatacctagaaaaaaaatatcttataagaagagcgaaatatggaaattaaaggatgcgttaaatggtgttacttgatggaaataacaataattaaaacttgtggcggcacttttttgtaccttaattatatgcatctttaaggccttttgtcagtgattatgcatgtgataacatataggctatagaaggtggtatgctttattttgagatagggttagggttttaagatccctaacttaattatgtattaaaactgctcacacttagtgataaatgtgtcaactttctctcacgtggtggttttttttttttgtgactctgtttagctggtcttggtaatgtcattttatgcgtgtattgcatatttagtttataggtaaaaaattgtttattgcgtttcacatttaatgatgtttagtttcagtttgatttcacatgttgctctttggcttcagatttgtagtttcattttcacttacacttagcttgctttgattcgatttgctatattgttcactcactcttgtttcaaaattgttcatttttagtacatattcgacgaattctccggtgtggtatgagagagtcttagcttgttttgtgtttttttttaattagcacatgtcttctaactcatgttctgtttttaattagcgtcatgatgtcaaaagattcttgcttaaacgtatg

SEQ ID NO: 22892 - DNA, 3000 bp, Unknown; identical to SEQ ID NO: 7415
  misc_feature (1)..( 3000): 2750-1469P.txt file - cDNA_ID_2124820; gDNA_ID_1621144; Annot_ID_172962

SEQ ID NO: 22893 - DNA, 3000 bp, Unknown; identical to SEQ ID NO: 5680
  misc_feature (1)..( 3000): 2750-1469P.txt file - cDNA_ID_2124844; gDNA_ID_1621144; Annot_ID_172974

SEQ ID NO: 22894 - DNA, 3000 bp, Unknown
  misc_feature (1)..( 3000): 2750-1469P.txt file - cDNA_ID_2124871; gDNA_ID_1620742; Annot_ID_49629
actgcaagctccgggaaactgtattgattctccaaaccttcttcttcactgtactgcgtgttatcgcttttcaccgaactaccttcttccccaagtcttttcctctcaatagactgagtttcaagattctcttgcattttcagcttctctttgagaagatcgacctgtttgaatgtgtcatcaaaattttgaacagactcttgaaaatagtggcttgttaatctattaagaaactgtaccttgctcttgagggtttggttttgtacaaagagaatgtcccagtcagtcttgagcttagcatagctagctttaagagagtcacagtcgtgttcgagctgtttggtcttgtatctagctcttctgttttggaaccagacagcgacttggcttggctgcagccctagcttctcggctagccagagtttcctgtctggttcgagtcttttctcttcttcgaaactctcctctagtaaacgcaattggatcggtgttagcttccgtttcttggttatctcacgcatcatgtagctctcacatacgtcttcttcgtccatagttgcagtctctgtgttgatcattgagctagatcctgaattaagaagagaatgaggaatgacacaaattttatagaagagaatctgacctatgtcgtcacatgaggttcttcaaagttcttgctattcttttcaaactcttttaaaatgaaaggacaatcttttaatctgagtggttacattttggggatgaagattcgtcaaaggtgaaaaagatgcatttcaagaaaataaaataaaataaaattagaatggaggaacagagatataccataaaaagcagagtgagagctcggaggaaaacaagaagaaggaaacttatggctatggttttggttttggttctgaaaccaaaagaaaacttctgaatcagtgtctgagttttccatttttactgaaaatgttgggactcttaagagtcactttttataaagaagaaattgtagaatgacgaaacataaaagttacaagagaaagaaaaaacgattccttttgcttgttttagtgtctggtaagaagaaggagacgaatgtgctgttttgctataatagggattatacttgtggttaataattattaaggtgattgattttacatttttccattcaataggtgtgatttttgttttttaaatggtgtgaatgatttcgcaagttggattggagatgctctctaatcacctttgttgtctctatttatattgcaagtgggcacaatatttccttaagtgacacaaacaatacatatgtcctacatttgacgaaaaaagaaattttaaaagtgacccattctttttttttttccgtatacatcagattcttttggtttggttttgtgaaaattgtgaatgtccagtgctgtaagtattagcttgcttttgtttattgacgtaaaactataggtcttgtttctcttgtttgggttgtatgctatgtgacggaaacaaatagaaattataaatttgacaatcccaaaaatatgtatgatttagcatttcacaccttggcgacaacatatcgtgaggggaatgagtgatgaagttatagaggctataaagcttttgatttcggaactaatcaatataataaaaacaaaatgaaaaatctccattctgccatatcagattttatttatcacttcgtatacatataaagtggtaactatcttaacatctcttttgttttttaaactcatcattgtttataacatttccttcttttcgtaattttcgtggagctttgtgatctccttgaagccttcctctgcttaagtccttgcttgctatttcttagaatggaaatatcagcaattgttcttataagaaacaaactaaccaatgcagactctccgatgggaattgtgtggttcgaaattaggttctattactggtttaggttgggctacgatatatttgggtccttaaatggggtttctgtattgtaatgggccaatcacaactttaggtttatttgatttatagaaatttataatatatatacatttaaatttaatcttataagtaattctttcttgggtgaaagtgaaactatcagaggtattttaacatttatttacatgcatgtatataaaaagtgaacagttaatatatggagacatttgccaaaaaagtattaatgctcgacatttggcgattttgcaaagccaatttactacgatgaaatcaagtagcatgtaatataaccattaggtcttcacagttcacactaatgagtaatgacacgtttagatttatatcttttggtcaatttggattttttttttttttgtaacgcatatcctcctctattaacagtaagcaaactcaaagctaaacctcttaaataaataaaatccaaaaatgtgctgtctcgtctagattcagataacagactgaaaaactattctctatttgtaatatacattgtcacacttacgttgtaaaaccttattctctctctctttttctagaaaattttgttatttagttaaagaagtgtattattgattattagatgtcagaaaatctactattctttaataatactagatcttagtgagtctactattcagaaaattccacgagattgcttacttttttttatcgagtcttgattaaattatcatttttatgtctttaaaatctaattactaattagggttcttaaaatctactttttgtaattccgaaaacacccttcttatcacttatatacttcaaaaacccttacctttatttctcatcaaaatttgagagagaaatcaaatggtgggttcttcaagcatctaatattgttctcattctaattattttttgttgttgcaatttttagttgtttaagaacaagacatcagttttggggtgctgatgttagtttctatttagagaaatagatattttctaaagtcttttaattttgattatttccaaatacaggaagtagaaatg

SEQ ID NO: 22895 - DNA, 3000 bp, Unknown
  misc_feature (1)..( 3000): 2750-1469P.txt file - cDNA_ID_2124871; gDNA_ID_1620742; Annot_ID_166490
acaatgcatttttattccatcaatgaatattattactgctttctttcttagaatatgaagtctaagataaaaaggatggagacagcgaagataacttgaggcacacggaacgttgttgacctacactatcacaaccttagatttgaagcagttaaggttggatcataataaaatccgagaactgcaagctccgggaaactgtattgattctccaaaccttcttcttcactgtactgcgtgttatcgcttttcaccgaactaccttcttccccaagtcttttcctctcaatagactgagtttcaagattctcttgcattttcagcttctctttgagaagatcgacctgtttgaatgtgtcatcaaaattttgaacagactcttgaaaatagtggcttgttaatctattaagaaactgtaccttgctcttgagggtttggttttgtacaaagagaatgtcccagtcagtcttgagcttagcatagctagctttaagagagtcacagtcgtgttcgagctgtttggtcttgtatctagctcttctgttttggaaccagacagcgacttggcttggctgcagccctagcttctcggctagccagagtttcctgtctggttcgagtcttttctcttcttcgaaactctcctctagtaaacgcaattggatcggtgttagcttccgtttcttggttatctcacgcatcatgtagctctcacatacgtcttcttcgtccatagttgcagtctctgtgttgatcattgagctagatcctgaattaagaagagaatgaggaatgacacaaattttatagaagagaatctgacctatgtcgtcacatgaggttcttcaaagttcttgctattcttttcaaactcttttaaaatgaaaggacaatcttttaatctgagtggttacattttggggatgaagattcgtcaaaggtgaaaaagatgcatttcaagaaaataaaataaaataaaattagaatggaggaacagagatataccataaaaagcagagtgagagctcggaggaaaacaagaagaaggaaacttatggctatggttttggttttggttctgaaaccaaaagaaaacttctgaatcagtgtctgagttttccatttttactgaaaatgttgggactcttaagagtcactttttataaagaagaaattgtagaatgacgaaacataaaagttacaagagaaagaaaaaacgattccttttgcttgttttagtgtctggtaagaagaaggagacgaatgtgctgttttgctataatagggattatacttgtggttaataattattaaggtgattgattttacatttttccattcaataggtgtgatttttgttttttaaatggtgtgaatgatttcgcaagttggattggagatgctctctaatcacctttgttgtctctatttatattgcaagtgggcacaatatttccttaagtgacacaaacaatacatatgtcctacatttgacgaaaaaagaaattttaaaagtgacccattctttttttttttccgtatacatcagattcttttggtttggttttgtgaaaattgtgaatgtccagtgctgtaagtattagcttgcttttgtttattgacgtaaaactataggtcttgtttctcttgtttgggttgtatgctatgtgacggaaacaaatagaaattataaatttgacaatcccaaaaatatgtatgatttagcatttcacaccttggcgacaacatatcgtgaggggaatgagtgatgaagttatagaggctataaagcttttgatttcggaactaatcaatataataaaaacaaaatgaaaaatctccattctgccatatcagattttatttatcacttcgtatacatataaagtggtaactatcttaacatctcttttgttttttaaactcatcattgtttataacatttccttcttttcgtaattttcgtggagctttgtgatctccttgaagccttcctctgcttaagtccttgcttgctatttcttagaatggaaatatcagcaattgttcttataagaaacaaactaaccaatgcagactctccgatgggaattgtgtggttcgaaattaggttctattactggtttaggttgggctacgatatatttgggtccttaaatggggtttctgtattgtaatgggccaatcacaactttaggtttatttgatttatagaaatttataatatatatacatttaaatttaatcttataagtaattctttcttgggtgaaagtgaaactatcagaggtattttaacatttatttacatgcatgtatataaaaagtgaacagttaatatatggagacatttgccaaaaaagtattaatgctcgacatttggcgattttgcaaagccaatttactacgatgaaatcaagtagcatgtaatataaccattaggtcttcacagttcacactaatgagtaatgacacgtttagatttatatcttttggtcaatttggattttttttttttttgtaacgcatatcctcctctattaacagtaagcaaactcaaagctaaacctcttaaataaataaaatccaaaaatgtgctgtctcgtctagattcagataacagactgaaaaactattctctatttgtaatatacattgtcacacttacgttgtaaaaccttattctctctctctttttctagaaaattttgttatttagttaaagaagtgtattattgattattagatgtcagaaaatctactattctttaataatactagatcttagtgagtctactattcagaaaattccacgagattgcttacttttttttatcgagtcttgattaaattatcatttttatgtctttaaaatctaattactaattagggttcttaaaatctactttttgtaattccgaaaacacccttcttatcacttatatacttcaaaaacccttacctttatttctcatcaaaatttgagagagaaatcaaatg

SEQ ID NO: 22896 - DNA, 3003 bp, Unknown
  misc_feature (1)..( 3003): 2750-1469P.txt file - cDNA_ID_2124889; gDNA_ID_1620742; Annot_ID_166503
ttttccttatagaacggtgagtgactgacaaaaccgcttaatagttcatctctagacttcaatgattgaatggttttatatttcaggggtttgttttggaggatgccactggattagcagtcaaaggaaacattgatgtgcattctgtatatgctgcctcgttaccttctacaaatcctagttttgcaccgcagaagcatctcgagatgcaaaggatatggaaagctccttcgttacctcagaagcctgtagagttgttcattggaattctttctgctggtaatcattttgcagagagaatggcagtgaggaagtcatggatgcagcagaagctggtcagatcatcgaaagttgttgcccggttctttgtggcattggtaagcacaactcttgaaagacaaaattcacctaaatatagccattggtttaatatactaattcatattgcagcatgcaagaaaggaagtcaatgtggatttaaagaaagaagctgagtactttggtgatattgtcatagtaccgtacatggatcattatgaccttgttgtgctcaagacagttgccatctgcgaatatggggtaacttcttcgtccctcttttgttctccttaccttttattacttttctgattactcatccggaaaacttgtaggtgaacacagtggcggcaaagtacgttatgaaatgtgacgatgatacatttgtgcgtgtggatgctgtgatccaggaagcagaaaaggttaagggaagagagagcctttatattggaaacattaattttaaccataagccattgcgtaccgggaaatgggctgtgacattcgaggtatagattttgtggcagacctgaaactctattgagaaagaaacatgtgatgtttagactttatgttgattttttctgacttgtgaaaccaggaatggccagaagagtattatcctccatatgcaaatggtccgggttacatcttgtcatatgatgtagctaagttcattgtcgatgattttgaacaaaagcgattaagagtaagttatccttcacgtagatatgagattttgaggtgatcctttcatgtttccttttatgatatggtcttggttcttcttggtcattgcagttattcaagatggaagatgtgagcatgggaatgtgggtggagaagttcaacgagactagaccagtggcagtggttcacagcctcaagttctgtcagtttggttgcatagaagactacttcaccgctcattatcagtcgcctcgccagatgatttgcatgtgggataagctgcagagactcgggaagccccaatgctgcaacatgagatgacataacattgttttttgacggatttttcgttagaaaggaaaatgaagaagcagatgggtgataatggagctaactgttttagatctctgtatattatagaaacaatatataatgtatctatatatatatatatataatataatgaagggttcttgagaagttgactgagaagtcaatagtttttgcagtgtttacaaatatataatccagaggtactgcaagtaatgagggaagaacataacttctcctgtaccttgagtagtctacgtaaagcccatgagacaagccgcaacggtctggtatctcttcaacatctttaccaaaatgaggatttttgaatccttacaggtacttgtttcatctgcattcttacattggaaattcttttatcaagatgctaaacaagtgtctggctaattctaacttggctagttgagagtataagttccttgattagcctggttctgagggaaataaagtgggaaagctataaatagattcatacagttgctattagtagactgtttgcttaataatttttggaaacttgtgcttatgaacattaccgaagctgttagttagtgactggaataagcatctgacaggacgcacaaaacagagttgcagcacttgcttttcattttgtgattttcctgttcacttggcattggttcccacgtactccctatgctagactctcttcttatgtggtggattcgtttttcacaacagtaaccttatgtcaagacctttcctgattattcgccaaaacaactctctgaaccggacaccaaattaccaatgggataaagctgcttcaggctgagcctccctggcggtgtttataaagccttatgcatgcaagttcaggcctaatcactttatctgaattctgatgaagattaagagtgtgattacatgttggttctagattaagagtagttacaggttggttctggatttcgttctcaccacgacacaaaacctttcaagccttttacattgtgttttcagttggctattagcctcaaaatatctaaaaccggcacattctctcataactagtttttgtaatgcagtcactttacaaaaagtaatagatgccaagtgtaaagagctaaggtccaaaaaaaaaaagagctaaggtgcaagagatttgagggaggtcggtaaaagccattggtgtgttgtcacgttcaatcattttgcatagaatattggaagataaactggatgttggcaaaaaaaaaagtatagcaagttaggaagcagctaatgcaaccaaaactctctcatgcaacaacaaaacattgcaacctgaaggcggcggcggtactacaatttttggatttggtaaacattggttagccacaataagtatttgctgctgcggtccaaatatattcaactcctagtcctaggtaactaaaatataatagtagaaaattccaaacattaaagccatcactatatttgataggtacgtggtcgataaaatagataactcagagtacaccacctttgactcatcagccacctgccaacgagaaacacgactcctaattccactttcctccctcactcactctattatatataaacaaatcacactctgacctaaaacaaacaactctttaactatcatcagatcaataaaaaccagaagaagtcatg

SEQ ID NO: 22897 - DNA, 3003 bp, Unknown; identical to SEQ ID NO: 17679
  misc_feature (1)..( 3003): 2750-1469P.txt file - cDNA_ID_2124996; gDNA_ID_1621200; Annot_ID_174859

SEQ ID NO: 22898 - DNA, 3000 bp, Unknown
  misc_feature (1)..( 3000): 2750-1469P.txt file - cDNA_ID_2125000; gDNA_ID_1621200; Annot_ID_174860
aggtaaaccaagcactatcagattctacccaccaccaggggttttcctccaactgtattaactaacgtaccagttgcaagttccggggattcaatgcaatacaaaccctcctccttttcaaggtgatgacgctgatgagctcattctttcaccgcccccttctcttgtgaaaccgaaatcaccaaatattccctgcatttttttaatcaaaaaaacattccagaatctaaaaagtacaatgacttgtagagactcatgtacgtaccattgcatcattgacagcatatgtgacacagtaatgttcctgttgaatataaacggttaaataatgctcaactacctacacactagaacaagatctgacgcatgcatcatcaaaaatatataatggataccgttgatattcaacaccaatcatcttttggtctttttatgctttcccatacatacatagaggtgcaacatctagttaatgaggtatagacagacttgcctgcatcatgtgccactcttcaaattcgtcaaacaactccaatcgctcgatcctagaaacacgacattctcatttaagatatattccaagagaagtaggctttctaatgaaagctcatgaattgaagaaacaagagagccaaaacaggatagtgagagagagagtgagagagaagaaaaaacaaaaaacaggatatatatagtaagactgtaagaggttcatctaaaaaacattggaaagctcaaaagtcacgggcaacagcattttttagatatttcttgacagagttcagccagatactaggtatgaataacataacgcccttacacagttttaacaaaacgtacagtactgacctgcgtttttcttgagtatcaacaaaactaccatacacttttagcatgtcccaggcaacagctctctgaaacaccagaataaagaagagggtaaagaaatgagagtccttatatcagaaattatacatgaaagttagccctgctttaatcataatattctaactgcaaaacgaacctgccatccattatcaagaaacaatctctcctttgcaagtaaagttggtgatgcatcaatgcttaagagtgcacatccccgactctgaagaacagaaacaccgttaagctttcagaacaagtttaaatgaaggtaattgatcagtacaacatgaacccatgtggcaatactagaatattttagtgtcatactagtatccatattttgacaaaaatctcaaaaaagctttactaatgaagatgtcgctgtaactagagtagtagagtacacgttcttacctccaaatttctaatcatttgatgcccaaatgcatcatctggatggatctgcaaacagaaacccaacgggttagacacataagcaataagattcgtatctgcaatattatgcagacaaggaaaatcacagttgagctaacctgctcatataagaaaaatactgcagttgaaaacgtttttgacgaccaattgacgatggcacggcttgaatcggggtccagataaatcaaaacacattctgcaataataaacgtcggcagactgataatgatattagggatcaagtaggtctatcaccagtaagtatctgttaccatatatcttaaacccgggtagaagaagagggttgaaggttcaagataacagtgtgtaaaataaataaaaattattcatggataccttagatccatatctgcaaaggatataacatctcttaattttggtatatcgcgcaggtcaactggaagtaacttgtaatgatcactgagaacttgtccttcgtctgtagagataaacagcccaacgagttaagagtaagcaactgaaactagacgctaacggtacaaagtaaaagggggtggttgagttagtagctagtagaagcggaatgaagaaaaatatgagtgcacaagctgaaatgcatcataatgaaaaggatcattctacataataatacatggggggaaaaaaggctcttaccaatagaaatagatgcattggctcctagtttgtccctgagttggctggagttttgtataacagcagccttcttgctagtcacctaacgtaagaagcaaatccatttaggcattagactcaaaacacatgatggatacttttgtcagcacgctcatccagtagtacctccttaaaatcaagttccacatagagattgggcccattcccctcatcctacaaaatgagaagagaagaagcgagagatccctggaataagccgaagaatggtgaatttggtaaaagctaacaaaaaggagaagaaaaagaagacgcaccagcaactgaaaataggtagtatcaaagccagctccgagagacagtatctgtttcttagaacttgtcccgcttagaagaaactgagacataagctttcggaaggcagcccaacgggaaaagtaacctcgattaatgatgggagatcttcgaacaggtcttttcacaaagagatgaacatagtcgtctttcatatatccctttttgacacaagacctttaaaaatattatctaggctcaaagatccacaacaacaacaaaaaaaaaagaagagccctaattaaagaagagagaaagaggtaggcgtacaatttactggcggatgcatcgtcgttagtagcctgaaccgccgctctgttgctgcgagattccgccatcgtcgtcgctctctcagccaaaatgaaggaagaagaatattcaatagtctctctcttccccgggattgtttgggctcaccagacgcggtttctaatatttctcttagtaggccttggcccagaaactacgaaatttgagcccaattattaaacaagattctagaagaattcggtcggtcacataaaaaaaacagtaatataaaaacggaagaaggaaggagcagagagaagaagtttgggattttattcgttattagtgtggtaagaaagaaaaccctaaaccaccggaaatcgatttgtttggaagatg

SEQ ID NO: 22899 - DNA, 3003 bp, Unknown; identical to SEQ ID NO: 17685
  misc_feature (1)..( 3003): 2750-1469P.txt file - cDNA_ID_2125031; gDNA_ID_1621200; Annot_ID_174872

SEQ ID NO: 22900 - DNA, 3003 bp, Unknown; identical to SEQ ID NO: 18233
  misc_feature (1)..( 3003): 2750-1469P.txt file - cDNA_ID_2125136; gDNA_ID_1621115; Annot_ID_171853

SEQ ID NO: 22901 - DNA, 3003 bp, Unknown; identical to SEQ ID NO: 20958
  misc_feature (1)..( 3003): 2750-1469P.txt file - cDNA_ID_2125292; gDNA_ID_1620852; Annot_ID_170361

SEQ ID NO: 22902 - DNA, 3000 bp, Unknown; identical to SEQ ID NO: 6228
  misc_feature (1)..( 3000): 2750-1469P.txt file - cDNA_ID_2125304; gDNA_ID_1621084; Annot_ID_55337

SEQ ID NO: 22903 - DNA, 3000 bp, Unknown; identical to SEQ ID NO: 6236
  misc_feature (1)..( 3000): 2750-1469P.txt file - cDNA_ID_2125304; gDNA_ID_1621084; Annot_ID_170451

SEQ ID NO: 22904 - DNA, 3000 bp, Unknown; identical to SEQ ID NO: 6235
  misc_feature (1)..( 3000): 2750-1469P.txt file - cDNA_ID_2125311; gDNA_ID_1621084; Annot_ID_170453

SEQ ID NO: 22905 - DNA, 3000 bp, Unknown; identical to SEQ ID NO: 6246
  misc_feature (1)..( 3000): 2750-1469P.txt file - cDNA_ID_2125352; gDNA_ID_1621084; Annot_ID_55349

SEQ ID NO: 22906 - DNA, 3000 bp, Unknown; identical to SEQ ID NO: 6230
  misc_feature (1)..( 3000): 2750-1469P.txt file - cDNA_ID_2125352; gDNA_ID_1621084; Annot_ID_170468

SEQ ID NO: 22907 - DNA, 3000 bp, Unknown
  misc_feature (1)..( 3000): 2750-1469P.txt file - cDNA_ID_2125370; gDNA_ID_1620315; Annot_ID_153133
tttgtttcttatatagaacacaaatcattacaatattttatttttgattgtagaaatcatataaaatgttcaaaaatgtgtttttttagtaatttgatatagagattaaatgaataaaacaatatagaatgttttctttgttctataccatttcatgttatatgttctatgtaaacaaaaccatttactcaaaacgatcaaagacgcactttcttaattttccatagtacagtgtcataagcttcgttttattatcgaactaggtcattgctgcaagtgacccttcaaaaattgcactaggaagaagcctaggtgactcagaagcgcaaattgcaaaatgcaaaagattgcactagagattttacctctaattacaagagagatttaaaaggcaaagagaaaatctgaaagccgtggttaagttattcattaagacaatccatcaaagaaaccatgagtttcagttgcgaaagtgtgttggacagcctcaggtaccagttgcgatttacgaaatgtgttgaaagtgtgttatagtcccctttttccttctcaggtagctaataaccaatcaatatctttgcttttgaaggaaagacaggtcgtcgcaccatccaatctacgtgcttcagatcttctctggtgacggattcgtgctccttctcaatcctcatcaacttgtttaacgtgtgcgctattccctccggctcagtgagagattgcagtttctcgaacatgcatgattctcttcttctccatcctcctattttccacttttgtcttcgcaagtacatcaaccctgatcgatgtcggagcatactccgttgtacagacccttttcaagagatggctactagaaccaatgatacggcggaagttcatcgtcaatccaagctctcaaagttcactaaccctaattataatacatatagctttcttcttatctccaattaatgtgctatttataaaaatgtttacaaagtttataaaccttgattacatagatgttcaatatcataagtttaatccaatctgtatattttaatgctgaaaagatagctaagaaactatatagattttaatttggtatgttagagttgaatatcttgtttaaaccttgactatacatagatgttcattatcttaagtttaatccaatctgtcatactaagccatgtatatcacaagaaagtctgaaaatgtgctatatgtcatagtaaaattattaagttaatgcttttttgatgtgagaatcagcattatagatttgatggtaaaatgcttccatcagtttctctactcttattaaaaggtagccaaatttagtttaattacttacttttaatatatattttcattatgttgatatgaaaataattttatttttattacctccaaagtgatgtatatgaaaataaataaaattgcaagcaatggaaaacaatagaaaacttaaaggtaaatattttatttaagagttgagataattatgtactaaaagtttactacataatgacactaattaaatctttaattcttgttttctaaagttgactacattaagatctactaattaactctttaaactcttctaaataattttgttttcaactatatctcaaatttaatagggcaaaaccaaaatctccctactcactttggaaatcagtaatgtttggaactaattttgactaaatatgctaaatgcaacaagtattaattcagaaacaaatttactacgcaaattcggcaaatgtaaaatgtcaaatatatatagtaattaaacatgttatgtgtgagttgtcgaaatgataaactagtttgttaagtacttcagttagtctttgttcttcatcatgtttctctataactaagtccctttccatatttcatcaatatgcatttatcttattcaaacatcataacattacaacatataactttccttgatattaaaagtgcatacaaagtattaaatctttaaatacctatccgggtgcaataacatattcaagccatcaaacctaatttctaaaagcccgatccgatcgacaacgaaatgttgtcctcggactcgaattacgctagtgatattagcgacgatgcctccgccaccggatcgatagagaatcctatatacaaatgcaagtattgtcctaggaagttcgataaaacacaagcattaggtggtcatcaaaatgcacacagaaaggagagagaggtcgaaaaacaacaaaaagcatttttggcgcatttgaaccgaccagaaccagatctttacgcgtactcgtattcgtatcatcattcatttcctaaccaatacgcactcccaccgggatttgaacagcctcagtacaaagttgatagatcatacaagatgtccatggtctacaaccaatatgtgggatcctcaagctctagctttgcaggactacaaagtgacccaagtcaaggaatgaaccaggattggacctttaccgggatcccattcctaccccaatctcaacctcaaccactatcgtcaccaatatgtttggatctttgccttggcattggtagctcccaaacccaaccacaacctcaagaaccaaatgatgcaacagaagagatggatgctgagaaagaaaatgatggttcttccctttctctctcactcaaactgtgaaattgtaatctttcccttttaagtatttcttaaactttcattcctcacctttgttttcttgcatagtattatcggcttgtgtcaaatcagtacttgtgcacttgaacattgtaataaacttggttgttatttgcatttgaatttcatataataataaaaacttgatattgttctgactttggggtgtcaaattctatttataagaatttgagatgcaaatctcaattttagttactttatgataccaatataaaaaaaaaaaccactctttcgaaaggatgcgggttttgaaatactttcgagctccttcttctctccgtcatcgttcctctcccatg

SEQ ID NO: 22908 - DNA, 3003 bp, Unknown
  misc_feature (1)..( 3003): 2750-1469P.txt file - cDNA_ID_2125376; gDNA_ID_1620315; Annot_ID_153136
aataggaggatggagaagaagagaatcatgcatgttcgagaaactgcaatctctcactgagccggagggaatagcgcacacgttaaacaagttgatgaggattgagaaggagcacgaatccgtcaccagagaagatctgaagcacgtagattggatggtgcgacgacctgtctttccttcaaaagcaaagatattgattggttattagctacctgagaaggaaaaaggggactataacacactttcaacacatttcgtaaatcgcaactggtacctgaggctgtccaacacactttcgcaactgaaactcatggtttctttgatggattgtcttaatgaataacttaaccacggctttcagattttctctttgccttttaaatctctcttgtaattagaggtaaaatctctagtgcaatcttttgcattttgcaatttgcgcttctgagtcacctaggcttcttcctagtgcaatttttgaagggtcacttgcagcaatgacctagttcgataataaaacgaagcttatgacactgtactatggaaaattaagaaagtgcgtctttgatcgttttgagtaaatggttttgtttacatagaacatataacatgaaatggtatagaacaaagaaaacattctatattgttttattcatttaatctctatatcaaattactaaaaaaacacatttttgaacattttatatgatttctacaatcaaaaataaaatattgtaatgatttgtgttctatataagaaacaaaattttagataatagccaaattaaccatacaaaaaacaaagtaatgtttgtgtgaacaacctctccacttctgcttcccaagacaaatttgaccaaatgccaaagactgagcataagtaccaaacacatattgagaagcagcaccaaactgatctttgaggttgagaaaagaaaactgatcttttgcatatttttttttcaaaggattaacaacattgatttaaaatgggctttcagatgagtccataaaatgggcttaaaaatcatatttaatggcccataatatttgtttgcttctcttaaacggaaagagtctttaaccggcgaaagaaaccaccctctgactgttaagaaaattctcatcggcgtttagatcagaaacttgggaatcggagaagctcactgagaacaatggatatgagacgtgcttcgatgtgtatgatgttaatttgcgtctccttggttctcctttcgggttttggccagtttgtgatctgcagtgaagaaaaaggaacgtacaacgacaacgtcgtaaagatgaagcttggtggatttagcgattccaagaacgattggaacggtggaaaagagatcgatgatattgcactcttcgctgttcaagagcacaacagacgagaggtttgatttcctccaacctaatttgtatattctctgcaattagggttaggattctaaaacttttagcgtaaattcaagtaatttgcgtgtctgagtgttcttgatttatagtctgaagattagagattaaggattttgtattagtatttagtgatgaattttatgatttctctgttcacggtgtttatctctatatgtggtctaatagcttttggattttatgcgtagaatgctgttcttgagcttgctagagtattgaaggcaacagagcaggtggttgctggcaagctataccgtcttactcttgaagttattgaagctggtgagaaaaagatttatgaagctaaagtttgggtgaagccatggatgaactttaagcagcttcaggagttcaagaatattatcccctccttcactatctctgaccttggcttcaaaccaggtaatcaccgtctctggtttagtcacagccaccgatttttgtgcataaaactgtttccttttcgatctttgatcataacaagtttttaatgttttttgatatctttgctctgtttgaggcagatggcaatggatttgactggagatcagtatcaacaaataaccctgaagtccaagaagcagcgaagcacgccatgaaatcacttcaacagaaatcaaactcactgttcccctataaactcatagatataatcctagccagggcaaaggttgagttattgtgcttattatattcactatcagtttctttcgtaatcaccaaacccaggcaggcacctaattaagtaaaggaatgatatttttacgagcaggtggttgaagagcgtgtgaaattcgaactgctgctgaagctagagaggggcaacaaactggagaagttcatggtagaagtgatgaaggatcaaaccggcaagtatgagtagaagttgcagatagcttttgggttgtgtgccatgtgtgaatggatcctttatagtatatagtatactaaatactgctatgtagtgaaaataaacatggtgattgtttggctttaaacaaggtttcttgtaaataaatacatgacttcacatatgtaaaagttacaaatatgatatgattatgcgtgtttgaaaaaaaggttaaatctagagtcaaaaccgaccacaccaaatcatgagaatgtgataactaaactaaactattctcatgtcttcaaaagggaaagttgtcttctttagtatttggccccaaagacaacaactttggggaaatttcaaattggaaacgttttgttgggttaaaagaaaaattaaaggctacaactttattttattctccccactagttttgtgtccgagacagagagagagagagagagagagagagagagagagagataaagggtcgataaggtctttttccgtttccttgacctctctgggatttggatttcgatttggatttcgatttcctcatctcatcgatttgcttctcaatctctccaattcgattctcctctggaaatttcaatcctttttatattttccttggtgatttctaagataattaagatcgagaaaaggagaattttgagagagaaagcatccatccatcgatg

SEQ ID NO: 22909 - DNA, 3003 bp, Unknown
  misc_feature (1)..( 3003): 2750-1469P.txt file - cDNA_ID_2125401; gDNA_ID_1620315; Annot_ID_153145
acagacatagtattattttagacaatcaaccatctaaatagactattcaaaaataatattataacttattatttaactaaatttcgaaatcttaaaaccaaaataaaaaatgaggcgtgaatcggttaattaggtcaagcaaacagtcaaaatcgtgattttccccaatcttttcattaatcaaaagatgtggaattttagggtttaagtaaccgaacatgattactatctacgatattgtcaaaatgtaacaggcttattactgtactattttcttcccttttttttgtacgttagcttattagcagtaactaaaataaggttgcgtatacaaatgaatttaatgatcttttgtttgtactccagatagcaaagaaaacgaatctatgatgatatgtcttttttctccgacgaggtcatttaatggagggaacgaagtttatttttgtttctttgttctgaaactctgacttcgatatgacctgaccagctgacctttttacccatcaaacgacattacctcctagacagattagctctgtcaaactatgtaagatattcgtcggttataaagataatggtacctagacaacgatgcaaaaagtgatagtcgaaagagagaagaaataaattaaaaagacgtgtgttcgaatcttcgagagaataatggggaacagtgatgtatgtaagacactattactaagactctaacaacacacagtgatttatgtaagactctctctaatccattaacctacgtttctcaaaattatacgtaaactacatatatagtacatacagtatatgataaaaaaaaaaaaaaaaaaatatagcccaacagattgtggcctagttagctagcctgatgatactgacagagatttgctcaacagatttgtcgaagaaggctatctcgtacttcaacgaaaaaacggttagctaggaactaaagaaaacaaaatgaatctcttactgtgatggtgatgccccggcccaacaataagtagatccctagcgcaaaaacaaaattgtttgggcttttacagtgtatattactacatttacaatattatttggacaggatttcttcaaaaattagcacaacatttctaaaattttacaaataacactataaactttaattcaacttaattaaaatatcagatagaaaataaaaataagagcaaacactaatctaatatttaattgaattaaaaaaaactttaaatagtaaaaatatatatccgaaattaaaaatagagaacccaaatataataccacaaaaactaatattaaaataaaaaatctcttttaaatagtgaaaatatactctaaattggaaataggaaacccaaatataataccataaactaaaattaaaaggaatcaaaatttcttttaaatggttaaaatatataccataaattagaaatagagaacccaaatataatactttaaatttatttctaatttattttggatgatagaatttatataaaaattatggtattgttgaaaaaatatattagtaataaacttcatagtaagttaagtagtgctatttttagaagtttatggagtgtgtgctattattgtccataaaacttgttttagtgatatttttaggaatttctcataaagttattagacatggtttaacaaatatagataaaagatcaaagtaggaggaggaggggtgagaaacaggattgaaatggcggatggatgacaaacttctattgagagatcatacatttcaaaagaaaagtgaaagtagtatactagtatttatttcaaatcaaaatagtaaacttacattttatgataaattaaaatacataccaccatctcaacatactagagcaccagagagtatggaagacggggaaaaaggagataaccacggtctccatggtcaacatctccattactatcctgcatctcgaagtatggagtgccatcaatttcatctctaccagcccctattaaacaaaaaaatcaaattaacaatatacaaagataagtttccttttgcttatgttaattattaatctcatgtgagtattcggtatgtgaatcaaatcatcattcttaaaaaaatatgaaatttaatctcgtaaagtgattcatcagttgaaaatacttgtcaagagcatggtgtgagtaatagtcttcttataaacttagggagtttttttataagcatcacattcatcatcagttggtttgtatattccctaccagaaaaaaaaagttaaaatcacaaacaaaaattaatctacaaatatttcttacatctccgctatgatcatgataacttggaaaccagagtacgctgacgatcactagaacctcatctttagccaaatattcaatcacattgtcccatctttccggatttttgttgtcttcataagaaactgtcattgaaatagctttataaactttcaagtcacaaatttactcacaaaccaaaaacaaagagagaaataaacaattctcactaacaacaacaaaaaataaacaattaccacttcaggatcgttttcagactcgatcccaagaaccgtaagagaattttgcgcaacgatttatgcaaaaaagtgagcaaaacgatttatgcaaaaaagttagatattagttgaccaattattacgacgaaaaaacaaaaaaaggttgaccaattaatttagttgatgtgtttatttttctaaccggttcacttatttttcttgacattattaatttttaaaattatttaaatactcgacgaaaaaataataattattatttaaatacttaaaaaaaaaaaactactctggtttatttgtcaaaagttaaatcgtagtaaacgtgaaaagccctttaacaataaacgaatgaaaactttggtaaaccgataataaagaaaaaaagatatttttatcccaatttccctaaatcataaagaaacttagggttcgttatcatcgccatctcgattctcctaaatcataagcgatg

SEQ ID NO: 22910 - DNA, 3003 bp, Unknown
  misc_feature (1)..( 3003): 2750-1469P.txt file - cDNA_ID_2125423; gDNA_ID_1620315; Annot_ID_153150
agcgaatccggcgacgaatatccgccactagtaactctagctcaggtaggttactctctctctcgttttctttctttatctggttttcacttcgtccacttagaagtatgctcatttgataaattggcatttgaccccagttcaggatttaggattctgattatctctcaatacttgattagtttagtgcttaagttattagtttttggtatgcccacttgcgccatgttcgtttctaaagcaatgagattattttcatttaaagatctggaaaaaagaaactaatggagacaacggcaaatgaagatggattttaagggtttttgttcttagtaaaaaaaagttatcttctttttaattttctgagactttaattgctagaaagttataggattgattcagatagtggaatcagacaactttttcttttatgggcgattactcatttttgttctttggtcttctgattgtttagtttcttagcagatgatttagtcttctcttttgtgatccttttttgctttccttggaagtgtaggtaaggatttgtgtccatggcagctttgcaaacgcttcgtgaatggatcggtatccagcagttcccacctgctactcaatctaaattgctcgagatccttgggaagtataaagaagaggttcctttcttgtttctagcttcatctgctttctgtttgtttcttcttgtcttagagagatttaagaaagaaaaaaaactggtgtaggatgtgagctcgctaacggtccttgtaatggggaaaggtggtgttggaaagtcatcaactgtgaattcagttataggcgagaaagctgctgcagttagtactttccaggtgccaagtttaatgctcttctcatggcttgtctttatgactattggctatctttcttttaatttttctcatagaaagtgtgtgattttccctctttatagtctgaaggactgaggcctaccttggtctctcgcacaagatcgggatttacattgaatatcatcgacactcctggtcttattgagggaggatatgtgaatgatcaagccatcaacattataaaacggtatgatgaactgtttccaggtctaaggagttactctcctaatttggggctcatttgtggcatttgtattaatttggattcgtggatgttgaatttgaacagatttctcctcaacatgactatagatgtgctactatacgtagaccgtttggatgtgtaccgggtggatgaccttgataggcaagttgtcggtgctataactgatgcatttggtaaagagatatggaagaagtctgctcttgttctcacccatgctcagttctctccaccagacgggttaaattataaccactttgtctccaaaagatctaatgctcttctaaaagttatccagacaggcgctcaactgaagaaacaggatttgcaggtatagttttttcctccttacataaatgtctgtaacgaccttgatagtagtcaagttaatagactcacttacctctgatcttttattgtagggtttttctattcctgtcattcttgttgagaacagcggaagatgccataagaacgaaagcgatgaaaaggtcagttgattggttttgtccacgttctctttttctcgcgtcttgtagtagttggaccaatcttgaagtcggattttccaaatttgtgacagattcttccatgcgggactagttggattcccaatctgttcaacaaaatcacagagatctcttttaatggcaacaaggcgattcatgttgacaagaaactggtcgaagggccaaacccaaacgaaagaggaaaaaaactgattcctttaatgtttgcattccaagtaagcccctctgaaccattcagtaacaatacagaataaggcttgatcaaaacatcatgcatcatttattcatcttttgatggtttgaaaatgcagtacttgctggtgatgaagccattggttcgagcaatcaagtccgatgtttcgagagagagtaaaccggcgtgggagctgcgagactccggtttagcaagtcgaaggtcttgagttgtggacacgagttttgtttggtttgtttgtctatctgagagattgttctgtagttgaaattgtgatacaactcgagaaatgtggttcacagataattactgtcgcaaagttctctcatcttaattacatcttctttagcctctcgtaaatcgtaattaagagctactctcttggtgaaaatgattagaagagataattccattttgtcattaatggtaaaagtaaccgctgcagttatttttgacgcgatgcaagttttgaaataaaataaaaatttgagttaaagaaaaaaaaaaccgatgtttaaaggaggaatttggcaaacggagaagacggttcagagaagatcgtttactctttcctcaatttcgaacaaagttttcgaattttccaactctctctagtgaatttagggttctgatttcgacattagtgtaaagatttgttttttatccgaggggtgcgattgtgtagtcaaaccagatcaaatgtcggcatcaacggtgtcgatcaccgctaatacggcggcagcgactagacggacgccgattcttgccggagagaaaaaatcaaactttgattaccctcaaagcgaatcgcttgcgaacggtggtgttggggaagccggtggtacgagtagagatctgagccgcggtgaagctacccttgatcgatctcagggacaagatttgggtcctgtgacgagaaggtctgtttccgctgcgacggggactaataccaccgctacgcagcgccggacgcggaaggttgcgactcctaagtctgagaaagcgcggtggaagacagtggtgaggatatttgcgaagcagcttggtgcgcttttgatcattgttgggttaattcaattgacgaggaagatgattctcaaggcttcttctccgtcctctccgatttcttcttatgaaacggagatg

SEQ ID NO: 22911 - DNA, 3000 bp, Unknown
  misc_feature (1)..( 3000): 2750-1469P.txt file - cDNA_ID_2125437; gDNA_ID_1620315; Annot_ID_153154
tctatcaatgattcgattcatatacgttatgaataataagtggtggatctcgtttataatgcaataacttcaaattaagattagcaattcatcgatctctagattctctacacacataattatattcaaattttatacttagtttagacgtataaagaaatggtaagactgtagatggttaaaacttgattgttttatttatcagtacaaatttttttatatatatcttataagttatgttttgatgtatctcgatttatttatcagttaatataagcatgcatctaacattatagataatctatataatcaggtgataaacagagtattttatctatattttgaagtatctatttgcataatcaacattttataatatggcaaaaaaaataataaaaaaaaatcaacatgttatacatgattactgcaaatacatacattcataaataattgtgctaaccattccaaactaaaagcctttacccacatggcatgatccacgacttggataaccatatatttgcgaatgttaataaaacatgtaatatgcataaaactttttttcagttatatcgttcattattataagatcatgaacggtatgttatatgagcctcctggaattaggttatcataacccttcccgaaccatgaacagtccatattgcggctacgaagtatacaagatgtggacaagcctcaaaggatctcttatctctcctacttctcttctattcggacctcaaaaacttaattcatataatttctaatattatcgttaattcatattacgagataacgtattgtatatagagttggtaaatggtaattaattaaggcatgtctcagaacattgaaaagtcaccatggaaatttatcataatatattaaatactatatttataagaaatatgattagtttgatatcatattatatagcgttgaattagaaacactcgtcaatattagattccgttcactcccatgctttgttggggataaatctcaattggaattccgtcgggctctagacttccgctatatttaatctcaattccgttcactcccatggtttatatcattccaacctacatattaattggaatatgttttgataataaattgatgttgcatatatacattgatttatatttatatatcagtgtctcttgcttaaaatgaatagccaatttgacgtccttctcaacgtatgttgacatacatgatcctaaaaaaacaaaatgcgattttgttttcagacatcaaatcaagcacactacagtaaacatcttgttgaaatgctttacatgatcctgattgtttcgtttgcttttgatatccctactgtttttgatattagatgtattggttacatcttgtttattgaagttgaaccaaaataaaagaaagatatattggttacaagtcttcatttacattaattgtttttgtttttgtgtttacgtttagagtttacattagttattatttttcactagtttctctactattattttttatttttgtcaaccactagtttctctatttgaatttattttttcttttgtctatttatagtaatctcaaaaaccataaatacaacagaaacccgaaaaaaacaatgagtgtgttagtaagttttaaactaacaagtgcttgtcaagtggtcaacactcaacagaacaaagatttgcatccactaatcaagacgtttaccaacacgtcgatttcaacaaaataaaaaaaaaataaaaaaaacttagtatcaaggccaaaaaaaaggatatcttgctcatttattttacaaattaggttatctattgaccacttatcaagtgtttttcgtatcaaataacgtcttcacggtatccaacgttaggttaatacgtattgaaggtggccttacctatcaaagtgttcgaatctttgtaggatcgggtccaaacacaaacaatatttgacgctttacaatttacataaaatagagttctatggggtgattagtagtttcctttaatcaaaatcatacatgacgtaaaacattttgctaaaagtataagtgatcatttaactctatatatttaactgatctataacctgtttttttttttcttggtgcaggacttcatcgacaatggatcttgctaaaaccaattccgttcctcgttttagagggattggctcttagacagaattttcagatttaagcgtttaaggtgacgttagactatgtatgaaaaaccaccaataatttacattgtgctcgtcactactttcgttacaaaactcatagaccattataatattgagtgaaagtactataaggaacatacatatatgatttggatcccacctagggaaggatatatactatataataaatatataaataattcattatgatgaatttctcaaacaaaatgtatcattttgtttgacgagtatatgtgtaaaatataaaataaagagaatcttacacgccaaattgtaagattttttataaaaaaaacgaaagaagacaatttctatatttcatcacttctagttctacatatattatatatggatttcaaagcttcattgaaaccagcagaattctacaatcgaatgaatggcttagtgagaaaataatataaaaagagtaatgactactattattaaatcaaatcttattaactttaattataatgatgcatataaacaggaagatcgatcttaaaataaaataaaacgagaaagatactaacatatacacaaagaaacatgagaagcactcgcaatgttaacgatcaaattattcatcttagtgcctcccacgcaaaatatatatttgtgccgcgtaaaatcaagtttaatcattcactttaattaaaaatacaaatcgtcgactcttatatatcctctctacaagagtaaacagataacatcaaaaacatttgatcacacaaaacttcaatatctcacaaacgagaggccggttaggaggaaattacaaaaatg

SEQ ID NO: 22912 - DNA, 3003 bp, Unknown
  misc_feature (1)..( 3003): 2750-1469P.txt file - cDNA_ID_2125451; gDNA_ID_1620315; Annot_ID_153160
tagacagaaaaccaaacttttttatacctagtgatgtagtggttatcatcaacctttaattatgagaaaagtttaaactatcaaacactttaaatattcgttatataagtagaaacttacgagttaattcagttcttgttttttccctccgtgaatccaagttttaaattttaatatatgtcacgtctatatcttctttcattatccaatattgaattttgaagttgatcttttgaatgattcaatatttgatttttcaccaagtatgtatttatatgaaaataaaagtatattcacatatatgagaaaatggaattcatttgatttaattggtggctgatatctggatattagtttactttctatatgaataatgaatatggtgatattgcaaagccagatattgtatggattacaaaaatgataataaaacaagaacaattatctaaatacattgtacatacgatacgtagtagtgtacgttatataaaactatacaagttcatcgactttggtcgagctaacataatctgaatcgtgtttggatttttaacgcatttgactgagagtttccatttgaaaaccgtaaaccggattttagactttcgtaaattcaacattagaattttataactagctagttttaagttctaactgagattaatatgagattaaaatgataatatgatttttaactgagattaaaatgataatatgatttttaattcgccatactgagattaataattagttgtaataataaacaaagagcaaagacaaacaagtcaagactcaagcggcttacacttcacatggccaaccacaaacaatgtaaagaagttcgaagaacacgatttccacgcccttgattgtattacttttgatatttaaaatttagagagtaattaaaactttaaagttatgtagtctttcacggttttacaaaacaaaaatgttaaagagattcaccaaaaaaaaaaaatgttaaagaattgcaaattggtcattatcgatcgagtattggttttaatatttcactaacactgtacacatatcgtcataataacatacactaacatgattggaacgagttagttgtatgtatgatgattaaacaatattctatacattaattattcacctaacgacatcgctttcgtacaagtttgtttaacgactaagcacgttgaatctttaatgaaggtaatcacaacaaatatacattaataatccgcataatgctagcataagaaaaagaaatcttcgcactaccatatatacactaacaagatttacaaataaaactaaatgtcatttggttgcaaaatatgccgtaaataatcaaaggaaattggttattttattattttggcaatatgtagtttgaacaataaaacaattcagctcaaagtaatcaaccgtgaacatattttagctttgacaaaaaaaaaagaacatattttagcaactaaccatttataaattataacgataaacttattcatgttttgcatgtgatagtatcgattttatatacttataaatttaattttatcacacacacaacatgaataaactacataattataaattgaatcttaaagatgtttttgatgtttcgttgacacaaaatatgggtcaataacaatagtacaacacattcttctttaaaaccaaaaaaaaactccttatctcaagattccaacgtcttcgtcatcacatgcattgtgtccaacgctttaatcaaccattgaagtttctcattcatatatcatcctcatacttaagtctttagctagtatatatataataagtcttctcctctatctcacatctcaaagatggccatatctactcttatcttgattgaaaatatataattcttggaatgaaacttctccacttctgtatttagtttcatgttatcttcaacagtgtatggtgaaagaaggatatgtttgaatgatcacaaactacaacatcaatcacttcatacttactcttgtctagtttgaaaagtcattaattcttagtatgaaacttctccacttcttcatttagtttcgtattatcttcaacattgtaatattgtatggtgtaaagaaggattgaatggtcagaaactacaacatcacttaaatctggattcaaaagttaaattaaaaagtatgagctattatcgtaatatgttttttctcataaggactgaaatataattttactaaaccgaggttgattctagacgtgtttagtggggagaaggttttttttttatctgaactatacaaaaagtacgtttttcagcctggacaaatgcttagtgctgatttatcatttatacctaaactcattacaaatgactcagttgacacgtgtgtattgtcgttttgctattttgttcatttttttgaaaaaaataaaaaagtggaatctcgaacctgtgatcatgggaacgtttaattcagcttttaccactgatccatataaacattattgacacaattactggtgtaactctttatatacaaataaaatccatgggattggatttagtaaaacgacacgtctacaagttttagggatttcgtattttgctttcatttcttcttcttcttcttcatacgagagccgaaaacgaataagaagattaattgaggagaaatcgaagatgtctatagcgttagtggagaagattcaagccaaattttgaagaagtctagtagattctgtattgtaagctactaaaatctgcgatggtgaggtaagattctacaaaaccgagtatttttattaagtttttgtttggttgtctacacaaaagctgcgtatttgttttgttttcttcggttgaatctctttgacctcaggcatttcaatcgtcgccggaaaattcatcggagatattaaaattgaatcaagcttcgaattggtcaaccgatctattaatttgactagagaggaacgagctgtatgatatatctgcttccgaattgagtctccatg

SEQ ID NO: 22913 - DNA, 3003 bp, Unknown
  misc_feature (1)..( 3003): 2750-1469P.txt file - cDNA_ID_2125472; gDNA_ID_1620314; Annot_ID_153092
cacttattacctactaaactaaatatgggaagtagagtccttgaaatccaataaagtgttttcttccatgtataaaatagggtatatatgtacagtttatagcgattacagaatgtaggtaaagaggaaatcattatagaaaacccaacaacttcatcaaatccatctataaattataatttcagaaatttaaacattaattttgtttcattagcaaaattatacacatttgtttagacaacgttgcaaaggtttctccaatctgatagaacttcttaaaacttgatgaaactgtggttaaaaaaatactaatactcaaatgcttatataccacaccggttagtccaacctctcgtcaaacattaagcatctaaacaaatattataaactattgaaatgaaagcatatgcatgtcttcagaaaatatagaaaatataaggtgtcatgcacatgtaattaaaagtagtgtatatataggatcgttttaaatacaggtacgatccaaaatactacaattttggcttggtttgagcttcgttaccatctttatcggcatttatagtgtcctacacttgtagcatcattacaatacttatttttgtatctcaattctcaacctctatccttaaactacaacttaatttaacttaacaattcatgcaaataaatttacggaagaaaagtgtaattgagtcattaattgaatcacaactacttccatgaaaccttaaatgcctaacccaactacacactgcacatctctataaaacacagcctttagttctttctttaccactctccacactacactctagtctcacacaaaaagaaaaacaatagctaatttaatatcttcttgtgatcatcacaataccacattgatccaaggccagttaaaatctctttcaccatgaagataaagattatgagcaaaacacatgtgaaaccaacaaaaccagtactagggaagaaacaattccacctcaccacatttgatcttccttaccttgctttctactacaaccagaagtttctactctacaagttccagaaccttctagatctcgaggaacccacattccaaaacgaggtcgtggagaatctcaaagatggtttgggtttggttcttgaagacttctatcaactcgccggtaagctggccaaggacgatgaaggagtcttccgtgttgagtacgacgctgaagactcagagatcaacggcgtagagttctccgtcgctcatgctgctgacgtaaccgtcgatgatctaacggctgaggacgggacggctaagttcaaggagttggttccttacaatgggatcttgaacttggaaggacttagcagaccactccttgctgtccaggtatgatgacttcttttaatgtttatatattttatacatattacactaatcccatgtcagtatctttgtcgtccaacttgtttattttcacgtataataatatagaattagattttcaatcggcgtgacgaaagaaaatatatacaactagataaccactactgattttacgtatctgaattatcacacaaatatctgattatgtaatcatttctatgtggttatgtttactgaatcttgatgcatgttatgtaataaatatatattgaactactacccgtcaataaatattaccatttcaagagaaacatcacgtaacatccaaaactctattagtattagctataaagaaaaaataaaatgaattacaaaataataaaataacgcataaaccagtatatgaagtacaagtgtatctttccagcaagaaaaaggaacgcagttcacgtacttcagaaaatgctgacattaactttgatcaaaacagagttaaaaatgggaaaaatattgacatctcctaactactgaagagtgcatattaaatcacaaaacactatacacgacttaaatggtaacaaaaaatcaggttgacatgcattttatacaaaagtttcttgttaccaataaaatttgttattttagaagcttgacatgcatactttatgcttatgaatatattacacatgcacgtattataccatgaccatacacatatgtataagatatatgtgtatgttcattttcatctctacagtaattgtagtcaatgatttgagaaactcggttttcgaatccctttttttttactgttttttttttttattgtgtaattttttgtaagagaaaaataaattaactgacacaaccataaatacaacattcaatgactgaccaataacatgctacggatacaaactatgagtaaatagcaaacaccacgtatgcatgtacaaaataagtagatagattaaatttgtatatatcactcaacaaatagtacacattagagaatttaatagtcattatcaatcaatcctatacaaatataaatatcagctttagcgccaactaaatcatatgagtttcatcatcatttttttttatcatcgacccacgttgactacttgactataacagtataaaaatattgttttcacaccaaaaaaaactaatagaaatattgtacaagaaaataacaacgtcgtgtaatattgagattcgtggggataaacactttcacctaaatagctgttcaaaaataaaataacttaaacactttcaacgtcgtatatttgattgattgtattcatacgtattaaaacgtgtatatattgcatacgtaacttcattcattatacaaactttcattttcgtcggatatggtcatttaaattctcaacggcattaatgtgcattgaatgtaatggctttagaatataggtgtagtcgttgggagagtcattgtctatgttggtctcgaaactatcgtccaaatcaaacactccaaaccattaacatgaaaaaaaaagcattacactaaaatttaaaagaaaaataaaaacattttcacaagtattaattaaccaacatttttcgtttcgcaacaggtgaccaagctaaaagatgggcttgcaatg

SEQ ID NO: 22914 - DNA, 3003 bp, Unknown
  misc_feature (1)..( 3003): 2750-1469P.txt file - cDNA_ID_2125476; gDNA_ID_1620314; Annot_ID_153093
acttgattcaagcgatcttcaccggaacagcggcggggctactagcagcgcacggaccggagttcggagcttcggtgatccagaaagcaatcgcggcacacgacgcgagtgtgatcgacgcacgtaacgacgagtgggagaaatcgccgaagatttttcaattcaaagacgccggagtgaattgtgttgcggtgggaagctcaccgaggtttcgtgtttacgaggtggatttcgggtttggaaaaccggaaacggttaggagcgggtcgaataaccggtttaatgggatgatgtatttgtaccaaggtaaagcaggaggcataagtattgatgtggagataactcttgaagcttctgttatggagaagcttgtgaagagcaaagagtttttacttagtgaggaggaagaagaagatgatggaaagaagctcaccaatggtaatggccatgtcaatggtaatggtaatggctatgtcaatggaaatggcaatgggtttgtttgagtgtttgtttagtttaaggttaattagataattaatcaaactacatattttggttaattagctaattaatttgattaaggagaaaaaccttatggctttttaagtatggtaataatgtgctcgtggttgataataagcgtgtgtgggttatttgtatgattatgtagtgtgtttggtttggaattgtaatatttggaccatggttttttagtacttatgttgtttaaagtttcatgtactgttgtcaataaaaaagaaaaattagttaatgcaattgttatcaaatctgttttaactttcaagtgaacggtgtaacataatttgttatttaatttgctaatctctaaaacccaatcactatctatcttcaatggtgattaccaaagctaaaccactctggtgtaaggttaaacagtacacaactttggtttacaaactcaaattgatgattttttttttgttaataagaatttcctaaaaataattaaatctaaaaccctaaagacaatcagtcttatgttctgccgtcgttcattgtcttcatcatctccgttaaaaacagagcattttcagattgatcgacccactctttctcctttctctccataaatctcatcatgttttcattaatactccatggtggaagaaggtcacgcgagttacatcaatggcggaatctgaatcttcttctccaaaactcctctgctttcactgaatcgttctcttccgttgttactactactaaagatctaagtcttgaagatgaacgaaagaggaaaactttcacagtctcttaccttattgattcattagggttaactacaaaactcgctgaatcaatctcaatgaaagctaacttcgatgaaaaaggtaatccagattcagtgcttaaactcttaagaagctatggattcaaagattctcaaatctcaagtattatttccacttacccacgatttctcattgagaatcctgagaaaactcttcgtgctaaacttcatttcttgaagcttaacggagcttcaagctctgagcttacagagattgtttcaaaagttcctaagatcttgggaaagagaggagggaaatggattagtcattactatgattatgtcaaagagattttgcaagatcaagattctagttcttcttcttccaagagaaagcagacgaatcgaaatcgaaatgtatcggttttgagaaaattaggagtaccacagagactgttattgaacttgttgatctctagagctaaaccagtttgtggtaaagaaagatttgaagaatcggttaagaagattgttgagatgggttttgatccgaaaagtccaaagtttgttaatgctttgtatgttttctatgagcttagtgataagactatagaggagaaagtgaatgcttatataaggttaggacttagtgttaatgaagtttgggcagttttcaagaaatggcctttctctttgaaatactctgagaagaatataattcaaaagtttgagactttgaaacgtgttggtctaacgaaagaagaggtctgcttagtggttaagaagtaccctgaatgtgtagggacttcagaggagaagatagtgaagtcagttaaaacttttcttgagctaggatttacgaaagacgaggttttgatgatcattaagcgacatcctcagtgcattggattagctgcggattcggtgaagaagaagaccgagtttcttgtgaagacaatgggttggcctttaaaggttgtagcttcgactcctattgtacttggtttcagcttggagaagttcgttttaccgcggtgtaatgtaatcaaagctcttatgtcgaacgggctgatcggtgaaatgcctgcgatatcgtctgttttgacgagtcctaagctgaagtttttgaagctttttgtggagaagcatcaggatgtgttgcctgagttgaactctatcttcaccggagatagcattctaataaataagatagcattgtgaagaaagattgcttattgtaatttgtatcattaaaagtctaatcagtcaccaaaatgtaaaccttttgttgtaaggaaacatttttttaggcaataaaacaaaaaatgagaacagttcaagctgattcaggcaagaaatcagaaaacttgtaacacttaagataaatttggtaacttttggcaattaagggtgtgtttagtatttgtctctaattagtcttctaatttgttttattaaccatttttgtatggtcacaaaatctaacaaatcatgagatttcaggtaaaacacttgtcatattcgatacatcacaacaactaatcttattttttatttctcatttttgtatataataataattgtaaggtccagaaatagataagaagacagagaaggttaaccactccatatctacactcttttcttaccccaccaaaccaaattgtcatctctcattttcttattcaagcttcgaaacaactcttgaaactccaaaaacttttccaatg

SEQ ID NO: 22915 - DNA, 3000 bp, Unknown
  misc_feature (1)..( 3000): 2750-1469P.txt file - cDNA_ID_2125479; gDNA_ID_1620314; Annot_ID_153094
gaaaagctcagagacagaaggatactcacagcggcttggacgaaaagtgaaggcttctccagaggggctaattgttcatcgataattcgatatataaaatgaaaccctagttgttgagacagggtccttattattgggcttatctttataaatgggcctggtctttaattaattggagacgacccaataaagtttcgaatacttgcgttttctcaatctctcgtataaacgacatcgttttggaatataaaatataggtatttttttttctttcacaaagtctgtttttgagtttttgattcggttattttagtttctgcaggataggaatatgcacattgtaatgtataatataacaataattggccataattcatataccggaattggctatctatcgaatcaagttgcaatatttatactcactagctactatatcaaataagaaagtctttaaaaattgaatactcaaaatgtagtagtaaaatgtatcaaagccaacttactcaagtactagttgtaattggtttaagagctttaatatgggagcaacggaaaatgtaactgtcattggttgacttgacttattatcgttgctaaaaaagtaaaccttcttcacgaccgacgtgcgatgttctaaattacaaatcaagaaaagtaattagtatgaagcggccacatattagatgaatatatagtttggagccaacatgtaactaattataattttgttaatcaaatgaacaaaaatatgtttatttcccaaaataagaatcggtaaaagggaatctttctttcctggccattttagtatgcacccattaggccatgaccccatatgtattaaaacatttaaatacattgttgcgagcaaaaaatacttggtagtataattctataaataccattaacttgtaaacatacactaatttatcaacatcaagacaaaacattacaaaaagccatgtctcgtgtcctcctctttctcttcatcttttctttatcggttttggttggatcaatcaatggtaacaatcttattatatcaaaccagttccttccaatctcagcaattcatatacaaaatataaatgccaagatatctacatttttgatataacaagaaaattttcaggacggtcatgtggatcatcgacgcccacttcagaggatatgtacaaaaagcagatggaaaggtccgaggaatcagcacgtgaaatgggaaggattggtttggagtgtgaacccgaagggtacacaggtggttcaggcaacacgaactctgttggtgatatgattctcggcttcttcattcttttctttattgttggtgcccccattatgatctgtctcgcgtgtgttcggagacaacaggctataaacgcagccaatctcaataacgtttccggttagtaatatgtaaataagaaataaataatttgttatggtaacgattaggaaataagtatataaagataatctttattgtaataggtcaagtggtaggagctcatggaactgatctcaagtcttatcctcagacagggaccgtccaaaagggagatcccaattaccaagtttgatccatcacttttcacaagtatggataatggttatttttcggttgtcttgccaattaatgtatgtgttttcaattacatatgcgtgatacgtaactttttttgtttgggttggattgtatctcctcaatctattttgagagcgaaaaaacatttgttagcattgctttcggagatgttttattttggtctcacaaaccaaaaaaaaaaaaactgcaaaaccctaatgttttacatactcgaaattgaaaattgtttaccattatttgatttccctggagaaaacaatccgtttaatcatttcaaggcgatatcaacactaagcaacgacgccaacaaagatatatatggtcggttaattaactcaaaagtaggaagaaaaaaaattctacaagcttagtaatagctattacagtattcacagagaagctcgagatggaaaaattgttgattcaacgtaatcaacacacacaaagctcgtagtcgataaacggaaaaagatggattcatctacaacgacgtagatttttttttttatcacaacggcaaagtatgtatgagtatatcattttagaaattatcaatctgttagaaacggtactaaaaataatacttttattctacatatcgttctcttcccgtttctaccaatgaaaagactcttattactttgtcatctgatccacatactacgcaaagagaccagagaacatagttgatgatggcgttggcgtccgctcgtgctcctttggattagataattgtatactttactttagccttattactttagccttattgtaattttgttttttactctcctttttttccaagattactctactttaggtgttgtttctgtaattccttcattttcatttctaatgatatttacaagcttagcaaaaaaaaaaaaaaaaaaaagaaaagaaaaggaaaacatagttgatgatacattgattgatagagagaaaatgctactcacgattacattaactcctactaattaataagagggtttcttaattattgggcttcacaataaagatgggccaatctcaaataaacggagccgagaaactttcttcctcctgtaaaacggtgcgtttaacttaatactaaacgacactgttttgtatgcaggcttcttagatacgccgaggtaggacacgttttgagtcatcatcgaaaggagccagacttcgagattttgaatttttttacttaacggctcactcactttcatctctctctctttatctcccaaatctgacactactacattcaaacattaagagaaaggaaacaaaatcttcaaattcaaacgtttttttccctttccaagagagattccttgtgtttctattcgatctagggagaaaaaaatctaggaattttgagaattatggagacaaagatg

SEQ ID NO: 22916 - DNA, 3000 bp, Unknown
  misc_feature (1)..( 3000): 2750-1469P.txt file - cDNA_ID_2125490; gDNA_ID_1620314; Annot_ID_153097
tttatgtggttatcttgagtgacctagaagctacatttagaagtctcacaatacatttctgggtaatttgtttagtttttcacagtcccacaatatgtgtctgtttcaattagacctctggctaccgttgttgattgctcttctttccactacatagtggtctgcaactgaccttttacatttctgactactcttgcagttattggttctcacgggcctgcatataaagatatattgattgatggatttgttcccccatccagcagcgtagctccaatgttcccatattatgataacacatctgaatgggacgactttggggagattattaatccagatgactatgtgatcaaggatgaagacatggaccgaggagcaatgcatgtacgttccttgaattctggtcttggtcttggtctttcttagctcttgttatatttgcaaattagacctcttaatttccatgatgtttgcatagtggtggttccttttacgatttttgtatcaagaagaacaaagatgtaagaaatctgcatgatatgctctgaggatttgggatacagataggaaatcttttgccataaagttgcttaggctcttgatttggtatgagtgcagttcttcaaatgagtgcactggttctacagttccatctttatattttccttaacaactgattgcttactagtaaaggtttagggtcattctatgtagagtcttgtgttgcttattaaatttgtgatataattttccatttcagaacggaggtgatgtggacggaaggcttgatgaggcaactgctagtctcatgcttgatacaagaccttcgaaagtcatgtccaatgagctcattgtaagtagactctaattatatccaaagaacaatacattgatagagattttgtctcagttaatgtcctcatttgttctccctttctagaatctctgattattgttatagactgcttatcaatgataggcacaaggagtagtcttctcacttagaaatagagagataggaattctcattgacatggcgttgtgcctgtcaaatttatcttcatctgatgatatgcatacaagaaatttattaattgatcttctaattagttatcacgggagaccttgctaatcagatctttagcacgataattcaacttacagatattttgttgtttggattaatcggtctaattttcttcttgttattgaacaacttttgtgttcttacttttacccacttgatcttatgtcatgtagaagtttcagaaggttattctcagaacgtaggccttgcctgctaaacaaaacaatatggctctttagtcttcttctgtctatacctaactgctgtctaatttccctgataaatgatttagtttgttcttatgcttttgcacaggtgactgttagttgttcacttgttaaaatggactatgaaggtcggtcagatggccgctcaatcaagtcaatgattgcgcatgtttctcctttaaaacttgtacgtttctctctcgtcttatatatatatagtgttaagcactgaactggaaacttgcggtgatctaatactatatatcatgtgaaggttttggtgcacgcgatagctgaggctacagagcatttgaagcaacactgcttgaacaacatctgtccacacgtgtatgctcctcaaatagaggaaacggtcgatgtgacttctgatttatgtgcttacaaggtagaaattacttagaattaggaagatcctttttaactcatgggttttgagttgtgtgattgaattaaccctgtatggtgatacatcaggtccaactttctgaaaagctgatgagcaatgtgatcttcaagaaggtaccttttatttccgtgactatttttttcttcttttccgatttgcaaccaatgtctctgaagaatgatgaaataatatcagctgggagattcagaagtagcttgggtggattccgaagtagggaagacagagagggacatgaggtctctactaccgatgccaggtgctgcttcgccacacaaacctgttctagtaggtgatctgaaaatcgcagacttcaagcagtttctgtcgagcaagggtgttcaggtagaatttgcaggtggaggagctttacgttgtggtgaatatgtcactctacgaaaggttggaccgacgggtcaaaaggtaattcaaagcaaatactgcatttcttacaacaaatcagagaatgacttatatatgttggggattgttcagggaggagcatcgggtccacagcaaattctgatagaaggaccgttgtgtgaagactattacaaaatcagggattatctctattctcagttctacctcctctgagcatgatatagaaaaaaaatgaagcttcttctcattttctcaacatttttcaaccactcaacatgtaatctcgtatagtttattgccttgcttataaccctcaaatcttatagattaatgtgttaaaaatggcaatagctttttgtaacttttttgtacttgtcatcttagtagaagcttaagttgtcattggatatattccactcctatttcggtaaagcggtaaactaaaacagtaaaacgtgataaactctcttctttgttccttgtatgttctctcaaaagtttaaaatgaaagcgaaaacactttccattcaagagctttcaacacctggtcttggcttcgtgctgacgtggcatctagcttttttttttcacttgtgaattaaaccaaccatatgtgttaaacatggaaagataaataaaagcaattaggtggttaggtgtgttagtgtgaggctgatcactgtccaacgctctccctttgtgcaatattctgtaacgaaaccaaccaaaaacacagaatacatttgatacaattactttaattccaattaaaccctaatcctcctctaccattcttctactgacgattctcttcatattttcttatcctctcttactctctctacaatcaaaccatg

SEQ ID NO: 22917 - DNA, 3000 bp, Unknown; identical to SEQ ID NO: 756
  misc_feature (1)..( 3000): 2750-1469P.txt file - cDNA_ID_2125576; gDNA_ID_1620316; Annot_ID_153174

SEQ ID NO: 22918 - DNA, 3003 bp, Unknown
  misc_feature (1)..( 3003): 2750-1469P.txt file - cDNA_ID_2125580; gDNA_ID_1620316; Annot_ID_153175
tcagatttcgtcgtgagtcatttctgtttcaggatatcaaactctggggtggaattgcaatttctcactgcttgcgtgagctacgtatcgactttttttctcactatgccaatccatatgttatattgcccagaagcttgtatacctgcaaatctctggtgaccttgaaactcctaggcttgggtattcgtgtggatgttcctcgagatgtttgtctcccttctttaaaaactttgctacttcaatgtgtggcatactcagaagaagatcctcttcgactgcttctttcctgttgccctgttcttgaagatctggttattgaactagatgatgcaaaccaaaatgtgaaagcgctagttgttattgtcccaactttgcagtgtctatccttgaagatacctgcttcatgttctgatgaacggtatttgattgttaccccttctttgaagtatttcaaagttgaggatgacagagaaattttcaatgctttgattgagaatatgccagagctggaagaagcggatatctatgttacgcaacatattgagacgcttctcgaatcagttacatctgtcaaacgacttacactacgccaattgtacaacagcatagatgaggtaatttgtttctgtctatcaactttaagctctcaatcgtctgttacaacttatgacactgttacatgtgatttgtgcagtataagtgtcgtgctggtattgtcttcaaacagcttgaacaactggagctatccatatgcagtgataattggacaaagttagttatatggttgctccaaaattctcccaatctgcgagttctcaatcttgacgctgatgtaagtctcttcattgactatttttgctaaaagctttctatggtgtaatcttgagtctgagtctctctgtctctctctcacccccacgcagagtgattatgaacgttatgaggagtatgaacaggataactggaagaatatacaaagatctgttcctaaatgtttgaagagcagtctcaaaactttggagtttgcagggtacacggcaaggccagaagagagggatttcttgagttttatcttcaaaaaagctcgttgcttgaagacttcatcaatctcgcattgaccacaacataagaaacttgagagctatcgcattttattctgaatcttgttttccaaagacaatttggttttaaactgaatatggaacttgcttaagaacgaaactagtgtagattattaatcttatcatgtggttagtgacttagttctatgatctggttatatgtgtgtgtgtgtgtgtcgcagtcttatgtttgtttaaaatatttcaaataaatccgaaatacaatttagttgaaacagaagcatacaagaaacatgaaattttgtaaattcgtgatgttttcttgtagtcaacttacatcctcaaaaagtcaacattttcaaagttataaatacattatacatttgtttacaaatagccattctcttacaattataacactctcatgacatacaagtgtatcaatatggcaaacaagaaaaaaaaatcataagaaacacaaaatcacttcttgttttctccttcaaataattgggacgtaccatttttattttatttttacttcatgtagtttagatatatacggtgcagatttgaaggataaaaaaatataaatatatgatttaatcaaataagcagcaacaaacaggaccggtgggtttgtcgaagaggcagtggccgtccatggctgcagcgtcggtgctcctgtgacaatgcttgtcgcagtcgccgtcgttgttgcacgttcctcttaagcggcatggtccgtccattacgtctttctctgtttttatgtaaatttaacacacatgcatgtatattattaggtcaaaaaaatatgacatatgccacaaaacacaagttttggatttaaaagtatttgttattttgaaggggtggaagataagtacctacggaatttgcagtaatactaataacgagagagaagacgacgagaagagcaacaagttgaaatcttgatgaagccatttttcagattatttttatcttttgtattgcaagatattcaactttaaatttgtgtttgaaaaattatgatctatgttggggggttttatacgtgaattttagttttaaagatagtaattttgttttgttttaaatagtagaccagttttagtcaaggtaatttatggttaatatagcaatacaagtaaataaatctcctcaaattagaattagccatcgtttcttacttctaaatttggtgaggatatgaaagaatgaacggtagaggagtggctttgattacttgaaaattacttaaaaagtcaatgcaaacacaaagtcttaggtttaattataaatattaaacattgatattttttaccaaattttaagcatcttaaatattaaacataaaacataatatgtccaagatcatttaagtctcaaaaaattatgcacacattatcaaacaaacaccaaagaaaacaaaaatcttattaactttctttggagagtcgctgtcaaaattaaatcttatacatattcgaaattttataaatattgaaagtaaaaaatggtctggtagttttgtttttgttttttgttttttgtcaattaattttgcgtaaaaaatctatacaattttaatgtggtataagtataatagaatctaataaacttttcaaaagaaatataaccaatccaaataaagtgcaatgcgatccgaaataaatgaattaagaattttactatttgaaagaaagttgttaagaatctagatattgaaagaaatattcaatagttaccatgattgaacaacttgggcttattataataatgggcctgatacattatcaatccgagagagtcaagcctcgtgagtggttaaagctctcttcatcggaaaattccagattgggaaacaccaaaacaaatcaccggcgatcggaaaccggcgacgtaagctatg

SEQ ID NO: 22919 - DNA, 3000 bp, Unknown; identical to SEQ ID NO: 751
  misc_feature (1)..( 3000): 2750-1469P.txt file - cDNA_ID_2125611; gDNA_ID_1620316; Annot_ID_153187

SEQ ID NO: 22920 - DNA, 3000 bp, Unknown; identical to SEQ ID NO: 747
  misc_feature (1)..( 3000): 2750-1469P.txt file - cDNA_ID_2125615; gDNA_ID_1620316; Annot_ID_153189

SEQ ID NO: 22921 - DNA, 3000 bp, Unknown; identical to SEQ ID NO: 748
  misc_feature (1)..( 3000): 2750-1469P.txt file - cDNA_ID_2125627; gDNA_ID_1620316; Annot_ID_153192

SEQ ID NO: 22922 - DNA, 3003 bp, Unknown
  misc_feature (1)..( 3003): 2750-1469P.txt file - cDNA_ID_2125685; gDNA_ID_1620318; Annot_ID_153232
atatttaaaatgtacttcccaaataatatagtaggataatatgtctttgacactactccaaaattaagaaacatatttctaaacaataaaatcataagttttagttaacttaaatttagataatgcgtccctaccactagttataagataagcaatacaatgcttaggttgacaaagaaaatgttatgcttatgatttttctagacaaaaaattgttgggcttaggtcgaccaaagaaaaaaaaaattgggcttcttattttcatgtagaacgaaaaaatagaggagggtggttatggttattgatattgtgaagaagatgaaagtaataagacaagtataagaaacacagacgatttttaaggagataaggaagagaaggtgtgtgaaggggaaaaagggttttgatgaaaggttcgttgtggattatatagaaaccaaatctgaagcatccaagatttgcaaaaacataaaatgaaggagtgcggtggcggattctcgaagcccatcatcggagccgtgtcagattgttgagttgttgctagctctggtttttaggtttaagtgtgtttctgatttagataggtttgaagaagtggttaattctgttggaatgttagctctgttccaacttacgtgagattttgtctagccttagaagcgagtgtaaatacgttcacagtgagcaagagctccagatgaaaccgaataatacttgagatccgatttctgagcaaggcaagaaagtgaaaggatatgaagatgtctgagcaagaagagggagtgagagaagacggtgaggttttgttcactgagcatatgagggaatcaattgatgatgaatgatgtggtggtagtggtgttaatttgtcgttaagtaaatgtttggatcatttacacagaaaaaggctatcatatgatctgaattacgttttaggagagcctgttaagttttgatcttttagggttttagatctaaaattaacagagctctttgatttaacattttggaaattgaatcccatgttaatgtagatgaagaatctacccaagtgtgttgaaatatgtttgtgaatttaaaaactgatttattcatttttggaggaatattgatagttggttttgttacatttgagaacgtagaacaattgtagagcggcgtgtaattgattttgttagtttgtgttgaacttatttattttgagatataacaaagaaatgaaagacgtcaacaacaaattggtcttatagttccggttatttattctattctagaatagattatgttggcttaagaagacatttagacttaagagttatttcctctgttaaaatatatgtccttcattcttccaaacgattaagtgattttaagttttgtttttgaaatgattaaatgactctgagttttgttcttccaaattaaatcaaaaatattaacaacataatctgttcttaagaaactgattagcgaatctcaagaaatacatatttgtaaacaagaagaatttggaacgagaataatatatttataggtttcttaacaacaagaatttggaacgatagattgtttggctaccaacaacataaacaaaaaaacaagcaaacggatatagttccaaaataaataattttatatggtcaaaactactgttgctatataaagcacaaaaactatagaaacccaactcaacaataattatcctgttactttttttgtttttttgctatataaactaagcaaaattttcataagtttgaacactcataaactcatctcttcaaaataatggcaactcaaacaataaaaaagatatacagtgttttgatgattgtagttttatttacgatgatggtttcaaccaacgcgagtacggtggaagtgtgtgttaagcattgtgtcccgaaccaatgcatgaaagtttctcagaaggcaactcttccattatgtgagactgcttgcacaaaactctgcaatgaaaacaaacatgaggaatatgtcgtgcctcggagttactgtgagggattattttggtttctatgtgataattgaaatttaataaatatgcaaagtaatatatatgtattttttatctgtaaaaaaataatctataatgtaaaaatgtacctttaatcaatatactaatttcatgtaattattttatttatactaatcaaattgacacatcaaaatgctgagaagttatctaatcacccaactaataaaaatcttataaatgcaatattgttctcatcatctctccacatcaatatttagatcgttttgtaatctcttgctaaaactaatccaatcggttctctatcgaaccattaagttatgagttttctctttacaattttgtatgaatgactagaatgattgtgaaagaggagagcaatctcgagttatctaaattttgttttgtcacttgttcataacaataacatttttgtgctacgaatgtcaaaatttcaggatttgttaagtattagagaggatgaatttaatagttttttttgtttttgtgttttatttttgggtttttaatagaatttaatagttcatgtattgtttaatacaatgtcaaaattgtgtatatatttaagaaagatattatttaattagtgtacaaatatatatttgtaaacttatggtcaatgatgtaaaaatttcaattagtaattttgaggcttgttttttttttagattcaagccacttctttagtgggcttatcgaaggcccaataccaaatttacgtctcctctctctctctccgatctcaatagatcgctggagttgagagagcttcgggacttcgcgttccttgacgaagaagacgatacttcttctccttccatcacagcttcacgcaaatctttctgcagttacatcttcttaagattctgagttccgacttatttcgtggaaggattttgatatttcaacagtgattttaattttatactggaacttaagcatcacttaatcttccggctaaaatg

SEQ ID NO: 22923 - DNA, 3000 bp, Unknown; identical to SEQ ID NO: 760
  misc_feature (1)..( 3000): 2750-1469P.txt file - cDNA_ID_2125720; gDNA_ID_1620318; Annot_ID_153240

SEQ ID NO: 22924 - DNA, 2025 bp, Unknown; identical to SEQ ID NO: 766
  misc_feature (1)..( 2025): 2750-1469P.txt file - cDNA_ID_2125758; gDNA_ID_1620319; Annot_ID_153255

SEQ ID NO: 22925 - DNA, 3003 bp, Unknown
  misc_feature (1)..( 3003): 2750-1469P.txt file - cDNA_ID_2125764; gDNA_ID_1620319; Annot_ID_153257
aatgttattttctgtctatctggttctttggagaaaatatttttggtttcatcagtaactgtagattcttgatcccttttttttttttttttttaaatgatgattactttgcagataacaaaactcactaaaggtttaaatgcggtaaattcagcatgtgaggaggtaagatttttgtgcagtccatttgcgtttctctttcttggaccattaatcgatctcctcatttcttgttcatcagatacgtacttcacaaaagctaaaagatattatggaaaatattctgtgcctggggaacatattgaaccaaggaactgggaggggtgagtgagtatttctattatttttacccaaatatcttttggctttaagatatttcctaacgcaacataataaaatctgtgtgttgttcaatgtgagctaagaaaagaatggcgcctttgtttcattgcatcatatatacttttgttttgtctgaacgtaaattctttgtggttgataaagacccttgttcttttttctgaaggcagggcagtgggattcaggttggatagtttattgatattaagcgagacacgtgctgataacagcaagatgactctcatgcattatctttgcaaggtaaaatacaatgcgaaagaaagaaacatgcagcgtctttgctttagaaatcatgaaaccctcctctttgcttttcccaggtccttgcttccaaggcatcagatctactggacttccataaagatcttgaaagtcttgaatcagcttcaaaggttttcctttctacttactttttccgtcctgctgtaattggctcatcatttgattgtcctgtctattgcagatacagttgaagtctttggctgaggaaatacaagctataaccaaaggattggaaaaactgaagcaggagcttaccgcatccgaaactgatggtcctgtttctcaagttttccgtaaagtatgttgctgtttttctatcttctccatcttttgcatatcttttatcaatcatgattcatgaatttgagattaggtcctgactgtgccacataactaaatcttccatcaataccagctgctaaaatctagttttaatgttttttcaacagttattgaaggagttcatatccaatgctgagactcaagtagcaactgtgatggctctttactaccccgcggtaatttttgtcaacctctactagattccaagcgccttacctttgacaatgtgtttggtcctgaatttgccattttttcttgaatcaatctaattatgatggacgacagagaggaaatgctgaggcacttgcacactattttggctaccattatccatttgaacaaggtatgcctcggaaacaataaacttcatcctcatttattctaataccatagaaagtggctcattgctaataacatacatggtgatcgattgctgcagttaccgcgacactcttgagttttataaggttgtttaagaaagcacatgaagagaatgtcaagcaagcggagttggagaagaagaaagctgcaaaggaggcggaaatggagaagacgaagtaacgagtcagtgtcactaagaaaaagagcaagcggagttggagaagaagaaagctgccttatataactgaccatagtgtggtaactcagatgttcttttgtgttgaaataaacaagtgatgtatatactttcactgcttggttttgttaaaatgtgtgtggttgagaaaaaaaaacagttgaaatttgcattcaattaaaatatttgatactaattcgaacttgggactctgaacagaagaagaagtcctcctcccaagtcaactgatattttatgtgtgggccgatctacaatttcttttattttcgtaaaatggcccatttaaaggccttcaagactgaaccggttcgaccggatggtttgtcttaaaaaattgattttaattctttccaataaatgaggatttggtttgctggatctgtaattctccagaaatagtttttttgttcactttttttctatgtaggaaatgataaaaagagaataattttctctgacttgggaaagtaaggatacattaaatgaataaatgtaataagaaaaagacaagaggaggaagaagaagaagaatcagatagagacgaaaaaaggagtaataatctttttttttctttttcttggagttggagtgggtcttttctctcacacaggtctctctcttctcaactcttcccatgttgtttcgcttcttctgtaagatttctgtaagttagttccctcagaaaattctccattctccattttcctgcaatccaatatctttatctccaaagataatggcccagcagatctcagatatatagaagatccctcttcttttggtccactttcccttgtttacattttcccgagaaaacaaaaagaaagcttttttgcttttttttctttcttctctgctttcccagctttcaagcttctgaagtaaaagaacgaagctttgtgttaaaatctcagaattttgattattcttcggattgaaaaaaactgttccttttcctaaaggtagatcctttcactcgttttgatttctgggtttcttcatcggcagattttttgttctgtttctttctttaaatactcatttaaaatctatactttctttcattactatgttcttctaggaatctagctcaaagtttcatcttttgcttccttcttggtctttaatgcttacaatgtcttgttttcttcttctttttttggcaatcaacaatgtcttgttttaaagcttggtttttcttttaaaccacttatgatttttctgcctacaaaatgttgttaatagtctttgagatcttatcttaaatctcatctttttacatttgcatattttgtttgtatagagaagcagatttgatgatgcattgtggggtttacttttttattttattttaatgatattctttcttggtgcagagtgtgaaagtgaatgaagaatg

SEQ ID NO: 22926 - DNA, 3000 bp, Unknown; identical to SEQ ID NO: 777
  misc_feature (1)..( 3000): 2750-1469P.txt file - cDNA_ID_2125768; gDNA_ID_1620319; Annot_ID_153258

SEQ ID NO: 22927 - DNA, 3000 bp, Unknown; identical to SEQ ID NO: 767
  misc_feature (1)..( 3000): 2750-1469P.txt file - cDNA_ID_2125772; gDNA_ID_1620319; Annot_ID_153259

SEQ ID NO: 22928 - DNA, 3003 bp, Unknown
  misc_feature (1)..( 3003): 2750-1469P.txt file - cDNA_ID_2125786; gDNA_ID_1620319; Annot_ID_153263
atggttgattgatcttgaagttttatctgactttttccgccaatctttctctttcggtcgggtttcgggacagcgcgctgctttggcatcgtttaatgggaaaaggggttcttgcggtgcagacagatggaccgccacagctacgggtttacgcacattgttcaaaaggaagagtgagttgctcatatcatcttttatatcgcagtttccaaacgtctttttcggttagagtttgctttaaatgctttggttttttcttggttttaggccggtgtgacattgctactgataaatctaagcaatcaatcggattttacggttagtgtcagcaatggcataaacgtggttttgaatgcggaatcaaggaagaagaagtcattgttggatactttaaaaagaccattttcttggattggaagcaaagcttctgatggatatttgaatagagaagagtatcatctgacaccagaaaacggtgtgttgcgcagcaaaacaatggtcttgaatggtaaatcgttaaaaccgacggcaacaggagatatcccgagccttgaaccggtcctccgtagtgtgaactctccgcttaatgtcttgccattgtcgatgtcgttcattgtgttacctaattttgatgcttctgcttgttcatgatgttaatggggtctctctttgcttattgggaaaaaataaataaaaataaagaatagttgtaatttttttggtaattgtatctaatgctggtgataaatgtatcatttcatatttcaatacaacatgattacaaacctttggttttgtgtctcttcgacttatgagccattgcaagaaagataacaaaagacaagaatcaattcgcagaactgcaagaagtgtctccacaagataaagaagtatcttcactgagtttcttcctctcttcataagcccattccaagccgtgacagtactgaaccggcgggttgaacctactgtcggttatatcatcaggtaagaaagcaccgttccccacaagaaacttgacagcttctcttttccgttctttagctgcagcatggagaggagtccagccacaagcaccagaggttctagcttccatgttggctccacgttcaagaagcaagtccataacttcgatgtgacctcctttggcagcaaggtgaagaggagtcattccttttgatttaggtccacaagctagagcgttcacgtctgctccttggtcaaggagctctttaacagctttgagatcgccttcacgagctttgatgtgaagctgagtccaccccctgtcatctctgtcaacacccgtttccatggaccggcgcctaaatgagttaggccgaaaggacaacgcaaccggctgctcttggagcatcttgcagataaaccagaactgactagaattcacagatgaaagactcaaaggatatttcctaagggaaacttactagacaaggagattctaggagtgactcagatttacataattttggttacaatcttatacaagaatgtctaaagcaggaacactacttgtgggtagaaatcatcaaccaatatcactcagaataagaacttatgggagaggcagattgagatgattcagttggaatggagcaactcaatcaagggaagtgattagcaatgcagtaagggaaagagggattcaaaccagggccaaagacacggagattttgagggatcacaactggagtcatagacagtgaagagaacacgagcatcaactagaaagaggtaggagcttaatggtttctaggaacaaagagaaatcagaaaaagcctggatcaatgggtaaagagagcatcgggccagagtctctatctgcgtgatttttaccagccagatctgccaacaagacaaggatggaaaaaaaaacttagtggattcagataatacaaataagcaaagtgttcattcaaaaaaaaaaaaaaaagcgaagtgctacagaacaagccataaatctctctgcaaagatcgccagaaatattttcagagatcaaaattttaggttaggtaacgaacaataaaaactttagtaacaagtcccaatctttagaatcgaaaactctggcaaatgaacagtatactaagagaattcccaaaataagctgaaattcagaaccacccaaaattcatctaaaaaattctaaagcagcaaagaaactaagataataaaagcttagtgatgaatccaaacaacataaagaccaaatcaatttcacagtaagacgacgacaacgtaatagaattgaatcggggaaagatagaaacctgtaggcgtcgtagcttagcgcggagggagaagaaagagatatggtgaatcaaacacagatttatccttgacggaggatatgaatcaattagtgttttttcgcgggtagagagtgagaatcgtatatcgatttccagatgaagaagaagaagaagaagaagaaaggcgcgtgagtgtgtgtcagagacaaatatcgtttttttttgtttgttactatacttgatccactttaaaatcgaatttgccacctcatattagcttaattaatcaaggcttcttactgttgggcctacaataaaaggcctgaatttggcccagatagattaaaccatatctaatatctttatcaactaatttaatttcaaaaagattttattctattttatcgtacatagtttgcataatatggttagatttcaaattttatatggaagtaactaattttggcagataattggattcataagaatagaataaaatctctatatatttatctatactattaaaagacatcctagaaaatagtataatacaatgtatttcacccattatgcacatcattttgcaatattaccttaaacaaaggctaaaaattacaacaacccccaaaatgataaaacttatataagaatctcatgattgatgctgtaggagaagaagaaaaacaaagaaacagaaccaaagtagagacactcttgttctttatatg

SEQ ID NO: 22929 - DNA, 3003 bp, Unknown; identical to SEQ ID NO: 22928
  misc_feature (1)..( 3003): 2750-1469P.txt file - cDNA_ID_2125786; gDNA_ID_2684233; Annot_ID_192323

SEQ ID NO: 22930 - DNA, 3003 bp, Unknown; identical to SEQ ID NO: 22928
  misc_feature (1)..( 3003): 2750-1469P.txt file - cDNA_ID_2125786; gDNA_ID_2684233; Annot_ID_137650

SEQ ID NO: 22931 - DNA, 3003 bp, Unknown
  misc_feature (1)..( 3003): 2750-1469P.txt file - cDNA_ID_2125790; gDNA_ID_1620319; Annot_ID_153264
aatttgccacctcatattagcttaattaatcaaggcttcttactgttgggcctacaataaaaggcctgaatttggcccagatagattaaaccatatctaatatctttatcaactaatttaatttcaaaaagattttattctattttatcgtacatagtttgcataatatggttagatttcaaattttatatggaagtaactaattttggcagataattggattcataagaatagaataaaatctctatatatttatctatactattaaaagacatcctagaaaatagtataatacaatgtatttcacccattatgcacatcattttgcaatattaccttaaacaaaggctaaaaattacaacaacccccaaaatgataaaacttatataagaatctcatgattgatgctgtaggagaagaagaaaaacaaagaaacagaaccaaagtagagacactcttgttctttatatggattctacttcatcggaagtaaaaatcgtttctcaatgctttgttaaacccaaaaccatccctgaaaaatggaaagagccataccatttatcaccgttggatcttgtgatgctctctatgcattacctccaaaatggtcttctctttctcaaatctgatgatgcaaccaaaacaaaagatttcatggagacttggctacaaaagcttagagattctctagctgaaacccttgtccatttttatccgctcgcgggtcgtctctcgactttaaaaaccgataatccgagatcctactctgtgtttgtggattgtaatgacagtcccggagctggatttatccatgccaaatcggatctaagtgtaagagatattgttggatccaactatgttcctttggttgttcaatctttctttgaccaccataaagccgtgagccatgatggtcacaccatgagtctcttctcagtcaaggtacattaatttattcttgtaatctcaaaatcatataattcacttagcctagaagtttagtctgaacgatagtaatacacatatagtactaggtttacttaacttcttgccatttgatttagagatacatcgaagtattgtgtatctatgtagtcttagttgtttgtatatcacgcaactatgcatgcaataccctaaagagatgaatcttttcaggtaacagaattggtagatggagtgttcattggattttcattgaatcacgctgtgggagatggaggttccttgtggcattttttcaactctttgtcggagattttcaatgcacaagaaaccgataacttgcttctcaagaatcctccagtcctttcacgttggtttcctaaagggtacggtcctgtgtacaaccttcctttcactcactctgatgaattcattagccgattcgaatcaccggtcttgaaggagagaatattccatttctcgtctgaaacaataacatcattgaaatcaaaggctaatgaagaaagcagaacaacaacaatttcttcttttcaagcgttagccgcatttatgtggagatgcattacaagagcaagaaacttaccttatgatcatgaaattcgttgtagccttgccgctaacaatggaacaaaattggatccaccattgtctttgagctatcttggtaattgtctttctgctgtaaagtccaagaccgttacatccggtgagctactagaaaatgatttgggatgggctgctttgaaaatgcatgaagctgtgattggaaacactagtgaagtggtctcggagacaatcaaaaactggttgaaatcatcttatgttttccatttagaaaaacttttgggagcgatggtggttcacattggaagctctccgaggtttaagatgtatgaatgcgagtttgggatgggaaaagcggttgcggttagaagcggttatggcggtaagtttgatgggaagatatcagcatatgcaggaagagaaggaggaggaaccatagatttggaagtatgtcttcttccagagtttatggaagctttggaatcagatcaagaattcatgtccgttgtctcttcttcttcttgatcttattcatataagtttgattgattgtttgtgttgctgttaaagtccaattaatattatgtgacaatgtgttattcaactgataatgactgttatttattaaagattagtacaaactaaaatgtgaggtttagagatgataaagttgatgtctttgtggattactcccactcactctcttgattctacactctacttgtaagaacttagataggaaacctgaaaacagaaccatgaaacagagaaaattgcagagaagtaaatgtgtaagatcaagacttttacgttttcaggtttcagtgtgaaagcgcctactcatgccttgacattgttactcggaatccactattaacaaggtttataatatcaagctctttcttgagcttatacaacaaccatacaagaagtcatctcctcccaaaacacaccctccattcaactactctctgaaccatttgtcccttttgtctcctgatatgttctaacactaagaccagatccaaaacgacacagttctacttttggcaagaatcacgtgacgtccttgtgattgggcttcagaatttgcttgcttcttcttcaaaccctctgtgggaatagtgtttagtgaagttagtagaaacatgcatgtgttatttgattaaagattaatacaaactcctaagactaatgttattcaattagaataaagatcatatatatgatgacatcattgatgatgaccagcatatcaaattgtgcaggaacatacatatagatatgatgacatcattgatgatgatagctatctataatcatattatatgaatatattatttggattgtttatgtaagcgagtataaaccaaagtaacaagataaaagggaagcaaagggaccattgaaagaaacaaaagagtcatattatacacattttttctctttttttttttcttcttgagaaaaatg

SEQ ID NO: 22932 - DNA, 3003 bp, Unknown; identical to SEQ ID NO: 22931
  misc_feature (1)..( 3003): 2750-1469P.txt file - cDNA_ID_2125790; gDNA_ID_2684233; Annot_ID_192324

SEQ ID NO: 22933 - DNA, 3003 bp, Unknown; identical to SEQ ID NO: 22931
  misc_feature (1)..( 3003): 2750-1469P.txt file - cDNA_ID_2125790; gDNA_ID_2684233; Annot_ID_137651

SEQ ID NO: 22934 - DNA, 3003 bp, Unknown
  misc_feature (1)..( 3003): 2750-1469P.txt file - cDNA_ID_2125794; gDNA_ID_1620319; Annot_ID_153265
ataatatcaagctctttcttgagcttatacaacaaccatacaagaagtcatctcctcccaaaacacaccctccattcaactactctctgaaccatttgtcccttttgtctcctgatatgttctaacactaagaccagatccaaaacgacacagttctacttttggcaagaatcacgtgacgtccttgtgattgggcttcagaatttgcttgcttcttcttcaaaccctctgtgggaatagtgtttagtgaagttagtagaaacatgcatgtgttatttgattaaagattaatacaaactcctaagactaatgttattcaattagaataaagatcatatatatgatgacatcattgatgatgaccagcatatcaaattgtgcaggaacatacatatagatatgatgacatcattgatgatgatagctatctataatcatattatatgaatatattatttggattgtttatgtaagcgagtataaaccaaagtaacaagataaaagggaagcaaagggaccattgaaagaaacaaaagagtcatattatacacattttttctctttttttttttcttcttgagaaaaatggattcctctccatcagaagtaaagattatctcaaaatgcttcgtcaaacccaaaaccatacctgaaaaatggaaagagccataccatttttcaccaatggatcatgtaatactctcaatccattacatccaaaagggtcttctctttctcaaaccatcgttttctgaatctgtcacaccaaaagagttcatggagactttgctgcagaagcttaaagactctctagccatagcacttgtccatttctatccgcttgcaggtcgcatctcgactttgaaaaccaacgactcaagatctcactcggtgtttgtggattgtaataacagtcctgctggatttatccatgctgaatcagatctaagtgtatcagacattcttggttccaaatatgttcctttggttgttcaatctttctttgaccatcacaaagcattgagtcgtgatggtgacaccatgactctcttatcagtcaaggtacatttcttcattcttgctatatcatattattcaaatatgtcagcagatttgtagtaataaaagttaaattgcttttactaatgatttattgtagtagtgttttactgtgtcatagtgaaaaaaagatgctgaatctttttctggttatacaatgtaacaggtaacagaattggtagatggagtgttcataggattgtctatgaatcattcgcttggagatggaagttccttctggcacttcttcaactctttgtccgagattttcaattctcaagaagataacaacaagtttctctgtctgaagaatcctccaatctttcgtgaagtgtccggtcctatgtacagccttcccttcagtgaacctgatgagtccattagtcaatcagaacgtccggttttgaaggagagaatgttccatttctcatcagaaacagtgagatcactaaaatcaaaggcgaatgaagaatgcggaacaacaaagatatcttctttgcagtcgctgactgcattgatatggagaagcattacaagagcaagaaaactaccaaatgatcaagaaactacttgcaggcttgctgctggcaatagatcaagaatgaatccaccattgccgatgaatcactttggaaattacatctctcttgtgatagctactactacaactggtgatctattggagaatgagtttggatgtgctgctttgaaactgcatcaagctgtaaccgaacacactggcgaaaagatctctgccgacatggaccgttggttgaaggctcatttgaaactagatggatttttcagtccaaatattgttcacatgggaagctctccgaggtttaacaagtacggaagcgagtttgggatggggaaagcagtggcggttagaagcggttatggtggtaagtatgacgggaaggtatcagcttatccagggagagaaggaggagcaagcatagatttggaagtatgtctacctccagagtgtatggaagctttggaattagatcaagagtttatgtctcttgtctcttcttcttcttcttcttgatctaatattcttattcatatgtgctcccatcatatctctatctaaactggatttgttagattggagtattttgtgttgctgttaaaactcaatcaatattatgtgacaatgtgttattcaactgataatgattcatgtttatgaaaatattaatacaaactagtatgtgaggtttagagacgataatgttgaaatctttggggatttattctcactcactctcttgatacaacactttattttataacaacttaaaaatgaaacttgaaaacagaaccataaaacagagtaatcgcagagaagttaattagcaagatcgagagttagtaaagctctttcttgagcttatacaacaacaatacaagacttcatctgctcacaaacacagcctcaattcaactcctctctgaaccttttgtcccctttgtttcctaacatgttctagcactagaaaccatatccaaaacgacacggtttactttaaccaagaatcacgtgacgtccttgtgcttatcacatatgagataggcttgggcttcagaatttgcttgcttcttcttctaaccctctgtgtggaaacagtgtttagtgaacttagttgaaatcatgcatctgttatttgatattgatataaattaaactaagattaatgctattcaatatgacatcattgatgatgaccagcagatcaaattatgcaggaacatacatgttcatgtgatgacatcattaatgatgatagctatctataatcatatgaatattttatttggattgttctataaaagagagaataaacgaaagtaagaagataaaagaagaccaaagaaacattgaaagacacaaaagagtcatattatacacattttttttcttcttggaaaaaaatg

SEQ ID NO: 22935 - DNA, 3003 bp, Unknown; identical to SEQ ID NO: 22934
  misc_feature (1)..( 3003): 2750-1469P.txt file - cDNA_ID_2125794; gDNA_ID_2684233; Annot_ID_192325

SEQ ID NO: 22936 - DNA, 3003 bp, Unknown; identical to SEQ ID NO: 22934
  misc_feature (1)..( 3003): 2750-1469P.txt file - cDNA_ID_2125794; gDNA_ID_2684233; Annot_ID_137652

SEQ ID NO: 22937 - DNA, 3000 bp, Unknown; identical to SEQ ID NO: 774
  misc_feature (1)..( 3000): 2750-1469P.txt file - cDNA_ID_2125798; gDNA_ID_1620319; Annot_ID_153266

SEQ ID NO: 22938 - DNA, 3000 bp, Unknown; identical to SEQ ID NO: 774
  misc_feature (1)..( 3000): 2750-1469P.txt file - cDNA_ID_2125798; gDNA_ID_2684233; Annot_ID_192326

SEQ ID NO: 22939 - DNA, 3000 bp, Unknown; identical to SEQ ID NO: 14900
  misc_feature (1)..( 3000): 2750-1469P.txt file - cDNA_ID_2125798; gDNA_ID_2684233; Annot_ID_137653

SEQ ID NO: 22940 - DNA, 3000 bp, Unknown; identical to SEQ ID NO: 770
  misc_feature (1)..( 3000): 2750-1469P.txt file - cDNA_ID_2125806; gDNA_ID_1620319; Annot_ID_153269

SEQ ID NO: 22941 - DNA, 3000 bp, Unknown; identical to SEQ ID NO: 770
  misc_feature (1)..( 3000): 2750-1469P.txt file - cDNA_ID_2125806; gDNA_ID_2684233; Annot_ID_192329

SEQ ID NO: 22942 - DNA, 3000 bp, Unknown; identical to SEQ ID NO: 770
  misc_feature (1)..( 3000): 2750-1469P.txt file - cDNA_ID_2125806; gDNA_ID_2684233; Annot_ID_137657

SEQ ID NO: 22943 - DNA, 3003 bp, Unknown
  misc_feature (1)..( 3003): 2750-1469P.txt file - cDNA_ID_2125817; gDNA_ID_1620319; Annot_ID_153273
gtatttgtaatataagtatatataacaatgttactattcatcttgatattattaacttgatcatatataaattacctaaatgaattaaacaggactacaatgaacaaagggtatgctttcgtgaacttcacaaatgcaaaagcagtgtccaagtttaaggctgcttgcaacaacaagccgtggtgccatttctactcaaaaaaagaacttgagattacttatgctagaattcaggctagttccactcctttacatatatatatacacatctttgatctgtgtatcttatcttattcaatcttattgtaacacttgtcggggaaaacaacaatacttttgtgtagggcaaagatgagctggtgaaacgtttccagcatatgacatatccggaggaggcctacagtgcggtatgtttcagcccagctcgtagcggagggaaagatacagttcaaaccacaatggtcggtaaatgcaatgaaccagtgtgctcggtttagtctttccatatatgtaattaggattatgaataataaaagtgtatgcgatggtgaacatgggtctaggatggaaaagaaaagactcagacaccgaaccaaatccaagtaaaattctgaaatgtttagttttggatttggtttttgatgtgtgtgagttttgacttttcataattagtgttatgtttaagcgtctactactctacctgtttctctgatctatatataattttctatgttgttgaactgttgtctggcgatgtttatatacaaaaatatagctatggttttctctttttttttttttgttaatgattattctgatattcaaaaatttggttgaaagttcttttttttggtgaaaatcaagtcatacttcattccagttatagagaagacaaaaaaatctttctacaatgaggattgtttttgcaccaattaattttttaaaggaagtaagccacgaactcttagcttagaaggtgatcgcatgaaaaactagctaacaacataaaaaaaaaaaaaaatgagttggccaaatatcgccggtggatattattagactacgttttcttgtcaacggtggatattttagatataagactttttggaacgtaccaaaaagtttctcttattcctttgaactcgcattatgttacaaaatataactagagaatcttgcatagaaaggtttgcggttttgtcactattttgtatgtgtactactgtactgtacattgaactgttgtgatcttttcaatcatgtaaaaacctactatagaccttagcctattctggcgttacctttacacattccagtttttattgagccgaaaccatcattgttagtttgggtgacgatagattctgcagtaccttgacacaaatcttcgtttcttggggaatggagcgacaagtgtgacgtagatgtgcatcgtaggctcctacaaataatgaccaaaaaggcctttttccatcaacaattgcttctttttcttttctctctttttttgccacttttttccccactatggtcatgagtcatgaccggcttcacataaacgatgttgaatcaaatagctttttgggcggggactgagtggaattaaagatgatggattcagttagggttttgaggtagttcttggcccataatatggcccaatatatgaattttgacttttttcgaattatcgttgaagttcatctcttaacaataataagcaacaactttatgagataatgaattattgcaatacaatgatgtagaaacggaccaatacagtgtcgtgtttgacgtttaggtgggtttggttataattgtcttatcactggcccacactacaacaacaactctcgtctaaaaccaaaccctctgacatggaaagagagttttgatctacgagccaattgctttggacccgagcctcgtatttgcctccggacccgaacctctgtttggctcctccgctcgccgttgaaaaatttccgcactgatatcgatcactttatctctctcccttctctctctctttctcttcttctcctggtttcgttaattcttgaattcgaaaaccctaaacaacttgttcctagaaattgagcaagcaaaggaaagctttttttcatcttcaggtttccatttgttgtaaagctaaacgtgacacaagtgtgtaagttcacatctctgtttccctctgtggaaaccctaattcttgctatatatcctaaaaagaaatgatttttttttttacccaattattgtaccgtgtcgataggtagtgttattgtttgaggttgaattctcggttactgtaatgttcatgttattattaaccatagcttcgatttgcagtgagattgtgtttgcggcaattttgatctcaagtgtgttctcgagttttccaatcaaattctgtatttttttcgaaattagcttaattttcagctgccataagagtgtttatagctgtgaaatcggaaattttcagctggtttttgtttaatgaagttgatgctgtttactgaaatgagctctccaagtttacttgattaggtgttaagagtttctgatgttgactggaacttaggcgtcagtgtaccctaagttccaatctaaggaaacaatgcttattctgtttccttgtaccatgtgggctctgcatcaattctctagtgtctcactttgctgccctgtggtttttgtttcctctttgcagaaacaacacttgtattggctttcttctgtctagtgtttttgtttcacttgttgtgttcaactctaaattttgcagtatctgttttgtttgtttagcaggagaacctatgagtattcaaagcatgccaattggaggtagctcatgaattctggggaaagaggtgtttatatgttcccttttttcttacacattcggaatttagatcaacgaaggcgcaatgttgaacttgtttctgtgtttttttcaaaggctcagataattacaaataatttagaggagctgaatctatg

SEQ ID NO: 22944 - DNA, 3003 bp, Unknown; identical to SEQ ID NO: 22943
  misc_feature (1)..( 3003): 2750-1469P.txt file - cDNA_ID_2125817; gDNA_ID_2684233; Annot_ID_192332

SEQ ID NO: 22945 - DNA, 3000 bp, Unknown; identical to SEQ ID NO: 7115
  misc_feature (1)..( 3000): 2750-1469P.txt file - cDNA_ID_2126339; gDNA_ID_1621128; Annot_ID_172381

SEQ ID NO: 22946 - DNA, 3003 bp, Unknown
  misc_feature (1)..( 3003): 2750-1469P.txt file - cDNA_ID_2126351; gDNA_ID_1621128; Annot_ID_56405
atatgctcttgtacctatgattgcaaggggtatcatgcttggtgctgaccaacctgttatcctccacatgttggatattcctccagctgctgaagctttgaacggtgttaagatggagttgatcgatgctgctttccctcttcttaaaggtagttaagggttttgttttgctgtggatatttgcattccgtgtcataagttgttttgtataagtgggaaaggagaagatgaatatttgatgtgtattattatcaggtgttgttgctacaactgatgccgttgagggatgtactggagtcaatgttgctgttatggttggtggtttcccgaggaaagaaggtatggagaggaaggatgtgatgtccaagaatgtttccatctacaagtctcaggctgctgccttggagaagcatgccgctcctaactgcaaggtgatacgatctgtttgctttttaagttaaatgaagccactgcatccaatcttctctgttcattggagtgtaacagatgctttgtgttctctattgggttctagtttacgactctcttgctcacacattcgctctcgttttgtcttttttttttcaggttcttgttgtggccaacccggcaaacaccaacgcattgatcctcaaggaatttgcaccatcaatccctgaaaagaacatctcttgtttgacaaggcttgaccacaacagggctttgggacagatctctgagaggttgagcgtgccagtgtctgatgttaagaacgtgatcatctggggaaaccactcatcctcacagtacccagatgtcaaccatgctaaagtgcagacctcgtctggagagaagcctgtccgtgagctcgtcaaggacgatgcatggtatgtataacatgccatagaacttaagaccctttctcttctctggaagcaaaatctagtttcacttaaatatattgctcattctgtaggttggacggagaatttatctctacagttcaacaacgtggagctgcaatcatcaaggcgaggaagttgtctagtgcgctctctgctgctagctctgcttgtgaccacatccgtgactgggtccttggaactccagaggttcataataaaactcttccccgttatttgcagtgctgtttttttgtaacagttaatctaatatgagttctttctttgattcaaattgtcagggtacgttcgtttccatgggagtatactccgatggctcttacagcgttccatcaggacttatctactccttccctgtaacttgtcgcaatggagactggagtattgtccaaggtaaatatgacgcacttacaaactcaaatgctcatcaattatgaaatcctagattctgcagaccctaatgtgtattttgtttggttaggccttccgattgatgaagtatcaaggaagaagatggatttgactgcagaggagctcaaggaagagaaggacttggcgtactcatgcctctcttaaacccttctggagcaaaattttcatctataaggtgtgagatcagttaaagcctttcagggctttgtccgaataagaagtgtgtttgaaagatctccaaacactgttttataacctctttggtctctttgatgagtattgtccctggtctgtttctaaaccaggatatcgtttttttcaatgtgtctgatttggtttacccatgaaaagaagaaaattggcagttgcatggttatcttttgcgattatttttttctgctttagcaattagcccaaaattgatgagctcttcgataatgggtttgtgcaattgtgatttgtgaggaatggtgttattgtgttgcaattgcaaaaagaaatgctactcttgcagattcataccaaaaccaaatcactagattaaactgaaattctaatgtggattattttaattttacttctatttttcttcacccaaatattttataaccaaacaccaagttgacaccaaaatatacatccaaaaaacttagattgcttctattttacgactatccgaaatcgaatcataaaccgtaggcaatggtccattaataaggggtatacgaggattcaaagtttgagagaacttttttatctttacctttttccttttgtaaagtaaaagcagtggattttgattatagattctacttggtaatgactaatgagaatcaagttctcacctttaagccatatagactttagatatttaatggattctacaaaagtgggcatgaccagaatcgagttcatgaaccaccgtcctcggccccaacgttaaaaaacttttttctctagcataagaagataagagtatcttcactgcgctttaggcccactcaacattcaaacaaaattcgatctcttataaaaaaatatctcacaagagaaagttcgtacatgatcccgataaaatcgtagatgagcaaatcaaagatgagatgtcggtaaaaaaaacgctattataagaacacacgccactagttgtggataaagttgtctacttttgtctcgttgtgattattatattgcacaattattaacattcatactctcatatgggtattgtttttggtctccgttagatctcaaatctttaactttgcatacccaaaataggaagaaagaagagtcaagtcactaaaataactttcacagtctttgattcgaagatctttgtcgccgagagatatccactctgatttgagttctggtaaaaagtttccagcttttgatttttgtttctctcaattgaatttctcttgcttgctctgtttaaaaggattaggattaaatcgaatctctctctgttatgtttttttgtagattattttggattttaggactcaaagattacagatttcttatcaatcattctctgttattgttatagaactattctctggaggaggttgaggtctgaaatcatggaacaacttggttagagtgtggaattttagctgatttgatctttgattcatctgtgatcataataactatgaagatg

SEQ ID NO: 22947 - DNA, 3003 bp, Unknown
  misc_feature (1)..( 3003): 2750-1469P.txt file - cDNA_ID_2126351; gDNA_ID_1621128; Annot_ID_172386
aatcggatatgctcttgtacctatgattgcaaggggtatcatgcttggtgctgaccaacctgttatcctccacatgttggatattcctccagctgctgaagctttgaacggtgttaagatggagttgatcgatgctgctttccctcttcttaaaggtagttaagggttttgttttgctgtggatatttgcattccgtgtcataagttgttttgtataagtgggaaaggagaagatgaatatttgatgtgtattattatcaggtgttgttgctacaactgatgccgttgagggatgtactggagtcaatgttgctgttatggttggtggtttcccgaggaaagaaggtatggagaggaaggatgtgatgtccaagaatgtttccatctacaagtctcaggctgctgccttggagaagcatgccgctcctaactgcaaggtgatacgatctgtttgctttttaagttaaatgaagccactgcatccaatcttctctgttcattggagtgtaacagatgctttgtgttctctattgggttctagtttacgactctcttgctcacacattcgctctcgttttgtcttttttttttcaggttcttgttgtggccaacccggcaaacaccaacgcattgatcctcaaggaatttgcaccatcaatccctgaaaagaacatctcttgtttgacaaggcttgaccacaacagggctttgggacagatctctgagaggttgagcgtgccagtgtctgatgttaagaacgtgatcatctggggaaaccactcatcctcacagtacccagatgtcaaccatgctaaagtgcagacctcgtctggagagaagcctgtccgtgagctcgtcaaggacgatgcatggtatgtataacatgccatagaacttaagaccctttctcttctctggaagcaaaatctagtttcacttaaatatattgctcattctgtaggttggacggagaatttatctctacagttcaacaacgtggagctgcaatcatcaaggcgaggaagttgtctagtgcgctctctgctgctagctctgcttgtgaccacatccgtgactgggtccttggaactccagaggttcataataaaactcttccccgttatttgcagtgctgtttttttgtaacagttaatctaatatgagttctttctttgattcaaattgtcagggtacgttcgtttccatgggagtatactccgatggctcttacagcgttccatcaggacttatctactccttccctgtaacttgtcgcaatggagactggagtattgtccaaggtaaatatgacgcacttacaaactcaaatgctcatcaattatgaaatcctagattctgcagaccctaatgtgtattttgtttggttaggccttccgattgatgaagtatcaaggaagaagatggatttgactgcagaggagctcaaggaagagaaggacttggcgtactcatgcctctcttaaacccttctggagcaaaattttcatctataaggtgtgagatcagttaaagcctttcagggctttgtccgaataagaagtgtgtttgaaagatctccaaacactgttttataacctctttggtctctttgatgagtattgtccctggtctgtttctaaaccaggatatcgtttttttcaatgtgtctgatttggtttacccatgaaaagaagaaaattggcagttgcatggttatcttttgcgattatttttttctgctttagcaattagcccaaaattgatgagctcttcgataatgggtttgtgcaattgtgatttgtgaggaatggtgttattgtgttgcaattgcaaaaagaaatgctactcttgcagattcataccaaaaccaaatcactagattaaactgaaattctaatgtggattattttaattttacttctatttttcttcacccaaatattttataaccaaacaccaagttgacaccaaaatatacatccaaaaaacttagattgcttctattttacgactatccgaaatcgaatcataaaccgtaggcaatggtccattaataaggggtatacgaggattcaaagtttgagagaacttttttatctttacctttttccttttgtaaagtaaaagcagtggattttgattatagattctacttggtaatgactaatgagaatcaagttctcacctttaagccatatagactttagatatttaatggattctacaaaagtgggcatgaccagaatcgagttcatgaaccaccgtcctcggccccaacgttaaaaaacttttttctctagcataagaagataagagtatcttcactgcgctttaggcccactcaacattcaaacaaaattcgatctcttataaaaaaatatctcacaagagaaagttcgtacatgatcccgataaaatcgtagatgagcaaatcaaagatgagatgtcggtaaaaaaaacgctattataagaacacacgccactagttgtggataaagttgtctacttttgtctcgttgtgattattatattgcacaattattaacattcatactctcatatgggtattgtttttggtctccgttagatctcaaatctttaactttgcatacccaaaataggaagaaagaagagtcaagtcactaaaataactttcacagtctttgattcgaagatctttgtcgccgagagatatccactctgatttgagttctggtaaaaagtttccagcttttgatttttgtttctctcaattgaatttctcttgcttgctctgtttaaaaggattaggattaaatcgaatctctctctgttatgtttttttgtagattattttggattttaggactcaaagattacagatttcttatcaatcattctctgttattgttatagaactattctctggaggaggttgaggtctgaaatcatggaacaacttggttagagtgtggaattttagctgatttgatctttgattcatctgtgatcataataactatg

SEQ ID NO: 22948 - DNA, 3003 bp, Unknown
  misc_feature (1)..( 3003): 2750-1469P.txt file - cDNA_ID_2126383; gDNA_ID_1621128; Annot_ID_56419
atgacggatgagttccctcacctagacatcatcaatgatctgctggaagacgaacagtgcagcaacatggtgtataacggaagcatattcaatccacaaccgcaagtgttcaacgggcagtactcatcataccatggtgagttattgtctggtggcaggaccaggagtttcggagaggaaggattgcattacatggcacgtggaccatatggtacagacggaatgatgccgagacagtggcaaatgacgaacatggacttgtcgttgccagcaatgaggagcaatggaatggaagatggaacatcatcagcagctaattaccatcacagttactttggtttggacgcttcgaatccaagttttacgtctggtattaatggctacaccgagttcaggccatcgaatggtcattgatcagcaaatggagagaggggatttgtaatgtttttattttttttaaaaaggaaaaaaaatcatgaatatacaatttgtgtaaagagagttgtcttcttgtcatcctctacgtttcaaatggtttttttttttttaaatatagtataagatagttttcgcatagaaaaactcttccctgaaagtccctgaatagtttttataaataaattatactcctctttatctttaatcaaaagaaactgaaatctgtctaatataaaatgtgtgtgtgtgtgtgtttttttgtctaatttatttttttctttctttgtctaatttgattagatcacttctttatttgaatgagtaaaaactagaaaaaaatgtgagccatttaaatctgattcatatcaaaaaattttcgatttaaaaaaaaaaccctcaaaaggtgttgatacggaaaaagaaaagggaaagaagaagagaatggatctagaatcggtgaaaaagtatctggaaggagatgaagacgaaaaggccaaggaaccaatggtggcgaaattaccacacagattcctcgaacgattcgtaaccaatggtcttaaagtggatctcatcgaacctggccgtatcgtctgctccatgaaaatccctcctcatctcctggtaacaaccacatgaacaacaaatccctaatttcgagaaaaaaagaatccctaatgacttttgtgaatttgttgaggaaagaacgcagggaaattcttacacggaggagcaacggcgacgctggtggatttgataggatcagcagtgatctacacagccggagcttcacattccggagtttcagtggagatcaatgtttcataccttgatgctgcttttctcgatgtaacttcctttccttctttcttaaatttattagatgtctttctttgcaaaattgattgacatatatataaaaaaaaacacaggaagagatagagatagaatcaaaggcattgcgtgttggtaaagctgtagcagtagtgagtgtggagctgaggaagaagacgactggtaagattattgctcaaggtcgtcataccaagtactttgctcctcgttccaacctttgatcgttcaaccaacctttcttcttttttacattcaataaacaacatcaaggtgtttttagtctttgtcccatttgcttcttattattattgatactaataaaactacattactatatgtttttctaataatacaaacaaccttactttttctctatatgtgtttacctcgatgttgaactaagctttttttttaatatacagatagatcctgtttaaaaaatttggcttatatatttgttactgtgaatatgatgatcatttcaaggtgatgatgcatttgtaaagtattgatgaggtttgtggtggtaacttattagaattgtttatgtttcactatttttagtttcgcattatgattactttaagttttgatacaaagttggtaccatccaattatttcaatcaagttgttcattcctgccttttcttttactgttttctcacatccaacagatatgtagatcttctgttactacttttgttaatgtatgtgaagcaaaattcaaattaacatagacacatgaattcattaatcaaatttaatcagtgttcatgtatattatcaaactttgtagctcttatttgaaccaaaattcatgtatttttatcatcaaaatactccctttctttcttcttaaacttttatcaaatatatgagccacacgagtatatgacctttgattcaaaagaaaaggggaatagaatactgaacaaaggaaaatgacgcaggtgatgtgatcagttttgtcgaaaaagaatattagttgagatatgttggtttcatacttttgatctttttttgttagtttatgttattactgtatctattagacgatgaattacattatgcatagataaacaattaaatcactagtcattttggcaatcatactttgaaaaaccaccccatccgcaataagtcaagtcatcattaaattaccacatcatgcatgatatcaaatttcatataatattaatatctagtagtagctagtagtactatataataaacattaaataaatcccactagatgcattcttaagagaaatcttccaagaaaaattcagacatattagatgagaaaagaaaaatccaaactagaaatcaatgttgtgttgagttagtgcttaccctcgcagtctcaatctccttcccaaaaagacttttcaaaccaaagaatggtgaaacccttaggaggtaatggtcttcctctctgcatctctctcttcgtttaccagtaaacaaacaacaaaaacgtatttgaaataataaatactattgttttttatttctttttctctctctctctctctcttattgagttttgttgatttctttgctatagaaggaacaagagatgtctctaatgttggttgtaaatcagttgatctcctcctagcttctcttggtggtcttgccgccgctgtagcagctgcttacgccggagaattactccttcgacgccggaaacttgatcaaggtgcttccatg

SEQ ID NO: 22949 - DNA, 3003 bp, Unknown
  misc_feature (1)..( 3003): 2750-1469P.txt file - cDNA_ID_2126383; gDNA_ID_1621128; Annot_ID_172405
cactcctcaatcctataaaaacgctatagtcggtaactctcttggttcatcatcatctagtttcaaccaccacccaagctctcatggagttgtcccgaccacattgccatcatcatcttactcgcaagcaccaacatcatcttatcagtcaagcttcccttacagtcaagatgggctcttgtggacaggaagaagtcccagttctgtaaacatgggcatgtacaacaacacttactcacccgccgttactagcaacagatcgctgaaccacatggacgttcagatagcgcagcaacaagcacaaagcatgatgacggatgagttccctcacctagacatcatcaatgatctgctggaagacgaacagtgcagcaacatggtgtataacggaagcatattcaatccacaaccgcaagtgttcaacgggcagtactcatcataccatggtgagttattgtctggtggcaggaccaggagtttcggagaggaaggattgcattacatggcacgtggaccatatggtacagacggaatgatgccgagacagtggcaaatgacgaacatggacttgtcgttgccagcaatgaggagcaatggaatggaagatggaacatcatcagcagctaattaccatcacagttactttggtttggacgcttcgaatccaagttttacgtctggtattaatggctacaccgagttcaggccatcgaatggtcattgatcagcaaatggagagaggggatttgtaatgtttttattttttttaaaaaggaaaaaaaatcatgaatatacaatttgtgtaaagagagttgtcttcttgtcatcctctacgtttcaaatggtttttttttttttaaatatagtataagatagttttcgcatagaaaaactcttccctgaaagtccctgaatagtttttataaataaattatactcctctttatctttaatcaaaagaaactgaaatctgtctaatataaaatgtgtgtgtgtgtgtgtttttttgtctaatttatttttttctttctttgtctaatttgattagatcacttctttatttgaatgagtaaaaactagaaaaaaatgtgagccatttaaatctgattcatatcaaaaaattttcgatttaaaaaaaaaaccctcaaaaggtgttgatacggaaaaagaaaagggaaagaagaagagaatggatctagaatcggtgaaaaagtatctggaaggagatgaagacgaaaaggccaaggaaccaatggtggcgaaattaccacacagattcctcgaacgattcgtaaccaatggtcttaaagtggatctcatcgaacctggccgtatcgtctgctccatgaaaatccctcctcatctcctggtaacaaccacatgaacaacaaatccctaatttcgagaaaaaaagaatccctaatgacttttgtgaatttgttgaggaaagaacgcagggaaattcttacacggaggagcaacggcgacgctggtggatttgataggatcagcagtgatctacacagccggagcttcacattccggagtttcagtggagatcaatgtttcataccttgatgctgcttttctcgatgtaacttcctttccttctttcttaaatttattagatgtctttctttgcaaaattgattgacatatatataaaaaaaaacacaggaagagatagagatagaatcaaaggcattgcgtgttggtaaagctgtagcagtagtgagtgtggagctgaggaagaagacgactggtaagattattgctcaaggtcgtcataccaagtactttgctcctcgttccaacctttgatcgttcaaccaacctttcttcttttttacattcaataaacaacatcaaggtgtttttagtctttgtcccatttgcttcttattattattgatactaataaaactacattactatatgtttttctaataatacaaacaaccttactttttctctatatgtgtttacctcgatgttgaactaagctttttttttaatatacagatagatcctgtttaaaaaatttggcttatatatttgttactgtgaatatgatgatcatttcaaggtgatgatgcatttgtaaagtattgatgaggtttgtggtggtaacttattagaattgtttatgtttcactatttttagtttcgcattatgattactttaagttttgatacaaagttggtaccatccaattatttcaatcaagttgttcattcctgccttttcttttactgttttctcacatccaacagatatgtagatcttctgttactacttttgttaatgtatgtgaagcaaaattcaaattaacatagacacatgaattcattaatcaaatttaatcagtgttcatgtatattatcaaactttgtagctcttatttgaaccaaaattcatgtatttttatcatcaaaatactccctttctttcttcttaaacttttatcaaatatatgagccacacgagtatatgacctttgattcaaaagaaaaggggaatagaatactgaacaaaggaaaatgacgcaggtgatgtgatcagttttgtcgaaaaagaatattagttgagatatgttggtttcatacttttgatctttttttgttagtttatgttattactgtatctattagacgatgaattacattatgcatagataaacaattaaatcactagtcattttggcaatcatactttgaaaaaccaccccatccgcaataagtcaagtcatcattaaattaccacatcatgcatgatatcaaatttcatataatattaatatctagtagtagctagtagtactatataataaacattaaataaatcccactagatgcattcttaagagaaatcttccaagaaaaattcagacatattagatgagaaaagaaaaatccaaactagaaatcaatgttgtgttgagttagtgcttaccctcgcagtctcaatctccttcccaaaaagacttttcaaaccaaagaatg

SEQ ID NO: 22950 - DNA, 3000 bp, Unknown
  misc_feature (1)..( 3000): 2750-1469P.txt file - cDNA_ID_2126471; gDNA_ID_1620321; Annot_ID_153327
gggattaaacggtttctcattcaacgcataacgaatgtatttccgcaatatctcctccatgttaaactctgtctggattgtagaaaaacaaaattcagcatcctcatgtcaaattctgaactggaaatgattaagagatcaaaccaaaagattagtgacatgttatatatattctcaccttttgttcaagtgccttaagctcagagctatgcactgttccagctttccttaatagctcatctatagatctgcaaagcatagcattctgattcacctgaagagattcaaaaaaccaaaattgaattagtttttttttttttaagtaaggatcacaaaagagagagtggaatcagagaccagtttcttgcgctgagctttaggagaagagaacttctgaacggttttgacgaaagcagtgacgaaagtgacgccggcgtaagctaacggaacggcgagcatccacggcaatttgctacttccaactcgaggaccaggaatcgcctgactcaccgatccagtgaactcgactaggtctaacgccttctcttgaatccacggcatatcttcctctacttcctcttctgtttcctcctccacgctcgaattcttcttcgctgccggtgtcggcgccgtgacagtctccgattttttcttcggcgctgcggcggaaatagagatgtgtttcggtctcaactgacggagagaaggtagtggtgcgaacagtggtgttagagggagaaggaatggttggccattgttttgggttcgagtctggagaaattgagatgaaggaaggagaagagacgtcattgttgaagctcgacgatttgaaaagtcggcttcggatgcggcggggctcaacagtagttagcttgtcggggaactacgacggaaggtgaaggaagaagatataacaatttctatttatttgaaggggtcattaatgggccttttttactcggcccatttattttaactataaacgatcatcaaatggtttttaacaagaagaaaaagtgaattcagcagacagcagacataataacaaatggattaattacccacacaagctagaattttttgttactcccatgttaaatcggattattatcccaaatttagttcacaatataaagtgatttggtcatgctaaatgcatgggtaccaatgcaaggcacatgaacatacactttagaaacttgctaacaaaaacctttacttgaagtgtctgcattaacttcattttcttttcccattttctaaaggtataaggttgagcgcatgattctataactatttttcttcattgataaggcaatagaacagagttattctaaatttgcagtaaatacagaagcttttggaacattcaggtcaataagaagtaaaagaataaaacctagttatacattatcgggccagaactccctaaagaaggctcgttcaaattctttttcctgtaaatgtttttcgtgctccatcatcttccgcattttcttcgaaagtttcttactctgctttgagacttcttcatcctgaaaattttagtaaagaaaagataagtttcgatgcctaacttgaaaacaaatgaaacataaaagctaatggcaacgtgataagccaaaaatcaagtccagcactattgagatatgaagtgtcgctgatgcagactttcaaaaaataaaatcagatgagactctttatcaatgcctgaacacttcttcatcattagctattttcagatttaaaggctatcgcatgtaagggttttaagaaacaagaccttagcctgaggctgagccacttttctcttagctggttgtttagctcccactcctcgtttgttatgttttggctctgcttgtagaggcaccaatataccctgttcagcgattccaagaccagtgccttccttccagccatgcttctttaggagctgaaacccaatgttggacgaatttatagcagccaatgaactgcttgatccagaggactcacccataacgctcgacacctgaacatgttaactcacaattgtcaataaaaacaaaaggaatgcacattcagttctgcttacttcttgtagtctattcaattcacaactagaaacagacccaaaagtttcctaccactgaacagtaaacaaaatgttaataggttaaatgcagcacaaaatagaagagatgcatccagaaatgagttatacctgaaacctattagcagattcaatgacagcccatgaacttgtcgaaaccgaggaatctcccataagaaatcgaaacctaaatacaatgaaccaaccatcagaaatattgttatcatctaaattcagggttcaattaaagccaaacacaagaattcgcttatgttgattatttcctggaataaattagagcaaatttcacaaaccatgagcctgaatcatcaaaatattaagataataatagatagacggaactcaccaaaaacgtgaaactcaagcagtcaccgaacaaaacgagaccaatgaaccctagaatcaccgagacgatctgatgaaaactgagtgaaaatcgcttcaatctcttcctctctctatcgaaccaccgcctttgctaatcgccggcctgtagcagttggatcgtcttacgggaactgagaaaattataaaaagacgcctcttatgtttctaaatgctaattgttcccaatactttataattatttcatattcgacccacatattttacgtttatcgaagtttaggatagtttcataccggaccagaatatttgggcctggaccaagagaggcccataaaatagagagaagcttaacgtcaagaagacgcggagtaatctaaaccaaacagcttatctcgagttcgtcggtctcaggtgggcagtgattataacttcgtctccgtgtctgttcaagctcccattcttgtggccttcacgcttcaggaacaaagaccagtatctctctgaaagactacttctcggaaattttcgtctccatg

SEQ ID NO: 22951 - DNA, 3000 bp, Unknown; identical to SEQ ID NO: 791
  misc_feature (1)..( 3000): 2750-1469P.txt file - cDNA_ID_2126482; gDNA_ID_1620321; Annot_ID_153330

SEQ ID NO: 22952 - DNA, 3003 bp, Unknown
  misc_feature (1)..( 3003): 2750-1469P.txt file - cDNA_ID_2126494; gDNA_ID_1620321; Annot_ID_153335
aagctttgcttataaaagattaagcttcaaaggtgttaaattaaacatacagaaatggagaaagccatctataattgattgaacaagatccaaagaaaagtatgtttcttttagctgttcagaatcataaatactcttctaacttctaaatcaccagatgatctacgtgagagagattcgtgctggactctgcagtgtaagaaaagccgcaagtaagtcaataacgaaggtatagaagattaacaatggtgccagatattctcgagatcacctgttttgtgaggaatgttccttgaggatatattgaactgagcctgatgttgtttattcctctgtgttgtgtattgaagaataacgattagtgttataagttaagttgggacatatttcgacaaactgaataagaatagtttgtggcagatgcttacaaattataaaactagcggaattcatcgtggaaaccataatcatcatcagtgtcatcttcatcgaaaatggcactgtagaagacgtatggatgctcaatcatctctgccaaagtcaaacgtctatctttgtctgaatccgcctggacgattagaaaaagaagagataaatcataaatgtaacatggaacaattcagcagctaaatacaccatttatttggaaagttatgtacctgtgatattatataatcagcttgttgctttgcataataatgctcagtaggatggattttactgataatgggaagcaattcaacgtctgataagtacctgtagataagtggcaattatgttaagggatgtatggtattaatggaaatgctaatcatggtgtgtactcgtatattacgaacccgtcatcatttttgtcaagctgagaaaacaactgctttgctgggccttcaggcaagtcatggtaaggatgcgtagaattgtgattgtcttcttcgtagttccttacagtgtcaaagaggccgtggaaaaactcttcgaaactgatcttcccatctttatctgaatccctttctctgggagagggaaggaggggaatccgttgataaacattaagctaaaagaaaggttcctcggaaataatcatatgacaaccgtacattaccttacttcctccttgcataaccataacagtaactttgggttcttggtgtcagcaggatgcagaaagctaagggaattaaccagcaaaaacattgtgagaaatagaaagaaaaaataactgatagtactaaaaacctgaaatagctcggttgatttctatctacactagaagaaaacgcttactcgttaaactctgttaaattcagaagaccatcaccatttgcatctgatgcattaaaatgctcctccttccaccagcccatatcatagccaaacgaattattatctgttaaatttataaccaagtcagctagcagtcctaagagacaaaagtgagatcatttgcttaaaatcgcaatcaaactgtggtccagaataaggaaaggattattatataggtcataggcagaagagctagaagtgaaacacagattaaagcaaatctacttacaagactgtcatcaaatatttctacatggtcatattaagtagcaaacattttagtcaatgaaactcaaagacgaacaggaaacagcagctcacccgacttacggacccaagacggtggttcatattcagagaaagaaataaaaccatctttgtttctatcatgaacatccaggtctcgttgagttctgtgcacaacttccttggcagaagactgcatagtccactcagtcaattcactctccgtcataaacccatcagcaggagaaacatcaatcttcggaaacaacaatatcagcctgcaaagtaccatagcaatcaaactcattccttacaaaaatgacatctttagtaaatgctaaactaaaatcttcaaagatccaaactttgaaggaaattgaagtacacattgttgcaattagcgctcaaaatcaaagattgggaactgaagatatatataagtataaccaaacctatcagtgacattgaacttctcctcatcatttaagtaatcctcagcatccatgaattcttcccactcaggctgcgactcgtgaccaggtgcatgttcatgtccaccaccggttgtttctttctgagaatgagagacaagctccgggtgagaatgctcaatgtactgtcgctcccactccttatcctcgcggcggcgctccatgtcggcgacaagaggatcaaacggaactggatcgtgacgagtgggtttgaaattgaaagaagaccggagttttaagcggtgatgttgattgtgaccaccatggtggtgatcgtggtcacccttcttcttcggtgaataagagacgaggaagagcaccaggattcctaccgtaatgtataggatcaccgaagctttactcattgggtatttttgtgtaacagaagtagaaaatctcagcttgaaaccctaattttgttggctgaaagttgaggtttttacacttgggaagtgaagaagattagatctgttggaaagatggagtcttgcgaatatatatctatagaagattttgactctagatctgttacgaccaaattagtcaaatggtttgtagtatttaagagagagcccacaacacacatcaatattgtacatttatttctctaaacgcaatttaaatgattaaacgaatttctgctaattttgtcatttcgagaagaattgaaacaaccgttggattcactttcaatcaaagcttaataattgaaaaatctagcagattacactccacgtggtccagtccaccatcttcttcgtttactccttcctacatcgatattatacacacatgcgtgtgtattggatctcacgatttcttatcaatggaactcgcttctctttctcagatccccatccaaatcgttttataggtagattagatagataaactacggatatactcgaactctatccatttacggtattgatttggaaatatg

SEQ ID NO: 22953 - DNA, 3000 bp, Unknown; identical to SEQ ID NO: 790
  misc_feature (1)..( 3000): 2750-1469P.txt file - cDNA_ID_2126506; gDNA_ID_1620321; Annot_ID_153337

SEQ ID NO: 22954 - DNA, 3003 bp, Unknown
  misc_feature (1)..( 3003): 2750-1469P.txt file - cDNA_ID_2126510; gDNA_ID_1620321; Annot_ID_153339
ctgaaagacatatttgttctgaagttccttgggaatctttctcgtgatttcatgtgctttagccaggtaatcatttactacccaaggtatactgtggcatgtggaatctcgaatgaaggacttcagaaaatttctactaaatggaaacttcttccatgacagatcctccccaaagagcactgtgttatcatctacttccttgtttttgtcaaggaagcctacctcatactgaggtttactatccccatctgatactatcctcaagattttgcaaggatgcagttccccatccctttccccatacaactctgcgccagggaaaaagcaatcttgcaactctgtcgctattttgtcagcaagatctttcaatgaaagcgtaccttttcaaaatggaggaaaaagagtcagaaataatgctcataaaccagagatttcaagtattaagaaaattatcttacacaaacaaattcaaaacggtaaaaaggtagtcctgatttgcaaaacttatagagagaaaccgagaaaggtaaaatcaagacttggacactctgcaaatcaagacttcgacacacttatatcacataaaaataatcaatgaaggagttaaaaacttactgaattggatgatgcgtaaagcaggtgcaactagctctctgggcagagtttgaaccttcttgcctgccagtttttctgaatctaaggcctcctcgtagctcaagctagttttaccagtagacttacaagtccaaactcggttgcgatacagatttaacctcttcaagtacaatctattttatgttaagcaaacaaatagttctgacacggcatgtgcactgataaacatgaacaaccaagcctttgaagaataatatgaataaaggttgtcccagaatgaaacaggcaaacagaattacaagttttaagcttatttctctttcctctaactgcacacagaaggagaaggcaaatattcaaaacataagtcttaaaattgtaacagttacagaataaggatactgataatctcgaaagatctcatttgttagacgaacttgatagacaagttcttgaggctccaagttctttgggggctccagtagtttatgtgacttcttttttagtagaggcatccttcaaatggcaaaaccaacctgcagtgtagacaaaaatgaatggtctatataagtgattctcatattcactaatgtgaaatcctagtaaatgtagaaccaggtcatccaagcaagaagggaattgtatacaaaagcaagacgtcacagttgttccaaagcggaaaatgtaaaccatggagaacagaaaatcaacccataaggcgtttaaggtgacacaacggtcaagtaaaacttagcaaacgtacaaatttgtggcacagaatgcaaatgattgcatgcaagcctagagctgattctaatttctactgaattcgacagagcctatggaaaagcaagtggtacttgtgagatcatgtgcaaaaaagaaaagccaatgaaaaatgttaagaaaagcaatgcagaagaaaccgagatagcactaaaccctagaaaaatcgcaatcccaatcgaaattagaaaagatctgaaaccatgggacaaaattgacacttgagagcaaaggaaccaaaacgaaaccgaggaatcaaaacacatacccaagagagatcgagaaaaagaaagcactatcatgcgccactttcggagaatccagaaggcgaaacggacaagtaaaacacacaaaaagcagtcaaaaaagcataacaacacatgtaacaaagaagagacgaacacaatcatcaataacaaacaaaacggaacgaaaattcgaagctaatgcaacgaaatcacaacgaagaaagcaaaatcgcagaagaaaagaggatcgatgttcccgccacaacaaagaaaacgattggagagaattataaacaacgaaattagagagactcaatcaaaaatcttacggagaatgtatgaaattgggaatgcgcgtcgtcgagagagagaggtggtctctcaaggaaagaatacaagtgttgagatctcaccgtctctcttcgtttttctcttcgctctctctctctctctctcgctctcagctctttttggtcgtcgtccttccttatgggaaagacgggaaaaaaaacttaatatgcgaattagcctctcaccttttttttgttattttatatcttaagtagcactcggtttcctttttttgtttatacaggtgttgctgttttagagccctatactgtagtttttcctttttctatagtagcccaataactgggccttgtcttgttatatgggccttgaatctttagctttaaatggggttggatttgaaaccagtattttattcattgcttacgatttaaaatggtaaagccttaactctccaccattattatttgattaaattccaaatgatgtttgaccaaaaaaagaaaacttcaaataacccactctagaaaccaagtcattaaataatgtttcctgtgtaaaattcatggaccaatcgaaatgcagaagaaaatctttacagtaattagaatggccaaccaaagtttgttgtttttgtttttgtttttgtcaacgactcaagatgatatttatttgtgtttacatgaacacccgccaaaaatatgtactaaaatatctatttcaaatatggtattttatggcctaaaatataataacatcacttttttccttttcttaaaactaccaccacaaaacaacaaatcaaattaattaaattcttcatccataaatctatcaaaacttggtaccaaactcgtgagtgacgaagcctcgacgacttacacatatcaacacgtactttatgtggtagttgtctctatccagcggccaagatttcgccacgtcctcacttcctccctccttaaaaccactcgtaacaccatcccccaaattacatatccgccattgtttccggcaacgcaaactaccaaaaaaaataatg

SEQ ID NO: 22955 - DNA, 233 bp, Unknown; identical to SEQ ID NO: 789
  misc_feature (1)..( 233): 2750-1469P.txt file - cDNA_ID_2126513; gDNA_ID_1620321; Annot_ID_153340

SEQ ID NO: 22956 - DNA, 3003 bp, Unknown
  misc_feature (1)..( 3003): 2750-1469P.txt file - cDNA_ID_2126569; gDNA_ID_1620323; Annot_ID_153407
aaaagtataatcatccatctggtcgtgtatatacgtactatgccaacttccatgaattttcactgattagtttattaaagttctcaactatcttcaggaaattcagttcgagttgctaaagaattgggcatataatttccacgaaactttgcatttgatagataatttaacatgacttgactatttatactagatatgtgtaatttcccacctatcttttagggtctaaacatttttgcatgccaaaagagttaggtgtggtggaagctaccatatgctcttaacatccatcttctagaattataatcttcgattgtaagcctgaacattttcatttttatgagatatttaaatttttagcaaaacaaaaaattggcatatgagtttctttgtacatgtttcttaagctgtacttttaaagttgtagacaatgttacaatatttcatgtacagtttctttatcttcatgccgtggagttatgtttttactttttaggttgtgcaacactgaaaaataagggttctaatataaatggattcatattttaaaatcaatttttgtagcatgtagagcggtaagaactattaatcaagctcaaaattatgaaaatttgtatttgctgcaatgttgaaaatatgatcatcatattaaaatattattattaagaggttcttattaattcacatttccacaagtaatgtttattgttttggcacaatggtgtcagatcttgcgtggtgtcctggtgtcctaatatcgtacatgtataaactataaaagtcttccaccgtactaattaattaatgtttaacttgttaatgagaagacaaagttgccaactaaaaggtaaccaataactaatttaaaagagagtagtcttggtcataagtcataactcataaaaatgaagatcacgaactgatttgagcatttagtgggtccttgatggttatcatcgagatgaagtgaatcttgtcatggcgggttattatactcataaacactaatgatatatttgaaatagtagttaaattacatttcatgagggacaaatatgatgacggtataattatgtcaattgaccgtaaagagtttggtggcagatagaactggtcggaaatctaacataccaaaggattattacaacctcgtcatgtttttgttacaaccttttaattaatgttcttagtttataccctaagttattacaacctcgtcatgtttttagtggtcgtatagactttgttcttagcattttaggtttcatattagtttgatgtaagcttgcattatcatttctcaactacaactcgaaattagatctagttacattggggaaacaaaattctacctgtaaattatttaaacctattcttggattttgacgaaaccagcattaatgttgtcgtctcttaagatattagaaataggattaaacacttccatcgtcatattgtttgaaagcaacttgataatgatcacagacaaagatgattaaaaacacttacattatcacatatactaaattgatgttattataattaattatagaagggttgattaattaagagaaatggcgaaatcaggagtggggtggtaggtgggagaaagagaggtcgagcacactgtggtagttggtgagtgtgtgggggagccttgtacttaggttttgccgacttctttagattccggttaagcttttggttttggttccggtttaagttagagatcttaaattagtgattatacaagaaatctcatgtagtaatattattctatttgtggtccaagatatggcataagatttaacgaaagaattgaatgttataatgtgttgcaagtagaagctttttacgcttttaattaatgttcttagtttataccctaaagttatgaagacaaatagcagcctagccctcgatggctcgatcaatttttatcttatatttctcattgttcattgttattccgttatatttctagtatcgcgaaactggtttcaggtgacaaattgaaagtcaagtgatcaatgaagaaatatttggcttcaatatgtattttctacgattttattttcttaagatgtagcttatctaactactgcagaaaaatgtatacacgtaaatcatgtgatgagctttgttttcaacgtgaaatatctcgttccaaaaaataagaattttatttttccattatgttgtagttgttttcagacagcattttccactccacttaaagagttctcgaacttattcaatgattggtcatgtgaggctgtggcatatggtgattgaccaattaatttaagcagtcaggtcaagtaaaataagtaaattaagcactcctaaacacactaatattgaatcatttgcgttagtttttgtcgtaaattgtgtacatttaaaatatgtttagataaattattaattgatatcatccaagtggtaaatctttcagatagaaatgctgagttcgacgataattgagacggatcttttcttcaaacgagataatcaatctaatactattgatttttgtttatgagacatctaaatctttcagacttgaattttcaaatattatttataaaaaataataattggttggtgatcaattggatccagtataaagctgaagcctgaaagtagacttttgtaacgcaattactaaatatcaaacattgtatgcattggtttcttgaaacggcccatgttcttcaaagtatttgatgttcggcccatataagatttgaaaggtatgggccaatgataattcagataatctacaagacgcatttttaagccttcttaaacttacggggcaaaaataagaaaaaccaaaacaacaggggcgaaatacaaattatctgcaaatgtttttgtttcttctcagtgtctctagtttacacaaaaaccccaaaacctctctcacaacgcttatctgctcaacaacactcttcacctatccacttctcatctcttcgttatcccctctctctaatg

SEQ ID NO: 22957 - DNA, 3000 bp, Unknown
  misc_feature (1)..( 3000): 2750-1469P.txt file - cDNA_ID_2126639; gDNA_ID_1620324; Annot_ID_153429
aagaagaagaagaagaagaagatgaggctgtgattgcgttggagaaggagatgtggagcagattttacagtggtggtttctggcgaagcctttctcaagctgaaacggcgtcgtctcccaaaaacaattaggcgatgatttttttttaagtgtagatttgattcaatgtgtaatgtaaaaccaatgtgaattggagatcaatgttgataaaatgtgtgttttgtgcaatggtcaagtgtgacctttcgatttttctgtggctttcaatcaaatcttttgaattgtgactatacaatgtgacataaacagtaaagaattgatgatagctaaaaactagagactatgtattctcttagtcgaataagctaagcaagcatttggaatctattgggatgatgattgagattgagaagctcagaaaccaactttgttggaggaatcgtttccttgaactaggtagttatgtttagccgtacaagtagacgtccactaggtgaagatctctactccaacaacacttgtacaccactttttcggagatacgaaaacaaatcattttacaagtcaaataatactcaaaagcaaatttaaagtgagtatgattaacatttaaagtgaatatgatttataaggcatataaatcatgtgcatgaatcatatagattcatggactaagttaactgtattggatcaaaacttatggtaacgtacgtaatcttatgtgcatatctaggttacacaataatctatgaattcacatcacatgtatgataatattgaactgaaaaaaaagaaaaagacatttgtttgagtttgaacgtggcatacatgccatattgaacagtctaagtaggatcaatcactgtgaagaaaaacagtggtttgataccgtataccattataatgtattgagattagctagttttgtactataataagtctataacatttgaaaatgtattgattaagacgtgctttagttgggatcatataaagagcaggatccagtaaatagattcggaagaagcgtgggatatggaatatagctggtataagctatctataataggtgtgacagtctagggcttgagagagagagagagagagagagagagagagagagagagtcaggtcaggtggtaaaataataaaggacattgagtgaaaaaaagtgaataaagttaagtaattagggtttcatgtgaggccagagtacagtgtgactcttcgtgtaaactgtccttttctttctttaccttttgattttatgtgggggaccttttgatttgtttttccctttacattgatttcacagagttcctaccacaaccattactttcctctccatatttattgactcttcttttatttcctcttttatctctttttataaatacagatttgtttagtttcaattgtcatacacatgaaatggagctgtgataagacaattctccatggattttgctatgcgttgaatcccatgcaatttttttttgtcttaaaatgtctttccacaacattaaggtaaagaaaaattaaatactcctatacatttaaattcctttttactcctccctcatatcacataagcaaacctaacccaatcgaaatatgtggtcgctgtatatccttcatttaagacatataaagagttaaaatcttcatgccaaactaatatcacatgaataaataaagtgttcccggagattgattcaacaatgaatgaactatgctagtaattaattaattataaaaagttgaaaaactatttttttgtttggaggcgtgagcgagcagcaaccaacctgtgctattaaggcaaggcttggattactttactggtcgtgaaatggaaaaagcaggagaaactataaaaatgttgaattctaggtcagtttgaggatagtccatgagaccatgacctaatctgcaatagtgtgagctatggagatggagaagtattaaagacggagagattccagggacgttcactgaaaacctctatatattgaagattgaactagttgtttttaattagaaaggtggacttgtgatttttgaatatttccggatctcttttgttgtggaaagcgagaagatatttataggatttacgtgatccatatatttttgaagtgccacttttttttcattcaattgtaatttgcgtcactaagaaaatgtttattttgcaaaacccattaactgtacgactacaatctactatatgtgctaaataagacaaacaggccaaaagcccaatttgagcccacaaaaggttatacttgtgtctgtgtggggttataataaacaagatattcgctcttttagtaaaaatgctagacgacagaatagatgcttgtttagtagcgtggcctttacgcacaaatatggcgcgtggaagtaagttttccgacgagggtcatttactcaattcacaaactctacagatggatgtttacgtcccaaaccgacagagccacgcgttcctctctcagcttctttcttttgcttccatcataactcacatgcctcttttcacctttttccttgtcctaatttcactttcaagttaagtatcatcacacttattcattcagtcattcacacattatttcctctcaccaaaattacataattcttgtgaacattggcttaaaaccaaaaaagaaataaagaaagagtaataagaggaagtagaagccaaggccgagccgagtcgagtcgagaggtgaaaacatgcaaagtcagcaacaattataaaatttggtgtggtccccataaccagcctggttcgaaaagtcggaaaacccaaaactacacaacatagacaacacaaccaaactcatctctttttctttaacacttccacttgccatcgccgacacttcaagaaaaattaaagaaaagaaagtaaactctttcaccaaaaaaaataaagaaaatttattgttccatctttctgataatcggatcttacagagagagagctccatg

SEQ ID NO: 22958 - DNA, 513 bp, Unknown; identical to SEQ ID NO: 286
  misc_feature (1)..( 513): 2750-1469P.txt file - cDNA_ID_2126653; gDNA_ID_1563366; Annot_ID_147550
  misc_feature (50)..(50): n is a, c, g, or t
  misc_feature (52)..(52): n is a, c, g, or t
  misc_feature (61)..(61): n is a, c, g, or t
  misc_feature (63)..(63): n is a, c, g, or t
  misc_feature (70)..(70): n is a, c, g, or t
  misc_feature (73)..(73): n is a, c, g, or t
  misc_feature (82)..(82): n is a, c, g, or t
  misc_feature (85)..(85): n is a, c, g, or t
  misc_feature (91)..(91): n is a, c, g, or t
  misc_feature (93)..(93): n is a, c, g, or t
  misc_feature (98)..(98): n is a, c, g, or t
  misc_feature (100)..(100): n is a, c, g, or t
  misc_feature (105)..(105): n is a, c, g, or t
  misc_feature (108)..(108): n is a, c, g, or t
  misc_feature (130)..(130): n is a, c, g, or t
  misc_feature (132)..(132): n is a, c, g, or t
  misc_feature (145)..(145): n is a, c, g, or t
  misc_feature (154)..(154): n is a, c, g, or t
  misc_feature (157)..(157): n is a, c, g, or t

SEQ ID NO: 22959 - DNA, 3000 bp, Unknown; identical to SEQ ID NO: 822
  misc_feature (1)..( 3000): 2750-1469P.txt file - cDNA_ID_2126711; gDNA_ID_1620325; Annot_ID_153466

SEQ ID NO: 22960 - DNA, 3000 bp, Unknown; identical to SEQ ID NO: 817
  misc_feature (1)..( 3000): 2750-1469P.txt file - cDNA_ID_2126715; gDNA_ID_1620325; Annot_ID_153467

SEQ ID NO: 22961 - DNA, 3003 bp, Unknown
  misc_feature (1)..( 3003): 2750-1469P.txt file - cDNA_ID_2126738; gDNA_ID_1620325; Annot_ID_153472
aattaaattaaagttttaatgaattcagtctagaagcaatacaagtttctgaatttgtgaaattatatatatatttgtttagcagatcacatcctaaaataactaaccattttaaaaaaacttaaaaagttcagaattacagtagagatgattaaaacaatgtgactgcaagtttccaacctactggctgggttataaataatatttacttataatggattcttaatatacatagttttgatatgtttatgtagtttaacgacaatgcgacacatattaatattataatttaacttcttacatatgtttgaaatcagtaaaaccaaaacatgtcttaaaaaaaaaaagagatatatatatatataaaaggttaccaagaacataaagagaaaataaaatataagaaatttaatagtaagtacggaaccctatataaaaataatgaaggaagtctctttagcgatgacgcatcaatatctcttgattaattaattttattctcttcatagaaaaataaatactaagataatacagttttacaaggataacacatcattatctcttagttaattaattttatttctcttgataaataaataaataaataccaaaataataaagtttaaaaattcctttcatcttttatatattggatttgatagccattatgagaaaagtaccaatcagaaatggtgaattaataagttaataatgatgatttcatttcataccagaattggtgggcttaattccttaaaaacaaataatttgatcaagattaatgatagatgtgaatgagtaggagagcagtaacacacaaatgaatgaaacgtgaaatataattaagtccattagacgtgcttaccatattcatatgaatcatacaaactaatctgtcatcgataaaaagaataaataattattctctttttgtttatttttataataatgtttagttgaaatgaaaacgttatcgttagagccacgcacgatcctaaattctctactataagaatatgtatgaatactatatttgtagttcacattcgctttcctaaggtttaccaaccagtttacactgaaaatgtgtacatgacaaattgacaatgattgtttcgttttgtttacgctgtttttttttattattgaaattcaggaggttctaggccgaaaacgtaatccccaaaaacccgaaattatattatgtaatattagtttcgtctcaaacatcactcgaaccgacgacctttaaacttctcctagagtttttaccaattgaattaacgacattataatttatttttcttagaagataaaagtaataatcaataccaaaagccaaataattattcttcgataaaaaaattaatttgaaatgaaaacaacaccaaacgcctaataattattggatgaaaaaacagtattcatacattaattaataagtgaatcatcttacatgtcaaaaaatgttaatggtgtttgtatctatctattcttttcggtgattgattacatcaacaaccatttgaaaattttgacatctttttttctgacatattggatactgccctatttattttgtccaaaacaaaaaaaaaggatactgcccttttttcttctcatagacaaaattaagtatataatttatcaaattttgttagatgattttttttgaataaaagatgatttggttttgaaaaaaaattcaactccatgttaactaacaattcatacaagatgaccaaaaaaaaaaaaaaaatcaaatgaggatttttttttttttttttctgttttttcttggtctttttttatgtcagcactcaattatgtttagagttgacatgtttgaatatatatatttaaaaaatctaaaatagtttaatttgagaaaaagaaagaaataatgaacaaaaaaaaaagagcgagcgttcgttgctccggaaatgatgggcaaaagtgggtaagtgagtgggaaatagaggtctgtgaataccaaacgcttccctttttcttcactttcttccctctaattactctcttgtctctctccctttcctctttcgtctcctacgtgtttaaaccttgcaaaaaatcaagtcttttttggtgtttaaatcacccatttttgtcaatctgtttttcgagcaaaacaccaggaggaaaccaaaaagctagaggctttgtggagtgagaagaagagtctcaggttagtttcttgtattcttctgtgtattctcattatctgtttttttgttctcattcgtcttgtctgcaaaattcagttcacaaaggttgagactttacacgacttggttctctttaaaaccgttttgaggtcataattggtaaacatttgaattgggttttaagagctctgtttatatagtagaagaagttggaacctttcaatgttcttgattaagggttttaggttgaatgtttatagggtttgattttggatgactagtccctttttagattatttacttgaaatggccctttgtctctgtttatatgctatggaacaaaatttgcaattcttgatctcggttggttggaaaatgctaattctttaatcttttatttgtagattttgttaattctttgttgtcttaaaaatagtattgttgaagattcagacaaaaatgtgtttttgtttcagatcaaattgtctggtttctttagagctgtggattctacttcttgtctgtttgttattctttattaagatttagttggcgtgttgttgtttaccttaaacatccacagaatcatatactctttggtttaaattccttaaaatggatttaaaacactctagaccaatattagttgctttagtttcattttgctagcagcttgaaattttcgagtattcttacaaataccatcgctgaagatttgactatttgttttcttcattcttgtttgatcatttcatttccacagtgaaaacagaaagcagcatttgagattccactgttaatctttgaattaaaaatg

SEQ ID NO: 22962 - DNA, 3003 bp, Unknown
  misc_feature (1)..( 3003): 2750-1469P.txt file - cDNA_ID_2126804; gDNA_ID_1620327; Annot_ID_153520
ccaggtgctgttttctgccttagggaaccattggttttcattttcataaactcgttagtggttcttatagtttctcaatctcttattatcttacagattttggtggcacacaaaaatgaagtgtggtttgtgcaattctctaatagtggcaaatatctggccactgcatcaagcgattgtacagctataatatggaaggtaaatatcttagaccatttggtttctcttatttttccctaaagtcattgagaaagagaccagatgaattagctctgatgtgtaagagaaccttatgaggtttcttcttgtataactcttcacgctgtgaggtggaaaaaaatattaaggaaataacatttggatgtcttgtcttgaagcttggtatataaggtagaaagccattttgtgacaacaaaaaaggacaagaacttttatgttgtaattcatagtgatttgtcgttttgagccatgtaatgtaactagttcttagtacttcagggttgataaaatttctgtgtatttttctatggtagttttgagaccgtttctttaaggattaaacatggtaatttctaattgataaaatttggtattggactaaaacttcttgtttcaggtactggatgacaacaaagtcgaactgaagcacacacttgagagccaccaaaatccagtttcttttgtctcgtggagtcctgacgatactaaactgcttacatgcggaaacgctgaggttcttaagctatgggatgttgacacaggtgtgttgagacacacatttggaaacaacaatactggattcactgtcagctcttgcgcatggttccctgactcaactcggcttgtctgtggcagttctgacccagaaagagggattgtaatgtgggacactgatggaaacgagatcaaagcctggagaggaacgagaattccaaaggttagtaaaggttaaaagatttgcttatccgttttggtattcaaatacttgaaattcgaaatgcacaatttcctaataggtggtggatttggctgtgacgccggatggcgagagtatgattacagtgttttcggataaagagatccggatcttgaatttggagacaaaagtcgaacgtgttatctctgaggaacagccaattacttccctttcaatttctggtgatggtaagttttttatagtcaacttgagctgccaagagatacatctttgggatcttgctggagagtggaaacaaccattgaagttctcgggtcacaggcagagcaaatacgtgatacggtcatgttttggtgggttggatagttcgttcatcgccagtggaagtgaggattcacaggtaagcacattattttcgaccaagacagttgttttttggttgctgttgactgacattgatctgttgttcacaggtttacatatggaatctaaagaacacaaagccgcttgaagtgttatcaggtcattcgatgaccgtaaactgtgtaagctggaacccgaaaaatcctcggatgctagcctctgctagtgatgaccaaaccatccgtatttggggaccgggcaaaccgaacaaaccactgaactgattagataaccagaaaccgtagtagctttaaaccaggacctagttctagtagttccacatttgtgtatagttcatttctggttttttcttttttggtggtccttattggctttgcagaacaatctcttgctttttgagttttggtacactggttttggagaacttgatttgagatgagccatgaattgaaaccaaaccggtttaggcggtaaactgaaccaagctgtgttgaggagttaggtggcaattgtttggtgttcagagcaaaacttagctaactacttgtttcgttggtcatttgctaccatgtgggttccccgttattttaaacagaaaatttaattataatataaacttcggaaacgcccctaaacttatgatatttaagaatctgccaatattgttactttttttccttagtacagagacattattttttctaacaaacctgtttagaccaaaacttctgaaataattggcaatgcgtagattacaccaaaaaaaaagtttgaaagaaaatgtgttgcaatgattctaatatcttgaaaaggtatatgagtttcaattatagaactcaagaagattaataagtaattgcgagttcgaacatttgtgggtttcaattatataattaacaaaaaaatctactaagtgcatacataagaagtatttcacctaatacgattaagaatatacatgatttcagttttagtatctactatataaatatgaataccaacgtaatttaatcatatatttaaactacatatacatctatttgaaacatggaatttacatctttctatatttaaaaatatttgaaatgaagtttcaaaattttcatatgtaaagtatacgttatacaatctaaactagtattcaaaagatgataacatctacacaaaacaatcacatgaataggttaaatcaaaattaaaaatagaactgatataccctcttagatctcgaaatatttatcagtatgggccagaagggctatagttattcttagaaaaaaaatggaggtaatgtcgaaattgacgaaattaataggcgtatttttaaaaataaaggttgtttaagataatcatgaaaaattagcagccactgagtaacataattacataaacagagacacacttacttgaaatagaaaacaaaataagatccttttaacaacaacaacaacaacatctcacaggtctcgctaagacggtcctaaacaaaaaccaaactgtttaggtttcgtcgtcgacgcgctctcatcaacaaagtcccatacgaaatttaaccaaaactatatatcgagggacgaagcgcgtgacgttagatcggagatctcaccgagatcgccggtgaattagggtttctacttcctttgttcttgttaacgttatatgaaagtttggaattcaagatg

SEQ ID NO: 22963 - DNA, 3000 bp, Unknown; identical to SEQ ID NO: 841
  misc_feature (1)..( 3000): 2750-1469P.txt file - cDNA_ID_2126813; gDNA_ID_1620327; Annot_ID_153523

SEQ ID NO: 22964 - DNA, 3000 bp, Unknown; identical to SEQ ID NO: 842
  misc_feature (1)..( 3000): 2750-1469P.txt file - cDNA_ID_2126817; gDNA_ID_1620327; Annot_ID_153524

SEQ ID NO: 22965 - DNA, 3000 bp, Unknown; identical to SEQ ID NO: 838
  misc_feature (1)..( 3000): 2750-1469P.txt file - cDNA_ID_2126839; gDNA_ID_1620327; Annot_ID_153531

SEQ ID NO: 22966 - DNA, 3003 bp, Unknown
  misc_feature (1)..( 3003): 2750-1469P.txt file - cDNA_ID_2126849; gDNA_ID_1620327; Annot_ID_153534
ttaaatagcatgagctggaatggatgtttctcaacttatttctccaagttgcctatttcacatcaagacatggtgcccactttcctccaactctagatttattgtatatctatgtgaaaatgtgctgtcgttcacattcatccccaaagtattttaatgtatattgtatttgatcacatgaacatgacaaaatttatctgtaaatgtcttataataattgaactaaaaatgttatatttttaatctttttgtttgtttctattggataaaatgcaaataattatttggtagctatagacaaaactaacgtcgtgcaacaaaagttaaaaccatctttaacaaaagaaaaaaattgatgacaagatatgtataacaatatcaatgtctaatgacattctatctttaaatgtaagaaacaaaactagtattttggagaaaatattttaaaccttactttgtgtttttgttgacatttcacaaattatttaaggtgatttgttaattaacaatatcaaaaaaatcttcctaaaaaaaattaacccatacatgtgatgctatagttagtagtactagaactaaacccatccagtagtaaatctaataaacttcatttttttttgtattttgttgacttgcacttcgacatactctatataaacacaaccatattagagatcagatcccaacaccactaataaactcaacatggctagatccttgttgctctcgctaaccctcacattcctcttcgccggaattgtctcagctcgtgactggaacatcctgagccagctcaaaggaaccacaaccaccacgaagactagccaaaccggcgtcacatctttgaaagctcccaacctaaacggatactgtgagagctggagagtcaacgtggagcttaacaacataagggactttaaggtggttccacaggaatgtgtatggttcgtccaaaagtacatgacctcatctcaatacgaagatgacgtggagagagccgtcgatgaagccatcctctacctcggaaaaacttgttgcgagaagaagacatgcgatggcatggatgcttggatctttgacattgatgacactcttctctcaaccattccttaccacaagagcaacggttgtttcgggtaaataaactaaacttaaccatatacattagccttgattcggtttttggtttgatttatggatattaaagatccgaattatatttgaacaaaaaaaaatgattatgtcacataaaaaaaaattggcttgaattttggtttagatgggtttaaatgtctacctctaatcatttcatttgttttctggttagctttaattcggtttagaatgaaaccgggattgacatgttacattgatttgaaacagtggtgagcaactgaacacgaccaagttcgaggaatggcaaaattcgggcaaggcaccagcggttccacacatggtgaagttgtaccatgagatcagagagagaggtttcaagatctttttgatctcttctcgtaaagagtatctcagatctgccaccgtcgaaaatcttattgaagccggttaccacagctggtctaacctccttctgaggttcgaatcatatttaataaccgcattaaaccgaaatttaaattctaatttcaccaaatcaaaaagtaaaactagaacacttcagataaattttgtcgttctgttgacttcatttattctctaaacacaaagaactatagaccataatcgaaataaaaaccctaaaaaccaaatttatctatttaaaacaaacattagctatttgagtttcttttaggtaagttatttaaggttttggagactttaagatgttttcagcatttatggttgtgtcattaatttgtttagtttagtaaagaaagaaaagatagtaattaaagagttggttgtgaaatcatatttaaaacattaataggtatttatgtctaatttggggacaaaatagtggaattctttatcatatctagctagttcttatcgagtttgaactcgggttatgattatgttacatgcattggtccatataaatctatgagcaatcaatataattcgagcattttggtataacataatgagccaagtataacaaaagtatcaaacctatgcaggggagaagatgatgaaaagaagagtgtgagccaatacaaagcagatttgaggacatggcttacaagtcttgggtacagagtttggggagtgatgggtgcacaatggaacagcttctctggttgtccagttcccaagagaaccttcaagctccctaactccatctactatgtcgcctgattaaatcttatttactaacaaaacaataagatcagagtttcattctgattcttgagtcttttttttctctctccctcttttcatttctggtttatataaccaattcaaatgcttatgatccatgcatgaaccatgatcatctttgtgtttttttttccttctgtattaccattttgggcctttgtgaaattgattttgggcttttgttatataatctcctctttctctttctctacctgattggattcaagaacatagccagatttggtaaagtttataagatacaaaatattaagtaagactaaagtagaaatacataataacttgaaagctactctaagttatacaaattctaaagaactcaaaagaataacaaacagtagaagttggaagctcaagcaattaaattatataaaaacactaactacactgagctgtctccttcttccaccaaatcttgttgctgtctcttgaagctttcttatgacacaaaccttagacccaatttcactcacagtttggtacaacctcagttttcttcacaacaaattcaaacatcttacccttatattacctctttatctcttcaatcatcaaaacacatagtcacatacatttctctaccccaccttctgctctgcttccgagagctcagtgtacctcgccatggaaccaaacaccatg

SEQ ID NO: 22967 - DNA, 3000 bp, Unknown; identical to SEQ ID NO: 835
  misc_feature (1)..( 3000): 2750-1469P.txt file - cDNA_ID_2126856; gDNA_ID_1620327; Annot_ID_153535

SEQ ID NO: 22968 - DNA, 3003 bp, Unknown
  misc_feature (1)..( 3003): 2750-1469P.txt file - cDNA_ID_2126859; gDNA_ID_1620327; Annot_ID_153536
tctttggtttgggttcggattgatccgttcttgccgaaacagactggtccgttactgaagcaatgtggcgtcgactgttaaatgaggaaccgcattttcgttttggaccgctattttgagccattttgcttggcctatttttccgatttgggtgttctttgttggattatatggatttgtaaggaggaaaaaaaatacaaaactttgattcacttgtgaaataaagtagacaaatttctgtaaaatacaaacaaatagaatgaatattactaaatcaaatcacacacaaaacacaacgattttgttatcaaccacacacacacaaacaaacagagtgataaaaataatttcacaaaggcaatgtagtaaccaaacatgtgtggaattctttctctgttgtggaattggagttctaagaacttcgactgtacttgttcgttgccattgagtgactgttccagtaaccaccaactgttccaattatcggtgattcagggcttctacttggcgatttccttggcgaattcgtagctgagaactgctttatctcctctgcagttaacgcgcccaatataggtctttcatcatggcattgaaccagtttcgagtatttcttcttctcggacattgtggtttcaacactgctacaaccgctggtcgtggtttgtgatgtggataaccaagttgaaagactagcatcaacagctatttcttgagttctctgtttctcagtttcatctcttgatttccggttcaagctgaatgttgatgataaatcatcaacctgagactccaagctgaaggaagcaattatcacattctccttccgaggctgtgtttgagttgttgttcttcctttggctttcacagctttccattgggaaagattctcaatcgggttcagtactgcattgacatatccacttctgtctctaacactcacactacccttttcttcaaccctctctatatccataacattatccgcaatctcctccgtataaactactttatcccagttgtgcagcttgtcctcataattgtcatcattataatagtcatcatctagcagcccacaatcatcatcatcagtatcctcaagatcgctatcgtcacaatccgttacatcctcctcttcatcatcactctctctgcaattctgatatctatggttagaaggataagaccctgacgagttagaagtaacatcgctcccttcagacgaacatcgagcctgcctcgacttcacctcttctttcttctcttcaaagagctcaacagattcatctactgcaatgtgttcatatgttttaacattggtgtcaaaagttactctcttacgatttggacttggactcggactctgtttctcctcaaccttgtcactgcagtttaaagaaaagaatcaaataagtcaaatctgttgagctaaaacacaaaacatgaatctaagtagaaagaacaaaaccacaacacttaccagatatcagtgatcggagttacagaaactgtagggactttctcaacaacgttcacatgattatcctttggagacacctccgagattttagggacttccataacagttgaatcttttgcatactttgggacttcttcaacagtaggaaccctaagattcaaaagaacatcctttgcagcttcctcagagattctctacataaaacgaaacaaaattacttcagataaagcaaaacccaacaaaaaattgaagctgaaattagcttaattgcagcaaatcaacactaagaagaagaacttacgtttaaacgtggctgaaaagattctctgcgtctctgacggcgacgattcttccgacgaccgaagcaaccaagtaagcaacccattctcttctacaattcaaagagctaacaacgagagagattgaaggtaatagattccttcgagagcttataaatcgaagattaaagagtcaacattgcaaagagatgatttttaactggacttagagagaagaagaagaagtgttgtactcatggatttgggggtttagggtttccttttttatttgtctcttcagatttccttttttatttgtctctttagatttccttttttctctttctaatttcaggttataatttattaattttggcggagtaaaagtagatgaccgttacaagtctgatttattagactgtgaaattggaccgttgttatgtgggccatggcttttattaaaaaaagaagagaaggtatattatttaaattggagataatgggccgttttaaacccaattattattggtccactaaagtttttatatcctctaacttcgacgagcttgatatagttttggaccttttggtgtgaacggtcacattcaactaaattaaaaagtccaacaaacaaaatctggtcatgaaaagcttggtgtgatgtttctaataagtaaatttactgaggttaattggttggtttaacttaaatgtaatccaaactcctctccctttagagattttcagttgggaatgaaaacctttaaagcttgcaccctaaaatgacattaatggttatagatatagtttgttttcatgtttcttttttttttatattttcctttagttttttctagggttgggactaaataatcggactcggatccgagatccgatttgaaaagctggatacccaattgggatggatccgcttccggatcctgaatttttagattcagatgaatatttttttttaaactaaagaaagcatatcagcatcacatttttgtggtgatactgcttcaagaatctgtcacatatctgtccaaaagaaaagaatttgtcacatattgtataattttaatatatttattgttttagtttgaaaacaaacgtggaaaaaaacatcttacaggtgtcaggtgtgccgcgtcgtcccactcaaagcctatatcatcaattttctggctgttctaatctactcaatttatttttttattgttaatttactgaagatcggcgatg

SEQ ID NO: 22969 - DNA, 3003 bp, Unknown
  misc_feature (1)..( 3003): 2750-1469P.txt file - cDNA_ID_2126896; gDNA_ID_1620326; Annot_ID_153490
tattcataaacatagaaggagtatttaacaacagtaggtaaaatggtaacattctgattcgggtaaactgggtttaccttttttcattctttggtacaagggatggtttggcatcctagttaagagataagaaaataatcatagttatccataattgaaatcgtaatgagaagacttaaattctgatcttttattcaaaatgaatcagtcatccactagaccaccattaattattttgtaagaataaagtttgttacgcatgatttatagtggattcttgggatttcctaacatgatattaggcagttacacttacacatatctactggttaaatcccttatgtaataaaaaaaaatctcgagttcaaaaacttgaggtcttttccaaacattgatttttgggtgatttgcagaaatgatcatgtttgataatctatttaagaatataacactttaatatgtaaaactaagtaaataacagtagaaagggatgaaaagtcaagtaactccttgttaaaatatgagaatacgctcgtgaaaagagaagaaaagtgacgtgatctttcacactcttttcggttaatggacattcataaaaagacaaaagtgttggctagcgtgatggtggcgaagatggcgatgatggtaatagtaacaatgacagtaccgatggtgatggtgacgacaacagtggcggtgccgatggtaatagtgatgataacagtggcggtgccggtgacgatagtgagacaacagtggcggtgccggtggcgatggtgacgacaacagtggcggtgctggtggtgatggtgacggcaacaatggcggtgtcagtggcgatggtgacgacaatggcggtgccggtaacgaaaagataagtacaaatatatattgatctaagaaaactaaaccttaagatactatacatggaactcaaacaaaaatcattaaacgaaatgaaatcatctcaagtttcaattttcaaaaatctagcagcaaaatagaatagtacaatggtgacgatggcttcggtgacgattttccggtgatgatggctccggtgacgatttttcggcggtggtggcttcggatacgattttccggcgacaatggctttaaaggtagtggtggttgtggtggtagtggaagaaaaaaagaaagaagagagaagatgttcatgcagaagaaagaagaagaagatggtataattgtatttattacatataatatacataatatcaccttatggtttttgaagtgttagtttccaaattactaaatttttttaggttatacttacaaatttcccttgattttatccaacgtcggtgccatatacaatcgttgttaccagatgatgtatgttagtaacttactaacgtttgagcacaaaaatatcatctaagaaatatatggatatttaaagataaagttgttatatataattaggggtgtcaaaataggtaacccaactcaactcaactcataatcaaatgagtttagggttaaatgagttatgggttaatccaactcattttgttaaatgggttgggtcaacccataactcatttaatttgataggttgagttgttaaatgggttaacccatttaaataataatttaattaattattattataaaacaataataaaaattatcattattaataattattaattcattatcatcaaacttagaatatttacagattctaccgtttacggatttacgtttttggcggaaaaattacgggtttacgtttttagcgagaaaatcacgggtttacgtttttggcgggaaaatcacaggttttcgtttttggcagaaaaatcacgggttttcgtttttagcgggaaaatcacgggtttacgtttttggcgggaaaatcacgggttttcgtttttggcggaaaaatcacgggttttcgtttttgactggaaaattacatgtttttcgtttttggcgggaaaatcacgggtttacgtttttggcgagaaaataacgggtttttgtttttggctggaaaattacatgtttttcgtttttggcgggaaaatcacaggttttcgtttttggcgggaaaatcacgggttttcatttttggcgggaaaatcacgggttttcgtttttgacggaaaaatcatggttttcatttttggcgggaacatcacgggtttacgttttttgcggaaaaatcaaggatttacgtttttggcgggaaaatcacgggtttatgttttttggtggaaaaattacgagtttactttttctcaattcatcgcttgtatatttaagaaatttggaaaaatattgattttattagattggtttagatgtgttggttaaacttaaattggcattggtttaaagattttagttggtttaattcaattttacaaaacttgataggttaattgggtaaaccattgaaaacattaaccattataactcaactcattttattcatcaaaccaattgatccaataattcatttgacccatcaactcatttgagtcaaaaaatttaactcattagtgttcaggggttaagtaaagttgagttgacccataaattttgatccattttgacacccctatatataatacgtacaattcaaaaatataaagtctagtttttttttttttcgtatatggatacttcaatagtagttttttttttaataattattacttgaatagttttagattttaaatcatttactttatcactatttgtcgaagtgtgtattttcctagctatcttcccaaaaagaattaattaataaattacgagcacaataccaattttttcgcagttctgaaaatactgtaacccaaatattcgaatctacacagtctcaaaaaacgaaaaggttcatataaaatattaattccttaacggctatatttttctccttcttccattttttttctttctcaattgatatatccaacgacaacaaaaacaaccaacaagaattagttcgtcgagttcacaaaaatg

SEQ ID NO: 22970 - DNA, 3003 bp, Unknown
  misc_feature (1)..( 3003): 2750-1469P.txt file - cDNA_ID_2126916; gDNA_ID_1620326; Annot_ID_153497
ttaattacaaaaataactcataaaatgtaaaggccagttttttttttttcatgtctaaaatatcatttttactttgcttctttttccagactgctctgtttcttagcaaagctcttatcttatctcttttttcgaagatatcatttgcttattctatatctgtggtttatttgatctcaaaaaaatgagattatgacagtagatgtagttattaaaacaatgctcgttcgcaccacgaaacattttgctaatgtacatggtaacgcatcaagtgtaagagatataaaagagaagggttcttttatagtcagggaaattataatgacattccatatatttttaattcacaacagccaaactcatcgcaaataccaagatcttacacataaaatatacacaacaatcacctgtcacaccatacacttttacgagacacggaaacactcaggaattgggtaaaagctctaaccatagagtaatcattatctatcacgtgatctacgccttacacatgtcaattttctactttagggtttcggttcaatatgcatcatgcctactttgaatcttgaacgttattgttatgttttcacacaataatctcactgagtttttgacttagtgttgatggatctttttttttgttttgatggattttagtggataaagggggaacaatttggccaatgggtgtaaataactctctccccacgggctagcaggattggtgcgttactgtgacttattatttggaagaggagcacattgactaacctttcttgctgagaacagaaaaagctctcaagaatagtgtgcattttgattgacggggatgcgagtgtggacgtggactggaaacagtagtaagtgaagaaatttttgaaaggagaaatgaggattagtcttgtagactctccaacactgatcatgcatatggtcatatagctagaaattttggggagaaaaatatggtaaaattttagaaagggtcaggattaaactgcttattagtgcgcttagtagatagctagaatttcggattagttttgttggaacaaacaagagttttttttaagaggcatttactataaatttgcagaatgactttgcatagaggtgaacataatagaaagagagagagaacctttaatatgatcaggtttagatcttttaagtatcatagatgtgtgtgtgggtgtgagagtgggacttaagtccaccaactcatcctcttttactagatatatatgaattgaattggtattcagagagaatacatgttcgtagaccccattgtcgaatagctgaggccatcggctgcatagtgcttttgacagatggaacataacactgatattcatggtatgacaagttagcttctttgacacataacattcaccgaaataagcatgtatggcaatggcatgatcaaacaacaaaaaggtttctccgtccaattttgcttaatatagtttccactctcttgagagcctgatatgtattcatgtgtcatgcatggtttgatgagcagttagaaaattttcctaaattaaaataatatattgtatgtattgatttacaaaacttataccaaacccaagcatactataaactttaggtatataaaaaggtactcaattgtagtaccatttgagtaacttaaaataatactaatacaaattttaacctaactgttcatgaaaattttgaaataaaaatctaaaatatgaaagatttaaaattgttattttgtatataaaatatatctcacaaaattaatcgactattttaattaaagatatatagtagtttaaataacataaaacaacgacaataggagggttataaataaatgttctaaaatgatgtctaggaagtcgtttagtctccgcctagaatagacagtggaagttaccttacacacattgggattatgtatttttttttaataaatggatttaagttgtttcaagagatcttaagctctcttaggtggtcttaggcggttttacaatttaacggttttagtttattttccaatatttaagtacaataatttaaatttataatttttaactccatatacatgattataaacgttcatatgttatttgatatgaattaaataaactaatttttgtttatgatttactatttttatttttaatagatttttgtatattgtgtatctaaaatatcatatttataatattgtatgttggaaatgcttaaaccacctaaaattgcatatgttttgattagacgttatatgttttaagtattgtgtcagtgcttgcttcgtgcctaacgctttcttaaacacaaacaagtcaatattttatactacacaaactcattaatagatattagtgctaaacttaataaagcatatataactattcaagtccacaaaatcttttaccaaaataaacttttaaaatataaacttttttacatgtctagcacgtatccgaacatttccaaaaagatactccatcttttgaaatagttgtcgtttaacgtttttgcacataaattaagaaaacaattaaatttatagttgtcgtttaaacgtttttgcacataaattaagaaaacaattaaatttatccttaaaagacattgttgctaatattcataaagaatatctaattgtttgagtccaaaaaagatttacccaaaaaaacctttgaccattaaaaacttgcttacatgtctaatacgtgtcttaaaagttttcatatcaaagctcaaaattcctaaatttcaagattcttaacttttgttttatttacaagtaatgatgatactactttaaaatcctaatttgtaagagacaatatattgtgtttaattaaatattttcttattgcaaatgttttcttatttatataaggagttgttgaagaacatctacaataaaatctccttctaaactctcacttatttcgtactgataaacaaaaagagcatcttaaatctcttgatcggttttcgaagatg

SEQ ID NO: 22971 - DNA, 3003 bp, Unknown
  misc_feature (1)..( 3003): 2750-1469P.txt file - cDNA_ID_2126961; gDNA_ID_1620326; Annot_ID_153511
agtaacgttcgtattttcagaaataacatattttatattcctttaaaaaacaaagattatagtaaagaacattaaattaactaataactactctacttttccatagaatactaaattcctacgctttctattaatctttagtgtttttaccgctaaagatatcactatatcactttgtcaaaaaatctcaattttccatacatacaaaaagattatgtttagaagtcatcaaatccataatttggttcacttaaatacaagttggtgattatttgattttgttcgatttaatgtcattttggtttcattttgttttctaaaatcagttcagtgttggttaaaataatataaaatacttctaaataataattcaaccataattatataaaagcaagaaaaaaaattctgaaattaaatttcaaattattctaggcatgttctccaatgtggctgcatccgtcttgttggttcaagatgagtgctcttctgttaggtcctctatctaaacatcttcaactccatttcgtggatcgatcacccaatccttcccagctgatccgtattttagtggtccttgtcgccgacgagaagtttagtctagtttctccatggtttgtgtagctattgagatgttaactctcatgctttcagcctccttttcgctgtctctatttgagctgctcatgtctccacactacctatgaagtccgatctctacgactttggtgtgagctaccccctcagacctccagatccgccccctcaggccccaagttgaccattcgttccaatttgtgggagttttctccggtgttatgacctatggtccttccttttctaccacctcacctagcagcatctcctccattcacccttgtttggataatgatctttgtgtcttccacttgcctccttgcgatctattattgttgtgtgcagttcatggtactaaatctttcctctagcgcatatgtgcaattaactggatacttctctggtttatctttgtttgcatttcaggctagtctactttgtttctaatctagaatcacctttgttagtttattttctgtccaaatttggcagagtttgttcaccgaatacttctttagaatcttcgtgtctagggttaagaaaaatcaaacttttgcctagatccatcaaaatttgctcaccctatacatctccagcgtctccatgcatatgtctacggttgatccttcttgggtgcatcatcagagatcctttcatggtgcaacgaccacctccgcctcactgttgaatgaatgggagagaatgagtattattttcgtccttcatctatggtggagaaatatctctgattttgaaaacaaattagaaccgaagagactttgcacaagttttaaacagttttggacactaacgattatatgctaacaaaatatataattagtaaattttaagttttgaatataatttacgaatattttttaatccatgaaaaactttaaagaaaatatcttatgttgacttgacactttatgagtctaattaaaaatgtacatacaagtaacatcataagtaatttgattccagaacatcaagaaccaggtttcaggtttcacactttcgcccatcatgaaaagtggacaaaaatcaaatattttatttggcatgttttgctttgattctttttgaatgaatgttattcatcctaaaacatattttgtataataaatgtaaccttatacttttttccgccaatgtaaccttatgctaaaagttcagaacgtttataaataaaaagacaccaaagacaaacagtagggccttcaagcaccaaagacaaacactagggccttcaccaaaccaaattcttaagacatcctcgaatttggttgtggtttccttttgacttgaaagtctgttctagagttcggacgatacgctcaatgaaagaagacatgagtgaaggagacaagttttgttccccatgtctacgtctaggtttatttctttcggaccatatggaatgcacacaaacttggaacacataccgtacgaggtagtaaactgacttttatgttaaagatggtttatgtaattatgttactttaattgttaaatagtttttacgtttccatgaattggatcaaacgtaatcaagtaaaaaaaaaaacctatacttataatccttccttgtttcatttgatttccttgcctttaaaccacaatattatttcttttgagtttcattgatggtgtctcaattgtaaattggggtttagggacattatacagatggttgtaaattcctggaactgactgagaaaaaataaacttatgggcctggaggagatagttgttgggccacttcttaatatatattggcccacgaaaacacaattaactcttcgtttcaaatttacaaactaaacttcgtgctatctaatacttttaaaacggcacgtaatttagttttcaaaacatagaacgacacagggttattgtcggagttgcttcttcagagagaaacattagagaggggtgttcatcttccacatctcaaggagacacccaaaaagaaaaaccaaacctttgaagaacgaaaagggttattaaaaaagcaacaaactttgagagtaacaaaggtaagtttttatctgtaattctaagagttatatcattttggttttgtatgatttttttgaatttgtgaatttgatccgttgatttaattctgaattttctacgattagttcactgttatgttttgtgaattataactgttttattgactaatcacgactttgaatccaattctattgaagggctataagaaaaactgaaattaatttatagaaacttgaaaattttggggacttttcatgttttgttaagtaagaaatcttcttttttagctaaattagtttcttctaaatagaaagttttcgaatttagaaaaaggttggggttttttcattgactcttgtctgtgttacagaaaaagtagttatcatg

SEQ ID NO: 22972 - DNA, 3000 bp, Unknown; identical to SEQ ID NO: 827
  misc_feature (1)..( 3000): 2750-1469P.txt file - cDNA_ID_2126979; gDNA_ID_1620326; Annot_ID_153496

SEQ ID NO: 22973 - DNA, 3000 bp, Unknown; identical to SEQ ID NO: 847
  misc_feature (1)..( 3000): 2750-1469P.txt file - cDNA_ID_2126983; gDNA_ID_1620328; Annot_ID_153557

SEQ ID NO: 22974 - DNA, 3000 bp, Unknown; identical to SEQ ID NO: 860
  misc_feature (1)..( 3000): 2750-1469P.txt file - cDNA_ID_2126987; gDNA_ID_1620328; Annot_ID_153558

SEQ ID NO: 22975 - DNA, 3003 bp, Unknown
  misc_feature (1)..( 3003): 2750-1469P.txt file - cDNA_ID_2126991; gDNA_ID_1620328; Annot_ID_153559
aaatcagaagcttcagcatcaattctgaaaacatgaattcaatcaacagtgaggcaagatgagtagtgccctatgactcattattcattaataaagagaaacaagagcaaaaagcacatcattatcttcatttatcacctcagcatttcagcattaatcttcaaccctgtgatggcattttgggcaaactgaagcaattcgtcctgcttaacctgtccaaaagcagccaaagcaacacagaagaatagaaaagttaggaggagatccaaacgcccataaattaacatatgctgacttttttactgatcaagcgcttaccaaaacttcatccttgtaacttgaaaagactgtagcaagatcctgcatactgctaactatggcatcatgaacttcctttcctccattcaaacaaaggctgaaaacaatgttaagttctatgaataattgcagtacgaatgaaaatagcaatgaattgtgttgactttccaagaaacagtttaagactccttttggaatccaaattttggcaatgcaatatggaatgccagcagactcacccaaacatctccaggagtagcgtgatttcttcgtcatgtggtggttcaataatctgtaataaaacagtcaaacctttaacccccatagacggcacatatgttttcacatcacccaaatataaaggtaaaatggtactacgtatctgttatcacttatcagatagccaccaaaagatcaaatttaggttgcaaaagaataccatggacagaacgatcccctccagagcttgactttgcagaaaaacatcacggaagttaagtggctcaccgcctatatctggatcgtaatacaaaacctacacatgcaaagggatcttcagaaagaattctgttggaaaaaggtcataaatacaacatatgaaattcgacgcagaatagtaatgcaaaagtcactgttaatgaaaaaccctttagcagaaaaagttaccctatactactacagattagcaatcttatctacttaagtaatacttttttttttatattctaaaatgcaggaggatgatatgatgacatcttcctctttctctttgacaaaaccagttaaggaacatataagattctaacgcagcaacactaaggatcacaatcatctctacttaattactagtcttgatattttacgatgtgggagaattgttaacttcttcttttcctcttatccaaaaaaaaaaaaagaataaaaataatacccattcacgtttctttgcttcatcagaagcaagttgttcctctgaactcaattgtttatcctttagagaactgtcagtagctctatcaatctccttaagcacacttagccatctagtaatcagcaatgccctttcttgacctctatatgagactgcagcttcttccaatctctgaattgtctgatgaacactcttataagccccaacaccctgcaaagttacagtccggattattcactctagtcctaaagtaatgcaactgttgtgtcataattacaactgtattgtaataaaagcccttaataccaaaatcaaaactggaatctagaaaaataagacccaaatactaattagaaatgggaataattaaaaggaaaggagaaattacaatgcggtcttggaacaatttggctccttcagcgacggcttggccagcgtgctggacgacggagtcggcatagtttttgacggttcgtgtgatgtttttgcggtttccgacctccacagccttattcacggccgttcgcagccacgacatattctcagcgatcttatggtctactagggaagaaacctcctcggggaacgaaaaccaattttagagacgactaattactgaaatgagagaactcggccaccgtccatcaaagtttttttttactcggtttaagtttgacgatttgcaggcgactaatatattatttcttttctgaaatgtagcttatttttactatgtaacgtttgtatattaaaccgatttaaataacgagtttatgtataagtattttgttaaaaatgtaaaaaaaataagatcaaaaacctaaactatttttgtgaatactataaaacctctaaaacatttaagtcgttttcttcttcacataacaaataaccataaaatgaagttaaaaaaacaatatgtgaaaaatatggaatttggtggcaaagaaatgaatagtggagttgagaaaaaaaatgatcttctaaagaattttctaactattgaaattaaacttctaattttcgtagtagattacatgatcgagaatatataccaaaaaaattgaagaaatcatagctttcatgacatgaaagatccttgatgagaattaaaattctaatttaaaattaatttaccaatgaaaaaaattaattaattagtttgtcatagttgtgaaatgcaatctcaattatagatagtaaacacaagttttttcttataataattttcttatgaagatactatataaataattaattatttttaaaaataaataatattaatttagattatatattttatagttggtaaatgttaaaataaaatcttcatatctatttttttggtaaaaaaaacaaaacatgtaaatgtttttaaacgttgcccaaaaaaaaaaaaggtaaatgttttgactaaaaaatatccaatcgaaacttgggtcggatctcggatagttttatccaccctaaacagagacggcagctcataactcaatcagccataaaggccaaagaagggcccaccttttagatacacacaatcgtcgcactctcagattcttctccggagcgatcagatttcaccgacgacggttgtttttgcctcctctttcaatcagaggaagccaaagcttagagcaacagttgtaaatctatatatagagagggagagagagagagagagctcctctcgtccagtattagggttttaaaggcaagaactactagaacaagagaaggtacaaaaaaaaatg

SEQ ID NO: 22976 - DNA, 3000 bp, Unknown; identical to SEQ ID NO: 857
  misc_feature (1)..( 3000): 2750-1469P.txt file - cDNA_ID_2126997; gDNA_ID_1620328; Annot_ID_153561

SEQ ID NO: 22977 - DNA, 3000 bp, Unknown; identical to SEQ ID NO: 858
  misc_feature (1)..( 3000): 2750-1469P.txt file - cDNA_ID_2127013; gDNA_ID_1620328; Annot_ID_153565

SEQ ID NO: 22978 - DNA, 3003 bp, Unknown
  misc_feature (1)..( 3003): 2750-1469P.txt file - cDNA_ID_2127019; gDNA_ID_1620328; Annot_ID_153567
gaatcgctctgatgcagagttgctccactctcttgtggagagcatgtgacttccctgcagcaattggtaaaccacctccataagaaaacattcccactcttgcgtaatgacaatcatgaaaaatgcaatatggtcataagtggactaacctgttctagggtcacgaccagcgaaaacgattggctccatcgctccatcaagctcagggagggcaacctgcagagccacctggatgggatgcagaccaagtgtgctgtttagccattcctctgtcgtctggaacaccagtggtactgccacaaggtaaggaacatcgagctttttcagggcttcgatagccctgggatgatcctgccttgcaggtccaccaacaagagcaaaaccagtcaaggagacagcagagtttacgatgggctgtttcgacaccgggtctacgaaatatttctctactggaccagagaaatccaaccctcctgcgaatataggaacgaccttagcacctctagcctcaagctccatgataacagccacatagtgactatcatcaccagtcacaatgtgactcctctgcaagactaaaccgacaaccgttgcatctttcctcttgagtgagtcattggtgtcccttctagtgtcataccagttccagtactccttcacatcatcgtacatggttggagcaagtggatgccaaattccagtatccaagaacaaaaccggatccgaatactcgattttgacacctttcaaagccggaacataagatccagaaatcatcttaacaaaattctgaagattatcaggagagcctccaagccaaaactgtaaactcaagatgtagagacgagcatcttgagccttgtcactaggtaagtacttcaaaaccttaggcaaagtcctaacaagcttcaacatactatcggcaaaaccagcagagccttgtttcttcctcttgaagagttggaaaaacggagactttgactgacccaattgagacatactaaaagatccaagcttgttcagtctcattacctcaggcattgaagggaagacaagaactgcgtccatcctgtctctctccttctccaccgcatccttaactttaatcgccaattcctcgacgaagatcagagaaccaatgaagatgttggcgtctttaaggtcttcgcagaagttgttgtaagtgttcttgtctctaagctcctcgaccaagtatccaaccacttcgtaggatgcgaatctcgaagtcttgttgagagattgcacggcttcactgagagaagactggtactgagcctcgaggacgacgtagacgattttcaccgtcggaacgttgtctctcttgatcggaactatacgacggacctccgggttcgtctgtgtgaagaggccgtttccagatacagcagatttcaccttgaagaaagatttggctggtttggttgatctgtgtttcttccggaggaaagaatgtttggtactgttagtgagcgaagagagatgctctgctttagaagtggatagagtgaatggagaatacacaagcgaagccattttgcggctgctggattctccaaacgttgaattcgaagaggagaggataggagaagagatgaatcgttttttgttggttgtctcttacactttttgagctccaagtgggagtttatgattctctcatcggtaaacgcttcggaccaaggaactaaaaaagaagcgttggttttgaaggtaagtggtgagagggaaggacacgtggacgaatagttacggaagaagggagagtctacttgtgaggttgagttttgtcggatgtatatccgcttgggacaatgagatggactttgctggcctctgattggctcattgagatttctattcatattttcatggtttgggagtgtggatattgagtgtcttattttctttacttatttgacaagtatttttatgttgctctcttgaagatcgtatttgcggtttcagccatgtaaaagattcttttccgatgacgacacttttactaggcatattcgtcgggtagccggtttaatccggtctagattttgtataatttttggttcagctaggtctggtttgatatttttctacttatttcttaaaaactggctttaatcttttaaggtaaactcaggatttttctttgaaaacgaaatttgaaatatcagactcataacaattgtaacaacaaatgtaaaagttaaaacactctaaaatgtactcaaaattttgatcatcatcatcactattttttttataataaatggatgtaaaaacttatcatgtttcaatatttaaaacttttttttttttcaatatttaaaacttacataaaatatataattaaaagaaagtttatgaattagaatattaagttatatgtaattaaatggagcaatacatgtagcctactagtattgttgttgcatgagttgcatcatattcgaagatatacaatatgtttttttgatataagagtaccgcttcattctcttttttttttttgtcatttcccaagtgtaatattgttattaatacatgggctatactaaaagccccacgaaaagtttactgaactatttgaggcccaacaagagcctatcggattaacgcctactgcagaagaaaatctgtctgcactccacccaagaaaacgcagactaattaatgaaatcaacgaaacggataggtcgggtctaaggttgaccatgaaccgcaacctgaaccaggagcaaagtggtcaagttttgccatccggtccgagtcccttggaggaataataccagaacagaaaaaaacagaaaagtcgacaataaacaaaagagacaaatttgatttgattggttccagaaattcgcagagaaacagctctttgtctctctcgactgatctaacaatccctaatctgtgttctaaattcctggacgagatttgacaaagtccgtatagcttaacctggtttaatttcaagtgacagatatg

SEQ ID NO: 22979 - DNA, 3000 bp, Unknown; identical to SEQ ID NO: 850
  misc_feature (1)..( 3000): 2750-1469P.txt file - cDNA_ID_2127027; gDNA_ID_1620328; Annot_ID_153570

SEQ ID NO: 22980 - DNA, 3003 bp, Unknown
  misc_feature (1)..( 3003): 2750-1469P.txt file - cDNA_ID_2127039; gDNA_ID_1620328; Annot_ID_153575
acacaacaagctaaaacgatgtattcactaattacttcacttcccagaacaacattgcattttatttttctatgtaacaatagaagatgacttggttcacatatagttaacatctatatatggtagcaactatacaatgtaacacatattcatctcaaactgtaagaattggaggctcaccggcaatttgacaagtctagatttatgcgctatagcccttaagatggcctgtttgatccaccagtagacataagttgatagtttgtatcctcggtcgggatcaaatctctcagctccacgaagcagccctatgcttccttcctgaataaggtcttgcaaattcaaacctttgccttggtaccctgttgcaatagaaacaaccaacctacggtaacaacgagtaatcttttctctcgcttcttttctacggcatagtatttcatttgcactacgcttcttcttccctctgccactggctaacaaaactgataccatttcattctcttcaacacttgttcccaaattttcaagttttgctccttcctattaattaccagcaaaggtattattaccaacaaggatacacaatgtttgaatctttccattaatgggccatgagagatattggataagaaagaaatgatataccttgaggtacaagcaaagctgaacctcctctaaacgactcaaaaacccagatcgtgaagctccaacaacaggaacactaattgtctctgcttctgcttctacgccagcattttcctcttcttcaggctccaaacgttcgtaacctactcttcttcttcttctcctcttccttctcttttctgactgaattccccatttctcaggtttgatcatcacggagctatcaaccactctatccactgtagtgtcaccgcaaaccagagccgtactaagctttatagaaaatggggatgataaagaaggagatggttgacattggtgagtcgttctgagtaagggagagattgtagggacaggaggagacggacacatagttgcggtagctgtagtgggaatcgtcgtcgccatggatggatgagctgcagagcttcccacaccttagatttttctatttttgttatctatcttctttttggtccaataaaaatggaagaagaagataattctctcttgtgttacttacttatatcatagagcctctctctgtgtcatatcagttatccgcaattaaatttgggtggagttgctttctttttttgtaattaaaaaaaaaaaaaaatcttttcgatatgcaacaattttggaaaaggaaaccaaaaatgagaaattacagcttataaatgttttcggattgcagtatatacaaacccaaagctccatagttttcggacccttaattattaatgcaaacccaaaattcgagtggtttcggacccataaaaaggcccaataaaattggattcctagtaaattgacgcatatgatgtcacatgtacagtgatggctgaacgagagataatggaccaagtgtcacggtctagaccccacgtgcttgagggtgggagcaacgcgctgttccaaagcttgtctgtggtgaacacgcgtacctctctgaatcctcgtgatcttacggtgggctccactaatttcgctgacgtggaattgtccacacacagtactcttcttggcactgtacgctcaacacaagaggagtcaattatgccaccactaactatatattaagattagactttaacaacaaaaaacctatttaaaattagatttttatatggaattagtaaaagcagtatattcgtacgagttccaaagcactcagagcctcaaccattggacgtcattcatagatgtacgaattaataatcattgtctttagaaatagtctgtaaagccgtctagatggtaagtgtttgagtcaatcgtttttgtagacggtttcatacgaaaatgtaattcaaaaagctgttttgtaaaaagattatggattaagtttggacgtagtttaattagacgtgtaaagtatacgaatacgcaaaactaatgatagagaatcaaaggtaaaacacattttgattccgaagcgggaatcaatccacctttatccatacgcatatgaataacaaagtctatcttcttttttgttctgatgatttaaagtttcaatactattttgttttttggatcaaaatattttttaattcactttttaaacaataaagtcttttttgggtatatagtattcttaaagtatctgctgctttaattttggtgatgcatctgtacctaacaagacaaatgaataattgttgatataatttcattaaaatagacacacgtgaagcaattggatttgctaaatgagataaccattccaagtcttaaaagatagatcactagacaacattgtttagtccttattctattctctccccactttcaaatcaattgtctctttcttcctgtatgcattatcccatgtgccctcaaaaaacattcctcctaagattgattagtctctcggactatacaattaatatcttaaataccagtttttaattacaaattactttctcactaactaaactttgaatcttttttaaaaaaaatatgtaaccacatttggatggattggtgaaaaacaaaattgcgggtggaggaggtccgtgaacatgtgacgagattaaaatgacacttgggtgaccacctttttggccctctttagctccaaggctatatatatatatatgcatacatccatccatttgtacatatatacgtgactcatcgtctttttcactcccacacgttctgctccagcgatactgtgagagaatctctgtgtggtactctttcatttttcctttcccattttcaaatattccgttacgatttcgaatatttcccccattgattatttcctttaattctcacgcttattagcttaatattggaatttttaggttctgaattcttaggctggaattgaattctgaaatg

SEQ ID NO: 22981 - DNA, 3003 bp, Unknown
  misc_feature (1)..( 3003): 2750-1469P.txt file - cDNA_ID_2127056; gDNA_ID_1620329; Annot_ID_153582
atctccttttttgttcttctttatttgccttttataagcttctacagtgatatttaaattaacctttaataaagtcaagagacacactgcaatcataaactcaccaaaagagtagaaaactaaatgtctagagccttctctccctcacacacacacgtttatgtatgtttcttccacattgttaaaactaaaacgatataagaaaactgcaatgataggttttacattattttctcttctggtttgatatttggatgctgttgatatttcactgacacgagagatagtgcaaatgaaactattgggacatgccaaaagaaaatataagaaagtgttcttattgcaacacaaaaagacaaaagaaaaggcagaattaatgggtgtgttacatcaaacgccctattaacgatcatttccatattttttatatgctctaatggcttgatggcatcacaaaacaatagaccccacattatcaacagcataatctctccccatatggacggtaaagattagaaaacaaaaaacaaaaagaaaatcattagagaattttaataatgtgagtgttatatcgcgtagacacaacacagtattcaagttggcttatataaatattggtaagaggaatgccataggttcccataaaccagctgagaagtaaaattttctattgcagagagaaagagagttagagaaagagagagagagagagagagagagagagatgaaacttgtgcaagaagaataccgtaaaggaccgtggacagaacaggaggacatcctcttggtcaactttgtccacttgttcggagatcgaagatgggattttgtagcgaaagtttcaggtttgaaggtggagggagaaacataagaataggtataggtttgttttggaaaaatgggcggtctttggaaaggaccttccatttaaagaaatgacctggttttggttgtaggtttaaacagaacaggaaagagttgcaggttaaggtgggttaattacctgcatcctggtctcaaacgtggtaagatgactccacaagaagagcgtttagtccttgagcttcacgccaaatggggaaacaggtcagaagaatcttcaagaaacagagaaaccctaaaaatgtttttttttttaaccctaaaaatgttctttgtttgttgtttgagcttttggatactttcatatgcaggtggtcaaaaattgcccggaaattaccggggagaacagataatgagataaagaactactggaggactcatatgaggaagaaggctcaagagaagaagcgacctatgtctcctacttcctcatcttcaaactgttgctcatcatctatgaccactactactagtcaagacactggaggctccaacgggaaaatgaatcaagaatgcgaagacgggtactactccatggatgacatatggagagagattgatcagtctggagcaaacgttattaaaccggtaaaagacaactactactcagagcaaagctgttacttgaatttccctcctctggcttctccaacatgggaaagttccttggaatctatatggaacatggatgcagatgaaagtaagatgtcttcttttgctattgatcagtttcctctaagttttgaacatggtagtggtcgcctttagtctaggatttgattcatttggaatgtttatatgtgcagcatatatatgttatcaaacgacgactgtagtagtttcctatgacttacatcaaaaatcaccacccactgtactaatctcataagtagtcatcatcttatgcctttgtttagtttgtagagtgagtgaaaagatgtgtaatacaagtcagaactctatttccaaaataaatagacttttgaagtttctgtgaaagtttgtaagaaaacatatataatgagttagaaattaatgttgatccatcagaaaggcatggatgagaaaagtctttgagtattcattcattattaaaaccatgaagagtgaaggaagaaaaatggaataagcaagtaacaacatgcatgagtgaacaaggcatattcatttgctaaataatcaagagaataggtttgacttgtaaagcttaagccaactttgtgaaaaaagaatgtattcttctactttatcatcttattgatcaaatcgagtatgattttttttctgtttaagaaatgaatccatgataaaagatcagttcccactctttagtctttatggtaagatatcttttttttttctttgttatatgatgaacaagtaccactaactacaacttcaactttttgtctttaaaatttcaataaaaaaaaaaaaacaaaaaagaagaaaaggatggctgcttaaagtaaccgagaaactatttatcaattaaaagtgtagaagaagggagcctaattgataatcagctcaattcaataaaagaagtattttttacaaaaaaaatgagatcacaaattcgtaggtttttactgccaatcgagcaaactctttaaccgaattggaatgtatgtcaaaaattaagtccttaaaatcttgtcaataaaatgaaaattttcggtatatttttaaatcactatttcaataacattgaatttcattataacttttaaaatttatgattaaataacattagatttgttactttaacacaaatcactcaaaatacatgattaaatacaccccttaatctttaaaacgcataattatttttgaaacatttttcattttatttaactaaattactgtaattgtaaaaaataataatacaaaatataaaaatgtgtcatagattttaatatttagctttgaaataataataattgtttttatttaattggcctaaccatatgtagttactactgtacgagtgactcatggccacacaaagttgttacgtcactcgaaatcttaaatccgccgtcaaaaatgctattcagacgaagcagccaccaaccactactcgagccgccgtagatccagattccttaacagtagatg

SEQ ID NO: 22982 - DNA, 3000 bp, Unknown
  misc_feature (1)..( 3000): 2750-1469P.txt file - cDNA_ID_2127077; gDNA_ID_1620329; Annot_ID_153589
gctagattcaagggatatacgacatgagcaaatcaacggttttgttttaccaaagatgacaactttataacgacagataaaaataaaatcataacggataaaattaagtaacaaaaaaaacaaattttttgtaccttaaagagtaaattgttccatgaaaggtacaaaagttgaggatcagctgatagattgatctccagattttggcttttgtgtaataaaatttgggtttggaaattggaacagagtagtaacaaacaagagatgggtttttttgtgaactctgcaaacatgaatatataaaaagttattaatttaatatttgtgtattagatgcaacgacaaataaattgacgtgagcaaatataggagacgaagggattgaattgaattgtcagtctgattttttctgatggctatgaaagttaggaagaagacgaaaatttcccagattttaccataaaaaactgcacaaacgttagtgggtatgttacattaccactttttaatctgtaaagaaatagcgataatttaactttttctctacaacaatactatatatttttcttgttaattataattataattataatatcatttttgtatgcaatcgtcggttcgtcactcacagtcacatatgctaaatctcaaatatatactttctttattccaaaaaattaaggatggtagtggaggttggaaaaaaagtcaacatatgtaggttgtgtaattttttttaaggatataccaaacttccgaccatatttatgaagaaagcacgggacacatgatttttttcggcatctgttcatgcattataaatagattatcatgagtttactattccatgttcgttctgttggaagttcatttcaagtttttttttttttgtcacaatagtctcatttcaagtttttgttactagttaattgagctattaagttttatacttaaagtatcatacactacttagccttgagatttttcataaatcaaaacgaaacagaagcttaaagattttaaatgaaatgaggtggtcacatacatatatgtgtcaaagatctagaagttctagattggatataaatgaagaatgacgacattaaccgcccctacttttcatctaaatggaacatgacatacaatagagtttatctgaaaggatcgataagatgtcgctatatttactaaaattatctataatatgatgagcccactatgtttttcttgacaattgggaacttataatataattcttggatatcaacgtataaatgatcatttacataatctagtgcttgtgttagtgtcgtgtgtaatatccaagttcaagcatgtatcatatgttgtacaaaatagtttcagcctaaaatgatatttgtggacctgtgttgtctaccgacacatttgtttggacagtggaaacaacaattctatactatgttaaagcataatcaagaagaataaaataaaaattggttgagatgtcgcaaggagaatgacttttagatttgtttatattgattcacttaaaacaaatacaacataaaattcaaatttacacatattaacataaattgagttgtatgttgtgctaagattacttagtgatattttaaagcccatgcaaaaataacttatcttctaaagaaacggcctttttcttattttttgtaaactttgacaagcttagatcatatgattgaattgcattaatggacgttattttaattatcttgaaagatctaacgtcattttcatgttaactaaatacaaaacatcttagcattcatagctgaataagaggcatagttactattcaacacttttagctttaactacaaccttcaaaacacacaattttgtcgttttgtttgatttaggcttcgtaatcttgtaaacagaattcacctacttcagtatttcttcttttacactacgatttcatgattccacaaagtaaaacatcaacatcattcttgatttggaagtaaaattgtgaatcgtgtatctaatgggcctggtcaaataggcccaaacatggatccgcaaataaggaatttttctccttacaaaagacactctttctgagtaagaaggtttcgtggggcctgtcgtgacctctgaaagttccctccatcaccaatcattcggcacaaaactaatatttatattttgtttcctttatttattttatttaataaaatatttatcgatcccaattttctaaatcttgcttcttctctcgttcctatatccgttttccgatttagggcaccaaattgaatcaaaatctccgcttcttcccaatttacgaaacttcacgaaaaatcttcttcggattcttcttaaccctttctctcaatttttcttccagagttttctaattgggcactgtttctcttcttcttcttcttcttcctccgtacgcatccttctcctttttactgttgagtgtgaacagatttaaacaacgtcatttctagggttttcggagttcaattttgttatcttactattgaatttgcatcgcgatagctgaatttaggatcctgtgttgttgctcagtcgtattattacaactgttgaattacgcttgcgtttgattgtttttttctttattggatcctcgtgaggtttttttttcttgttctgaatcgtttcctggacttctgatttcctgctagaagtttatttcatggttgctgattcattatcttcttgtttctagatgaaagtttactgtgtataaaccttcaaaggatgagaatttcaatcttactttgaacaatatgtagtttatacagtagcttcgtctgttgttgcaccatggttgataagatttatgtctcctttgtttggtttattgaattcttccttttttccaggctattcatttctgagtaatcgtttattccatctcagattgtaggcggtttcgcgtcttgtcaccgaatgatacattgtctcacgtgagattgtcagtcagttagtgcaatg

SEQ ID NO: 22983 - DNA, 3000 bp, Unknown
  misc_feature (1)..( 3000): 2750-1469P.txt file - cDNA_ID_2127085; gDNA_ID_1620329; Annot_ID_153592
acaacccttattttattgtagccttgaaggaaacccaaggcttataaaaccacctaagaaggaatttcctgtggcaattgttacattagttgtttttgtcacagtcattgtggttctttttcttgttttcagaaagaaaatgtccacgattgtaaaaggtacttgcaagagaggcattaaataagaaaaacttataaatcttgggaatgccgttcgttgctccgttgcatgacaagaagagatgcacattaaaaaaagaaatatcataacatccttattctgatgtacaggtctacgcctgccaccaaggacatcaatggtggatgttacattttctaataaaaaaagcaaaaggttcacatattcagaggtcgtccaagtgacaaagaacttccaaagagttttaggtaaaggagggttcggcatggtctatcacggtactgtaaagggttctgaacaggtggccgttaaggttctctctcaatcgtcaactcaaggctctaaggagttcaaagcagaggtgcccatatttctgtaatcttcccaactatactatgatctgtttctccaaaggttacggatttcaacattttcttaacacgtagtcttttttaggttgatctccttctgagagtgcaccatacaaatttggtgagcctggttgggtattgctgtgaaggagattacttggccctcgtctatgagtttcttcccaatggagacttaaaacaacatttgtcaggtgatatattttcttaattatgtcacgtctaatagttgctcatgaaactcagaagacctgaatggatctaacaatctaatatacaggaaaaggaggtaattccatcatcaactggagtattcgactgcgaatagctttggaagcagcactaggttcgtactatgttaaaaaactgtaggacaagatatcaattccgttcatattagtttgatgataggtttgatgatatttgtactcaattgcataggtttggagtacttgcatattggatgcacaccaccgatggttcatagagatgtcaaaactgccaacatattgctcgacgagaattttaaggccaaactcgctgattttggtctttcaagatctttccaaggtgaaggcgaatctcaggaatcgacaacaattgctggtactcttggataccttgatcccgagtaagtattattagtttccagatacacacactcaaacacttgttctgaaactttttattccttcttcgatgattaaagagtatatattatgttgttgtcttgcagatgttaccattcaggtcgattgggtgagaagagtgatgtctacagtttcgggatcgtgttattggagatgatcacaaaccaaccagtgatcaatcaaacctcgggagattctcacataacacaatgggttggctttcagatgaaccgaggtgatattcttgagattatggatccaaaccttcgcaaggattataacattaattctgcctggagagctttggaactggcaatgtcatgcgcgtatccttcttcctcaaaacgaccatccatgtctcaggttatacacgagctgaaagagtgtattgcgtgtgaaaacacagggataagtaagaatcgaagcttggaatatcaagaaatgaacgttagcttggacactacggcggttcccatggcaagatagttctgaatgttttctactaataaggaatcaatactcaactagttacacatttagcaagatttgtaaacttgttaaagtaatgattgaagtgtgtaattgtgtatacgtcttgtagataaactcgaagtcgacaaatttccttctgcgttcattgattattaatatattcagatcaatattctctgctcttttggtttcttcatatgtcttgagtaccacgaaaaggtagttttgctttgaccatctacatttcaaagatcattttctctacaatcttggtttctttcaatgtggtttacttttgtctgtaattgttttctctcatgttaatccacttacccatttctaattttttttttttttttttttcctgcctatgaaacagaactaggtctctcaatcctagtcaactatcataatgttggtgactggtgagtctgcttgctattgatgccatcatgccactagccttttgtgtgacactaattaacgaccattgaccagttctcagaatttcttcatgttgtcatggtgttgagtgtctagtggcttattaaagccaatatctttgttgcgtgattgatacattctttggaagttatactaaaagcaagttgcatatttctgaccaggaaactaaaaactagactgatatacacaattttcatgatagtgatgttggaccattatctcccttttattcttcttattcctctcgtggtgaagttgcattagaatacaccttttggtcattatccatcatgtttaagcctaagggctaattgttataaaccttgtttatttcctgctgacctactttgctttgtaatatctagtcagcatatatagatcattgtgtgcctaaataatgctgaatattgttgtggtttctcactttttattcatatgatttgaaacaaagtcaggtctactacatatataagtcaacgaccattagaatgtcaactctttttgaacatttcttcatgcatcattgtggtagtctggtggctattaaaccaatatcttttttgtgtacttgacaagttcttttgaagtaaattgcatattgtctgaccaagaaactatactgatgttcaatgccacaaatgaccccagtcaagttcataatagtgatgttggaacattgttatcctcttatccttcttcttcttcccatggtgaagttgtaaaagccatgacttgaaaaagtctttgcttttagtttccagtttgttttttgcttatatatcctcttgttatcttcctgagcttaggcaacgatttttgtcattggtgggtaagaagaaaatatg

SEQ ID NO: 22984 - DNA, 1508 bp, Unknown
  misc_feature (1)..( 1508): 2750-1469P.txt file - cDNA_ID_2127113; gDNA_ID_1620329; Annot_ID_153600
cctgtacttgttttgcatcaaaaggaacaaattttgtccaagatcagttaaccctgcgtggctgcaggctgtgaggatggccgtgaatgttaagtggtcgagtttctctcccgtggcttccatctgatcaaatagctcaactgctttgtctgcgagcccgtgattcgcataacagaagatcatcgagttgaaagtaactgttgtcttctttggcgtcttgcgaaacaagatcattgcttctgatatgaagccacatttgccgtacatgtcaagcaaagcacttctaacaaacccgtgatcttctagtccagtgactaccgagtaaccgtgaatctccttcccgtgcttcatatatgcaagtgtggtacaagcaggcaatagagttatgatcgtagcagagtttggatacaacccatgagttaacatctgtttaaaagcatcaaaagctttctcattctgaaaattatgtacaaggcctgatataatagaagtccaggacacaacgtcgggcttgtaaccatccaaacacatcaactcaagaatctcagatactttttcttcatttctcatatgcgagaaccctgaaattagagcattccaagtgataacatcaggttttattcccagtagtttcatatctttcaccaagttcaatgcttcatctgcttggctattattagcataaccagagatcatagcattgaacacgaccaaatcctgttcacccaaatcactgaacaccttcctcgcattccccacctccccaaacttcgagtacatatcaataagcgagctaactataaaagcatcagactcatacgaaaacttcagcacaagacaatgtatcatcttcccgaattctctatcaagcagattgcgactggctttaagaagactaggaacaatgaaagcatcaagttttaaaccgtctttgtacatttctctgaagaaatccaaagactcctggtaatacccatttcgagcacaagccccaatcatgacaacacatccactaatatctctcttgggcatttcatcgaacaccttcctcgcatctagaactttcccacattcaacataaaaagttacaagcttagctgcaattctcgtcaagcgagcaataccagatgtcactaaatgagcatgaagcactcttcctctacaaaacagtcgatctcgaccgttggcttcgatgagttcaacataagaaccgattgataataaccgaaaagaactaggaacgatggtaagtttcttcatggataagaatcaaagcttcaaactttatcaaaacccgcattactgatggtagatttcagtgacggaagtaataaaagctcccaattttatctgacagagaacgaacaaggaagaacagagttagcgattataccagattaaacggtacggttaatactgaaccggaaatcgaaggagcggttaaacaaaaaccggattcgattgtccaaaaagggggaattcaatccaatgaagcagagcaaattatg

SEQ ID NO: 22985 - DNA, 3003 bp, Unknown
  misc_feature (1)..( 3003): 2750-1469P.txt file - cDNA_ID_2127140; gDNA_ID_1620330; Annot_ID_153609
tgctctaacagaacaaagtgcattttaatgtaaaacaacagaaagattctcatatcacaagattgaatgctattcaacacacaaaacctagaaaaaaaaatacgactctaaacaaaagattaaagatttgtgtaccacaagcttaagggtttttgattctttctttctgattcccgctaattcgactctgcgacggtctttaacaacgagaactgatttgatttcgaaattctcagagtgggataacgctaagaaagatgacaaagagtcgtctgaacatatatagttctgccttcgtcgaagcagaggaaacgcctgagacgctgctaatcgagccgtagtttccacgctacgcgtttgcttttattcttcaagataatatatagtattaattacagtatcttcagaaatgaaaacatatgtcttctattgtttatatgaggaaagaaaaattcgaataagttctagatattgaaaaatgttattacgataggatctgattccagtcaaattaatacacctaatccattacagattttactaccattttaaagtcacgtgacttttacataatctaaaatcaaaagagcgaaaaataaaacaagaggtcggtacggttcggtttagcattattagaaagtagaaaccaaaccaaactgaattggataacgttcattgatcagaataggtaataggtcatgtttctggtaatagctgacgtttctggtaaagtcttctgtagattcttgcaccttcgaactctgcgtggatctctcgttctgttcttatacccatcgggttttccgttaaccacccatcctctgtgtcaactgtgtccatgtgttgaagaacatttgattcctcgtccaactgatctctcatgtcttgagccacatccagcacatcggattgcacaaatatctgtgcacaaccagtaacaaagaaaatgtatatagttaagtttaaactgtaaaagaaccagtagtgttggtaggcagtaagcaaaacacttacttttccaccgggttttaggttttgaagaatggaattcaccaaaggcttttgaacaacacgtctcttttgatgacgtttcttgaaatgaggatccggacactgcatttttacacgtcaaaacaaataagttggattatcatcaccacctgaagaaagagccggtaaatatagctttctcggatgcttacaactttcttttatcacttaccaagattgagacaatctccaatggtccaggatagctcgatataagatgttcaaaagaaaccatggcgtttgcaaatatgaagtgtctgaaacccatccatcaaagaagttatcaacagagtatataacataggtgtattcaaaaaatctttcctaaggttttgggatgcagagattacacgtttgaaagtccgagctcattcacccaaaagttggcgcgcttgaccagctgcaaagaaatgtgacaaattaaacttcattaggccaaagataccgaaagatacatcagcttaagtagatgaatgatcagctggaaaacatcaaaacagtcaaaaggagatagatccttactttctgacgtatttccagccccaagtaatttcttgattcaacattcttattggcttgccataggagaaatctgccactacctaaaatataatgacgtagccacaggttagtagaagaatccaagttcaaaaaccaattacaaggcagagaggcaagaacggaaatcaaatgggaaacttttggcctttaaaagttgaaacacattcaagcatgaaagaggcgcaagaccaggaacgatataaaggagagctatttgactactcaaaattcaaattcagattccagggaattataccaattacgcaaccaaaagtctccaacaactagtgtataatgtaacttaactaagaaaacaggatctgcataagtatatatcaattttcagaagaagatataaatagatttgagttgagacaaagcataagtcccacaagtctaagcaagctcacaagttaccacttccaatatccaccataagaggaagtgatggatccttataaacttcatcccaaacaggaactggagctggtttctatcagaaagaagaacagtataaatcagttttagtgtttcacatatcatttcaaaagtcacaaactttgcaacatcatcaacttacagagaaagaggaactgagaggattaacatgctgtctgattcttacatgacccacttcctgcaaataaaacagagagaaacacaaattatactcaaccactaattagagatactgatagaccagagtctatgaagatgaaaagctatctacttggaacaaaaagagaaaagaacactaatcgaaacaaaaacaatacccagaaagcaaagactggaaaaggaaacaaatttagggtaagcaaaaacagagggagagagaagaaaggaggatacttcagatatcttatgattgaggttaagttctgcatactccaattccaccaattcattgcttctcagatccttaaaatcgacacaaactgaggtagacgctgacgaagacgcagaaacggcattaaatgctctaaagctgttacaatggcgagggattttgtgttccctcatgaagataaacggagatgatgctaaggagaacacccttttcgccaggagcaatggtgtagctgaagacgaagagcaagcttgacatagagaagccatttttgttagagaaacagaggaggattggattcaattccagaccataaaaatgttttcttttagtgttcttctcctgcttcttaaacccaatgaaggaagaagaaagctgtgatctcaatctagaaaacgttcaagagttttgtacttaatgtgataagaatcgaaataaatggggtgtttgtgtaaatacattaaaatgcttaagaacttgtggattttaaaaactccagctttctccgcttgagctcatcatagccactaaccaaaaagatg

SEQ ID NO: 22986 - DNA, 3000 bp, Unknown; identical to SEQ ID NO: 870
  misc_feature (1)..( 3000): 2750-1469P.txt file - cDNA_ID_2127144; gDNA_ID_1620330; Annot_ID_153610

SEQ ID NO: 22987 - DNA, 3000 bp, Unknown; identical to SEQ ID NO: 868
  misc_feature (1)..( 3000): 2750-1469P.txt file - cDNA_ID_2127147; gDNA_ID_1620330; Annot_ID_153611

SEQ ID NO: 22988 - DNA, 3003 bp, Unknown
  misc_feature (1)..( 3003): 2750-1469P.txt file - cDNA_ID_2127200; gDNA_ID_1620330; Annot_ID_153629
agaaaaacacaattccattaactttaatcgtacaagtgagagtgttagaaattgtggttaaacaatgatcaataaccactaaccatttcgtaaaattcaccgacgactttatcaaatgacgaacatgatccgatggatccacgaactaccgaaagagaagtaacctcagaactatgtagaaaaagcaatcctattattcattcgaactaattcaatatgcagctagttttttggtctaacgacttcttatcgtaccatttttcatctcttatcatttttaccatattcaaccataccaccatttttatcactattttgtacagttacaaagctcttaccgtcttgcgctattaatcggaccattaaacaacttcacataaaattttatattagacgtttgaatttaagtcgaagttttgataatcttaaatgtaacccctaaaatacagtcgatagtatttgatgaaacaactccctcattaaaaatcgattacttttataaaatagctgtaaaataaatggcaacccaaacgaaacaaaaaatatctatcccccgaaacatattacatatactccacatctttcatatatgtttgtttatcggtatgtctttaatattatctcttcttaccccaaaattatacaacaatctttcaaattacagaccactttcatggtcgttggaaaaaaataattcttccatagtcgagaatatgatttgcaaaaatgttattaaataataatcattcaaagtatcttaataaaaaaacaaaagaaaagtggaattggtccataacggttcggggaacttttctatgaaccggaaactgaaattcgtgaggacggtacacgtgttaggtaagaacacgatccgctcgtgtgtaacagccaatgatgtcgtcattccacgtcggtacaagactttttttttgtcgtcaacagaagatttcaaaattaacgaaaccgttcccataaccgaaactcacataaaaacaagacacaataaataaaaaactttaggtacttttctgtcgtttctttggtttctaacgtctattcgtgttatatttgttttattcttcatttattattgttgaatttaattctagttcgagttcagttacatgatttctctctttaatctctagtattttaatccatcaaaattatgtggttgcatactcgatcgagtttagtacaattactaaaatatgtagctttgtttagtcatatcaagactatagtaagttgttacgcatgaaagataattattacattcaaacgaatgaccactcaattcttatatcaaaaagatacaaaaaactaaagtctacaacttataggttcaatgggagcataaatagtccatatcattgaataataatggtcttcaatagagttggttgttcaattattatttttggtttataagaaatgaattgaacttttgtttgtcaccattcacattttcttctcttttttgtacttttagttttcctaaaaattaaaaaaactatgttcccttcgtacctaaaacttactttaaaataaccaatttgatgatagttttttttaaaaaacttcaacaaagattatatatttcatcctgaaacaaaaattacagcaaaatttaaatttaaactagtagcaaaaaatataggatgtgcatatgttttctgtttgccacgtctgttttccattaaatgtacgcacaacattgtttgagttcaattaactatttaagtaataaacaaaaacaatgcttgaatttcactgaatatagtatataagtaaaaatgtatacaccccaaacgacgtcgaacccatcgttcaaaagatattgaagtacttgaactagttgttgagctaatcatcatattactttataatttaactacacaaaacgagttctttgaaagatgcgaatatatatatacacacttatacgttatggagagaacagaaagctcataaaagcaatttatttctctccctttaagatcttttcttgctttgtgtccgaaacagacaaaaattgattctgttgttttttcccataattaactcacacacacacacttaacgtacgtgcaatatctgtatgtgtgcatagtatatactatagccacacgagcggttcaaaaatgttttttggagtttccgagactgttgagactgtggggcctatggtcatcgaaccctcccacacgcacgagcgggtctcgttttgcatgcatctacactacacgtacccaccgacttttccaaatcccttacttttgcacgtgtagagagagagagctttgtactgaaagtatctcattattcgaaatttttcgtgtaagagtaaaaactaaatcgcaacgtacgtgaaggaaaacgtgaaccttgaatatttaatgttttcgtgcggtttcattttaactatttaattaacacaatattagtacaataacaagcagctcttatgaagatagtgatgaaaaattgttatagatctatcttggaattttaatgatcgaatttcgattttgtacgaccaccatcgaggcatcgactataaatatagttaaaatgtggttgctgaaaaaaaaaaaaaaatgataaataaaatgaaaccgcacgtaattgtataaaaccattagcatgggattattaggccacaatttggtaattaacacttgtaattcatttgaatatgcttttacaaaactttcccttcaatttcttttggtgtgtgaataaacagctatcaattttgtttttcatgtacattaaataaccactctgcactcatcatcattttctaaaatattcttctatatatattaactagcttgcaaataaatgtaaataaaaatataaatttcaataattttttttagagaatctctctttcctcttccaccatataaacagtgaaaagccattcaagtgctctctccctctatctctcttctatttttagtttctcttcccttaatccctaaacccagaaacatg

SEQ ID NO: 22989 - DNA, 3000 bp, Unknown; identical to SEQ ID NO: 866
  misc_feature (1)..( 3000): 2750-1469P.txt file - cDNA_ID_2127207; gDNA_ID_1620330; Annot_ID_153630

SEQ ID NO: 22990 - DNA, 3003 bp, Unknown
  misc_feature (1)..( 3003): 2750-1469P.txt file - cDNA_ID_2127224; gDNA_ID_1620332; Annot_ID_153667
attaaaattattaattataaaaatacataaatttattacccaaagttcccaacaatattttcccaacaaaaattttcgacaatagtttcccgccaaactattttgcaggaaatataaattccgtaaaaaatttcccgccaaaaacaaattacacccatattttcccgccaaacaaaaggaaagtcaggaagaatattaaaaattaaggaaagattctacgcaattcagtaagggttcacgaaattcagattttttttttttgtaacccttcctgaattttatagaatatttcttgaatttggtgaaatctttcaaataatcatttctgaaatttataaagaattttacaaaattcagtaaggatttcaatacagattttttgcgaaatctgtcctgaatttcgtagttaccttcttgaacttttttggtgggaaaaatttgacggatattttttggctggaatagttttacggatatttttggcgggaaatttgtttgcagaaaattttttggcgggaaaatttgacgaaattgttttgcgggaaaagtttgacaaaaaaaattggcggaaaataatttcttttatttacttttttaattaaattacttatttatttttgacatataattaaattttgtagtgatatttttgaaatatttcaaaagagatgatatttttggaagaaaaatttattagtgttatttttgtcaatcctcctagaatatatatactattttatatagatgtagttttcctaattctgaaaaatttaaaatttcttataaattaaaacggatggagtaattaaactatcatttgttgagattaattttaaatttttattactccatccagtttttcttctcctttttactttaacttagtatatattctaattgaggcagtaaaagtaataaacctaatttgttgagccaaaacagcttagataacttctaagctgtaattgaataatataatgaattttgtatttgggttagttattagtaaaatataaaaagcataacagtaaaaaaacaaggatatgatcaaaattcaaatgcttatggaaactgattcacacgtaaaaatatataaatgtatgaaaactagatgtatttaaaatagaaattaattgtttgatctaaaaataagaaattgattgatatatcttttaacatgtgttacgtagtttttaacaaaaacatatgtgttacgtaatcttaaaattctcttaactgcaaagattgattatagtcatttgatatgttataatgttaactatattttttttgtatgaatgtaaacctatattcaacacaaaaacgtttttctcattaaatgtaacatagagagtagaaattttgaataattgcaaagcagcttagaagttatcggtacgacgggagtgaaaccaaaaccgcagtccgtcgtcaagtttagagttgcttagttgttgaatggtgctgaatctgttccaaacattatttttctaatgatttttgtgacttttggagccgggatttgcaggctcaccgtggcgtctagcgttctctccacatgatatggatcaatgcttgaaagacatacctgagagtgaagacatagaggttggcttggaagaatcgagtagaagggaagtgattgatctccagctctcgaagtgttgactacatttatatcgtgcaacatggttactttgcaacggcactgcatcagggtccaatttctgcccccaaatacttttgttgaagtactgctaaggatttgtttcaccatcaacagacaaaaatatctgcattattatgaagctcgcttagcaaaattctctcgattcctctctcacgatcacaaaacaacaatcacgaacgcatactcaattgtacatctcttgaaatgttgtcacttctctattcgattggtttgtaactccattttcctcgtttgtgaaagcaaaaacaatatttatttacaaatgtatgcatatcgaataaataaaagtataatattaaatcatactaaactgaagaaataccatttgtgttaacgttttcatgctgagtttcaatggtttttgataatgtgatgagagtttagaactggaagaagttatacttactctcataagaataatgattaggattacataggtttatatagtaaagagatttcataaactagatgaatacaaatatgtaaaatatcttatatcataactatacaatatttgattatatattgagaatcttctagatacttccatacccttctatagttttaactcaaaaatcaattggcaattggatttaaagaatataatgtgggattccattacacttacgatggatttgctcaaaaaaagaaaaaagaaagaaagattccattacatttaggatgtgagattcgtaacacgattcaaaataatagctaagaccttttatcttaccgaattcccttttaaaactgcaatataccctacttggatcaccctaaactaaagtctaaactatcattttatggttataaacttaattaaaaccaactgacaatgaattgaaaaaataatgtgagattccaaacattatttaatttttggttgtaaaatcccaaaaggtatatttaccgcctttaaaaaaaactaatgaaagcaatttaaattgtttctgtgtattctcatcatttcccgtcacttttgtaacaattccaacgttagaacgatcattcactcgcgtaaattgtttttattttattttaaagcgttttaaaccataacataaaaaagtttaaggatattataattttttatcaaaaattaatgatattaggttatcaagtggtcgagtaaatcatctggttatataaaattggagaaaaagattttctacctatataaatatagatatcatctgtacatgcactccacctcattgcaaaacaatttccccactatctatcctccataatatagtattcttcttttctctcctactttctctatagtaatg

SEQ ID NO: 22991 - DNA, 3000 bp, Unknown; identical to SEQ ID NO: 877
  misc_feature (1)..( 3000): 2750-1469P.txt file - cDNA_ID_2127272; gDNA_ID_1620332; Annot_ID_153677

SEQ ID NO: 22992 - DNA, 3003 bp, Unknown
  misc_feature (1)..( 3003): 2750-1469P.txt file - cDNA_ID_2127299; gDNA_ID_1620332; Annot_ID_153684
tactacaaagaacattaacacttcaagaagaactcaaagactctaaagtcgcattcttacttgagcaggttcgatatacaattaaatcctccttacttaaaacacaaccatgatcataatgttgattagcaaaacatgtatgtctggttttcttgcaggagagagcagaggcttccatgaaggaagcagagacggcgaaatcacaatggctgtgtcagatatgtcagacgaaggaggtggaagttactattgtaccatgcggacatgtcttgtgtcggcattgttcaacatcagtctctagatgtcccttttgtcgtcttcaagtcaatagaaccatccgaatcttccgaccgtaactaacaccaaaagtcaaatattaattacccaattcatcaaaggttttgtcctctatacattacaacagtttctgctaattcatttgtaaatacgtttaggtgttttcacttttgtatatttaagtaaagaaattttttattttaagccgctatcaatctatcatcattttaagcattgagtagactgggtattcaccctatcaaatatcaatatctcaaatcaaatttgaaatgagccaaactaggcaaaatcttcagagaccatcacaatatcagctaacgagtacaaaccaaaaaagctttggcttatcaagttttttctgacacttttctttttctagatgacatcaattgtttcttgttgtttatctacttcttctttgaatttttcttcttaacaaccaacatttgagcttccactgtttcttctgcatcgttcattaggttattatcatcaacattcaattcattttggaaatgattcaaaaagttgtatgtctccgaaatataggtatcgctaaggattctttcttcacctagggacaagactctcaccctagacaaaccaggggagtctaaagcttggtggatttgaagctccagacaccatccatagctatttttggtttgtctacatcaatgcttgtaggaataatttttttttccggagaagctgatcaccgttgtgatagagagacttgccaatcatatgtaagcatatggtctcatcaatatcataaattaataaatttataaatttatcagaatatattatgtatatgtaagaaaagttagtgaaatatgattctagtattgtttgtttttcttaaataatattaagttttgatcaaatattcatttttaatatgtttactgtataaaaaaaagttgtgctttttttaaaaaaagagaatatgttcttttacttgtatttgtatctaaaaagatgttggttatgacaaataaaacttcttttcatataggaaagttaaaaaaaattacaaattaaccaaatctctctataaattaataattcaacaaattaatatctctataaattaataaaatttcacgttcccgacattattaatttatagaagttttactgtattcctttgtgaatttccttttcataatttaaaactaagttggcaaccttttcatatcataaataagtaaattatttcaaactatttttctggatttttaatctgttcattggagtcatatcaagtcttgcttcgtatgatttgttcttcctactcataagagctttgtagacatacttagatttactagactatgaattgtgcaaattttgtaatgattaattttaatcatcttattactttctcgattcaagatgaattacggacaaagatgaatgtctgaacctttagcgttcaatcttttatttcttatcttttcttagtgatgcatataatgctaaaagaaaaagatgttagcaaaggagagacttttggattatgtatgataatggaaaaaatgtcacatggattcatcacagtgaaaatgatgaagatgaaagtatgactcaaaaggattgagtagttaaaaatttgagaatgaccagggagaaaggaagaaaatcaaggaggaaaatattttagtaaatttagatgattacatttgagtttttttttttttgtcacaagtgtgttttattgatattatagagccaaaagtaacaggccaataattcacaaagactaaaataaacaagcccaaagaaaaaaaaaaaaaacagcccaaaagcccaaatgaataaaccctaaactgaaggaagagaacaaatgattgttgtgcgccgcatagaaaacacgtgtcagtgggaaacattttgaaggacacataggaactggaagagaagggagtcgccgtcagaagcttcaattccggccgaaacaccggaaaacttgtttaattggcatagctcactcgtcgctcaaaagattaatggcgaaatttcagttgtagcttggacgagaatttgactccacgaagtgcaaatcttcttcttcttctttttctttttcttcctcttcttcttcaatcaacatctttttaactcttagggttcatcaatctttgaactacaagcagaagataaaaaaaaaacaaatcaaatctaaatccggtcaaaaaaccggagaaaaaaccggctaaagacgccggagaaaagcccgacgaaacaagaaagagggtatcttgctctcgggagataagccagccaccaccgctaaaagtagccggtcgatgccggaagctgagccagccaacgcttctaaggaagccagcgatgccggagtagaagccgaccaaacactgctgataaagccagtcattgctggccaaaaaagctgaaactctctgaaagatgaggagagagaagagagagaaaaccctatcaacgtgaaaataattacatttgagtttatatactcaaaacttggaagtaaaggtaaattaaaatatgattgttagaaacaattacaccaataataaaacgacacgtgtacactacgtagacgttagataaccacagcaaaaggatatgtattctcgaggcgggagagagaaagagaagagagtgagagagatcgaagaacatttacacacatcaatg

SEQ ID NO: 22993 - DNA, 3003 bp, Unknown
  misc_feature (1)..( 3003): 2750-1469P.txt file - cDNA_ID_2127307; gDNA_ID_1620332; Annot_ID_153686
tttttatttactatttaaaaattgtcaattactacatataaataaatttggtatgcggtgggttgttgtccgtggaacggtgactgaaccgaacaatgcggtgcggttcaaatagtaacgaatgtttttgcatatatatgtttttgttattatttgaactgcactgcactttatccgcagttgaacctaattgaacctaatgaaacttaaactggtttagtttgctaatattatttttattttatttttgaataacttttttttcttttcttttttgtcatctgatcatttttcttttttgctttcgttatggataagctgtaacgcggtttttgttttgaacattaataataattaattctattcttcgaaaaaagaaaaatatataatagtgtgtcgttttccggtggcgacgagagggagaaccggagaagagatctctcgttcgtttttttcccggtaaatccggcgagaaaaagttcacattgaatctacgagaaaatttccttccatttcactccacgagttttcacctctcttgttcaatctctcaacgtctctccctcgtttctcgttttcgctttttccccttttcctcttctattttaccggaatccgagaatttttgatcagatctagtttcagaaataggttagttccaacaatgttgacggaacgaggaaggcgaatttctggtttcaatgggagtttcgaatttagcaatagaaaattccgtggttatggattcgtagatcgatctcaaggtttccatgaaaggagtccttcaagatcatgttctgtttcgaaaatccttcgtatcacgccaccaacctcgtctccaccgtcttcggcttctacatgcgctggttatatcgaacaccgggtctccaagttcgatactctcgccggcattgccattaagtatggcgttgaggtatgtattataatatatgagtgtatatgctttggatgctggattagttttttttccttgtgttcttagaaagtgctatttcaggttgcagatatcacgaagctgaatgggcttgtaactgatcttcagatgtttgctcttgagtctctccgaataccattacctggaagacatcctccttccccatgcttatctaatggctctctaaatcatgggtacttttaagcctctttatcctctcttcttagatgacaaggctgtagtctgttactttgatttttatcttcagtgatggatttattcatatgttacttgagttgtgctactgtgcatttcccaagttcattcaaagaaacatagaccaggttatagaaagaagtttacataagatggaaaatgcttagtgagagttgtttatgctggaaaatgcttaagggagacatgatagaaaaccaagtgggtacaacaggtccttgtaaaagagcagttttgacgtttcaaattctggtttcctgcacagccaaaactcgaaagtttctatgcgcaatagtttgtgcctaatgggctatgaaccttaagtttcttggttagtgcatacaacctacgtcctagaatttttttcacattgatataagaatgaggacgtaggtaaggggacgagtaaagatgtcgagaattgagacagttaagtagagccttgaatgatcatgatggtagtatactgatttgcattaaagggcatccacatatcaaagtgatcctatccccatgactgacatatgaaatctttttgcagagaggattggtccgagcaagcttcatcctcagctagcaatggcaaccaccaggacgtatttgactccttccagtctttgaggttgaaccattcagaaaagaagatttctccagccatgaactccttgcaaggttattatggactgaaaccaaaaaacagaagagcttctgaaggttttgggatggcagtctacaagaacgaagcttctcaactccaagacaatgatcagtatctcactcccttccccgccaccagtactcccttatcccaccacagaaaatcaagaagcttggtagatgcagttatcgccgaggttaaccaatcacccaacccttcaaaagcaggaggaggagaagtgaactctactgataagccaatgagaagacgccaaaaatctgaagccgattttagttcacgagctccagaattgctgttgaaggaagagaacagaagcagcagtggcgcgttttctgcaatagctggaaaaaatttagcactgagatccaaagcatcaagcagagctaacttatcagcagaaaccagacatctcaattccataccaatcaatttgatggatgctcctgtgggagacagcttctcaagcgtgaggaaatctgttagcgcatctagtctacaagaaccaaactgtaacagcaacggttcatcgctatggccaacctcaaagtggaccctgaaacctgagttactcacacaagtagccatggctagttctatttttgacggattgcctaagccattaactggtcggagaaacaaaaaggctgtggactaaggttagttaggtacttaggttccgtcggtctcgttatcgactgtccacttttggtttttgtaatccaaaagcaagaagtcaatggcttttataatagattgaggagtaaatagaaagtaaaaagtgtattgctgcatttcattcattcaaaacaataaggcaaaataggttgtgacattgagagtcaaaattaggcattaaggttttgttgaatttaatttgtacgttagatgaataatcgaatatcagaatactgtattcaaagtttcaaagtatttattggttaagtagtttgcaaaataatcaaaaaatacaaaaaacaaaattttgttgtctaactaattttccactccaataaacaattaaaaaaagaataaaaaagagagtaactctttaataaatctgaaatccctaagctcaagacgagttttcatttctcgagcaatttcactcttccgagaacaaccctagattccgatg

SEQ ID NO: 22994 - DNA, 3003 bp, Unknown
  misc_feature (1)..( 3003): 2750-1469P.txt file - cDNA_ID_2127366; gDNA_ID_1620331; Annot_ID_153658
tttggatattcttatcctgtacttccttgatagtttcagttaacagtttgtaattaacacatgtatttaatttggaaacaaaaaaatgaatgtatagatgattttttttttgaattgttggtaaatatatgaacttgacgtatatagcaatagtatactatatttaagcaactgaatgtgaatattctataacacaagtaatatcaattttttgtgatattgttggttataagttatattcgaatttgtcatttataagaaaactcactggtttatccatccaatgaaaagaagaaagctttttgggtgactctaataaatattagcggttaaataactacaaacacagtgttgtttttgtctcttctatgtatctttttatgtcctcttttacaacttggctttgatgttaactaatcaaagattatcctacttaaaaactatttaattaaataatttttaatttctttaaaattaattaatttcttgatatgtttttgtaacgccaattaattatacgtttttcataatgtggtgtttgacttatggtttgaatgttaagatgtcgtatatatctaaattctaaagaaagaaatttgcaaattttgtaataaacactatttttacaacaattaataatacatgtgccaagcagaagaacgactatattagttttctatgtcaacatttaagaaacatttatttaaaatttgaatatttgattttgtatgtcagcaatgtttaagaaaactttgattttttgttttccttcttttgcgtacatattaaatggaatttaatagaaaaccattaaatcttgatataattaacttcttcgcccttgcagttactaacaaggagacttttgttttggtactttctcgattagtttagtgaccgaccaacaacgtattttaaaactcaaaacacaatctctttcacgtactgtgcgaagtgcaagtcgaataatgacatcagtccatttgtgttgtattacacgggactacgatctctattctactatatataattactattaattaaaatgtttatatagttatgatatggttgatagtaatttaatagtaattgttaaacagtagagaagtgacactgagacatatctgagaaaagcctgaactcaactcctacttctggtttgatttcttgggattcgttctctttcatttacttacctctccatctatacaccaacatatatatatatatattggtatgttaattctccaaaaaaaaaaaaaactattttaggagcaaaactttttcacagttattcattttttaagttaacttaacttctcttctttgtttgaaaattcatttatcatcaaataattctgttataaattagacctgataataattctttaacaaagaaaatatattttaggagcaaaataggcagagccgcagaggcatacatgtattatatataacgattatttatgtatagaaagggacaccttttgtacaaaatactagttaaatttgtacattcacgtgactggttggctaaatttagaatattattattttcaattaaaaatcatcgtcaatgttcaaatattgcttgagatacgctatgcttcataaaaatgtttaaaaagtagttccaaaaaatattttcaccaaaaaaaaaagtagttccaaaaatattcatttaataacaaaatttgcctacataagcttagcaaacgacactaacaccaaaattgatatcattttcttagataacatattgtatacatatctacatacatactaaatacatatacacgtagattacacgtatggattcagcaataaaaatcaaaatactaaatacatatatacatatatatatatatatatgaacatttaaatactaaattatgtttaataaataattaaatcaacgtagagatatgtcatatgaagatggcttgtataattagtttgtgtaccgggcaaaggatctctaatttttgttttctttagttcagtttaattatttgttatctatccaatcaattttttttctaaactgtttggaccaatgtacgtacgtaccatcctttttgattttttttgtaaactaaattttcgaattagcaggttcttaataattgaacgaagaaaataaagaatagaggtagacacctgtagtattttcttggtcagaccaataatttataattcaacgtcaaagaagaagaaaaatataaaccattatttcattatgacttacgtataccaaaatacacaaattaaatgtataattgtgaggcattttatatgcgggaaaaaataaaataaaaagaatattaatatttcttttgaaaattgtaaagcattttgacccacttgtgatatatatatatatatagatatatatagagagagagattaaaacattgatggctagctatagagtctatggcagggtcatgatcacctgtcttctgatctctgaagagataccaatctgattttttctcttcctaggtttaattttattttaccattttataattctttatttttgcctgtagtacaatttacagacccatactaaaagaaaaattaaattttgtcaaagtacaaaacaaagagagaggtgaagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagacatg

SEQ ID NO: 22995 - DNA, 3003 bp, Unknown
  misc_feature (1)..( 3003): 2750-1469P.txt file - cDNA_ID_2127506; gDNA_ID_1620744; Annot_ID_166571
ggagcataactatctatgtgttgaggaaacgtgaaaggactcaggagcttaccgaaatcggaacggggacgtttcataggaccaccaggaggatgatgttgctgtcgctgctggttccagtacccatccgccatggaaatcgaaggatcagaagctactagaagggaaaaattaagggaccaaaaaaaaaaccctaatttcgatgaataggttcgattgtagctggatttgatagatggaaaccctagctttgctcgttcttctgctccgaagcactctcgaaatcaaaagttttctcaaatctattgattccaatttcttgcttctcgatttcgaagtttctgattattttgtcttaaagatccgaaatctcgatgacccggcccgttttatggcaacagatctcaatttccgcgttggattaacgggctgctaaatcactattttaaggcccatttaactaaagttggatttacgtggatctaaaaaagtctaaagataagtgaatgtgtgaatcacggattatatgtgagtaacgagaaaatcataatgaatgaaaaactttgaataagtgaattaatagctgacaaaaataaaaacaaggtaaatatataaacgacaaaacaaaagcagaattatgtttttataactggttaagtggttagtataaatgtaggaaatgaggagatggacccaaacacaagaacaataaacaacaaaagtaagtaggtttccatgtttccttggagcttttctttttgttaaccaaaacttcatttgttctcaactcttaactcttaatcctttgccttaatcatcattcattttgtttctctaaagtctaatcatacaatctatcaccatcgcatcctcttagtatttccttaaattttatcaaatatttccgcttcagaactttcctattaaatcttatactgtcttgataataaaactttatagatactttcataaatatacatgtaatatggttttaacacacatatatatacataactatttatatgatctgtattagtttcttgaaacgatattgtcaagtgttattcatgagattttacgtttcagtaaaaatattgttcgtcttattcattaacatgttattcttaagtttacttacatagagataatataatactcatgtacatttgatttagacttagaactcaacatttcgaatatagtataatatcatctatgattctatatatgtatggaaaattgaactacaactttagtgtcttgatagttgggcatgcatcatccaatccaaggtttcgatttgcttttacaatgtcgagaagagctagatcctatgtaattatgtattggctaccaaacaaatcacattcatattcgctaaataaccagttaaccactaactattttgttttgtcggtgaatgtcaaggattacgcaaataaagaatcatataagaagaataagattaagggagacgcactattatagttttcaccaaaagtggatacattctcctcgactaactccccgaaaatgtggagagaagcacccagaccaaatgggcccacttacctctccttagggatacttttgtctttttcatagcaaacggcaaccaacattcaacgtagctgcgccaaaagaataaaccttccctactagtaaattaccattgcgtgacctcgtgttagcccggacaacctgaaccggccagctcagattctaatttatatgttagggagatttggaaattgattacaagtgaaattgtaatggcaaggaatctatacaatgatattaaaagtaatcaaaccaagaaagttataaagtcaatattattcatatctaaacaaatacctaatatcaaaaaacaaatgctgcacatagctaattgaataagaaatcaatattgatcataattaaacaattaccaatttggtcaacaaacaaatgatgcacttagttatctaatttttttatttgtgtttaatcataagtttttagataaagtggttcaaaccatatactgatatacgcacgtaaagatttgtatgttgattagccaataagcttacttttatataaagtataaattaaccaaacaaacaacttcttcacaatagagaattggaaatctaactatgcaatattgatcacaatgaaagtacgtacgacgaactaaaattagttctaaaacatagaatatgatgtaatccactcccataccatatagtagttttttaaaaagaatacaacaaaaacaatttaagttcgaatgtacaaacaactgcatggggaacgcctcttcactttttttttttatttttcttttttcctaagcatcaatagagttatagggatgcctcaatttttttattttaaagtataaattgttgttaaaaacaaggaaatagaataaagtataaagtatatatttattaataactccaagaaattaaagtgtttcctttatatttatatagatgtaattaatttgtggtaaaacaattttaccgtcgagtgtctgtgactccgtcttcttcttcttcttctccctctcacatcgtcgtcactttctttttggctattcttctctctgtcatcgctgtctctgacttcattgtcttcctccttcttcctttttgcttttccgtcgtttttctccgccggatttttctctctccaccaccactacctacctcctcctttgtctcgctggaaattgtttccgagctcaaaattaagttcctgaagatcgggttctagtccttttccatctcggagaagcgtctttagatctgggcaagcactgccatcttcaaattttttaccttttttctccttctctatctctcttcaccaactggggtttggttacgggttaaattgatggtttccgaggcggctagaacctcgtgggctcttgtttgtagatgatgaacggtccttcgtgtaaggatcgaagagggtggttctcttctgctctgtttttcacatggaatg

SEQ ID NO: 22996 - DNA, 3000 bp, Unknown; identical to SEQ ID NO: 4903
  misc_feature (1)..( 3000): 2750-1469P.txt file - cDNA_ID_2127517; gDNA_ID_1620744; Annot_ID_166574

SEQ ID NO: 22997 - DNA, 3000 bp, Unknown; identical to SEQ ID NO: 4899
  misc_feature (1)..( 3000): 2750-1469P.txt file - cDNA_ID_2127541; gDNA_ID_1620744; Annot_ID_166585

SEQ ID NO: 22998 - DNA, 3000 bp, Unknown; identical to SEQ ID NO: 4894
  misc_feature (1)..( 3000): 2750-1469P.txt file - cDNA_ID_2127560; gDNA_ID_1620744; Annot_ID_166590

SEQ ID NO: 22999 - DNA, 3003 bp, Unknown; identical to SEQ ID NO: 17710
  misc_feature (1)..( 3003): 2750-1469P.txt file - cDNA_ID_2127789; gDNA_ID_1621202; Annot_ID_174964

SEQ ID NO: 23000 - DNA, 3003 bp, Unknown
  misc_feature (1)..( 3003): 2750-1469P.txt file - cDNA_ID_2127795; gDNA_ID_1621202; Annot_ID_174966
agatttctctcttgtaaaggaatcgtttgagccgaagaacgagtctcggaaattgaacaacaaacggaaacgggagagtttgcctgaagaagctaagaatgttccggaaatagacatggttaagctcagcaagaaattgaaagagaactttactattcttcgggatataaaagaggacgagagagtgagaatggagttgttgcagtctgaagagaaaaaaccattgaagaaacagaacaacgtggtgaagaagaaacttaagaaccctaaatccaaaaagcaaatttgaaaggctttttgttttcccgctttaacggttatatactttgcttaaattaaacgcttcaatgaaatttttcgagtacaattttgttaaagagtgaaatcaacaagaagagtatttttcattttattcacatccaccctggtaatcctaaaaacttgtgtttataagttatgatgttctcgtatattttcaggattatttattcgaactgattcttataaagtggtaccaacatcgtataaaaatccatcgtttatacaaaacaacgtagtcttacatgtgccatagagttgaaagatacgcaaatcatcctctaatccactaacagttcgccacaaaccgtttactttgttataaaaatagagatggagatctcagctaatgtatgttgtacgctgtgaacagcaaattgttccccacaaaaaaaaaaagtccagccgtacaacggtacaagaagatacggccatgttgagaccttttgttctagaccccattttaatacacctataactataagtctctcgtcgttactacaagatatttgctactttatactatatttttttcgaattatcataggtcttcaattaataagtacaaaaattcaataaaaaatatgtgtaatcattatagtggatttacatcttttcatagtgtattatccacgcaagactcacatcgcatcatatatctgaacttttcaatcaattaaatgttaggtgttgggacgatatcatggatatataattcatattgacttcaaatttaaaataattattattattatatagttgatgatgatccgtagtacggtacgtgaaataacttgtattttgtcacttcaattttatttcacagtacaaattaaattgataattttgagataaaatcgaaaaaacaattttcatatccaaatcatcaagacgaatttctccgatcactcaaataaaaaaggagaagatcgaagaacaaaaaaaaaacagaatcatcatcatctactctgtagatacatcttcaccagataacgatgcaatgagctccgatgtatcatcagcgatgccagatcggagagactctacaacctgctcgaacacgaatacgttacaaggaatatgaagaactcctttctgagtgtatccgtattcttgagctgatcgattcagcaatccaacgaaaacaggatgattcagcagctctgcactcaccacgaacctctccttatcttcgcctacgttgacgggaacgtgaccggaaggaacactcgacgcgacggttgctcgcttgaccaagaaaactgaagaggagtacgttgacgtcgggtgatggatatcgccgctgcgatttcggttgcaggaggatgagtctgcgattcgtgacagacgtcgaatcagaggcttcatctttgatcctagacagccaaaaatgctagagacagagagacataaatatgggagagaggtgtggactcacattaagcttatcagaaatgtgtatattaagtattattatattttgagatgacacaaaaatggtatttaatttatttcatacatatatgtgttaacataatgagtcatggtcaatttaacaattgaaagaactacctaattttgattatgcaatatgagaaattctctaaatttggtttattttcaaaactttcctcacttacattagtcaaattacaaataagaatagtaagggtaattgttaacaaatgtggattgctaaaatcaaattttgattattgtacaaattaattttagacttttttatgtatgatgaaatgtacagaataaaccaagagactatgtagataaaaatccgttgtatttattaatctatttcttaccatgaatacgtaattttcccgtttgatggtaaattaacatataaatacacagagacgagtggataagaaaaagacgtagtatttattaatttactttttatttgctttccatgtatatatattttcatatatatataaaagaaaaagagtataatttagcaaaataacaaaaatataaatattgatagatggtttttgtatcataatttatttaattgtatttctggaattaatattcttctttgactagatttcataagaaagtaaacgaacacaaaattaatgttcatctttgactttttttggagggaaaagagtgtttaaacgtgggagaacaagaaacaaagcttgtagccaaattaaatagaagacaaataatcattagtgagaaaaattcttagattcctaatcttctttgtgtcttttccatcaaaccctaaaaagattcacgtaagagatgtcgagatttttggaatagtcaaagaaggtcgatcggattttgagctccctattgagattctatcgataattccgacggattctttcgagcaactggatctcgcgaagaggcgattatctgtaaagtgtcgaatttggaggaagaggtggtcgaattgaggaagaaactccatgagatggaaatgagtattcacgagcttgaaagggatgtctaggcgtggttagttttcgacgttttcaaaattaacacttaaacttatttttaaaaagtaaactgtaaaattaacatggttttagttaaaatttatcagttattttaaaattgttctaattttttttagtgaaaattattattattttttaaaaatgagtttaagtgttaaatctatattacgtgaaaaccatg

SEQ ID NO: 23001 - DNA, 3000 bp, Unknown; identical to SEQ ID NO: 8250
  misc_feature (1)..( 3000): 2750-1469P.txt file - cDNA_ID_2127813; gDNA_ID_1621202; Annot_ID_57714

SEQ ID NO: 23002 - DNA, 3000 bp, Unknown; identical to SEQ ID NO: 8250
  misc_feature (1)..( 3000): 2750-1469P.txt file - cDNA_ID_2127813; gDNA_ID_1621202; Annot_ID_174980

SEQ ID NO: 23003 - DNA, 3003 bp, Unknown
  misc_feature (1)..( 3003): 2750-1469P.txt file - cDNA_ID_2128001; gDNA_ID_1620334; Annot_ID_153733
gactcccaagaagaagactcgataatccccaagttacacgttctctcgacttattgacaaatctatccctgcgcttatttaccattcacatatactgccacttcttattctgacgtggcgtaatagtattggataaaacggtattatctacccctaagtcgattatagtatatatataaagcaacaaagcagttgcaaatttcaagatagtcgtcactttagtcgcagcaccaccaccaatttcgaatttagcatttctgaattccgactctgagaatcggcggttaccgggaaatatgtcggagactgatagagagcgtccgttattagcatcggaggagagagcttatgaagaaaccgagaaagttctcatagtcggaatcgacgaagaagaagacgctgattacgacgatgaccccggaaactctcctaaattctcatggaagaagctttggctattcactggacctggttttctgatgagtatcgctttcctcgatccaggtaatctcgagagcgatcttcaagctggagccatcgctggttactctttgatttggctattgatgtgggctacggcgattgggcttctgattcaacttctatctgcccgtctcggtgtggcgacgggtagacatctggcggagttgtgtcgagaagagtatccgacttgggcaaggatggtgctttggattatggcggagattgctttgatcggagctgatattcaggaagttattggtagtgctatagctatcaagatcttgtctaatggattggttcctctttgggctggtgttgttatcactgctcttgattggtaagtgtttttttttttctcaatttggttattgatttaggaaaaaccctaatttttggaatttagggttctttattattgtttgtttggtatctttagttttgatcctaacattgtgtgtgatgggttaattgcagtttcatctttctatttttggagaattatggaataaggaaactagaagctgtgtttgctattttgattgcaacaatggctcttgcatttgcttggatgtttggtcagacgaaacccagtggaactgagctccttgttggtgagactctaaatattcctttcttttgtctagtgtgtggagatgggagtacaaaaatggtaactgttcatgttttttaacaggagcattggtccctaagcttagctccaggactatcaaacaagctgttggtattgtgggatgtattatcatgcctcacaatgtgttcttgcattcagcacttgtgcaatccagagaagtcgatccgaaaaagagattccgggtcaaagaagctctcaagtactactccattgaatccactggtgctcttgcggtttctttcattatcaacgtctttgtgaccacggtgtttgccaagtcgttttacgggacagagatagcggacaccatcggtcttgcaaatgctggacagtacttacaggacaaatacgggggtgggtttttcccgatactgtatatatgggcgattggagtcttagctgctggtcagagtagtaccatcacaggtacgtacgccggacagtttataatgggagggttcttgaatctcaagatgaagaaatgggttagagccttgatcacaagaagctgtgcaatcataccaacaatgatcgtggcgcttgtctttgattcatcggattctatgcttgatgagctcaacgaatggctaaacgttcttcaatcggttcagatccctttcgctgtgatcccactcctttgcttggtctccaatgagcaaatcatgggcagtttcaaaattcaacctttagtccaaacaatctcatggatagtagctgctcttgtgatagccattaatgggtatctaatggtggatttcttctcaggagctgcaacgaatttgattttgcttgtgccagtgatcatattcgcaattgcttatgttgtgtttgtactttaccttatctcacgaggactcacgtacactccttggcaactagtggcttcttcacataaagaaccacagagggatgatgagtgagtaaaggaaaagcaaagagaccttttcattgaagaataagaataagagagattgctctttttagtgaaacaaacaatagaaagttgagtttcagtatggtaacaaaacaatgtcctgatgtatttgtattatagtgttttatggtttttagagtatagctttggaagaatccgaatcgtatcgtttgtgtaaaacttccggcgtttcttagaattttggcagaaataaaacgtaaacatgaagttccttcttcagatgtgcgttatttcattttcttttagatagattttttttttttgggtttaagtatataagttaaaaaaaaaatcttaatatttatacatttagatatcttgatgtttttcaaagtaataacgtgaactctggttttgaatttcttagagaaaaaaaaaatggtcaaaaatggggaagaaatggtcaaagattaatggaaacgcgctcgcatttaatttgatgtttaaaggtcacaaacaatgtttagtcgtttaggggaaattcatgcacaatttctttgatgccacgataagctttgattgcaaatttaagttaaaaaaaattctggaagctagttttatcatttgataatgaaaatttcctggcaaacgagagtcgagtcgagtcgaggtatttaaatacatcacgtaagtttcgttaactgccccaaattaaattaaaaacacaggagcagcttctcctaatccaaaatccaaaaaaacaaacatcaaaaagtcaaaaattaaaatatttaaatacataacctacctaacaaggtttgacgcaaaacccgccacgagtctaacgcatttattaagagaaagtatgcaccaaaaatatcgttattaattgactaagtagaccgataaaactttatttaagagattaatggagctcataataaatagcaacaaaaatctttgacgatgaatg

SEQ ID NO: 23004 - DNA, 3000 bp, Unknown; identical to SEQ ID NO: 896
  misc_feature (1)..( 3000): 2750-1469P.txt file - cDNA_ID_2128005; gDNA_ID_1620334; Annot_ID_153734

SEQ ID NO: 23005 - DNA, 3000 bp, Unknown; identical to SEQ ID NO: 893
  misc_feature (1)..( 3000): 2750-1469P.txt file - cDNA_ID_2128013; gDNA_ID_1620334; Annot_ID_153738

SEQ ID NO: 23006 - DNA, 3003 bp, Unknown
  misc_feature (1)..( 3003): 2750-1469P.txt file - cDNA_ID_2128017; gDNA_ID_1620334; Annot_ID_153739
ttatggcaacgaaaatataaaacaaagatttcattaacgaaaatacaaaccaaagtttttatttaattaaggttttaattaacgtattattaaacatggaaatttattttccaaaattactggtactttaatgtaaaagattctaattttattttaataatgaaaaaatattttcttataaaatcatttaaatattcaaaaaatagttaaataatattagtacgttttttgtttattttggtaaaaacaattgcgatagtagtaatacgaatgagcagaaaaacattaaaaataattaaataaaactagtacgtttttttgttttattgtaattctgtttttttttttttggtttgatacaacatacatgaaaaatatatttaaaatataagacgtttcagacattcgaattcaggacaaattgtttaataagttggacagaagaaacatcaccttgatttaaaaaaaatactttgaagaaaagatgaacattaccatcatcatcatcagtaagtttatagacagagagatctctgtgtttcattgacttctcattctgctggtttctgctgccctaacttgggcgaagtaagcgtgcgcctgtcaacaaatcaacaaaccatattaatttacctaatatgtgatttatatacaaatacaaaggcttctaatttgttttctgaagcatgcgtaccatggcttcttttgcagttaatctgtcttgatgatcataccgaagtagcttgtcgaggaaatcaatcgcctacaccgttttaaacaaaacccttaagaacccaactaaaccattttctatacaaggagttaaggactcaaggaaaggagtaaacctcgggtgaaactaagtgctgattgtctgcgttgatgaatttggaccaaggtttcctgctatgcctgtaggttgtgttccattgaaccagagaatgatacaacactaattctcagcttcagctcattacatggcaatgccaagctcggagattacaatataatgtttaagtttcacataccgcccaacaagtgcttccagttgtggatcaagttctaactggtacttgttcagataagcattcaattcgtcagtcccaagcacctggtgaataagaaggagagttcatgacgacaatggaacggagatctcccatattctaatactgaattacaagtaatataccttggcgattttcactagctgatcctggttgtcatggccgtagaagaaaggttccttacggaatatctaatatgggtaatgaggaaaaattaggtcaaaattagatcaccacaagttcatttctcagaaaagaaaggaaagccgttcaaatgttatatcatgaacttaccatccctgcaaacatacagccaagactccacatatccaatgaatagtcatagtcttgcaagtccacaagaagttcaggtcccttgaaatatctgatacacattaggagagataaacattagagtgaagctaggcaacagcgaaaaaaataaaataaagggtatgaagtaaaaccataccttgaggcaacacggacattatactcttttccagggtggtaaaactcagcaagaccccaatctataagacgaagcttacgcagctcatggtcaatcataacattatgaggcttgacgtctctgtgcattattccttgtgaatggcagaagtctagtgcctgcaacaagtagtcttaccaaatgtgagtatgaagtcaaatggaatacttatataatccaaccaataccagaatttataccttcaacagctcatagatgtagtaacgaatgtcgtaatcagtcaacgtaggatacaaaactttaaagtctgtgctgttaacatattcaaatatcaagcttggagttttcgaatgttgatctctaacaacatcaagcagcttgacaatatttggcccaccgcataggttctgaagtattttaatctctcttcttatctacgaaaaaaagatcatagagagattcaagaaacaaccccaatcatccaaaacaatgtaaaacaattcaccttctttttcttaacaggtttgaggattttgataatgcacttctccttgctgttcacatttataccctcgaaaacttcactatattttccacgccctaccttccttactacctcataatcatcttgctccctgagagagcaaataacaagatcaaaatgttaaactaaaaaatcattgctttacaatagaagaactaaaaggcaaaataagcacaactaaaaaatcaaattcatcaatagagataaaagtaaagttttttacattagcagcatcaatttgattagattagcttcatcaagaagcaaatccagagcaagctgaattcaaattcaatacaaacactacaaaaatcgattaaattactttagcaactaccaattcagctaattctagggtttaacaatcttacccccattgaacaatgagtgactcgtaatcccaataatccttgggtcgaatcacattgacttcggtgtacacacgagctttcgacatcgcccgcgtctggttagaatcagagatctctacgagaaaatctggatcgatcgtagtacaaccggaaacttccgagacagctctcgctgtgggagtgacgatagatgagcgtaggataggagagtgcgccgttggcgcacgtaaggctaagacggcgcacagtaacaagagacgtcgaagaggagaatcgaagaagaggaagaacaagaagaaaagcgtatctatcattcactacgctcttccgcaccagattaactttttgttttccttttttcgtttgcgttatttttgcgccaactaaatttgccataaaggcctgacatagtataatgggctttatttatggcccaatatatttggacccaaatagtccacccgcttatatacatgttagggttcttatttttgggaagcttttgaaatttcggatttgcattaagcgaggattcgatcagtgataatg

SEQ ID NO: 23007 - DNA, 3000 bp, Unknown; identical to SEQ ID NO: 888
  misc_feature (1)..( 3000): 2750-1469P.txt file - cDNA_ID_2128059; gDNA_ID_1620333; Annot_ID_153697

SEQ ID NO: 23008 - DNA, 3000 bp, Unknown; identical to SEQ ID NO: 884
  misc_feature (1)..( 3000): 2750-1469P.txt file - cDNA_ID_2128077; gDNA_ID_1620333; Annot_ID_153702

SEQ ID NO: 23009 - DNA, 3003 bp, Unknown
  misc_feature (1)..( 3003): 2750-1469P.txt file - cDNA_ID_2128097; gDNA_ID_1620333; Annot_ID_153710
ctgctcttccttgcgtgagatctacactttctcagactcgatccctaccatggctgcctctacatcgcaactggaagatactacccgtgagattatagaaggtacttccatactcaacatcgacgatacttccatactcaacatcgacgatgtgatgacatcgcaactggaagatacgatcgagaagttaaagaaaggtacgcgaatatttgtttattctgttattcctagtttctaaaaatattaaaactctgattctgttcaattttccgttttagtggtgaggagtttggaagagataaatagaaattcaaccatggcctcactcacatataagctttaccgttttatactggagaaagaagatgaggctgccgccgaactcaacgctgtggacacagactctatcgagacaaaggttgtgaaaagtctaaaatttattgtcgacatattattgattgagacaacagtttaactttaaactgtctggtgcagctggtgaaactagaaaacaaacagagatatatccgtgaagttgaagacaacccgatcgacatccgtagtttgtacaggcctaaacttgttaagcttttaaaggagagagggtttacaccattcccatctgaagataagcctttctcacactatgactacctagatgttgctttacatatggaattacctattcaaaaatacgaggagctatgcgatcaaaaaaatgtgttgcaagacatagtttctattttgaagaggattattgatgcctatcaacattaactaatctgcggatttggttcaagattggtcaactagttttttttttcttttatgaaagctgcagtctctcaattgctatggaaagatcaaaatagtagttacaattctgcattgtaacacgaatgttttcttcttttagctttcagtttttgtgtgttgcaaactcttttgttaaatttttatggtttcttaactcgtttgtcatcattttcttcagccttgagccgtagaaactaaaatatacatagagtttatgtataaatcaaggcttccgcctatcgtcaatgagctcatgcttaatgggctaatgccgtattttccctttcattaggtccagtggcccattgaccggtttgattgtccgtccatatgtttacagagaaactatatacttttatgaatttatctaatatataagatctacttgtaaaatacacctataatgattagttgccagagaactcctggatctgtacaagcagattcacattcttcgtatagacacaatggttataggacttctttaacatggagaaacaataacctgctggaagtacacttagattctcctaggtcttgccattttcatatttacacgcatttagtttctttctaggtgtaatcatacagatagtgtttagttaaaatcgtgaagtcagcccttaccatattatatatatatatatatatatatatatattgtctatcaaaatgtttgagtataactttctttataattttcacaaaaatcattcttcaattaccacttttagttttttaaaaatttgaatcttgaattgaaaactttcgaaatacacagatgtcctctagtagaaaggaatgcgttaaaaactatgaaacaaataaaaaatcattatgagaaaacagtgattcaatgagttgtggtctcttctccatttggacagcgatagtgagacgacgaatacgatgaaaaataattttcttttttccgttgtgttagtttaggagagggagagggagaagagaggacaaatggaagcagcttgcgtaccaaaagtgcgacacgtatgtaaagagtcggaaggagacgtacggtgtaagtcatctcgtcttcacaaatatgttttggttttatcttatgctttgtcttatcctacgtggccattaaatcgttccattcgtctaaaccataatatcaaatcaaacaatcgtataatatcttatcaaccgtaaagatggtgtggtccgtttctctttaaaggtttttggtttggatgattctaaaacgtcacatgaattcttttttagattaccaaaaagttatgggctgaagtccataatgttttcggattagggattagaacattcaaacatgggatatatattgtgtcctttgtgtgttgtatcaaatttgctattgtttgctgcatatatttatctgaaattcgtaagtaaacctcacataaatttcaaactcatgcgtgtgtgcttctcatttctcatttggtttaaaaacaaattcaccctcattaccaaaattgttttgactttattaatatcattaacaaaccatcatcagtcaaatatgattatttagacatatacattgcctcggattttgaactatggccacgcattttttcatggctatgcaaatttcttttgatagctaattattaattattagttattataatatataattgttttttaatttagttttaaacgatgatatcggtaatgaaacaaatatttatgggctaaaatcgtaatttcaaccatttcctagtttggtatatttgtttgggtagaatatataaaatcttaacccatctcctagttgggttaaaatgtataaaattataagaaatttagtgcaattcgtacttaaaccaaaattttttgggttaaatccaaatttcactcctaataaaacaaatccatatataaacaaggttattttctggtcaataataatgttatttttttgggtcaaaataaaataatgttatatgaaggagaaaaaacgagtggctggaaagtaaacaatattttcttagttttcttctccaatctggcaaataaatctcactctctcaatcaaaaacacacatcaaaatcaaaaccttctcttcttcttcttcttgcgagttgcaccgaaacactcaacaaaaccaaatcatccaaattgggtaaaacaaaagaaactaacaagaagaagatcgaattcaagaagaagagatg

SEQ ID NO: 23010 - DNA, 592 bp, Unknown; identical to SEQ ID NO: 898
  misc_feature (1)..( 592): 2750-1469P.txt file - cDNA_ID_2128149; gDNA_ID_1620335; Annot_ID_153757

SEQ ID NO: 23011 - DNA, 3003 bp, Unknown
  misc_feature (1)..( 3003): 2750-1469P.txt file - cDNA_ID_2128157; gDNA_ID_1620335; Annot_ID_153759
ctgggaaaagtataatacgtctacgggcactgcttacattgataactacatcactttggaggcaatggatccgtcctgcaactctgtcttctcttttcagactgtgttcagtgctgctggatgttataaccaagatacttatcatgtacaagactggagggtcttggcctgcagaccaacatgtacgtatgcttttcttctttaccactgtcttttctttcgagatcaatcaccagagaggactaactgtttatagagatcaggtggcaagtctgtgaatgaatattttgaccggcatgaggcaatggatcccttctacacaggtaaaatgcccaaatggttgtctgatgacgccttggcctttgacaacaaaaagtattacgtggtaagatgtccagaactggagtttaatcttcttttttagtttgagaagcagttagaggtgaatgcatttttgtcacaggtgcaagaatcagacttgcatgagaatgactggctgcttgtattcatggaaatggtattcttacaagaaaaatcctgtaagtccttgaatttcttcttcttctttttcttcatgtttcttttctcttacgcttgcttgccagtgtgactttaggaattgaaggtttccccacccttggagatcaacaaggtagttgtagaaactaaagaagattacataactgaggcgcgtgagaagctccacgcagagaatgcaatcttctacataagttacaagtatacaggtgtttcttcaagtgatcacaaagctatcataaggaaaaccatggatggggtaccagaacacatgagtcttgaaattgctttggtaaagtaagtcgagaacaagaagaagaagaagaagaagaaggagaatagacagacacctcttgtatgcatctggtctgttgcaatcaattattaagcgctattcaacttttatcttgttatatgactatgcacgatgtgtaaagataatgctgggatctatatgactatagcgagttgggatctatatgtattttaaccttcgctaactgctggatatctgtttgcaatgcataatagtactttgtatgataagttgataaccaataacacaagctgtaccaaaccgtggaggttattgatatgatcagtatgtggaaaggcaaggcatagttaaatggtaaagagattggcccaggagttctccaaatgacgaatatgttaaaaaatccgattagaggcaagcaaattcgtgccactggtcactggatgtggagagccatctctgagatggtaaactagaaagccattagagttctcagatttttcattgtttttttggctaaggtatcgtcaagttccaggtacgatcatgaagatttgggattcatatgctaccaagggaaaccaagcaagatatatatatatatatatcgtttgcctagttaacacaccttacattttttaattaggaacaccacaagatattcatttgttaacataccttacatcatcaagctatgtaactacgacatcagaactcattctatctcctcaatcaccacgccaccaccttttcgaaattgatctttcttcttcatttctggaaaccctctgtaatcgttgagctcaaccaccgagttcttctctgcccttacagatggttccagagcttcccatacttcagaattctgctcattgacccaacacatcatgtagaacactttcctctctgcaagctttagtttcttcttcagatcacgccctgatgatgattttacttcctttattgcaccaagaatcaacctttggagatcaccgagcagacataccatagctccagagccaagagaaagaaaacaaatcacatcatccaccagattcaatccgaacttcagaccaccaccaaggtttttataagctgaagagcatgtctgttccaagcaaaaggacaacacttcctttatggtctctggttgtccattgtgacccaaaactgatgaaacagtcaacaccattgttgctgcaccaagcgaatcagattgccactctccattatagatacggagcgtaaagcaataactatatgcaatgtcaatcaaatggattggtaagagaggagatggattcgtggaggtaagcttgcttagtgagatcaaaggtgtatcaggccctcgtgggatttcactcacaactgtggtctcttcttcgtcttcaacgcattgaacaagttgtgtacctccgagtccaagattgatcgttcgagctgaagcaagtaaccaccaaggatcccatggttggatcattttgcttaattctccagaagctaaggctctttggaatccttttctctcttctaagctcaaatcatcaagactcacttcatctccgttcattatcttctgaataatctcctccggtaagctcaaaccttcatcatccgtgatgctatcaattcccccatcatcttcctcttcttcttcgtgaaaccttttcaaaatttcgagcatcttccttttcgtttgatcatcagatcgaacttgcttcaattcatcgtttacattatctctcatgaatgattcagtacattggacactgtgagatttgtaacaaggaagggaacagtaccggaagttgcagcgaggacaagtgtactgcgagaactgcttattacatacatggcagataatccgcgtagaagaagggtttaacggagacgaatttgaactctccgacgaaataatcgtcttctccggcatcatcttcagaaagctattccaaattagggttttgacttttgattgaagaagacaggtctagaaacttacatacaccaattttaaaatcgagtttgggccgaattatggaccgtactttgggctatgggccttcattttaataaacaggtcggatatatccaccggacccggaatgatcgtcttcctcagtgttgtattttggctttcctcattgcttcctcaatctaaggatttccatgaacaaggaactaaaatg

SEQ ID NO: 23012 - DNA, 3000 bp, Unknown; identical to SEQ ID NO: 901
  misc_feature (1)..( 3000): 2750-1469P.txt file - cDNA_ID_2128163; gDNA_ID_1620335; Annot_ID_153763

SEQ ID NO: 23013 - DNA, 2374 bp, Unknown; identical to SEQ ID NO: 900
  misc_feature (1)..( 2374): 2750-1469P.txt file - cDNA_ID_2128177; gDNA_ID_1620335; Annot_ID_153767

SEQ ID NO: 23014 - DNA, 3000 bp, Unknown; identical to SEQ ID NO: 912
  misc_feature (1)..( 3000): 2750-1469P.txt file - cDNA_ID_2128239; gDNA_ID_1620337; Annot_ID_153819

SEQ ID NO: 23015 - DNA, 3003 bp, Unknown
  misc_feature (1)..( 3003): 2750-1469P.txt file - cDNA_ID_2128243; gDNA_ID_1620337; Annot_ID_153820
tattctggttactgattaggtcacctgtattagaaaccaacccgaaataggattttaattaaaatttatcgttgaaaggctgttttttttccagtttatacgatcctatgttaccaaggctactatatctttataaaaaaaatactataaccagaaagttgtttctatatttaattgttagaaatttaatcaaattgggtttcttggaaagcaattaaaaaaaaaaataggttaaaaacagggcacatttagctaaaacttactactgtacctctttgtgatccacgggaactgaaggatacaatctaagagcttcagacaaagcagcttgtagataatccatcttcttgatctcttctggtccaaacacaggttcataatcactcttctctgcatttccatggtcatctctctgcctcagaatcttacacatctccaccatgatcttctcttcgacctctgggttcttctctagcaaccagaaaaaccagctcaaagccacagaagaagtatctctcccagcaagtatgaagttcacacagatatcacgaagaaacttgtctgaaaaactctctcccttctcatctctcagacccataaacacagttaagagatccgatctttttgtagtttcgccctcaagagacagttctttcttcctcgtcctgataacttcatcagcgaaatcatccacaccctttattgattccttaagcttcttctctgttcctatatcaagatacctcatgaacttccacacgcaagtaggcatgacgaatctcacaaccgcagcttcagtcgcatcctcaaaggctttcgcaaaaggaatcactggttgatctggaccgagacatcctggatcgactccaaaagcaatcatacatacgttatcaaacgttagcctcaacaagacgtcttgtagatcgataggagatgagctcttaaccgatgtctcaagaacaggtaagagcctcttgtgcacgagctcaaacaaagattgagtggttaattgtctgaatttggctgaatgaaactcaatgctcgctgttttcctctgcctctgccaagtttcatcatccgcgttgaatattccatctcctaggaggtctcggagattgtctcgaaagtaagaacctttagggaagacagaaaaccggttcttaaggagatgctcaacgtttcttgggtcacaagtgatagtgctgttgaggctgctaaaccagggacctctgaattggaaagttccgttctggagacatagaacatcggatagccactcgtatatgtttcctctgaggccaaaagctagagaaggaagcatcccaagaaacggccacacgggaagaccttggtatttcttctgacgcaaggcatgtattgcgacaaagacgaaaattgcaataaggagctcaagaatctgaacatctctcaagagaaacagcctccgtgaaaccagagggtcactggaggaagaagaagagaagaaaacgtcattgaaagtgagattgtaagaagaattgaaattcattgtgacaaagagaagagagagcgatgaatctcagaaatgaagaattgagagagattaataagaatggaagtcgttagttagctagtgggtgaagaatgttgcatgagtttcttgttggggacaaaaactttggctatcaggagaaattggtttgatttggtgagcagacaaaaactgtgaactttatattcaagtggctcttggttctcgtgtatatatattattatgttacttttctttcactataagtagggttcttttgggggttttgcttctggttttgggaatttcaaaggtcgaatcttttttggggttagattgtgtttttgaccaaaattgtgaaatagtttaggaaaggaaatgagaggttgttggcgatgggtaacctaagttaataatacaatttctctccattctatatttagtttttttgcttccgtccacatttgctttatatttttatgagggaatttatgaatcgtatattcccaataaaccaaataaattgtaggtatctaatacctatagtatataaaatgataattcgttgttgggtgtctgtcatcttatcgattttgaaattttcataatgggataataagggtagatggctaaattttgacgtaggtaatatgaattggaagatttatttgcaagataatcaaaaggtataattgatgaatatatctgtgaatttttttaagcatttgtaatttgcaatatactaatttgtggcaagaccgttggctttttcgcttcttttttcgtgaaatgagctcatgttgttgattactttttcatttgtgcagtaattgtttgtttagtaaaatttggtattttgtgttattcgttgtatctctatgttcggtaagaaaaaactaaaaaatgtcataaaatttaaaatattatgaggattgtcctaagtttggaatggtaagctcttttttagagattttgaaaactggcctaggtttggattgctagtggcaacaactataagtatttgagatcttttaagttgaggaaaccacacaaatatttgagctttgtggtttggaatctaagtttcttttaaggtctctacttgtagagttttcgattgagttttctttccgttttctgtttgtgttgtaatttttggtggtttatgtagtttttggtctttcatattttttgtactatctttctgtcaaaatttgcaaaaattgtataaatacttagtattgatacaaaaaaaacttagaatatatattagaatagaaaattggtacataaataatagcatgaataacataatttacgtacaaaggacgtggcattggccgctcaacagttctaaagttaactaactataattcacattcatatacgtaagaaagttagcaaaacgcctaaacggaagagaaaagacaaaatatatagaggccctagaagctctattttaggcccattaataagaaatgggcccaaccatg

SEQ ID NO: 23016 - DNA, 3003 bp, Unknown
  misc_feature (1)..( 3003): 2750-1469P.txt file - cDNA_ID_2128276; gDNA_ID_1620337; Annot_ID_153830
gaacacagctcaacaaaaaagtactttaaaaagactctctttctccctctatctctctatatatatttctcactagctctttcacacacacacacactttttctctctctatctcctctctaattcacacatcaagattcaagaatcaacaacatccttgaaatgaatattgtaattaactaattctagggttttcagattcttgttttttttggttagttaattagggtttcttttaagttgatctagctttcatatacacttgaatcaggaggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggttaacttcttcttctttcttgaattagggtttcagagatctatacatacatgtgtatgtatccatctaattaatgaggaaatgagctagatatatgactcgtgcttgagaacagacagttttcatcattagtttctgaagtagcaggtgtcatgagtcgttttttggattttcatttggcccagaagttaagaatctttgatccaatatttttgttcttgcagtatttaatttgtattttcatgtatcttatcatatttaatacgtatgggtcaaattctatatttaatttgtatttgacatttcttgatccagctttttcgtaataagaccctaattttttttacttatttttgtcacaaaaaagaccctaatttatgtagtatattaatgtgtcatatttacaacataaacatacataccgatatatatgtataagtctcatgttaatgattcaatttagtacaattataagttttagttctaagtcatgaaccagataaataagaaaattattcacatatagccataataggagaagaagggtgtgctaatagtttaagcgttgattacacaaaaaatgggtaaaacaccttttaaatttgttttctcctaaccaatgtttaggccaaaatatggattctacccttcagaacattattagttattttgatttttgtgttcctccagtgattattgaagtcttgacgtgtagcattaaagatactaaactgatcacattttcatattgaataggatgcctcaactcattgaccgatacttgcataccaacggattgcgacttcctgatcatcatgacgaccaggtatatatatgcacgcatactttttcctttgtgttaccaattgacaacgaaggaaatcacacattttcttaagaaacatatgatatattcatttgtatttttgtgtataggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaaggtaatgcaaatatatgtccatatctatacatattcttttaaaactatattggttacacttttgtttgatctctgctattaatatattgaagaatgagttaatgcagcaacagttggagaatctaagcagaaaggtcactctctaatcactctttttaaactctaatttcatctaataatctgattataccgcgtgtttaattatcattaccgtgttatgcatatgatcagaggaggatgctagaagaagataacaacaacatgtaccgttgggtgagtttggttactagcgaatgtcaatacgttttcacatttacgttggtataacatttttctacatataccgatgtttctcgcagcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactctttctttatggagacagattcatgaacttttattacctatattttgataagccagtgtcttcttttgtgtggctatggaaaccttgtttaaagcacaatgcacttgagttcttggttatataattaatcatcattattacatattttccaactaaagatcatctgtttatgtaatgaaacacccttgttctccaagttatgtttgtgaaaaaaaaaagctgttgctttgatgttttgaagtgaagattggccattacctggagacagagtgcaagagataagcaaaactattcttagactattagccgcaagaaatacaaaaaatccggcaaatgtcttatagactattagccgcaaaaaaataaaaaataaaaaatcccggaaatgtcttatagattacaagccgcaaaactattcttagattattagctgccaaaaaaaaacatgaggatctttgtaatgtctggtggattcagacagagtggatcataatcccgaaaaaagctcttataaaaaactaagccatgattgaaaacattccaataacttttacagaggactgcaagaacgatcaagaagcaagaaagacgtttcagaagaacaaacgtcttcttcttgttcttcttcttcctcctcttcttttttttgttttcattacgacgagaaaatttgagttcgtgatcgcttgaacaaccatcatcatcatctagagccccaaaaaagaagaagctgcgggccggttattttggttaattagtctaaatccatg

SEQ ID NO: 23017 - DNA, 3003 bp, Unknown
  misc_feature (1)..( 3003): 2750-1469P.txt file - cDNA_ID_2128357; gDNA_ID_1620336; Annot_ID_153791
acactctttaatataaaaaaatgaaaaagtccaaggagattacataagtttctacagaaaaacctcaagaactacactttttaaaaaatcgctttcaagatcagtggaaaaaaatacaaaatctagatttacaattttgttataaaattaacaattgaagaacaccaagaggaaaatatcatcattaataaaaaaaacagagagatcaaaacgattgagattcctcactcacaatgttagtatttgtagatgatggagttttaacgcatcttgtataactactactaccattactactgctactgctgctactcatcatcataattgtcttccgaatcaaaagctgtataatacaaaactacagaggagaaaaaaacattaagaaacatatgaagaagttgtaaaagcgaaaattcacaactaaaacctggtttggatcagtgatcttgtgtcatcaaccatggtgatcattcttgaaagtttgaaattacagaaaggtacatgtgtaatgttgaatcactttctttgtaatattatatatgtagagagaaatgaataatttagtacgtatagatggagacagttgcagaagaggaagatttggtgatgtttcgtcttcagcttcggtgagttttttttttttccttgatttgttttgtgtattcattagagcaaaaaataaaaataagtgagggatatcaaaaggagcggtgaaacggtcggtcgtcttcatttttatttttaaattgtttctttttgtcttatatctttaaattgctttttttttgtgtggatcaaatgatatttttaagttttaatatatatactatttctatttctgtacacaaaaataaaatattttaaccattgtcgaatatattaaaagtatagaaaatttattatgtcctttatcaatagactaataagatttgtttttctaattagtaaactaaaataataaaattaaaattgagatttggtttaaaaatatttttgtgaaatcaaaaaagtattttttcggttaataaaataataagtgcttgcaataccaataaaatagttatggtttgattggtaggtaatcacagtttttgtcaaggtgattatgagagttttttggctgttaaagagaacggttaaagaaaaaagagacgattataattggtaattagattctaacccacgttattattgctttttagaatatatttattgtaaaaatgatagtatttaattacatttgtcatttgataatcacagttttgttaaagcgagtatgtgatgtttgaaggttaaagagatatgattataattagttatagactataacttatagtcttatagataatgattaaagaatagacgatacggattaatgcgtcaatctcttggtgcagtgaatttgaaactggtttagggtgaactgaaaaaggagagagcaaggtgcttgagccttgaggtgttgagatgaacacaagttacacttgcccaaaaaaaagggaaaacgaaaaagaaaaaagaacgcaagttacgacttgacatagtataagcacatgtgtgacgtggagaacagaagggaagcataaaactaacgaagatcatatctaattattgaacattgaagagatagatctctacaatatcctagaaattctttaataatcagaaaatgatcagaaattttatcatccaattaggtttacgaggataaatgtagtcggtacgtaatccattcatttgatttttttcatagtaaaatatagcactatttcgactagttgaaaaaaaatagttagataattacatttttgtggaaagttgatctctagtctatatctacgtagttataaaataaaagaggagtggttcatatcaaatatgctctaaaaatttcatgagcgacacacatgtgtactattgtgtacgtcacaccagagttggctaaattttttcattgatggtttttgtttgaagatcaacacgttgatagcttaatctgtttctcatcgttaaaacgtaactagtcccgaattctagtttacactatttttggattgttcgcaagcccagctggcaaattatattattacatagtttcagttgatatgtctctttttcaaaattatgttcatataccctaacgatacttaaattatagctttcgcttaatgatgatggatacatcatacctgctaaatttctctacctaatcggccagtttccttttggcctaaagaattaaaagcatcttccactaaatgttatacttttctattataattgtatatataataaggaacggagatattggtaatctaattactatattagtacatcacatgcactacaaaaaagaagtattgtgggaaagagatagatccgtacagaaataatgagggaggtgtgggcatgtgtttcaccatgatgagtgaacgtggtgcggtggagttagaaacctttttgtcttctctgtctcttttcgactgtactgttgtgtcgttcaaacaattatatatatgtcaaatgaatatgttttagagacaatagtaatatttatgttaggaacatggatcggtgtgtgtgttatggatgacaagatcttgaccacgtacgtactgataacaacgaccaaattatttattttcatgaggcaatttgaaattaaacaatctttaacaaatacaaatttcagattacaatcgcaagtgagatattgcatctctggttttcagttttcccttcgccggaaaacaaagttgttcgtcaccagactcttcctctagatcgcgagtgggctacttatgggcctttgatagttgggcttaaacttttcatatgttgaatttttagcccacataggcccaaatatatgtggtattatcataatcctgctttgactctttgaccattgtttctggaactcagtgcccacacaattcaaatacttgagctccgaacggtcgtcagctagggtttttcttcactcagagagaaccaaaaatg

SEQ ID NO: 23018 - DNA, 3003 bp, Unknown
  misc_feature (1)..( 3003): 2750-1469P.txt file - cDNA_ID_2128361; gDNA_ID_1620336; Annot_ID_153792
tgggtttttgttttgttttctacaggttgatgttaaacgagtgcacatacagagaaggtgaaattgcaaaaagatcttatctttttcatcttttgttaaatctttgaaattagactagtttttgtcttggttttggttctgtttaggggagtgggcaagaagagagatttattgaatcgagtttatgtttctgaagaaatcagagatgaggccatttcaagagctaacaaatttcaggatgaattggggagtggttatccaagttttgtgaaatctatgcttcaatcacatgtttctggtggcttctggctggtaagcaactttcgtataccctaaatcgttagcttacattgcttgatttctgttctgtttggtaaagtccattgctagtctttacattgcttggtttaatcaattttcagtctttctaactcagtacctatgagaagtctagctagtagctatttatataacttacattgcttaatatttatgttctgttcgcttaaactccatcaccgttcttagtattgcttcgtgttactctaaaactatcgcttttgaattcgaaattgttgagataaaaatgtctaaccatgtaaactacacataaaagtttatgtgttaagtctagagaagaactattgtaactagcctaggggtgttgcagggaattgtagtttttccagctcaacaacaaatcttacattaaggttctaaggtcttggttttgtgcgtttctctggttaatcaagtctcttgtatggttttagaattgaatcttcttaaacttatctgatgtttttgtacatgtgaaatagcattagcagacagtacttctaacaatgataagctatttatataatttacttaatttctggtctgtttgcttagactctatcaccattctttgcattgcgtattacttggaaaagtatagcttttaatccgatgagtttgtgataataatgtcaagccatgtaaactacaaaatttttaattcaggacctctgaaatgttatgtctagagcagaactattgtaactagccttgggatggtgcagtgaattgtagcttttccagctcaagaacatcagctgaatcttataaggcccattctggattcgtttaaagtcttggtttgagtgtttctctggttaatgaagtctcttctatggtcttattaaactcatctgatgtttttgttcatgtgaatgttatcattatctaaccaagcaaagccattcttttggttgcaatcagggtcttccagtgcaattttgcaaatctcacctcgggttacatgatggtgtcataactttgatagatgaagaaggcgaggagtatgagactatctacttagcgagaaagaatggacttagtggtggatggatgggatttgcggttgctcacaatctagcatatggggatactcttgttttcgagttagttcgtcgtaccgctttcaaggttagtaaacctgttagttacctaccaaaaccgcaaaaaatgatgaaactgatgattgatgttgttattctgtcaggtttacattacaagagttggaagttgtggagaaagctccaaagatatgagctgatcatgtcaggaatttggatatgacctgagttagaagtttatttgcccttttgtcttttgtaagtaagatggtaactctaggctaattgtcctcttcagtcttccactgctaaatctgatattttgttaacaatattttggaagggttgcaaaaatccttgaaattttaggaatgggaaataacagtaaatttagtttgatgtttgatgtttttatttgttgttttaactcttaagagctaagttgttctaatgattaaatctcctactaaaatcgcatcactttctcctaaataatttaaacggatataacctaaagtatcgcttgatccactttagacttatcaacgaaattattaatgaaaaaatcttagtatcgagcttatctattttaaaaccattaactaaattattaatgcaagaaacacttcaagtaaaaatcctcaagtattagtacattcttgatgtgtttgagttgttggtagttgctactgatttcagcccaaagttatctcgctttcgccgtcatagatttcaggtaacatgtgttataaaagacctttaaaaaattctaaatattctttatatcatgcgttagaaaactttagaaatttgcatttgttatattttaaatatagacaaaaatgtagtatttttgaaaaatgttatcataaaaagtgttatttttgatgttcttcctaaatcatttgctcattttctatagtttatgaatgtggtgcaaagaaatacaagcttttaaatgtaaaagtacaaacttttcttcagtcgtttcttgattatatattctctaaacaaaattctcattattaagttaaaacatgttttgctaaaatagaaatcaaagctgatttttaagaatgctcaacaagtagtattttggatcggacaatgatatcatcatattagcatgcacaattcatttgaaaatttcaattttttctaagcgtaaattattgtattcatcttattataatcaatgcaacgcagtaaggcactagcagacgcaaaagagagtgagaagaggcttgaaagttaagtcgcaaaggaaagccttcgtcattgcttaacttgcaatcgaagtcaagaaacaaaaaattactctgaagggcctaacgttcacgtcaatcatccaaacacacacatgaattttttttagagtcttccattgttatcaattagatttttgctatcactactagaatactctcaccaaacactgaaagaaccatctcaaccaaagattaattcaagaaaacaactcaaaccaacaaacaaaaataaaataaaagtattgagtctttagaaataaccctaaagcaaatgttcagagacttttcttgtgtcttctattttctggactcaagagtaaaaataagagagaatg

SEQ ID NO: 23019 - DNA, 3000 bp, Unknown; identical to SEQ ID NO: 905
  misc_feature (1)..( 3000): 2750-1469P.txt file - cDNA_ID_2128402; gDNA_ID_1620336; Annot_ID_153802

SEQ ID NO: 23020 - DNA, 3003 bp, Unknown
  misc_feature (1)..( 3003): 2750-1469P.txt file - cDNA_ID_2128406; gDNA_ID_1620336; Annot_ID_153803
aaatcatcataggttgttgtaacaaatataacttgcaaagttcggtcgattcaaagacagcactctttaaatacgtaaataggttaattcataccgttacaatcacacgcgatacaaaatcatttcatatcatttgccaatgataaattatgattaacataatgataaacccaaatcacacctccaatagtaaaacgatatgataatataacagttgaattttctaggcacacatctgttgtgctagcatgggagcatcggttctctcgccggttatccccgtttctgtcttgttacatggcttcataccatcggttaaaccatctccggttttgacgtcaatgttttcattcttagtcttgatctccgatatggattggtacgataatgaaaccgggagaaaacccttttgacgacatgtctcaatagattcaataaacatttcctcgagactatacttgaagttaaaccccatgtccgtcagcttcttggaactgaattcaatgctctttagattctcatcaacaccttcaaacctgttatatagagttttgtttaggacaaagagattatgggccaaaacattttggttgaacaaaaagttcaggcttaaacgggtatatcttacgttgaaggtacgttatattcggggtattttggcctgagaaatttggagatagtaagaatggttgcatcatgagaggaacaaatataacgtcccttggcggctgcttgttcgtataagaagatatgagcgttgcataagtcgtccaaatgcacatactgtccttgtcttatgatcgagtaatgcgcctcgttccctaaaacattataatatattcaacgttttagatttaacattttcacatttccaacaaaagaagaagcacacacacgtacgagtgataggagagagcgcggtgataaggctaggcggcatagacgttgtgatgaatggaccgaccaccaatgttggaataatactaatgaaatctaatcctttctcttcggcgaaatcccacgctgctttctccgctaacgtttttgacacgaaatacatctgccacacaaatatatatgaactttaaattacttcaaaaaaccgtaacttgagtttaattaatatgtatattcttacccatcctgtcatctttttggacatgataaactcaagatcactccaatcattttcatcatagacattcttctgatgttcttctacattaacggttccggcagatgaagtaaatacgaatcttcgtacggtctttgccttaacacatgctttcattatccccaacattccattcactgtcggctttatcacttcgttctgattcgcaaatacaaaagtcaagttaagctaggttgacgcaaaaaccaaaagaagtttcctaatatagagaaactcacctcaggatcttttgattcaaaatccatgggtgttgccacgtggaaaacaccgtcacatccgtttatggcatcatcgtagcttccttcctcagataaatcagccttccataaagtgagtagcgtcttggcgtttggcaaatcaagaagatgttgtactttcttcaaattaccttgacaatccaaaaaaacccgtaaataaacgttatattaatatacataatcttaggagaaatgagtttgtaagaacatatagatatgtaccgggatctcgaacggtggcacgaacaaagtaaccacgttctagtaatcgcatcactagccatgaaccgatgaaacccgaagcgccggttacacacacggtctctttctgactaaccatttttgtggttatatgatagattgtgctttgggaaagattcaactatgtatgttcggtacaaatctttgtgatgtgaagacattataaataagacactagagattatgaatcgttattgaagaaaacagataataagaacgagaagctgccggtcacgtgagtaccaaccggagaagcacgtggggaacgttggttgacgaaggactaaagagatgtgtggtacgtaacaatctggtaagttgattttattatttccttaggtgtgtattttgttgttgtaccggtgggtgaaatacgttgacttcgatttgtttggtgagacgtgtgggtgacttcagttcagtttgtttttgtttttgttccccacccacttttacgaaataaatcaaaatttgtctaaacaaattaacattttgatagaatatatacagaaatacattttacttaagtaatattttaattttaattgaaatctaaaaatcagacacctaaaataattataaatcttggaaaagcttaaatgaaaaatatgtttatattttagatttatgaattaggagtttcttattacaaaattgtaaaattataaaacatattaatttataaatatgacttctagatttattgcaatctaaatattataagcatttacataaaatacataaactaaaactttaaaagatgtaattatccaattgtgtcccatgtcagctttttcattattatttcacgaattattataaaaataattgatatgttaaaatattgttttcaaaaatttatttatttccagttttcgcaaagaaaataaaataaaattagaaggacagtgaatcacttaatctcataaagtaagaaataacacgtggtggttacctcgtccacgtggattctaaaacacagaatcaatataactcttgtattttcaatttgttgtatcgtaagacgtcagagaagaggtcagcttaattttgactctcctccaaacagagagacaaagtaagccaagcgtctttggtgtagtccaccaccacgtttgagctcgacgcagagagagaagaatacttcaaagctctccttcttcttcttcaaccactagaaatcttcgttctctattcaattgcattgcgttagcaaaattctggtgaattgatttgatcagatcttcgcttgatttcgattttaaaaatcgaagaattttgtatcgcatg

SEQ ID NO: 23021 - DNA, 3000 bp, Unknown; identical to SEQ ID NO: 917
  misc_feature (1)..( 3000): 2750-1469P.txt file - cDNA_ID_2128418; gDNA_ID_1620338; Annot_ID_153853

SEQ ID NO: 23022 - DNA, 3003 bp, Unknown
  misc_feature (1)..( 3003): 2750-1469P.txt file - cDNA_ID_2128465; gDNA_ID_1620338; Annot_ID_153867
tttctcagcagccctctccatacgagcaattgcatcatacaaacactttgctatatctaataaagcaataacttcgccattttcaacaaccggcaaatgtctgaattttcctgcagtaggtaaggttaagatatagcctcattaaggatctagacacagcaatcagataaacatcaagtttctctagcttaaaaacaatgagacaaaccttggaccatcttttggagagcttcaacagcaagtgtttctgagagaacaaacattgggttcttcgtcataaccttagatacaggtgtttcctcgacattaagttcctgtgaaatcactcttgtagctatgtcctgaaaatccaaaaaagacacacatacacacagatcaatgaagtctccatttccttcttccaatctgtttctaactttttaactacacttagcgaatagtggcataccttatcagtaagaataccacaaagcatttcattagagtcagtcaacaacaaggcatcaactcgtcgtgaagccatccttttacaagcttcatatatagttgttgttgctggtactgtaagtgctttcgatagccttaaccgtttcacagtccgctcgcctcctgttaaacccctgctccatatacagatgagagaaaaaagttaaaaccaaatcacaatagcttcaatggaaaagaaataaggtaaacctgaggagctagatgttctctatgaattgaatacgagcataaactagggtttatatataagattgagacccagctgagacttacaaaggagaacgagaaacagtaagagatctccggccagtatcgagacctcgttcggccatatccatggatttcttctttccgtgcaatgacgcagtcgtaacggataagctccgtcttggcccgccttggctagccatatctactgtatgatatagaaaaaatcaaacccttgtaatcgtcaacgcttacgaaatgattaccaaaattcgaataaggaaagtttttctggaatcgaaactaaacaaaacgccaaaaaacaaacactaataagaatcagaaaactcgtgaaatcaaagctattaccaggcggattcgtcgggtcaacaaatggattctgggattgaaaaaactgagctacaccaagttgggattagttccgtttcgtagatgctctcttctctcctttctcaaaatgttcgtgagacagataacggcaagagagaaaacgacgatttgtgagacgagaaagattacagagattctcccgggaaagtgacgggaaaatgtaagaaaattagaaagcaagaaatattctgtgatttttctctctgaaaaacacgttttattttgcgattttcacccaatcggattctttgatttcgatgctctgtcgaattggacgatcgctaccttttttttttttggtctttgcttttttttttgggggggcaatatattgatttcttatatctggttattgacacttatatcctcaatatttgagaactatgacaagtggatcaaagatttgtttctcatttggcaaagggttttatcgtcattagctatttatggtcattattacacacgagttgatactttttctggattttattttttatatgttgattattggatttgccttttactctttcttcttagcatttggatttttttttttccttttttttggacaaattggatttcgtctaagacagaaaattcaaactgattttttcttaaaacaggttaatttaattaggatattaaaagttctgtgttctatctggataaaaacgtgtagactaaaaacaaaatgaaaataaaatatccattctgtctcattttcagtttcttacaatgtatttaaggatttgttccatccatggttgtgaaatctgtgtgaaccaaaaaaaaaaaaaaaaacagaaattttaatattcaaactttatattaattgttgaatatttcaatgttaaaaacagtgaaatgaatcaatgtcacaacagttttgaccaaaaggaaaaagaattggtgtcacaacaattttgaccaaaaaaagaaaagaattgaggtcacactcacaacaatagtcaataaccaaagctactttagcttcatggatatggaccaaacataagttatgaattataatactgggccgaaaactcaaagcccatatgtataagattcacgttgttcgaaatcttttcccactaaacaataattttataattaaacctaaagtatgtccacgtggataccatcaattggttcaccacagcattagctttcacatcacacgagaagcttcgtctctaactaaaaccaaaaatactccagctccttcaccactctctatttctctctccaaattcatttcttctctctttaagacaagaagttatggcggattggggcccagtgttgatcgccgtgatcctcttcgtagttctatcgccggggcttcttttccagattccggcgggaggtcgagttgtcgaattcggtaatatgcagacgagtggcgcttcgattctcgttcacgccatcattttctttggtctcatcactatctttaccatcgccataaacgtccacatctattccggttaactgtttagccagacaaaccggtgctgcttggttttatttcaatttgattgtaaggtctggatttgttttgtttgtaacattttcggatttgtgaatataatcaaaatttcaccaaatgatacaacatccagttttgtttttgaatctggtatcaatctgtagagtttgtttgggatctggtttaatttggttttcaaatgctacttgacacctaatgtacatccacctaataagtgaaacgacgacgttttactattattgggcctgtggtccgttaaaaagcccaatatgctgtatctcgtttaatttcaggtgaatctttcgacgaccactctctctcttttcctctttgcaaatccttgaagaaatccaaaatccatagcaatg

SEQ ID NO: 23023 - DNA, 2500 bp, Unknown; identical to SEQ ID NO: 921
  misc_feature (1)..( 2500): 2750-1469P.txt file - cDNA_ID_2128477; gDNA_ID_1620338; Annot_ID_153872

SEQ ID NO: 23024 - DNA, 3000 bp, Unknown; identical to SEQ ID NO: 936
  misc_feature (1)..( 3000): 2750-1469P.txt file - cDNA_ID_2128498; gDNA_ID_1620339; Annot_ID_153887

SEQ ID NO: 23025 - DNA, 3003 bp, Unknown
  misc_feature (1)..( 3003): 2750-1469P.txt file - cDNA_ID_2128505; gDNA_ID_1620339; Annot_ID_153889
ataattacgaaagtgacattgttattttacctgtcttggcccatgggctttttcaagagacataagacccgttgacccattaaagggctgtattaacgacaagttccaatttttatttgtttatcttttgttggaaaatgaaattctaaaaccctaaaaaatccaaccagaagggtagaagctctctcgccgacaattaccggctacaaggtttctctgctcgtcaacgttgtaagttatttcttcattgtaatcaaatttgtgcatgaattaggtcaaattagtagcttttgtagtaattcttcccgaaatgagagcttaattacggattgataacgagcttgcgaatcttatcgttgtttgtttcatgcagctctgaattagtggtattgaaagatgagcttatctcagaatgctccgaaaagtaagggtattaaaagagaggagctcaagaaacagtacgaagatgttgaagatgaggaagagattgggtccgatgatgatctcactaggggaaagagaagaaagacagagaaggagaagcagaagctagaagaatcggaactggttgaaatgaaaaagcttgagaatttgatattcgggtcactctactctcctgttacgtttggtaaggaagaagaagaagatggttcggctttgtttcatgtagaccgttctgctgtgaggcagattcctgactacgaggatgatggtgatgatgatgaagagctttctgatgaagagaatggtcaagttgtggcaattagaaagggagaagctgcctgggaggatgaagaagagaaacagataaacgttgatatagctagtgtcaaccgtctaaggaagctaaggaaagaggagaatgagggtttgatctctgggtctgagtacattgcaaggctgagggctcatcatgctaagctaaacccggggactgattgggctcggccagattctcaaatagttgatggagagtcttcagatgatgatgatactcaggatggaggagttgatgatatccttcgaacgaatgaagatcttgtggtgaagtctcgtggtaacaagctgtgtgctggtcgtcttgaatactctaagcttgtggatgccaatgcagcggatccttcaaatggtccaataaactctgtccacttccatcagaacgctcagctgcttctcactgctggattggatcgacggttaaggtttttccagattgatggaaagaggaacaccaagatccagagcatttttcttgaggactgtcccattcgtaaagcggctttcttgcccaatggctctcaggtcattgtctccggaagaagaaagttcttttacagctttgatttggagaaggcaaagtttgacaaaattggccctttggttggtagagaggagaaaagcttggaatatttcgaggtgtcacaagactctaacaccatagcttttgttggcaacgaaggttatatcttacttgtgtctacaaaaacaaaagagctgataggaaccctaaagatgaatggttcagttaggtctttagcatttagtgaagatgggaagcatttgctgagctcaggaggtgacgggcaagtctatgtctgggatctgagaacaatgaaatgcttatacaaaggcgtggatgaaggcagcacttgtggcacttctctttgcagttcgcttaacggagcattgtttgcttctggaaccgacagaggaatcgtaaacatttacaagaaatctgagtttgtgggaggcaaaagaaagccgataaagacagtggacaatctcacatccaagatagatttcatgaagttcaaccatgatgctcagattctagctatagtctctacaatgaacaaaaacagtgtaaagctagtccatgttccatccctaaccgtcttctcaaactggccgccaccaaacagcacaatgcattaccctcgctgcctagacttcagccccggaagtggcttcatggctatggggaacgctgccggaaaagttttgctgtataaactccatcattaccagaatgcttgaagtggtctttaacaagggcagttttgggattgttgtgtttcctctttttttgtcgcaagtactctttatgttatcaattttcctatccaattatcgatcaatgaaaaattttctttctgattcttgggattgagtgggccaagttttgttttctcacgattttgacagcatcaaccacttatttggtactatcatctaaaaataaaaatgcaggagaaaaagaaagatgtcaacattatttcatggattaacacaaagtacaaattttagtagagtggcttactaatagctgaaagggtatctcgacccagagattgaatctgaaccgtccattctgggaagggcaaacaaaacagtgtttgtgtctcacgttctcttccttctctaatagagtcttaagccgctttttcactccttaaacccaaaaaaaaacattagtactatttccttcggagcctggccggcgaatccgacaggtcgtttcagctgtgtccgaaggaaagttccaatttttatctgtttttcttcacggaaatccagttaaggtaattgtctacatttctcgatttactttggtttctctgggttttgctgttttcttttctaatttctcgaatgattcatcatttcttgcatttggggtgatgaagaagcacaagtttacacattttctggtttatatgcttcacaagtgcttctcttatgatgttgtttattagtattggttgtttgatttcactgaaaattagtcagtcaacttacagtgtattaattggttcaataaatttttcataattcatttcttaacatgattttacctcattcattatatttatagatttagatcccttgataatgatctgatattctttctgtgaatttgaaagttgcaggtttccacattgcacagctgtaccatttgtcgagatcacaacacgcaagtctcttagatttagcaagcttatg

SEQ ID NO: 23026 - DNA, 3003 bp, Unknown
  misc_feature (1)..( 3003): 2750-1469P.txt file - cDNA_ID_2128521; gDNA_ID_1620339; Annot_ID_153893
gatcaactgcagagacagatccaatcaacgcgtctaagatatcattatccatagggaattttccactcacaatcacctcagccacttccttagcctccgttaatcgcttagctgaaatcaaatccagaataaaagctcggtaatcgctgctcctaggtgctactccgagctttctcttcttctttaaaacaacctgtctctcatacagattcccagtaactacaaacgcttcagctatgaccctataagccataaaatccggtttgcaatctatgttccttagctcttccaatatataaaaagcatccatttctcgtgaacacttacaaagactatggagaatcaacagtgcaatgattgagccattgatattcaaattagcctttttaacctcatccaccaatctcaagagctgattcgtttcagaacttctacagaaccatcctatatagacaccgaatccaagagtgttcaacgaaacacctttatgacgcattttaacaaacagtttctgtgcataatcataacatccatcagaagttaaaccagctaaaagacgattgcatacatcgggatgaatctcctgacccgttgaaaaagcttcttctaaaacccaaaacgcactctgagctttcctacccagcacaagcgtatcaatgagggagcgatacacggaagaatcgagaaggattttgttcgatttaacctgtttgaaaagagcgtccatggcggagaactgacgagaaagcgaaagagacttgaagatagagtggtaagatatggagtcgtgagagtaacctggttgctgagcagcccaattgaagaaaccgagagcaagagaatgatgattcagcagaaacgggtctatgactcgagccacaagcgaagggcttattgagtgacgaaaaccgagaccgtgaagactctgttcaatcaatggactccatatccgagcagctcgagagcttccggaaacttttagcagctctcggccgatcctcaccgcaagctccgtcgcaggtctcatggccgagaagctgacgtcaacattttcagggagtcgctgacaagttggagaaatcgaatttggttaatgagtccattagttagaagtcaaactcatactggcccagtccaaaaagtgatttttagtgacccaaaactttgcatacgagattaatccttattacttgcccatttttggcccatcaaatatctgcatacacacagtaaatgtcgttcaattgtttacatgagaattgagaagtttcctagaggaaaatgacaacaattcacaaccagacatgacaacaacaacctcactttttggtaattttgcagatggggtctataggagtgacccactaaaagaataagaagaaaagaaagaaaccattacatgttttacggtttcagtaattaaatttttgttttaaaaagagaatatattatctctacttgggaataatgtcgactgggagatacaataaggaaagtgaaaatataggataatataccaaaagaagatatgattgaggaacaagaaagggagatatgtcgacttatcgagtgtccacgtgaatttgacataagtcgatcacattcttaagaaaaaatatagaagataatggagtgggaacaatggaagtgactccagattgcaaaatttagcatttgtaagtttgtttaaatctggcacaaaagtgtattgctttccctcttggtccccatacctataccacctacttctgtttgttcctttgttccttgttcctttgtttcatcccaatatgcttccctgtaatccccaattaacccatttgctttatcattatcttttcatacttgttcaaactaatctaatctgcattgtctatggtgtttgtttcacacagacgcctaggttcaagattcaccatctaattcttaccactaacaagttcctatttgatctacaaaaacaaaactatgtgcttctaacgctaaggagatgggtgtaggataattaatagaggagaacaaacccatagcattacgagttgtaatattaaaaacactgaagcaaacaacagtacctgatgtcgtggacagcttcacttgtctgaatcaactagccccaaagtcttcgttgttttgtcacggagctcccatatgcctcctggaaaaagtactctttctttacttttctgcaggatggtcatcaatccaaattgcattttcttcttgtcggagacagacagatcaacaaagcagactctttatataagaaaattattaccacataatgcagcctcaatcactctaggaatagaatgcagccacaatcactctaagtgagcaaggagccagcattgattgttgtttcaagtaaaataaaataaatctctaggcaaagcagtatcagtgtaaaacacagtttacattgttactataatcaaacacagaatgagtttgtacctatgtaactagatttcaagcagagtgcatactccttctactgtactagagaagaatagaccatttcactcaatttgcacgaaagaaagtctaaatatcaaggtttttacaacacagagcaatagcaaaaattgactatttattcatgctttatctgcaaatgacttgtaaatgtaaacgccacataaaatccactgttttacaatgtagaaactcaaatcaagataaaatagtaatacctgagatgctcgatgattgtaattacggatagctactccatcaatgaatttgaggcgtcatgtaaccacaacagtaggggctcaagtatgtaatggccctccaacttgttcttgatgtgatcttgaaagagaatggccaaccaaaattttgtagctttcttggtgttggtctccactgtcatcaacctaaaagacttgagatacagttgcaaccaattcactgccacagtaagactttaccaatcattgttctctataaaagtcactttctcctctagtattctgtagcaactgaagcacgaaaatg

SEQ ID NO: 23027 - DNA, 3003 bp, Unknown
  misc_feature (1)..( 3003): 2750-1469P.txt file - cDNA_ID_2128528; gDNA_ID_1620339; Annot_ID_153898
ttagactaatagacaggtgtttgtttttactttttagctataagctataggtttaaacttgatgaagcctttgaccacaaaaaaaaaaaaaaaaaaaaaactggtgaagttgtagtacatttgacgtgacgatagctcgttctgattgagtgcaagttagagtcgagagatactatatccttgaagatatatatcaacgtatcttcacatgttgttttcattagcaactctatcaattgattatcttcacatgttgttttcattagcaatatactatcatccatattaaagtcaataccgtatatatctcttaatattagtctacttcttctaattatgtagtcttcaatgattgtgttgttgtatccgtataaatataatcttcaattacaatctagaaatacgaatagtcgtcgatctcatctgcgattgcatgcttctttatcaaaggatggttcaaataagaaatgatatacatagttagaagtaacaacaaaacaataaagaaaaaggatttattgtaattccaatacaagtacttaaatggtaatcataaatcaaagcttaccaaaaaaacaataacaaaaaatataagaagttaagagatacaagcagctcacgagaggaagaaagaaaacaataaaatgttaaattaattaggcaacatagatgtggatatgaagagcgataatagagactgtaatgcacgcaaagaagataagagtgtggatgacaatggctgcgccgcttgtttgaaagccgccaaactcaaccactttggtcttccctggaagctgaaacaatactccaggcgtcaatacgatgaacagaaataccgacattaagactggtccccaattcaacaccatttcaatataaagaatcaatcgatttgatgtatatatgtctatgtaaattagaatcgttattgtatgagctaggtagtgtgtacgtttctatgcaccacttttatagagtgattgaattaatatggaggatcgtaatgaaacagtggcttgaaccggacgaaattagaaagtttgcaaggtgaaggaaagaacgattcccctgcagctactcgattgtatcaaagttatatattattatattgtcacactatgtattgattgttgggtatgctaagaatctgattcttgtctcacaaacatttttgttcaccctcttgtttttttgttataagagacatttgccttttttagttcttgttaggagagacatttggcctttgagagtctgtctcttttattcaacaaattcataataagtaaatttctatatatgcctagtaagtataagtgttttccatgaaaatggcggttactcccgacttatttgaatacaaaatcaaatggataagttgatcgaataattaggaaacgacattatgtgccaaaaacaaagatgataaaatatcaattgctgtccatataaatctaaaacttatccatatccgagtcaagccgctcacatctttattttattatttaatttaaacgcatgtttttatttaatttatttgttgatacgaacattttatttaatagcatgttggtctactataaaatctttccatatacttctctcatataaagacacgggaaaacgactcttcacccaattcttgcttgatttccaaatgctaatccttgatgataagaaaacgtataaccaaacaaaccaatcatattcatcaattgatttaatgccaaaagttaaacagtgtcttatgctatgtgcaaagaacacatgcatgcaagttgcgttcatactggcaaaaaatacatgtttgcaaattgcaagttgtgtaatatgtcaaattatatacagataatttttatttttatcacaaactaagttatttttccttttccaacattcataaccccactaaaaagggttggattgaaccttaacgacaggtcatggtggaaccacccccacccaacaggccacattttgattataaagaaaatttactctcgcctatatataacctcctcaacattctatgaaacagcgtattaaaaaatgataattttatctcatttcacttcatttgttacgtcatccaatttccgtcagaagaaaaactgtgataagatcgattccattcaactagttggtaccaacaatgacaagaagtatcacttttgaggatattcactaatgttaactttcgtgaataataactttttaaccaattcaacgtgcatgtatagttggtaagaataccagactattccacgtactaccaagattagtttgtgttttagccggcttgtataaaattaataaatattattttattattcttattttcataaattatgataaatatgctttgaattgctgtttaaattttcttttattaattggtccagcaaagacagatttaaatccagttaacgataatgttgaaaaaggcttaagggataatcaaccttaattaaaagactgaaacaatgacaggcacgccatttaaaaagatggcaggcacgcacagagaattggaaaacagtgacgaaattcacaacagtcccacggtgactgactactactcataattatcaacgagccttttgttctacaatttgtatacgacttcttcactaaaatccacttttttctttttcttcttcctcactaaaatccacttacaagttgtaaccaaattttgatcatattaaaattatcgtaattaacaaactaaacaggaatcgcatatctgcaatagtaactatttcacagattggttttatcttttctatgtcttgtccttttttgtccaatttaagaccataaaaggagaaaatcgtgtgaaagacaagacagatagacagacacgaatattcaaaaaaaaaaatttcttttctctttctaacaccacagatttcgcaatcgtgttttgatctgattcttccaggattctcccggtggcggagagaagaaacaaaggaaacccagaaagcatttttctcaatg

SEQ ID NO: 23028 - DNA, 3000 bp, Unknown; identical to SEQ ID NO: 929
  misc_feature (1)..( 3000): 2750-1469P.txt file - cDNA_ID_2128549; gDNA_ID_1620339; Annot_ID_153903

SEQ ID NO: 23029 - DNA, 3000 bp, Unknown; identical to SEQ ID NO: 933
  misc_feature (1)..( 3000): 2750-1469P.txt file - cDNA_ID_2128553; gDNA_ID_1620339; Annot_ID_153904

SEQ ID NO: 23030 - DNA, 3000 bp, Unknown; identical to SEQ ID NO: 932
  misc_feature (1)..( 3000): 2750-1469P.txt file - cDNA_ID_2128563; gDNA_ID_1620339; Annot_ID_153907

SEQ ID NO: 23031 - DNA, 3000 bp, Unknown; identical to SEQ ID NO: 943
  misc_feature (1)..( 3000): 2750-1469P.txt file - cDNA_ID_2128697; gDNA_ID_1620340; Annot_ID_153945

SEQ ID NO: 23032 - DNA, 3000 bp, Unknown; identical to SEQ ID NO: 7145
  misc_feature (1)..( 3000): 2750-1469P.txt file - cDNA_ID_2128715; gDNA_ID_1621129; Annot_ID_172425

SEQ ID NO: 23033 - DNA, 3003 bp, Unknown; identical to SEQ ID NO: 18331
  misc_feature (1)..( 3003): 2750-1469P.txt file - cDNA_ID_2128719; gDNA_ID_1621129; Annot_ID_172426

SEQ ID NO: 23034 - DNA, 3000 bp, Unknown
  misc_feature (1)..( 3000): 2750-1469P.txt file - cDNA_ID_2128727; gDNA_ID_1621129; Annot_ID_172430
catggctttgtctctttaagcgaaaactcactcgacccgttagagtaaacgatgggtctgggtccgggtccgggcattggactgggaagagcggttatcacgagaggctttatctcactttggtgtggataaaacggtagcatcctctgtccttgaccgttctgctgactttgttgttgatttcctctgttgtgattgtgaagagaaatttgttgctgttgttgttgctgctgttgttgaatcgccatggaagagctcacgttctgtacttttttgcttttctttgaaccacccgacctgttaacccgacggacattctcaccgttctccgccgttgtggtcatgtagtgtttgacgctgatttctccacgcacggaagagaaaaggcttctcttttcaagagtgtagagctgaacgactgactctccttctcttccaacgctggaacccaaaaccctaacctttcccaagaagtttctactgttagaagaacgcttctcgttgtatacgttgatttctagggctttgtgtctgaggtcgttgacgtcaataacgtggaagacgagcttctcgttccagattgggttcaagtctttgggtttgaccttagtccggagacgttggttctcgaactgcacttccacaaaaggtgacgaagaatcttcgccatcttttggcatgagattgtgggcccctactatctccaccacgagcctctcattgccagtgccggttttagcttcagtcattaccggttagaaacaaagagataacaacaccaatggagaagattaaaagcacaagacaagtgaaaagacagtgactagagagagaaagatagagttatagagtctttgtgtatgcagcagacattaacaagagagggcgtgccaaggagagaatctggattttgtattttcttacaatattaaactacgtctcagatatttctcaattttaacttttaaaagatttttttatcatgacagttttgaataatgaataataggttgagtttgtaaattagcaacaacaaaaaaaaatatacgaacgatagcttttcaataaatagaagagaacataaaggaagggaacttcggagaaagggacataacagcctcgagcttcacgcacctggtcgcgcgtggatttaacaacgtgtctcaaccaatggaatggctctgctctgtacttaccgtctgctttttgctttcctcctgatccagtaggacccattttatttcctctgtacaattaaaaacgaaagagacatctataaacgtggtattcacgcgcgcttagactaacgcgtgaggaataatgaaaagaacaggctcaaccttcgtggcgggtcaaacctcaaaggtctatagaacaacaattttgtctcaaaagagtattcgtcagacctcagaaaacatttattgtactataatattagtaattcttgtattttgatattctttagctttagttttcaggataagtggggatttttataaaaatttgtaattataaaccatagattttatttttccccaataaaaatattacaatgtactgatgtagtgattagtgagtaaattaatactccctttgctttccacgagcagagcttagaaaaggttttggacttgagtttgcaggtctgtccttgtccttgtgtacataacgttcttcttgcttttttagagttcccaaaaaaccaataatatatcggcatttatttcatttgttacacttgtattttcatttttggtttcatgggttgtatgtcttgcttctttctttaattttctttttttctttaattttgttctgcagactttgtgcatgccagtgttaaataacaaaatcaaaacaataataataatacaaacttcgtccttgtaatgactgccgcgtggcatccagttcatagtcctcgtaaatcccacttgtgccttgtgagacctctggctctcatcacacaactcaaaaattcaaaatacgtaaacaactgtcatgttgaatcacgatgtttaagttttacttaccaacactacacgatttaccttttattttctaaccgtacgagctaaacgcacataaatattctttagtttgtctcgggcaacgtatattatattttgttccacaaaaacgataggattctagttagataaaaagtttcatcccaagttaaagtgaccgtatatggacttgacgttaaagcccaatatattgtgacaaaagaaaaactcaacactgataaaaggggcccatatattattgtctgcgagggaaccttactaagtcatatgctacatggggatgatagttgatgattgtctgcgagggaatctggatactatatgttttaaattaaagaattgtgattttacatataatgagcacctgttgtatcaaaaaaatcaatcaacatgtctcactaaaaaaaacaaaaaaactgttatatgagttgtatattattactactgattttaaaaagaacaaataattagataattgattttttttgttatgtaagaaatcggacaaaattagtttttccgcgtccgaaatacaagctcgtaataacaaagaaaagacaggggtaatttggggatgtaattgtcataattcaacgtctacttatgatgctgtcattttaattaaagtaaatattttctccaaaaacaaatcccaaaggtgggggaggtaagggaagagggaagcacgaaagccaaaataaaacgaaacttttttttataatctgagaaagtttgcgacattacaacaatcagaagaatcaacgcgtttcggttttgctaattccctttatttttctgggcattgaatctggtttcttgaagcattctcgtatacgcattgtcggtgtatttgtcggtgtattggaaggcttagttacaaagaagaagttcaatgttgctctgatttcagctagatccagagaataagcaaaataacattgagtttcttattcgttaaacaataatg

SEQ ID NO: 23035 - DNA, 3000 bp, Unknown; identical to SEQ ID NO: 961
  misc_feature (1)..( 3000): 2750-1469P.txt file - cDNA_ID_2128828; gDNA_ID_1620342; Annot_ID_154009

SEQ ID NO: 23036 - DNA, 3003 bp, Unknown
  misc_feature (1)..( 3003): 2750-1469P.txt file - cDNA_ID_2128857; gDNA_ID_1620342; Annot_ID_154018
gcaatcaatttctttattattttctgaactgtaaataataaggttcatccccttaaataaattttatcttcttgaaacgtttttttaagaagaaatttcattctattcatacataatatttttatattttaagaaaaatcattttaaatttaatgttttgtttaaattttataaaatccaaatatggttgcacattttaactttgatatatggaaattaaagtaatttcatatacccctgaaagcataatttaattttaatttttgaaaagtatttgaatattaaaatttgttttgggatgtgaaatgtttttgaaggcatatgttgatttcattgtgaaaatcaaagtgtctttgtttaattagtgaaaccacacacatgattataaccatcttactttgagagattcgaagaagagagaatttctatataatgttgtaattgatcatgatttaaatgagtttttatatacattttaaaatgatttggtttagagggttacttctctaatttttagagagagaattgaattactcaatatggtagagaaaattttggtcaagagtgaaatttttatatctaagttcgaccatctttggaaaaaaaacacatttgtctgaaaagtgtgttagttgggttttggctaaattctaactggtttacatggtagttagaaatgcaggcggtctgattatccatgaaattcggaaaacactccaaacttgggacaaactttatggtggtctttcggagagaagtctactataaaacaggtgcaattctaccgaccagatcagctgatagggtttatcaaaaaaaaaattaattttaaaactttataaaagctacttgtctacaattcttgataaaagatgaagcattggataagctgctaatcaaagctcaccagtaaaaaatgatcatagacaaaaaaaagtggatggaacatctgaagcacatgcactagaagtagcaaatgaatctttcggattatgcgcatgagcttattctttggatctagctattatatagctcattggatatcaatggccataacgaaatagtaaatcacattggtggtccaatagtagcaagttaaagttcaaaaagaaggaggacggaaaaattttcacaaacctgcatggaaaatttattgatcttctcctctttgttaacaatggaacccatgttacgactcatatgccatgattctttggatctggttgtggtagagcttatcattgtatatttcatctgtggtttcagaatatggttggtagttgaattagatgttaacgaaccacatgcattttaccttgacggaatttgataaatcactttctcataggggctaacatttttatatctgagtcaatcatatggcataagttggcttgcacaacaaggtgtattagttactccaagtaatatactatgaccaaaccacgccaacaaacctcgtcctccgccaaactagagccacaaatacatcgatgggaaccataccgccgtcgacggaggggagtacctactcactcatgaaacttctttaagaaatcttgacatgcgatgaaaatcaaagagaaccaaagaaactagacctaaaaaacttcttcaagcgagagaaaaaactcaaaatttgatctaatgattgtctccaccataatactgtttaagcctttaaattttaagctttaatattctttgaccgtttatcatcaattataactaataagtaataactaatgctcatacaatcgttgtaagtcaatcacattctctcttatcgcttccaagcttaacctttgacataattctatgaaacagaggtattagctctcaaattttgaggctcattttatgtagatttgttagtgttttttttttaatgaattttctaggctctataattaaccaaagttttcataattagtaaaatagaccccaaattaacaaaatatccaaaattagccaaaaaaaacataattagcaaaaagtcccaaaattaagaaaaaacagtaaataaaaattatgaatctcccataattaacaaaataattaataaaagtaaagtttacttttaaaaaaggcccaatttttttttcctattcagcctggattttataagaccggctacgatcgcttctattcaccttcattgtaaaccgataaaacaatcatatatatatatatatatatataattttggcacaacaatcatatattaaaccgatagttttttttttggtgtgtttgagatgggtatcaattgttatcttaaaaggaacctagaagtaaatttcgtgacctttacacaccacacatgttgacgtagatacgcccaaacgcatgtggtgttgtatcaagacacaaagtcacaaactgtctaaaaagtcaaaacccaatccaaaaccatcatcatgttttcggcttctttaaaatcccggtttagggttctttcgtagcaacatagagtagacggtcctgactcgtgctctgcctctttaatttccggtttagtactctttcgtagtaagtagaaactctatccatatagacccaaagaagggccactcttctattctcaaaggactcggtaaaaaaacaaatgcgaacgagacaacaaaaacaagtaagaacactctacgcgctccctccaatgcgcgtaaaccccacgtgagactgatatccaaagacaagtgagttaaacgctctgtttaagcgcgtgcgttcagacacaaagtggataatcatggggaaactgtctaaccctaaagaaaaaaaagagaaagatttctaattttttttaatagctaaccaaaagagatggagaatgctaaaatacgctagatatgaaatagtagcttaacctacgccgtattttagtcgttcctctcttttaaacctacgttcctcgtcaccgtaatcgctctcgctctctctcttcttcgtcgcttcatctttctctctctctttgtaacttcgaaaccgatcaaatccatg

SEQ ID NO: 23037 - DNA, 3000 bp, Unknown; identical to SEQ ID NO: 966
  misc_feature (1)..( 3000): 2750-1469P.txt file - cDNA_ID_2128873; gDNA_ID_1620342; Annot_ID_154026

SEQ ID NO: 23038 - DNA, 40 bp, Unknown; identical to SEQ ID NO: 965
  misc_feature (1)..( 40): 2750-1469P.txt file - cDNA_ID_2128878; gDNA_ID_1620342; Annot_ID_154028

SEQ ID NO: 23039 - DNA, 3000 bp, Unknown; identical to SEQ ID NO: 990
  misc_feature (1)..( 3000): 2750-1469P.txt file - cDNA_ID_2128890; gDNA_ID_1620344; Annot_ID_154093

SEQ ID NO: 23040 - DNA, 3000 bp, Unknown; identical to SEQ ID NO: 989
  misc_feature (1)..( 3000): 2750-1469P.txt file - cDNA_ID_2128900; gDNA_ID_1620344; Annot_ID_154096

SEQ ID NO: 23041 - DNA, 3003 bp, Unknown
  misc_feature (1)..( 3003): 2750-1469P.txt file - cDNA_ID_2128919; gDNA_ID_1620344; Annot_ID_154100
tacacagtttttatgagaaaattaaaacgaaattaaagaattttgttgttagtcattgcaatattacaccataattttcttaaaaagaatatataaatgttacttgtagtatttcttttttgtatagtggactttgagaatgtttctgcctgagcttttggcgaatataactatgagggtgtgagagaaaacatagatgaaggaataagcgatagatcgaataaaaggaccaatgttgtgagacaaagtaataacataaactaaaagagtaaacgctagtaatagagaaaccgatatggtctaaaaacagaacactccaaaacatacatagattaaccctaataaaaaccattaatcaatttcatacagccaaatctagctggtgaaaaaagattcaggtttttttttacgcactagagaagaacaaaacgaacagtacggcactgagtacagttgtgaacgaggtcggaatcaaagaagatccatcgttccctgaagaaggatttggagctagaaatccggctgtctcaggtccagcagcagctactcctggagcaagacctgataaaattaggttccacattaagaaatctcaaaagcgtaaaacatctcaacgagaaatcacataactaacatggagaaaaagagcagagatttccaatcactcgagcaaatttttacaaagaaaatcacaaataaggaattcacacaaatttttgtcatggttcgtattaattataattttttgtattgtagaatcttagataaatcattttcactttaagtgagaacccagatgatcaaagtcaaacaatcgacaatttttatcttttcaaaattttcaagtgggaatttaaaaacacaataaagcattgcatgagacaaaacttaagagtaaaattaaaaatcaaccaagaagaaagacaaaatacctggagcagtacttggagcaacagacactgtaagaacaaaaataaaataaaaaagcattataagtaatttaatcaacatcaacaacaacaaaaaatagaatcttaaaacagtttcgaaaaatctacaaattattttcttaattaaactgaaaaaattagaaaaaatgtggatttaagaaaccgctctcgaagattaagcataacaaattaagatctacaaaaccggaagagatctaagaaacaaacaagttaagaaatgaatagatcttacatccacaagtagcgatagaaggagcgtgaagcttgcatgcggcgggaagagtagaagccttagtgatattcaaagtaactccaagagaagcactgctcttaaacgcttcacatagacactgagagtcagctttaagcaccgtcttaagaccagagcaacatgtaccttccggtttcgccaccgtgcctccgctcgaaacgaaggataaacagtcagccatgttgagtatgagagtcgaacagtctacagacggagccggcgccgttgcgtggtggtgagatgcgccgagaactgagacggaggatagggatagaagaacgatgagaaagagaggtgttgttgcggtgaaggaagagtgtgttgccattgtgtgggattttgattcttcttctcttttttttgctcttttgagtttttgaggagagagtagagaggttttttaatggtggaaaatgagaaagagtgaagaggaagaagaagggattttgtaggtcggttttggggttttggggtaatgtgcaaaaacgatgacgtttaggtatacgtgtctctttgcattttccatatggatgcgtgatcgtggggtctttcaccaagagacctgccctttcatctttccttctttctttttttctctcttccttttcaagtttttactcatttgttttttaattactccattttgaaaatttattaactttactaggaaaaatttattagctttcatacactaactaagaaaaaattaaatgcacctccgaattctttgttctttcgctttcctattatgcgaaatttgcgggatatttctaacaatcaggggtttccaaacaaaaatctaaactaattagtaattagagtaaaaaaattgagaaaaaaacaacgagaataattgatcgagaaaaataaactattgtttgttactatgttagtgtactctcttgaaaataacaaaccacatttaaggaaatgttttatcctcaaacccttattgatgtttggccttttcagtttctatgtggttgtgagtctgaggccgttcattttttaaaccaccgagttaagtcatggaacttgttgtttgcctctgaatggaatacttagcatgtcaaattatcaatattgatagcttaatgtacgcaagtgaatagataaatattacacgtaaaaaatagaggaagattaatatgagttctatatttagcctccacgattcatctacagagaaagaaaaaaagtaagttacttcgtcttttgttttaaaacgaatttggaaggtcgagagtagagacatatgttattatataacttactctttactctttagctccacacatggatttgtatttatactcgagatgattttccattgtatgataaaagcatcaaatcttatttccaaaaataaaaaagattccggttggtgatttggtcgacgtgtaaagagatcacagaatcgtagccattcggatcgtcaaaaaacactacctaccgacttcaagcaatactgacggtaactaatatttgggccgtaaaactcaagcccatacaatatgggctcattgttctctactcttttgaaaccgatggcctattgtggcctagttgaagagtaaatacataacaaacccacctcataacttttattatcttcccgaattgccccattagaaacaaactgtgtaaatcagtcctcatcctgaaagaaacaaataatttcaatctttgcttctatatcggtactcctaaaatctagcgaaaacttctcttttgtctctcaagtcagactcaattcccatg

SEQ ID NO: 23042 - DNA, 3000 bp, Unknown; identical to SEQ ID NO: 986
  misc_feature (1)..( 3000): 2750-1469P.txt file - cDNA_ID_2128923; gDNA_ID_1620344; Annot_ID_154101

SEQ ID NO: 23043 - DNA, 3000 bp, Unknown
  misc_feature (1)..( 3000): 2750-1469P.txt file - cDNA_ID_2128932; gDNA_ID_1620344; Annot_ID_154106
gttatttacttggtaaacatcactcttgtcactatcataagtatcattagattaataatattcatttggtagtagagtttcactaactactactatgtgtacaagtcacatgagataaggatgatgaacatgttatttttggatcatctgaagataccgattatatttaagtatttaactaccatctatagatatattatcatggttcaattatcactctcttcgtatttatctcatatctattaagtagtgttttagattattattattattattatttttgttaagaagagattattttattgtaacgtgattcatagttttactaccaaattattatttttatatgtgatatgattatttatattatctagtttaatttgtattatcattcgttcaactaatttataaatactgttatagtctttaaaatatttttttctaaataactaaatgattttttaagttctgtgcaaaaatcccaaaaccataagcattgtttcattttgatacagaaagaatatattttctagttagggttaatcgaggcatacgacaactatctttttcaaatctgttttttttttaaaaaaaattgaactcttttagtcgcctatttcatcaattttgtttgaaaaacaaaagtctaaaacttctttttccgcacaaaaacaaactcaaattattttttttctgaaaatcggttaggccatgcagtggataattgtctggttggatgtagtggtgttcatcaaagtcaaatttattttattaaataaaaacatgataaccaatacaacacatatacattctcaaatataaaataaactaaaacaagttaggtattaaatttttagttattggtcaaaaactcaaaatatatcagatcgaaaatattgatagatacacaatcgtgtgattcactgaaacttcaaccactgacatcagaaaagcgaaaaatccggaagattttgtgacataagaaagtcgaagaacttaaaccggagatacttccaaaactatcccactaattgccggattccgcagtctgttatcgactcttcttattatgacttcgctcaaagtcagcttccaaaacattatcaatttcgaatgtatttatttatctcttaaaaccacaagccctaagtcttttgtcgaatgtccatacatcacggacggatgtgagacgtttttttaacaaacaaaaaaaataaaaatgtgagacgtctagtcgtatatacaagaaaattatactgtggattacccttttagaagaaaaatatgaaaacaatattcattaataaagataattgtataattagaaacaacaatatgataggaatgtggtacaatttcatttgtaatacagtggtacataggctgtaagtacatgtcatactttgaaaatagttcgttctgcatgcattcaaaatttgaatatgattacattatttttttaatacatgtaaacgcaaatgctaaacaatatccttgtttgacacagtcacggtcataatctcaatcttagttcattggttgaagaactaatataataaaaacataaatcgagcttttgacaataacaaaaaaaaatatttagagaggcgtagacaaataaagctcataatatcctcaaggaaagatgatcgtttagatcttatcttataaagtcagcggtcacaatttgaggaatataacaatgatactatatgagactgatacaaaaaaaaatatatatatataattttcatctatctcaattaaggttttttttcgtgtaatctacatatatttgaagtagtactagtctttggagataatgtgttttgtctccaagataggtttctgaatagtacaatttatcgcttagcacaagtcgttagaagaacaaatacatctgtctccatataagctagggaccttggtttgtagaaacttcttaaatgaactgcctcggccctttcctttaaccattaatcttttacgttatttattagtctctcatttgatcattgcacaataaataacacattgaaaaaatgtggtctggtgatatagctaataaggttcatggctttctatagtttcaaatatataagaactgtacgtgaatcacaagggaaaaactttgaattataatcattagcaatagtttattaagaagttttttattaaaaaaaaagagtgtattatcattttgtaaattacaaaactgtattcgccgtgaaaatatagtaagagtttggagaaacataattaacctgatcttcttctttttttacagaagaatcttgaaccaaaattcagagtaattaatttctaaagtttgtggaagaaccagattgcttcatgattccaatcacaagttaattcatttactaccagtagttttatagtgagaatttataaacctttggatatttccattattaaaatccacttggcagacttttgcactttgtaaattaaagaagaatttgatgttcgttttaatcctctaatattgagatctacctaccaaaaaatggatgtatatacaaatttcctaataacaaaatagtataatcctcatttttaattatatatttgctatacatcaattaggcatgaacctaaattcaaaactcctatacgtaaacgatatttccatcattcgttacataattcaatcaatttcacaccaagtaactatcaaaacgaaaaaaaaaaaaaaaagtatcaaaacgaacaaatccaaaagaaaatgcttttaaagtcaaccagtcgaccagctcacaacgcactgaccaacaccacgcgcttttgaatctcccacaaacggtgtcgtttttcatctatcccccacaaacaccaaagccggttttgttgactcacacgtcattctttgactaatcaatctcctctataaatagtactctataacgaactaactctactcactataacttaaacacacacttcatcttctctaaaaccctaaaatttaaacacaagatg

SEQ ID NO: 23044 - DNA, 3003 bp, Unknown
  misc_feature (1)..( 3003): 2750-1469P.txt file - cDNA_ID_2129013; gDNA_ID_1620347; Annot_ID_154203
aagaaaatgttactagaaaaactgtcactatttgtctcagatcagattgaatacctggagctcatcaaaagcaccactatcacccctatagaacaagagttctgtttgcagttgctcaatttggctccgcattctttgcatttgtgcggttgctgggtctcgattgatctaagtattagaagaaatgacaagaatgttaggccacaaatgatatctatagttgagaattcataattaaaagcaagaactaacatataagtaccactgctttgttttgaatattgcgagcacgatttgcgtatttgagcgtatttaaagtttcctcagcatttgtatcagcgggacttacacaagctgcaacattcagagatcataaattatgtgatccaatagatgggtgaaaacagttctgtctaatacttggatcataaatgaaatgtttgagaaaccataccaatcatcacagttttgctattgccaccaagagaatcctaaacaacagataattaccattagtttttctttttcataaccatatatttacaagggcatgtagttcaattgaaaatgtatttacgtgtataaacaaacacatagggaaccttgatacctgtagcaaacgagttaacttgctgtcacggtaaggaacgtgacctccttcctttctctttttctcatctccaagtgcacttataacatttccaagagctaatagacctttgttgatgtgaatacctgtgtaaatattgatgaaataaaccttatagtttagtcatagtctcttttaagaaaccagaaagaatatttatacaactttatacatcataaagataaacatgagatagataaccttcttttaaacgcatcccatcagctcctgttcgttttgcacgttctgaccccgctaggtcaaccaaatgaagctttgcacataatatatcttcacctccatcttcagttgttgtgcaagaaccaccggcaatcttcttttgttccagagtgattgtgaagattgcatgggaccgactaaaaaagcaagaaacaaacattacattagtatacttgtaagaactataatttcttaatattggtcatagaatatgatctaataatgaaattttatcttgatgcaaaagtactcataactctactagtggatcagccacattagctctttcaagtattgaagtagttataaagaaaacggaatgaaaacagtgcatttcaaattacaaattcaccttgactggctattcatgtttgtgctgcctgtagctcgagacaaagagcctcgtgctagaaacgagcccatctcctctttcgtcttgacttcagcctcagtaactccagccaatgttattcctccactggcagtttccctgatttgaattggagctcgtgagagagcagtgtgctttgcttgaacgccactgtcatttttaaggagggccgaagaatttgagtccagcaaatcaaaaacttcttccttaaaaatctgcatttaaaggtaaaaatcagcaagtgaaatatacaaatcaaatctcaaataacaaacacagaagctgtttctacctcaataaaagacactcgtatcaatagttcagatgaatctttggttgtctccactcttctaaatatatcctccataacgtttggtataacgccaccatttgtgcaatctccactataattagtacccatggtataggttttacctgaaccagtcttcaattacaacaaacaaacaatgaatttgatggatcaaaccaaaaaaaaaaacacgtagctaaagggaactgcagagtttagagaatttaaaaacaaacctggccataagctagaacagtggcattgtatcctttaaacaatgcatccacaagtggagcaacacagtgattgtaaatctccgaacacggatagccaccatttccgtagacgaaatcataagtaaatgtatgcgaaccaatatgtacctgtttcagttcataagaaattccaacaaaatgagttttatcaaagttcgaatctttaaacatattttcagcaaaaaaaaaaaaacattcacgcatcaattgatttcccgaattgaaccgaatcagttctatgtgaaaacaaatcccaaatgtttcaaaattcgaatcttacagcaaaactattaactgatgaagaataaacgttatttctcattcgcgcataaatttgatttcccgaatttaaccaatatataatcccacgaatcttatcaaaactgaaaaactctcagaagaaataaacgcagaaaaaacgaaaaacccttccaattgaattacctgtggctctttgggagccacggtgatgcaatctgtgcatccgttcaaaagctccggtgtaattaacggacggatgttgacggcaaccctaacgcactctgtgctctccataaccgccgagcagaaacccagaaaacctctggttacggatctaatccagaaacgaaacctcaaatcaacaccacgaaaatgtagatccaatccagaaacggaggagctagggtaattttcgagaagaaaattctcaggaaatgcgatttttgagaattcaaattttgaagagagagagagaaagagagaagggggacttttgtttattttgagaggtcaacaattaaaaaacaagaaaggcaaaacttaaaaccattatggaaattaaaattataagcgccgctcaggtacgaattcaaattttctttgagaccgttacgcacgtgtcatgcacatgatcatcactaaaatatcataggcccattattttatatttcagcccatattttaatatcaaaggcccattagtttatatttcagcccatagttttaaatattggcccatgttgatctttgtttctgaagaggaggaggaagaagacgatggttgacacttgacagagtaagctcagaaatggcgactctggtttcgaattgaacttgtgaggaaggtttttagggttataaggtgataaagaaaatg

SEQ ID NO: 23045 - DNA, 3000 bp, Unknown; identical to SEQ ID NO: 1015
  misc_feature (1)..( 3000): 2750-1469P.txt file - cDNA_ID_2129017; gDNA_ID_1620347; Annot_ID_154204

SEQ ID NO: 23046 - DNA, 3003 bp, Unknown
  misc_feature (1)..( 3003): 2750-1469P.txt file - cDNA_ID_2129056; gDNA_ID_1620346; Annot_ID_154157
aaacaatcaaatctgagaaatcctcagctaccgctgctatggaaacactgaggataagaaccaaattttctaattaaattcaatcgaaatagattccatcaaagccgaacgaaataagctcacctgtgagacagattcttccactagcaactccagaaaactccacagataaaattgtttaccagaaaacaaaaaactcagcagatagaagagattgtatcaattcatcgaagctagatcgaaaaaaaaaactgtgtaggactttctagagatgttcggcagaagacgatgaaggcttcctatttttttttttttgacaaacattttaaattttaattaaactattgtttttgtttcgggagaatcaaaagacaagtgaccatgatatcaacacgtggcaactaaatcaaaaggtttaacaggcttgggtttttaatatcagaattcgtggacgagagagcagtgtgagatcctatcagttccagttttattattggtacacgtcattagtaccttctcgaaactgggcacgcctcatcttcttattggcttacatcgtaatgatgacatcagcctttatttacgtataacaaattaccatgcggttaaaaaaaacaatagttatatgggccgaagaaagcccaaagaatctttagttgtttttccgatcgatctgcgagtcgagtagtttttttatttgccggcgccgggagagatcctttgatctttttccgatggaggagcaattcggcgggagcgatgagagatggaaaggatcattggagaatataacggagatggcatcgaatctcgattcgcttcagaaacttctcctcaagaaagcagtcttcgttgaagaagacactttctctagagcttctctcgtctccgagcaagcccgaacaatcaaggttaatcctttttcctgtgataaaatttgaaattatagagcttaattgtctgaattttgagcttcttttctttgactttgatgattgcttctgtgatttgtggattcgatctagttgatcacgatcgcactttttagtttgctttagtactactatagctcagtgtaatagtgtgattctggaattgcatttgacggtgaatttgggaacttgtagttgatcataaattttgaatcttcgattttgtgatctgttaatggtacaaatgatcaccaaatccttgaagactggacttgaggtttcactatgaaaactcccaagtgcaattatgtgtattaagtagaaattcttcatgttgtaagtaaaaaaggactgtgttacatgtttgagataagggatagtttcagattgtctcttaactctgttcaatggtttgttttaggttcttgagcaaagagtacaaacactagaaagagaactagatgctgccattacagctgctgctcatgctcggtctgagaaacgccaagctgagtcctctcaaaaggctgctgaatcacgtgcccaagatgtcacaaaagagcttgaaaacaccacaagtatgcacttgataatcacttcttgagttgatgcctggtggcaccattctctcccgcacgtttatctgcgttccagtttcatattcactctcactcactgacttatacaactcttggtttcagaggttttcaagctgcatatggaagagcttcgaggaatgcaagaacagatatccaaacgcgataacgagatcaaactcttagaagctataatccaaacgctcggcggcaaagagcggttgggaaaaagcgacgtgaatggatgatgatgatgcgttttttcacttgtaaaggtttgtactcctgagtttgtggagatgtatcacttcgaagataaatgtatttttgtctgtctatttggtacgttttagaatcttgcctgttctttcaagaaatgaatgttacatgggcctgaccctataaatgggcctaatgtgaatcgatcgatactaaaaatgggttttataggtgtgtgtgtgtggttttcacacgtttgccgccgatagtgctgcgatgccatccagattcagtaacgcggcatctccaggactccagccgtgtggagcaagaaactacgtaaatttgacagctgaagatgcaatttcacaaaaagagaataaaagaaacaaaagaggattatgaccaatttagaaaaaacttttttcaaaaaagtgatgcttcatggtttttagcgtgtggggtgtctctctatattatctaattttttggtagaaactagtgtacaatatctaattttgataaaataccaatgaaggaagttttgactatttctgattgctttatttttgtttgctttgttatagtatatacaagcatataatttttatttttaaggctcgattaagtaaggtaagaaaaatgaggattgtgtctaaaactaggtgggggtgaaccaaagaaatacgtaaagtaataaattaatgcaaaggccattgttgtttacttcacgctgcgaaagtggttaaaaagaatctatggctactaattattctcttacaaattttctttatacatttggataaaagcaagaacataaacactttctgattatgacaaagaatctgaatttcattttgctgttactagtcaactctagtcaattgtcatgcatatcatagcacagtaaaccatctctatcgactatcatattaataaagagtcactaatcaaatttccaatattcaaaaaaatatatcgtaatcatgcaacatttaagtttcgataatcattcaatacgagtatatccaaacccttgatatatgaaatatgtattcctacgaaatggccaagtttattattccacttttaactaatttcaagcttatcacttcatttttctttttgctaaatcctgcacatgattcaatgttcttgaccccatttgacgtacaaatacaatataacgtgcatctatttatacgtgtatatatatgcaatcaaacctcaaacacaaccacataacaaaaaaaatg

SEQ ID NO: 23047 - DNA, 3003 bp, Unknown
  misc_feature (1)..( 3003): 2750-1469P.txt file - cDNA_ID_2129068; gDNA_ID_1620346; Annot_ID_154159
ttgattagaggttgagaaacagaaatagggacttgagagattacggaaggtgatgttaaggacgagaagtgagtaggtgtcgctgatatccggtggacctgaccttccgaagtgcgacatggttttcccgccggcggagaaattgggagcgcgagagagagacgaagtgaaattaggttaaagcttttctgaaacaatggaatctactagatacggggacattttttttaaagcttgacgttgttgttaattacatttgtaccccttgacgaagacacaaaaaaaagaagataatcgaaccggatgataccgagtttggttcgtatcggttcagcagcgattgggacggttgagacgcaattttattatagtctgaaacatttttaccaaaacaattctgcaatttacaaacaccggtacatctctaacacctttaaaacatattttagcacattcaaacaaattcatatccaaaatcattaaaaaaaacaaacagaaaaactccaagtaggatactcttttgaaattggtttagtgataaccaatcggagctgctgcttctcgcaactcttttccttgattgcgaatgtcctgcaaataactcacaatattaacaattcaaaaacaccacacaacataacaaatccacagatttttaaaattcattgatttatattaaaaactatgaacttgtatgtatccacacaccaaatgtcgttgattctactacttatatcatttgttattttaatatcaccgaaatggacccgaagaaatgtatgaaactcgggagttttggaaaaaaaataaaagggttgttgttttagactcacagaagcaaaatggttgacatctcgatgatgagcttcatcagcacgaatcaccgttacaacatctttcaacgtagcatctttaggcaatctccaataatcaatagcaatcgcgggcgcggcaacattctcgatcttcccattgtcgatatctttaagaaactcggtgtaagaatgtatagcttcttcctctaaatatccaacgaccctatgagctaaccgcggggaaatcacgtaacaaacgaaaaaagagttgaagaatattccttgaacaagcatcactagaagacgctcgtaccatttgggtttgactaactccatcatcgtcattagatgcatcctctcgttctctgcttcttcgagtaatgctttgatccaaccgccgctatgttcgaattttcggattgattttaggtgaagaagcattcctccaaccattcctggtactgcagctactgtctctagcatcatcgctctgcatccatatcgtctctgctgaccaaacatatatttaacattaaggaacaaaaaatgtaaaacattagcatgtgaagtgaaacagtgaatccatacgtatgtatatatgtgaatcatggtaggataatatgtgcatacaaaattacaaaccaaaccaaaccgaatcagctaaataaaccaatgaacatattaaacgaatcaacgtttcattttaaaatttgaaattacagtcatgcctgaaaaaatatatcggtgggaatacggaggagcttgacaatccggtaagcgactttgtcggcgatattcttcggaacgtggtgcttcttcaaatctatcgacagatttgcttgataagtctcccatggctgttcaaaatatacttaagtcatatatctactacatataaaagagtgcttaatttgtctacgaactttgggatgtgtataagtttaccataaaacagttccaaggccaatccgatccatctttccgagtaattttcatctttgctgtctctattccccaataacttggaaccgctactgaccccccgccgttttgacccttctttaccgtcaaattttcatctttcttctccatcgccgatgcagaactcatacccatccacctcaagttaaaatttcctattcaaattttagaaatatacaaatcctaattatcatgtacaattgttataaggttgtatgaggatcatctacagatatgcacaccttgcacatgcttagagccgatcttgaaatcgccaaaaccgccgcaccagtcatgaattcgcatcggtgccgttatctcatacggacttttcataacagaggtggaggaaacagaactcacgaacatgttacagtttcctctgccgcagacaagcagaactcgtaaagctgctttcgtaatgagttgactcatcttacgacactctctcgtatacttatagattcacttctcagataagaggcttgttctctgactgaaagaaaatgattcaactctgttttttctcgaaagaaagtgtaagtaggggaaacaagaaggaaataaaaaatgacgttatcagctgatacgcggcgaatactgctgaatacacgtggctcatatccaactgttgctttacttttaagataactatttttaaaaaaacgaatgcacattttttaagtttgtccgaatcttgaagtggcgttcagcagacagagcgcacgtgaatctggtcttgactgaactgtccggtccaatatcttttggtttggtttaattcggattaatagattgtctccttaagaaaagttcctaaaaggaacattaattataattacattcatgaatcaatttagcaaaagtacacacattgaataaaaatttcatccacgtgtccacgtgtaaggtttgtattggataaaaatgttttggttcactaaatttataaaacaacctccaccatatcggcgctttccttccgatttcgtcctcccccagaaaatagagaggaaaaaaggaaaaaaagtaatcatcgattcgctttcacaacctggaaagctcgaaaagaggaaaaaaattctaaagagcttatcaagctcacttcatacacctagatcgatttagggttcgtttgatttttttttttctgtgattgcgacagctagagatctatctctggtggattttgggtttatgttccatg

SEQ ID NO: 23048 - DNA, 3000 bp, Unknown; identical to SEQ ID NO: 1002
  misc_feature (1)..( 3000): 2750-1469P.txt file - cDNA_ID_2129087; gDNA_ID_1620346; Annot_ID_154166

SEQ ID NO: 23049 - DNA, 3000 bp, Unknown; identical to SEQ ID NO: 1008
  misc_feature (1)..( 3000): 2750-1469P.txt file - cDNA_ID_2129091; gDNA_ID_1620346; Annot_ID_154167

SEQ ID NO: 23050 - DNA, 3003 bp, Unknown
  misc_feature (1)..( 3003): 2750-1469P.txt file - cDNA_ID_2129094; gDNA_ID_1620346; Annot_ID_154168
gatcactactccaagctcctctgctaacttgagacacagcaaattttgagctgcagcagtcaagaaaagcgcactagagtttccggcgcactgtcaaagatcagaacaaaattagagaagcagaacaaaattcgaaaacttcaaaagtctctcaagtcaaatacaaacaacaagaaagaatctttcatctaaactagaaagcaacctataagaaaaatgaaagattctgcatttgaggtagaaacatcaaagcagccctcagattaagacacaaattgatgcaaagttcaaactttgtttctcaggatcacactactaactaataattggagccaaatcatgaatcaaaggacataaaacaaagaagtaacctggaattgagattgaatcaagtaagagcctagtttcctcgaagaagaatcattcggtttacttccagccgagagcgatagagacttgatgatgggcaagaaaatgccaccagctctagcagtagtactaggcatcgcaggagcaattaaagcctcactaagcgtgagaccataagatagacctaaagtactcttcccaagccatttgacaaagtaagtagcgattctatcaccaagacctgttttgacgaatccacgagcgaagaagaaagagataacgatcaaccagataacctcgcttgtgaaagctgagaaagcggcggagaaagaaagcgttttggtgacgattgaagcggtgagaccaatgaaagcccaagctccgactgggagaggactaaggacgagaccagcgattgttgagaggaagattgagagtaattgccagccttgtggtgtgactccttctggtacaggaacagcgaatcggaggattaggccgacggagattgagagaatcagagggatgagtttcgctccttgaggagacggagacggagacggagatgggggaggaggaggaggagcgttgtcttgcggtgcggcggcgattcgtgtggagaatcgaggaattggtttgagaagagggaaggagagaggttgaacggagagagatcggagggagattgttgaaggcggagatctcgaagaggtacgacggagaagagagagacgtgagggatggtgatgatgatgatgggagagtaaggtggaagtggcggtggtggagagagagtgaagagcgaaactctccatcgccggagattatatatatagagagagtgtctgtgacggcgaagtgtttaattttcgtcagtcgctcgctgtgtttttgtcgccggagagatctcgatcaatgatgatgagtggatgtgtgaagctgaaagtgaaattacactgagaatctaaaaagtcttcggttctaaccaaacaaaccgaaaccatggtaaacttgaaccgaaccactttttctaatttggttcatttttctagccctggtttaccaaaatccgaattcttttggaggcaatcaaaactcaaaagtcaaaaacactatcatcataaattcaaaatcatcgggtgggtattattttttaaatcatcggtttatcttaaatttttgaaatgatatgttttttttttttttttttggaaacttgagaacatctcattactaaagtgtgaagctttgtctgatgtaaaaccaaatgagagattcatgtcatgaaaattgaagagtagaacaatgctccgagtcaagaatgtagtgtcaattcgacggatcatggaagtactgatcttctttgtcttaaacactatatgaatctacccttaaactaaaataaaaaatacacatcctattcgtacgtcccattgttagatgtcaccaccaattttcgtgttaagaataccaacgacgcatatataaactattacatcatctaacaaaacttatagtataaaaccaacaaaaatgaaaaaataaacttaaagtatgttgtatatgtaaattacaatatattatcttgaacgacgaatacataatgttgcatgggtcatccgaccaaagaagcgaggatggaaaaacataaaaatgtgcggttggtatgtcacgggaatgggctgccactcaaatagtttcctatatcacaattatcacttatgatcccaaggattgttatttggaatctcggatggtcattttttttttgacattttcttcataccatacttagcatattagaggatacgatgggatccgattccgatttgtaaagtggaccatatttgtttatcgagttattagcatagtcatgagatcacacatcaatgtaaaaacaataaagaatgttaaatatgtcgtatgtgattgaagttgtactattgacttagatctgtttacctgaatttatagtctaaatagttttgcagtattttcaatcttttgataaaaaacaaaaatcaattgaaactatttttttcatacaaactatatagttgagcaactttgttacgtcaaggcagagacacatcttattatcagtttttttcaacatctgaaaatttaccactaaacttcaatctctatactagtagtttctgtactaatgacaaagatttaaacgacgattattttgaccagtgtttgaagcatatgattattattctcttttgtctccaaaaacataattagagaaggagacttttctttggtgtaagtgtaactaaaaagaagatgaaaatgaattgaaagtctataaaagttggctttgaagagaagagagccaagcaagtgtcttatctcctccacaccgaatcacagagatccttaaattcttcatttttcccaatttgcgccgccattaaaaaagcttagctaatcgctatcgtcatccgcaactaacaagacccatcctctctcttcgctacacttttccccgcatcttcttcttccaatctctcctattaatcggtactgtgttttcttctgtgatcgtgagattagaaaatctacccaaatttttgattttgcgataagggtttttcttaatttcgtctacggatatagaaaatg

SEQ ID NO: 23051 - DNA, 3003 bp, Unknown
  misc_feature (1)..( 3003): 2750-1469P.txt file - cDNA_ID_2129123; gDNA_ID_1620346; Annot_ID_154177
tcaagcccagacttgtagctatcaaaatttccttcgcatttttgaaagatacatggtcaagaagacagagcaatatagatacaacgaaccttcttcatcacaattacagaaaaaatgattatgtagatatcatgtttagagcctaaacggctaaacagttccatcattaatgtcttaaacaagcttttatgaacagacaatggaaccttcactgcgcaactggagcgtataaaagccagataacgtgcacgaatcacctcttggatagcttctgtatcttctagattctgcagaatactcattacaggtaagtgagaatacctagctactatgactacacaaaaaaaactctacatagccgtttaggtctttaccttagaccccagcaagaaattcttgacaaaaagcttacttgttttccttacctttcaaagcatcaaggatgaatgaagcaagcaatgtgtgttgtcactttccctcttcgtttgtcagtccagaacacaacaagttatctagtgaatgaacagaagcagcaattacgacatggaaaccacctatgttttgcaatttgctgctctatggccttttgagttggaggaacataattcttttggaacaaaatgaaacctgagcaggataagtaactcactttactttagataaggcatttggctagtaaggttttatagtctaataaacccgagaaagataatcttaatgcctttactcagaactcagaagcagaagactatataccagaaagcgacgaaagcatccgaattttgagcaaaataacatcaacagattccaactacagggattccaaggaatcaaaatgctagtatttccactacagttaaacatcaacaggaaacataaaagctaaggcctacaacaacgaaacacccgcaacctaaacaaagagaggaaaaagccttacttcactaagtagccttgatcttatcatctccaacaacagaaagtatgggcaaactattcaagaattcatcaagtccctcaaagaacccaatcccttccatattatctacctccctgttacttccgatcccattgcctgcatttcccccacctgccacaccaggctcttccacttcattactaaactccacattcaaatccaacctccccaggttcttagcgcctgttcccattcgttttctagtaatataactccctggtttagacataaccccagttgaagacccaacagccgcagcatttgaagcaattgaaaccgcgtgattgctagcactactgatactttctacattttggacttcttcaactccatgtttcttgttacttctcacatatgtttctttccctttcccaacattcgtcttcttattcacttgtaccacatcttgccaatcaccatcatcaccagcgtcatctccatccgaaatcgcaacataaatgtcatcatcgtcatagtaaatcctaggaggacccggttcctttctcttctttggttcaccatccaacttttgcagaggacaggcaaagagaggtgaaataggtgaccaacttggagcttgaaattcaccggaaaaccccaatggaaacaaagcccatgagcaaaagtaaacgtcttcgtcgtctttcttatccaccggaggttttggtatcgtcacagcttgaaacgctcttctacattcttgacatttcaaagtacattcttcgtaagccttagggtactcaaagagtacaaagcagtaagggcaagcggtccagaagctcgtcgccataggatccgccgaggtcccagcctggctctgagaccgcggtggcggatatacggcggtgctactgctaggttcccactggaaattttgatgcgattgggtttgaggatggaatccagattgaccgagttgactaagttgcaattctcggtcgtagaatgatttcttgaacggatcagagagaacgaaccaagcatcggagacgattttaagagctcgatcggcgaatgggagacgattaacggaaggattgaggagaagagcgagtctacggtactgagtcgcgacgtgttcagggttttgagctaaacgaccgagtcggagaacggcgtaccagtctggcaagttggaatcacctaaacgagtctctccggcgagaagaatgtcgcagattgcgaggatgtagtctgcagcttctgctcgggtcgggtcagcttcgcatgcgcggatcgcaaatgtctttgctccttgaagatcactagacgctagaagcttctccgatgttacaagccactgatccgcctccactctgttaccaccaccaccgccaactccgccgcgtccgcctaccatatcccctatttctttttgttccctttcgtttttcctctctccccgttgaatttatttattattttatcggtaaagagtaaatacagatctaaaaattaaaaggacgaaaacatgatggatcgtcaatgggccggaacaacaacatgatggatcgtcaatggcattttggtccttttcattttatataatatgtgcaatgtgatggatcgtcaatgggccggaacacttttttctaaatttttcacttacaaaaaatattaataaaataagatgtaatattattctcttaggacagtttctctaaacaattggaaaagtttcttgtaatctctcaaatgagagactcactcatctttactgagagatttttttaattaaaaaaaacattatttactattttatttttatttttgtagatgagagatttgaacgaaaaaccaccaatacagatgctttttaggatgttgtaaagcccaataattcttttaagaattaaaatataatctggtgggctttaggtctggacagcctaactaaaataaaatattacattccgattcccagaaaataattcgtaatcaattgaccaaaccgatcgatcactgttgtcataaaagtcatcgccatcttggtttcgtgatcgaaaaagactcgtgaaaaaatg

SEQ ID NO: 23052 - DNA, 3003 bp, Unknown
  misc_feature (1)..( 3003): 2750-1469P.txt file - cDNA_ID_2129131; gDNA_ID_1620346; Annot_ID_154179
ttgcggttaatatatgttatggcagacaccatcctctgaattggttagcttttggtctaaatggtgcagagattgtcttcaacccttcagcaactgttggtgaactcagtgaaccaatgtggcctattgaggtttaacttctgattctccactttactcaatttgaagctttctttctttagtaacactgtctaacaatgcaatatgttccttaaaacttgcaggcacgaaatgccgcaatagcaaacagttactttgttggatccattaaccgagttggaaccgaagtattccccaatccttttacgtcaggtgatggaaaaccgcaacacaatgatttcgggcatttctatgggtcaagccatttttctgcaccagatgcttcttgcacaccgtctttgtcccgttacaaagatggtttattgatctcggacatggatctcaatctctgccggcaatacaaggacaagtggggatttagaatgactgcaagatacgaagtctatgccgatcttttggcaaagtacataaagccagacttcaagcctcaagtcgtctctgacccattgctccacaagaattctacataagaagaaaatttcactctgtgaatcttcaaagaagaaaagtccaataatcaatgttcaatcatttgtgtaaatgtaacggtaactgaaaatctgtttgtagctgaatatatgttgatgccaaaaggcagctcctttgcttttataatcgaaccggtttataattgaaccggaatccaattccaaaaataaccgtaatcagatactatgaactgtggggttttctactcctcgtcatcttctattcgttatccgttttgaagcgtactcggatgggattgagtttcgcagatgctttaaattctagaaaataatgcaatctcttaccttaactcggtacccaactccaatttccccgccaagactcaatctttacccgctaagacaaatcgcagcttctgttctctctgctccgaccgccggtattaaccgtcgcgatatggcgtctcgccatcagtcaacttcctttaagccccttgccgttggtcggaatttgaccggagatgatgatgatggttactgtactcttatagactttgcaggtaacaaactgctctgtctgaacgaacttagcactgtctcgataattcaagttaatgtgttgtctgtcatccattgtcaatctatgtccgaaaatccgtaactttagtggaaataccctgaatttagcatctaaaatgtgcttaattgagtaagacaaatcttggaaactctcttagacgaacaatggttgggttttgacttttgacggttcctctgtataagcagtttgattgaagtcttaaatttattattattttaagttgttctatgaaattttctgataggtagtggaggaggagaagggaaaaatgtaggagaggatcttgtggtgttgctttaccacttacaacatgcttgcaaaagaatcgcttctcttgtcgcctctcctttcaattcttcactcggaaagctctctgttaactcctctagtgggtcagaccgagatgcgcctaagccgctcgatattgtctcggtctgtatcttattactctcttttttatcatgattcatatcaagattcaatcttacaattcatgtttccgttttgcagaacgatatcgtcttgtcctctcttagaaactcagggaaagtagcagtaatggcttctgaagaaaacgatagtccaacttggatcaaagatgatggtccttacgttgtggttgtagatcctctagatggatcacggaacatcgatgcttcgattcccacgggaactatatttggaatttacaatcgtctcgttgagcttgatcatttacctgttgaagagaaagctgagctcaattctttgcagagaggcagcaggcttgtagcttccggttatgtgctatactcttcagccactatcttctgtgttacacttggatcgggaacacacgccttcacgctagaccattccacaggagaatttgttcttacccatcaaaacatcaagatcccaactcggggtaaaaagcgtctaatgacacatatgacttgatccattgcgacattcctattcatggctctgaacaacctgcattaatcgttgttttttgtatgatcaacaataggacaaatctactcagtgaacgatgcgaggtactttgattggccagaaggtttaaggaagtacattgacacagtgagacaaggcaaaggtcaaaacccgaaaaaatactctgcgcgttatatttgttctctagtagctgatcttcacaggactctcttatacggtggagtggctatgaatccaagagaccatcttcgtttagtctatgaaggtaaccctttggcttttctcgtggagcaagctggtggcaaatcctctgatggaaaaagagggatactttcgatacaacccgtgaagcttcaccaaagattgcctctgtttcttgggagcttagaggatgttgctgagctagagagctatggagatgtgcagcagactgtgaaccctggctatgaagtttaaacaactcctctgtttcatattatctgtaaaaacaataaatgaatcgatgttagatttggttgcttgtaacattatgtattaggaaagttagatccgtgtatatatctgtttatcaagattcaagatcgactggtataatcacaattcacaagtttattatgtttctttatcagaagcaatctttcttcgatttctaacacagtcccactcccataaattggttgttagatttcggttaagtttagtaagaatttttaaaatcggtacggtatggtttgccgttaaataataaatatataatgcggatatttggcgcaagttagcaacttagcgttaaagaccaccaaagacttctctcaagtcctctgcgccggaaaccgccgtgacgagattggagagggagagagaggagagataatg

SEQ ID NO: 23053 - DNA, 3000 bp, Unknown; identical to SEQ ID NO: 1022
  misc_feature (1)..( 3000): 2750-1469P.txt file - cDNA_ID_2129155; gDNA_ID_1620349; Annot_ID_154240

SEQ ID NO: 23054 - DNA, 3000 bp, Unknown
  misc_feature (1)..( 3000): 2750-1469P.txt file - cDNA_ID_2129155; gDNA_ID_2926256; Annot_ID_143118
gtgaaaacgaagactggaatctgaaacctggtggccgttacttctttacacgaaacatgtcctgtttggttgcttttgctgtcggagaaaagtgagtcttccgattcaattatgcttccatggtataagatttggtttggctttgataatgaatcctggaactagttcaagctttgataattgaagggttcttcacaaaaatcgttttttttttctttcttagattccttatttgttgggttcagggaacctacatttgttcctcattttgtaggtatgtgcctggtaatggttttcatgccatagctgctcacaccgatagcccgtgtcttaaacttaaaccgaagtctgcttcatccaagtctggctatctcatggtgaatgttcagacttatggaggtggtttgtggcacacatggtttgatcgagacttaagtgttgcggggcgagcaattgtgagagccagtgatggctcgtttgttcataggcttgtcaaagtgaaaaggccattactaagggtacccactttggccattcatcttgatcggtaaatttctttcatgagcttgtctagtgaagttttaggctaatgcatttgccatcaagtggagttatgttttgaagctcattcatgctgttttgttcttcgtgtattgtttagcacagtgaacagtgatggatttaaaccaaatttggagacccaacttgttccgctactggcaacaaaatcagatgaatcctcagcagagtccaaggacaaaaatgtatcctccaaagatgctcatcatccattactcatgcaggtatgagtatgacataatttggttagtcactagagtcattcctctgcatcgtttctgaacatgcaccaagtttctaagatattagatcatgagaactgtggaattactgttgctaaattttttatatcattaccaacatttcgagtttctatcatagtatcatcatcatccattagtgttgctaaatttttgtatcattaccaacatttcgagtttctatcatagtgtcatcataatccattagtgttgctaaatttttgtatcatttagtttaaatttgggtaactgtaaaatccgcaaatatctcaaagtttcctgatcgtgttgcagattttgtcagatgacctggactgtaaggtcgaggatatagtgagtcttgagttaaatatctgtgacacccaacctagctgccttggaggagcaaataatgaattcatattctctggaagacttgataatcttgcatcaagtttctgtgctttgagagctctcattgattcatgtgaatcatcagaaaatctgtcgactgaacatgatatccggatgatagctttatttgacaacgaggaggtacccttttcctctaagatatttattaggttccttcaaatcgagtaacatactagcagcactattgtcctgaaaattgttgaataaagaggacttgcatttaaccttccataacttttttgctttgagctgatgatgtccttgaaccgtctgagcctttttgtaaaaattcttcctaaaaatgtgttgtttcaataggttggttcagattcatgtcaaggtgctggggcgcccactatgtttcaagcaatgagacggattgtgagttccctaggaaataagcaggtcactgagtgtacatttgaccgtgctatccggaaatcgtttcttggtacacactttctacttttgcagttgtttatgcatatgtagtttccagaatttttgtgagacagtggttacaaaattgggatggtttcctatctcttactttctaatttctactgaaacttgtgtttgggttcttgtggttgcagtgtctgcagacatggctcatggagtccaccccaactttgcagacaagcatgaagagaaccaccgtccccaactacacaagggtcttgtaatcaaacataacgcaaatcaacgctatgcaaccagtggaatcacttcttttcttttcaaagaagtagcaaagctccatgatcttccaattcaggttaggtgttcttcttaatgttaagatgaatctacacatcatagatcttctagatgctctgcactaatccacccacatttaagaatgaaatactgacatttagatttttgctatttctgcaggagtttgtggtgagaaacgatatgggatgtggttcaacaataggacctatattggcttcaggagtagggatccgaaccgttgattgtggcatagctcagctttctatgcataggtatgttaactactgccattccttagcaactctttctcatgtttccaaatcaaaatatgttagactcagcttctggtttttggaactcgttacttgtgagacagtgtgagagagatttgtggaacagacgatatagacatcgcgtacagacatttcaaggcgttttatcgatctttctcaagcgtagacaagaagctcgttgtggatgattaactccccggatattctctctaggcaacaaagatcttaagacatggtgagaaatgttaagctagttgcttctgttcgtggatggtcctcagtctcacaacaagaacagaacctaaaattgattttcttgtttaggaaattatagaaaccaaattggaatgtaatcttctaggttaaggttccggtttgtaacactgcatattgttttaccttgacaaataagcttctttctaatttgtcgaatatttatatttttcagaagaacctttaattttctttccaacagaaaagctttccaaataaaataaagagtaaccaagcaaaggatatattcttatgtaagaccaatcaaagaataggatagagaaaacaccgaagattgtatgttaccgttatgccttgcatatacttccggatatctactacatatacttgagcttttacatataatatccgattacctctatttgtctttgtttatttttcatattctattaggttttggtccaagcaaatttgatatg

SEQ ID NO: 23055 - DNA, 3000 bp, Unknown; identical to SEQ ID NO: 23054
  misc_feature (1)..( 3000): 2750-1469P.txt file - cDNA_ID_2129155; gDNA_ID_2926256; Annot_ID_204555

SEQ ID NO: 23056 - DNA, 3003 bp, Unknown
  misc_feature (1)..( 3003): 2750-1469P.txt file - cDNA_ID_2129159; gDNA_ID_1620349; Annot_ID_154241
tacttctttgaaaagaaaagaagtgattccactggttgcatagcgttgatttgcgttatgtttgattacaagacccttgtgtagttggggacggtggttctcttcatgcttgtctgcaaagttggggtggactccatgagccatgtctgcagacactgcaaccacaagaacccaaacacaagtttcagtagaaattagaaagtaagagataggaaaccatcccaattttgtaaccactgtctcacaaaaattctggaaactacatatgcataaacaactgcaaaagtagaaagtgtgtaccaagaaacgatttccggatagcacggtcaaatgtacactcagtgacctgcttatttcctagggaactcacaatccgtctcattgcttgaaacatagtgggcgccccagcaccttgacatgaatctgaaccaacctattgaaacaacacatttttaggaagaatttttacaaaaaggctcagacggttcaaggacatcatcagctcaaagcaaaaaagttatggaaggttaaatgcaagtcctctttattcaacaattttcaggacaatagtgctgctagtatgttactcgatttgaaggaacctaataaatatcttagaggaaaagggtacctcctcgttgtcaaataaagctatcatccggatatcatgttcagtcgacagattttctgatgattcacatgaatcaatgagagctctcaaagcacagaaacttgatgcaagattatcaagtcttccagagaatatgaattcattatttgctcctccaaggcagctaggttgggtgtcacagatatttaactcaagactcactatatcctcgaccttacagtccaggtcatctgacaaaatctgcaacacgatcaggaaactttgagatatttgcggattttacagttacccaaatttaaactaaatgatacaaaaatttagcaacactaatggattatgatgacactatgatagaaactcgaaatgttggtaatgatacaaaaatttagcaacactaatggatgatgatgatactatgatagaaactcgaaatgttggtaatgatataaaaaatttagcaacagtaattccacagttctcatgatctaatatcttagaaacttggtgcatgttcagaaacgatgcagaggaatgactctagtgactaaccaaattatgtcatactcatacctgcatgagtaatggatgatgagcatctttggaggatacatttttgtccttggactctgctgaggattcatctgattttgttgccagtagcggaacaagttgggtctccaaatttggtttaaatccatcactgttcactgtgctaaacaatacacgaagaacaaaacagcatgaatgagcttcaaaacataactccacttgatggcaaatgcattagcctaaaacttcactagacaagctcatgaaagaaatttaccgatcaagatgaatggccaaagtgggtacccttagtaatggccttttcactttgacaagcctatgaacaaacgagccatcactggctctcacaattgctcgccccgcaacacttaagtctcgatcaaaccatgtgtgccacaaaccacctccataagtctgaacattcaccatgagatagccagacttggatgaagcagacttcggtttaagtttaagacacgggctatcggtgtgagcagctatggcatgaaaaccattaccaggcacatacctacaaaatgaggaacaaatgtaggttccctgaacccaacaaataaggaatctaagaaagaaaaaaaaaacgatttttgtgaagaacccttcaattatcaaagcttgaactagttccaggattcattatcaaagccaaaccaaatcttataccatggaagcataattgaatcggaagactcacttttctccgacagcaaaagcaaccaaacaggacatgtttcgtgtaaagaagtaacggccaccaggtttcagattccagtcttcgttttcactgaggagatcaaacccagcagccaaaagctgtctcttcgcctcagctgccagcaaagagaaaaagaccaatgagagtcgtcacttaaagttgaataccgaaaagaaaacaatatttcaatataccagtggcgtgaaactgtgtccaggattcattaagataatccagaagatccccaacaatcgacgcattagaatcactccccggcgatctcgaatcgcgatgggaggtgcagaggattggagagacggaggagaaggagcgaaagggagagcgatggagataagtaggaaaagagagagactgagagaggaaggatgaaggattgaagatggagggaagagaatgagttagtggaagacgagctatggccgccattaatttcgctccggactctaaagatgaggtcttcttctgttatctctaaagtctaaaccatccgccgacgattaccatccgccggagatttgaagaccacttcgacttcgagaaccggattttgtttcttactgtgtgtccccagtcttctaatcttgaggagctgagctgagggccatggcccatgaggattatatgggctatggtgccacttctatgggctttgggcccatgtactcttcacatgattttatttggaccaaagaacctttgccttttatggtccacacttgcatcattccaattttattgaacgcgtgttaaggacgtgtctttatgtattgggccttattaggcttcagtactttgcccttgggccttattagacataattacatgaaagatgatgacattaatttgccaaaagtctttatctttattgggtctccgtagactttaccaaaaggtgactgcaacgaagcttcgttaatgggttccacaacgtcacctacttgtttacttccttttgttttgtttacttcgttgcttgttactccactcttccttgccttttcttctctccacttatctctctctctttttctcatcggcctttgccatg

SEQ ID NO: 23057 - DNA, 3003 bp, Unknown; identical to SEQ ID NO: 23056
  misc_feature (1)..( 3003): 2750-1469P.txt file - cDNA_ID_2129159; gDNA_ID_2926256; Annot_ID_143120

SEQ ID NO: 23058 - DNA, 3003 bp, Unknown; identical to SEQ ID NO: 23056
  misc_feature (1)..( 3003): 2750-1469P.txt file - cDNA_ID_2129159; gDNA_ID_2926256; Annot_ID_204557

SEQ ID NO: 23059 - DNA, 3003 bp, Unknown
  misc_feature (1)..( 3003): 2750-1469P.txt file - cDNA_ID_2129171; gDNA_ID_1620349; Annot_ID_154244
aataatgctaataaatatggtgaatacctcctctttggtccatcttctttcacatgtatatgagttgcgatatcgacatcaatctgtaccaaataaatccaaagcagaaatgagacatcagtaacctagagctagcttttaatgactgcaagcttctttataaaactcgactaagacattagaaaagagtttgtataaaacacaggacacaaaagtaatcatccaataagcagagtaaacattaccttcttttcgggagcctttattccaaaagtctcacccattgcaagttgctcactgcattcctgcaaaacaaccaaaggcaatgttcaaaaaaaaaaaaacagctgcatgcaagcctctttgaatgtgaatgtgattacggtaaagagataaagaaaactgtaggcagaccggatggtatttcaagagattgttgatgattgttaatcggatttgttccaacaagtcaggatcttccactttccggccagtgtctctggtgtgaaaaagaaaatttatttcaggcatctgtaacaactgacaatgcaggttgctgaagatgatatatgcacacaacaccaataattctcaaaaacagaaagttcttttttatcagattcacttgtctcaagctaattatctagtttagaaagaattctccagagaaatgatatagcccaatgtcaagcatgaacttcataggacaactgcagaattctatactagcataatttgagataagggaagatcatatcagcactaagcagtttgagacaaaattgtgcatcctattgaacaagtgagaagtcaataagtgatagaaaatcatctaaagcaaagggagaccaggaaaagaaaggcctttcttaccgtttcgttatagaaaatttggtctgcttaatggatccttcagttgagacagttccttttattacatccaatcccaaatctttcagcgcccgcatctgccacacacatatgattcataagccgaaaacaaggcaagtttacatctgattctgatagtaaaaacgctacaaatcaagaaaagctaaagttttttcacatcgataagatagaacaaaaaaccaaaacaggatatagaatccctcactgtgtcaataagagccccaagacgatttccaaaactgagttgtacaatagtagcttcagggtcagcatcctggtctatcataaccattggcattggaacaacgtcgtcatcgtcttccgatttctgcgatcaaattttccagcaaatgtcatctcaaagcacacgtgaacacaaaactcatacgcagaccgtttccctattaaacatgagaaaatcaaatcacatatcaaatagcatacacatgaacacataacgacatactccctacatttccttgctgagcttctgagagcgaacatacatgcaagtcaaatcaatagatccaagaaacatccgacgaaacaaaaaaagactgaaacaagttactgaccggatacgatggagtagcggccgaatcaatgctgttaatcgaagcatatacacggtttttaatactgcatacaaaacgaacaagcacggaaagatatatcagcaacctcagatacatcatacaaagaagaatttggaatcggtacatagagaaaccaaactaccaagcaacttattctaattatctaaagaaaccataagaacttcaatctcgaaatcgaaatttaatctacctttgctttctcaaatctcttaagttcaagattcataacgaccaatacaactactctaaacgagaatctagtataatagttccgtttgccggatcgttcgagcacatacagagcaaagatttttagtcgaatcaagcttaatagtagctgaacataaaagacgaagcaaagattactcaaatcgatttagcagaaggagcaagaagactataaatctccatcaattctagtaaaggaaagatctaagagcgagacacgacgcataagaaataggaaagagcctaacctcttcgtcaagagagacattacacctccgacgaacttccggcgatcatcgaacaaagcaggcgatagatctggagaagcaatttgagcgggaaaacgagtctgcctactgattgcagaagaaggacgcgaagctaacgaagaagaaaactgagtaacagagaagatggaactcgagaacgccattgaagtttgaaacaagaatattttttttctttctttctcctccgaagtcagagagaacaccttaatctataaaatggcgagagaaattggcgtttagtgataacaaaaagatgatggagtgctgaatctgctgatgtgatgtgtgacgtcactatcgagatgctccacctatacatctactaagcttttattttatttttattttatatggtttctacaagtaactaattgaatatttgcaaattgctatagaataatgtgatcatagtgagacgaatgtagatgcaattatttgcttgctgacgttcaaacttctacgctgcaagttaccaaatatcttctcttttctattcttttaccctccaagccaatcggactggtttgctgtttgcagattttttaaattaaacctgctaaagaattttaaaaaatattttgttttgtctctaataaaaagtttaaagtaaaaaaatcttgtataaaaaattaaaaacttttattcgttgaccaaagaaaaggaaaaaatatctaaaaacaggggaaaacatgtatgtcaacttgggccattaaaccaaagaattgtagacgagtctggggaaaggttctcactattgggctattgtagcccattgggtcattagaccaaagtccttagctaacaattacgccggtgcaatgttctagcgggttcttcaataatctatacccgacccggtccggacccgaagctgcctaactgtctcttcactccaaagacattttctacccaaaaaaaacgattttgagaaaaccatctcactgattagcaagatg

SEQ ID NO: 23060 - DNA, 3003 bp, Unknown
  misc_feature (1)..( 3003): 2750-1469P.txt file - cDNA_ID_2129193; gDNA_ID_1620349; Annot_ID_154252
tctaatgatcatttttcttagttaatgagttaacttcaaagcacaagctaaaacttccattttcattgacattttttgtagaacacaaaatcattgtatctcattgcgaatgctattctgaatctgccagaggatcaagaacagatgtcttggcttattgacttcacgggttggtcaatgagcactagtgtgcctattaaatctgccagagaaactattaacatactgcaaaatcactaccctgagagactagctgtagctttcctctataatcctccaagactctttgaggcattctggaaggttagacgaatcacttcatctatgactcatagttagacaatacattggtttggttaagacaactttgtgtgtgttttgttcgtctatatgtgcaggaacatgcaaagacattcgtcaaggtgaagtttgtttacccaaagaaccaggaaagcgtggagcttatgagcacatttttcgacgaggaaaatctcccaaccgaatttggagggaaagctttgttgcaatataactatgaagagttctctaagcaaatgaaccaagacgatgttaaaactgcaaacttttggggattgtgtaacagtaacaataaccagctgcacgcgagcaacgggttttctggagctgagattgcccctgagccagtccaaacacacccttgactgtttttaaaggcaatgtattgttataaccaacccttttgaatcttagctcttgatgctaactagagaggttgtatgatttagacatagcatttgaataaaataaagaggggttgtgtgtgtgtattagtaactcttgcaaggcttgtaagtgaatccaaaaactctttacactcataagcattttattaacaggaagcagaaaataagattcacattaccagcaacaagctttgtttctttcaatctgaatctgaccaaacacaagaagaagggaaaatgaattctttcaaaatttgaaggcacaaagagattaaaaaaagtacataaaacaaaaattatactagacagcagtattagcttagactatatagcttagagttctgcagtcaaaagtgatgtgcaacggattggagttagagcctagagggagagagagagagtaggcaatttgaatgaaactagataatcctccttctgaagtttctggtggttgattgataggtgcgaaccagcaggccaaccccaatgccaaaaacctacacagacaccaagaccaattcccacaccagcgttgaaccacgacatctcaccatcttcaccatctgcgtactctctattccaatacatgtcgctgtgttctccttcatattcttgtttactgaattggaaataggcccaacaaaatgcgacgaatgttagggcccattaatggaaaacctatatttatatagataagcaattagggattgcgttgccgcttagcttcgtctgaaaaaagggggatcagttccgtcgccgcttcttcgatttttgacgccgccgcttcttcttcttcctcgcaggtacgttctgggtaacttagggattgcgtcgttgtcggaaactgcaaaagcttgtgctgtaggtttcgatttgttgtttttttttttgtctctgtagcttttgaatcttaggtttggttagattcgttaataagataatggaaaagttatgaaatgggttgatttttattaccggatactgccgctgcatcttcattcttttagttttattgtatcaatggcttcgttgtttttataatcacattaggcctctgtcaagttcagtgttatggtgatgtatatttcttgattcatttgcaattctctagacattatttgacattgcatttacatgtgattcctgtgtttgtttagtgttacacctgaatgttgatgtttaagacacaaatcaactatacacttggttgtttcttcatttgtcatatgcttatggatctctattgtttctatttgacattgctgttcatatgtttccttgaactatgattataacaatcgatgctttaggtgcatttcttgatacataaatggttttaatttcatgatgtaattgaatcacggattttgaaccctaactaaagacatggaatttctttggtttttcccctttcagcaggtaagtcacacaggtaactgaaagatggggcgtgttagaaccaagactgtgaagaaatcttctcgtcaagtcatcgagaagtactactctcgcatgactcttgacttccacactaacaagaaaatccttgaagaggttgccatcatcccttcaaagagactccgcaacaagattgctggattctccacccacttgatgaaacgtatccagaagggaccagtccgtggaatctcactcaagcttcaggaagaggagcgtgaacgccgcatggactttgttcccgatgagtctgccatcaagactgatgagatcaaggtggacaaagagactcttgagatgcttgcttctctaggaatgtctgacactcccggcatctctgcagtcgagccacaacaagctatggcaccaatcgctgctttcggtggtggcagggcacccagaagatactgagatggctttgttatcatcagccaatcaaggcaaacgactggctctcttttttcacagttagggataagaaagacatgtgtgttcttggaaagtttattgtttcttttgattcaagtttttatgtcttaaactcagagtgagactctttcgtattaatgggttttgagttatgtggaaccaaaattggagttaaaactttcgatagtaacaatatcttttgcttatcagatccgagttgattcatgggggagaaaatatcgaaattcacctgaaactttctcgaaagttgggttaatacttatttggactttgagaagggcaatttggtaaaatttcaaaagttataaggattatgtttcgttataaccagagagaagagatactagagagaagggaaagatagagaatg

SEQ ID NO: 23061 - DNA, 3003 bp, Unknown; identical to SEQ ID NO: 23060
  misc_feature (1)..( 3003): 2750-1469P.txt file - cDNA_ID_2129193; gDNA_ID_2926256; Annot_ID_204567

SEQ ID NO: 23062 - DNA, 3000 bp, Unknown; identical to SEQ ID NO: 1026
  misc_feature (1)..( 3000): 2750-1469P.txt file - cDNA_ID_2129201; gDNA_ID_1620349; Annot_ID_154254

SEQ ID NO: 23063 - DNA, 3000 bp, Unknown; identical to SEQ ID NO: 1038
  misc_feature (1)..( 3000): 2750-1469P.txt file - cDNA_ID_2129680; gDNA_ID_1620350; Annot_ID_154286

SEQ ID NO: 23064 - DNA, 3000 bp, Unknown; identical to SEQ ID NO: 1031
  misc_feature (1)..( 3000): 2750-1469P.txt file - cDNA_ID_2129711; gDNA_ID_1620350; Annot_ID_154298

SEQ ID NO: 23065 - DNA, 3003 bp, Unknown
  misc_feature (1)..( 3003): 2750-1469P.txt file - cDNA_ID_2129749; gDNA_ID_1620353; Annot_ID_154387
taatgtatatgactaaaataaatctaaaattttaatcattggaaactcattttggtgttcaaagaaatatttagtaacaagtaaatcatagttaatcagaatgtcaagttaaaattagaatcaggaatatgacagcatttttctttgacgacaaatgtaacaaaaatccaaaaaactgaagaaaaaataaactgccgacagaatttgttccctcataactcacacatctttgtctttcgctaatcgctacaatcaatttgattaattggaaaaagttttctttaacaaagccatgaaagccgctatttgatagattctcaaaacaggtgcaaaagatttgattaattgactcgagatgatgtatgatacacatatttggtgaatgcaatagtcattatatatcacatttaaagtatcaattttattaaagaaaagatatgcgtaaatagcattggctgttgtaggacaagagacaaaagtcacaacattaggcatcaaatcttttggaattaccaataagcaattccctaggttggtccactactaatcgtatattttggtttatataaagattttttttcttgtttttttggagttaccaataagcattcctgccttattatggcccattaagaatttttgttaatagtttgacaaaaaaaaaaaaaaaaaaagaatttttgttaatactataaatcctactttgttcttacgaatattttatcgtatgcaacaagccatgcattatcatcaacaagaaaatctaaactagtaaaccccaccagaaatggctaccgacttatttcccaagaaaacaaacttatcccaaacagaagaaatagaacaatacgttatattttccaaaagcttaagggtaaacaattttttaaaacattatgattcttccgtttatttcgctatacaactatagtcttcacgctaattactctagcttcatttacttcaactgttcctcatcgacgtgacccattttcaccaacttaccgtccaagtttcaaactcaaaaacatttgttctcaaacatataaaatgtacaaatttgcttgactgcatttaatatcgaaactcagaagaatgagaaaaggggtcctacactgtggtctttgcatgtaatctctgaaacctctttaaagtctttggttttggttgttagtgggtcccacttttcacgcagtctctgcctttgaccaaaagtaacctatcattacatttttttaatttacacatattaataggccacaacaaaaggtgttccttcattaatttctcatttgtcattgacacatccaaatctttcaaaatccaacggttcatgatttctttagaaagctcccaaatagttcctttgcacataattaattttctttttcacttcaattaaactattcaacagatttattccctttttgaatggtggaaccatacaataacttgactaagcacaaaccacttacagtatgatttatgtgctcctcctccccacatggtatacacatatgatatacgtaatatgtagtgaaagagaaacgacacgtaaacaatgcatacgtcccaatgtctatttgagagcgaatagcttttgtatactctttttgggtatttgcaaaaagattgagactcaacacagagatgccttatgtattttatttattcacatgatcacatctttatagattctctatccttatattcaaccattcattcacgttttttaattttttttaaaaaattacatttttttaatttacatttttaataggccacaacaaaaggtgttccttcattaatttctcatttgtcattgacacatccaaatctttcaaaatccaacggttcatgatttctttagaaagctcccaaatagttcctttgcacataattaattttctttttcacttcaattaaactattcaacagatttattccctttttgaatggtggaaccatacaataacttgactaagcacaaaccacttacagtatgatttatgtgctcctcctccccacatggtatacacatatgatatacgtaatatgtagtgaaagagaaacgacacgtaaacaatgcatacgtcccaatgtctatttgagagcgaatagcttttgtatactctttttgggtatttgcaaaaagattgagactcaacacagagatgccttatgtattttatttattcacatgatcacatctttatagattctctatccttatattcaaccattcattcacgtatacgtgtgtatatgtattctcatttatatgcatcaatctgagtatatgccaaaaagaaaattaaataattaccttcctttaagacataaatcctcacccgattgcctcgaatccattactttttttttttttaatacgtgggatttcaaattcttaatgttaaaaattcagtggtgaaaatatgctactacatttttaatatgcattgtttttgttttgaacaccgttacttattttatttacagatttaactctctctaaaaatacttgtctttcctaaagcaaagaagcaaagaatcgtgtcctcttacacaatcacaggctttttgcaatttttttttttgcaagtatcatttcttttcttggcttcgaattcagctccctcttcttcttctttattcactttctttcccctttttcttttatttcattataaataaatctgatccgatacatatatggttccttcttctttatgtgcaagaacaacacatggtttaaagcttcgaatctctccctttgcttcgtcatatatctaaatcaccccactcaagatttcaaattccctatatctttgtttttataaattctttctaattttattgtcacatataattgaagcctaataaatcacaccacactgtcttactctgtttttgtttcttctctactctgttttttttttttcccttcaacattgaagataaacttatcttttctctctcaaagactgaaactttatcaaaatg

SEQ ID NO: 23066 - DNA, 3003 bp, Unknown
  misc_feature (1)..( 3003): 2750-1469P.txt file - cDNA_ID_2129769; gDNA_ID_1620353; Annot_ID_154392
gaagcgagcttgcgcagttgtaagagaggtgttggggttaacggttgagaaaaggaccttgattgatcatttgacacatttcaggaaggagttttctttaccaaataagttaagagacttgattgtgagacatccagagctattctatgtgagtataaaaggcatgagagactctgtgtttctcgttgaagcatacaatgacaatggtgatcttctagataaagatgagagattggtgataagagaacgtttgatagatcttattcaagaaggaaagagaattagacgtgaacgaagaagaaaaggcgccacacttggtgataaaagcgtggaagagaaaaggaaagatgatgaaacaattgatgattatgatagtgatctggatgatgaatatgaagatgggtttgagaatttgtttgactcagaagatttaggtgtggaatatcatttcgacgaagaagatgatgatgatgaggcaggggttaatggtgaaagtgtagagtattggagtagaaagctttcgtcttcaggtagtagcagtgatgaagcaaatagtgctgtggaatcatggtgatggaaaatgttaaatagatcgttttgatatttatactcagaaaattgtacgcaattacacaataacataatgtttatgtcgttaatcttattctcattggctttagagctgtgtgtattgatgaaatagttcgggataatggtaatattgaatgggcttacgaaagaatatgaggccttttaactaaacgagcccatttaagcattgaaagaagtcgaaagtcccacatcgcttagaacaaaataagaagttgcgtttatatacaggtagagtcgaagtagtgattgtcccttcggggacatccgataaaattggaacgatacagagaagattagcatggcccctgcgcaaggatgacacgcataaatcgagaaatggtccaaattttttttgaaaattttcccggttagttaatcggtatgggtagtaaaccgacgtgtcggatctttgtcatactcattagtcattaccgaatctagttggtcagagggtttctggataataccttgtaagaacctgaagaagaggttttttgataggcatcattcttatgactatccgagaaggaatcattttgatgaagaagatgacgatgacaaggcatgagcagtgatattggagtagaaaactttcttcttctcctggtagtaagagtgatgaagcaaaaagtgttgtgaaatcatgttaagagagtagaaaaaccatcaatgttttgatatttttgtatattcgaaaattgttgcaattacacaagaacacactgtttctgtttggtatcttattctcatttgcttcagagaagcgaatttagcatacaaaactgtgcgcgttcccttctttattttctcaactgttgttcgagtctctcaatggctgcaccaacaccactcgtgacctcaccgtggtggcctgtgtcaacgttattgccttcgtttgctttcttcatgagcttcagttgtacccaccctgtagaatcaatgcaagtatcacttagttctagccaactttccaatcctccctgatgcttctctatcattctctaaatatggtaatgacttgtaagacttatttatgtaaataaattaccaagagggaagcacactgtggctccaagaactgaaccaagcaacacattccgcgcacgccaagcaagagaccccggcactgccacattttgattagaggtaaaaatatgttaggacacagaaaagttaacatcctgaatctaataagccacaagtccaaaggaggatgcagagagtttgggatgtatcagtactgattaggccaaaaactgcagcagtagctgaaccagctccaaccacattgaaaacatcatgcactcctcgggtctcagctaaaaagttttgtagactaaagaaggaagcagtgaacattccaagacgcatccctccaatgagggagccacgagttactcggatgaaccttttctccattgcatctcgcatcaacctgtgttgttcacgcttatcctgtgtactacccatcttcaacatcacttctgcatctttgctctgtttcaaaccacacacacactgattttaacacaggaaataatattcagctaaaagtcttaaactttgatatcttatgagttcagtctagtaccagaagtcactaagttacaccaaggtagtggaatcgaaacacaaatctcaaggacaagtaacgagcttgaatctgaaattgaaagcagacataccacagaagcagaagcttctttgctccctccatatagcaatcctgcaaatactccaacaacagttgctgttccccagttgggatttccagctaatcttgaagaattctgttttatataacataaaaagcaatcacaccacaagtaaactatgaaccaatcacttaaaaaccctaacttttatgtagattcttgaaatgataatcataaagaacacatattttgaaaagctttgcttctaacaatgatcttatcacagggaaaatgaatataaatacaatttcaagtaagtgatcccgattcgaatgatcttattctatgcatttgaacaatacaaccctaaaccggcttgtcgcttaaggaaaatcgttgagagggaacataaatctcacccctgggattgtttcttcgggtttttctaccgcttccatagatgactgatcaaacactatcgccgtaatctccttctccgccgtagtctctttctccttcagtccaactaaaggtagaagacgaccagaacggtttaattaatcatcggcgatctatcttaaccgatcaaattttcctagaccggttaaatttgtcataaccggtcgcatagaccaatttatgttttcttatgcggaacgtcttcgtattcctttaaaacgctttattttagccgccggggaaaaaattggtgacaagagcagagagagtcgccatg

SEQ ID NO: 23067 - DNA, 3003 bp, Unknown
  misc_feature (1)..( 3003): 2750-1469P.txt file - cDNA_ID_2129800; gDNA_ID_1620352; Annot_ID_154345
gaatttgctaacttgggttttccataaactctcaaatgtttgattttgataaactcttaaatgtttgattttgcaaggaaagaaaaaaaagtaataatgagaagagaaagagagagagagcgaaaagaagaagcgacgaagaagaaggaaaaaaaaggaacgtggagagatgaaactttttttttaattataattttttaattttcaggggcaaattggtcaaaagtttaatgaaaaagttggaaaagtgcctcatccctgacaagtggctcaaaaggaataaaattctctaaaagtgcctaaacgtgtcacattccctattatactccctatgattttttaaaaattaattttctagaaaaaacatacatattaaaatatatattaaaaggtgattatatatatatatataagttttgtgatttacatttcaataattcgaagccaatgattttcaattatttttcttgaagtttacaatttatctatgataactaataaatattgcatagaaaatctaaaagaatcaaattttttaaaacaaatattttttttagaaaaccaattaattaagaacagacggagtaatgtattctttaaagtgtttaaagagaatattatttcttaaagaatgttaaattgttagaaaacttatctttgtgggacgaagaaaatattattttcttttaaaaaaagttttgtattgttaaatctaaacatatacatcaaactttaaaaatcaaagcaaaaaaagaatatctctccttttgcatgcttttgacatattgaatttaatagctaattttcttaattaagatgttaaacttatggattcatgatttgaacaaaactgaaaaaaagtatatggaagcgttggtgagattcatacctatcaaaatgaacaaaaggatcaccaaccgaatagtaaaaccaactactgtattttttcttcttctttcttaatttctctctttattaaaaatttgttaattatatcataatcttaactgttgtatataaagtatttcttcctaaaatatacaaggtgtacgcaacaaatgccaataaaaatggtttcaaattaaaaagaaagaccaaaactcatatgaacctcaaaaacatagtatgctacttttagttaaaataaactttctcatttcaagttctattttttttgtcattcgcttagttattaatgctcaaaaagccatttctgaggattgttatttacataagtgacatgaagcatcacacgatctaaaagctgttagaaccacatacgaaggcaaacacaatcactatgtactaaccgcaaggtataacaacaacaacaacaaccatgacatgtcagactagttgtaccgctaacacaatcagcctcaacttaggtgttgaaatcgcatcggacacccttgaccatacatcaaacgagcatccacatccacatctgcatccgcatccgcattcacatcgtgttcgttctgaacttaaaccagtggaacgctggattcaagtttattcatggaccacccatgggaacctgctatctaagtagcactaatgccggtataatcatcaatataacggttcgagagaaacgatcgaggctcaaacagatgacatctcttcctgttatccgtatatatccacataacatagcaagaatacaatatggtctctagaggaggatggtctgcacaaaccaaccacagtaacacaataaagaaaaagaaaaacaaaggctctatacttgcattatttatcttgattcttcctaggttaggaatggaataacattgttctttgtaatctatgatctatatgtatgtatgtatgtatgtatatcatgacacactaagatagagatattggtcttaatctcccaacatatttatttgttttttattaattcgaaaatgttttgtaaaaaaaaaacacaaagctttatatgtttccaagaaaatctgattgcagagatcatcaacatcagcctgtaaagaatcttctccatgactgccatggaagaaacccacctgcaaataaaacagaaacaaacactaaagtatacttttacattttcaaaatgtaaaagaaagatatagagagaaatcgaagttaccacattcaggacaacgaaaatactttttgtctcgagaaacaagtcctgttcctccacattcttcacatctcttctgtgcaatctgaaaccaaaactcatttttcaatagacaacacaaccaaataattaatgtatgtgtgtaataatacatactattcttttgctgaattcaacacctgcaacaacgaatggtatgattccagctgcaagatcaattgatttattataagcttataagaaaaacacattttttaatcacatcactaattagctaattaattaaattaccaatggttccaactataatctgccacgtaatctccgatttgcctgtctccgccaccgtgtcagctagttcacttagagccgacgtcgttttgagccgtcgattactcatcgtcatcatgccgccgccgccgccgcggcttcttcttcttcccggagaaacgaaaccagccgtggattttatctgacgtggtcttgatctaacggtccacagagacggaactctacacagtgaagaagcctccattgtcgccattatgactcaagaaatcaaattcaccgatgaaaatatgttaaaaaaattgggccacgtcgacgttatttcgggtcgggttcgcgccaaccgcaaataccatcgtgtggctttaaaaaagctgccaatcaaaaatatattctaaaatacattaaaacgacggcgtgtaatcggaaaacagtaaacgccattagagtcttgtgtgtgttaataatgaatctcaaaacaaaacttttttgtttgtttgttttggaattagggttttagggtatattcgcaatcactctaatcggataattcctctactctgttaacattatcttcttcttcgttcctaccgcaaatg

SEQ ID NO: 23068 - DNA, 3000 bp, Unknown; identical to SEQ ID NO: 1058
  misc_feature (1)..( 3000): 2750-1469P.txt file - cDNA_ID_2129808; gDNA_ID_1620352; Annot_ID_154347

SEQ ID NO: 23069 - DNA, 3003 bp, Unknown
  misc_feature (1)..( 3003): 2750-1469P.txt file - cDNA_ID_2129812; gDNA_ID_1620352; Annot_ID_154348
ggacaaccttataccaagcttgtcaggcatagcagatttaaaagccggcacccattcctacacaaaacaatgaggaaaaaaaacacaattaggtgacaaacataagattaaaatagcttccatttccagaaactaaaattaaacagccaatggctgtggaagcaaatatatacctcaaggtttccatatccatcctcgtcctctatatcatcatactggagttttacctgtttccttgatacgtccaggacagtgcatctaaaccaacagcctctaataccgctatcttgacacagaaactctatttttgcatcagtcttaaccactccgttgtaacaaggatgtttctgaacattggttggtgaaggaaatcttttgcccgaggcattaagttttagtctcttacatgaagattcgtaagttgttaacagatgatcagacataattcttgctcgttttttcatgcttctctcagcaccaaccattacattctcaccctcactccattcttcatcttcctctatattcatcgcacagtctacaggaccagcctccatagaacttaagcaagacataatcggttggtccaaatatccacgcaatttactcaaatcaaaaggtttaactttgctgttcctgagttgccgatagcacatgtgtacccttgccaataaagaattcggaaaggaagccacacactcctcataatgctcacgggtcaagacagtggcaggaccatcaacacattctgcactgatgacctgtgaatgaggggtgataaaaacctcttttgggtttgggttcttgagagcaactgcacccttcacttcttttgtgtagtgaaaccacctcactttgaccttttttaggccacgcttatcctcatacatatcttccagatatgcaacgtaccgatcctcccctttgctcaagacaaagacaaaagattgaacctgaaaatccaaaagaagaattacgcctccaagtgagtagtctcatccaagatctttacagatacaaatcacaagaacagtcaacatatatcgaactatgcatgcactgatgccaagtcttcaacttacccctattgttgtcccatttctgcaaaatgatgggtaatgtttgagctgtttaccacacatccaaggagctcctgaccacataatctcccaactgtgaataatcaagtttatgggaagacggacctgtaagagagattttcccatcagtataacaggaaagtaaaatgcagtgacaattgtatgagagcaacaagcagctaaacatcacctcttcacttgcttgagctcgctgagcagtaaatccattgcttggaaattcgggagatccattagattcccctgactcacattttggtgactctgtaaatgacaatataacaagtgctttagaataatcagttataaagttagaagagaccaacataaaggaagaattcattccttctccactcaacagacaatttgtcacatatggtaaaagataaagataaatgcgtactcgaccagtttccttgtgtactctgcttagacagcattgaagtgagccaatccacaacttcccttctcgacctccatttgaagccagaatgaattgaattctcaggaccatgaatgcgcacaaactcctcagagacaacatagaacatgtgcctaacacttctctcagtaccaatgacagctaggatagattcaccggcagaatccttgaggaagtaatgaacaacacggttccctcgctcttgggagacaaaatgctccttccactcgacaaaatgatgatcattctcacacatttttcaaaataaaattgattcggcaagcatcaaacgctccaaaccctcctttacatcagataaaaacactaactactgccagttcaaagtcaaagtcttttgtcctaaatcaagttctaaagcaaccccaacgcaacaatctctatataccaatgacagtggaaacccttaaaaacctttaatctaatgaccaaacaatacccctaaaatcaatcccctgtgccgtggaaatcctaaagcaaatcactctaatgcataactctgatcaacatctttcccagcttcctacaacacagctaaatcgtcgaagtctctgtaaatttccagcttttaagaaatcaaataatccggacgaagaagaagttaggattagagaaagcagataagaacccagtgagcggagagttatgaagatctgtagaaagatcagagactaagccatggaaacactgatctaagctcgagagcgccgccaaacaccaagatacgactttgactgcggtaatcagcttaagcatgacgaagacgaaatgggcatctcaaaattttcagcttagaatagatttataccgattcctctaaggtttgtacagaacaaacaaatgattcaggagaaaaaaaaagtgaactttagaagcttagaatagcggcgagaagacaaaatcgacgatcgatttcggagatggagaagaagaagaaaatgagttctgattaaggtaaacttggagaaaataaggtattcccatggatgatgatctctcttctctctctctctctctctcaaagtcacaggggtttggcaaaagcagctgctttggtgaaggaagaagagagagagaagaagaaattgtgcaattactacgaaatgacgagaatatcaggaagttattgggccttatatgggtctttaatgggccttaaatgaccgtggccgactaaaaaaaaaagtcaacgaaaagtcaaatagatctctgtcttttatttttttgttctctctcgtctctctggctaccgagaaaacagagaacgttaagaatcattgcttttctcgagaaaataatatttttaattgaatcgagaaactcttcaaagttgaattaagaagaatattacctcaattgagatttgagagacacgcatagagagattgattattgcatcgaatcaagcttggtttgttagtaatg

SEQ ID NO: 23070 - DNA, 3003 bp, Unknown
  misc_feature (1)..( 3003): 2750-1469P.txt file - cDNA_ID_2129831; gDNA_ID_1620352; Annot_ID_154355
gatgatgaaaagcattttactcggtgttgctttctttcacagctgtcactgctgttttttcttgtaaccctaatttcatctgtagctttcctctgtttcttgaactctcaaggagtctcctctctcacaataaccatggcaatcttgttcgtctcctcttctgttttcttgttacgaatcttcaaggaaaagacaagactatgtttggctgaggggtcccaaggagaaggctacgattatgaagatgatgatgatgatgatggtctcattgagattgatcttgtgagcgaagaagcagagactatagaggcaatgagaaacattaatcaaagtcgactgagaattaggattgaagaagaacaagaagaagatattgatgatgtgaatatggaagaagataatcttattgagattgatatttccattggatccattaaaagacgaatgtaatttagtttaatagatctcatgatcacaccatcgtgtaatccgattttttcatttcaaatgtacaaaggaaatccaacattttaatatattattgttctagatatttggtgattagggtttagggttttaggagatatatatcaatccctttttatagatgcatatatatatatatatatatatatatatatatatatagtactaattaactgtggtagttcttttgcattaagattgtgtaatagattgttgacaaaagacaaaagattgtgtaatagattcctgaaaggttttgtaaaacaaaacaaaagagttgcaatttcttcgaaagtactctccgagcataccccaaactccgctaacttattttctatgccaaaacacttgtctttctcttattgcagagtatatttttcttcttcttcactatatcatttaaacatataacttctttttaccaaatttttggttattgaaaaacacttttcctttaactttacgaatcaatatacaagcataacttataatcatccaccacactaatcatcatgcactttgttaattgttatggcttatgagtcttatgacttaacatcctttttaatctggtaaatctagcaaataggaatcctctgcaatctgaatcttgtttcgaaatttgagagtatgttgatcttgcgaaaatcgaaacaatctttgcaatgtaagaagatatgaagccgcatatgactaacaagaaagttggtctttatgtcgtctaaatcagaatataagagcatctccattgcctatgaaactcaggagagttttagaaaactcaaatattaatatttaatttaaaaatattggaccatgaaatatgtaagcggaagagccacaaaacaactattattttgtttttgttctttttttagctaaataagtaataaaatattcaaaataaaaagaaggaaaaaatgaaaataaagaaaggaaattcaacatttctatatagaattagttattaccattaagttaaatctaaaaaagaaagaaatcttatccttttaaaaaatagtcaataccaaaattaatttcattatcaaaatgtaatacacttattatatatggaacaaaattgtcaaatacaataaggttaaaatctactttacagtattgataaatgataatcaatcatgactttattgagatatcaaatttaaccttatcatcaaaacataaaacatagtatagtatatatgagaaaaactatacaactagaaattatacgtagaaaaaatcgttaaacacccgctaaaaatcatactataaaacacaatagtatacatagaaaaaccgttaaacacccgccaagtttagtaaaaaaaccgttaaacacccgcaaaaaattagtaagtatacaaatttattttatatgatcacaatattatacgtagaaaaaaccgttaaacacccgccaaatctaatactactaaatatcgatcataacttcattaaatgaaaaaaaaactcaaacataatattaagatctacataacttcattaaaatgattaaagatctaattatttttcattttttggggcaaatatttagatcttctaatctaatagggaatgaactcaaagaaagatatttgtgtttgaagataagtaaactgtaccggaagttgggttgtgtctaccgtcaccgatccacgagagtatcgaacacgaaatctgaaccgttcacaggtccgacgtggcaataaactgtatttaaaatccggttttgagtctgaatccttaatagaaagagatcggagcgttggtatcccttttttcttctctgattcgaacagaataaataagaaccccaaaaaaaaaaaaagctcactgctttgaagcctttggatagcgaaggtgagattccaaagtcttctcctttcgagtctctttgtacactctgagcttgttctctttgtttagcggttgaatcttcatagcttcgtttatattcgcatgtggttttttttttttttggttttgattgttgtcttgcttcttgaagtcgcgtttagggtttgtgtttttttgtgttctctttgatttgtgaatttgtgttagtttagtttaggtttagagagagactaattttgatttctgtatgagctcttggattcctctgttgttgtggtttggatctaaatctatgttttataccacaaagtattcagattgaggaaaattttggttacccttcgtttttgatttggaattgaattatgaagaacttattgtatgttgtctatttcctttaaaaattgaatcttttttctcaatttctcgtgttagagcccattgaagtttttattgagttgtatgtagaaagatgggatgcaatgaagtttacatgttgatataagttttgggttatgtaacccttcttttgcgtgacttttgtttcatgaaatttctgccgctattgtgtaagtttttaacactgtacttatattttctacagcgttctggtgttttctggctttaagatctactgaacattgggtgtgagcaatg

SEQ ID NO: 23071 - DNA, 3003 bp, Unknown
  misc_feature (1)..( 3003): 2750-1469P.txt file - cDNA_ID_2129845; gDNA_ID_1620352; Annot_ID_154359
tgaacatactgtttcctaaaccccaatgtattggctccatataagctgtcctctgtaccatcggaccatatggaccatccgaacaactcccgtaaaacaagctttgcccgttcgctatcatcggctctgtcacattcgagaaggaagacacttccgcagtatttgaggtcatctggttattaaaagggaagaaagagagcccgttgtaatccatagtaggcagaggaaacaactgatactgctcaaaacattgccgattgtaaccgcataaaccaagttggtcattagaccaacaactagtgtcaggaaatgtctgattcctattcgtagcctcttggatcttgttttctactgccatgaaaaccgcatagaggtcatttaaagaacactggtcgagctttttgtcccatgtaggatactttgtcgcaatcgtcggtttctccaccttagtgttgtttttctccaagcattcttgcacggtgtatgtcttggtgcagctgcttgacgcagtgtctctgtacttggttaagatttcacggactttgctcccatcctttggccataactcgggctccatgaccatttcgtcccctgctctgctcgggccgtacacaatgacacaagtgtccacaccgcagagtgttgagaactcactggctttcttatacaaacatgctttcctcttcttgtaagtcgttatcctcgttttctcgttcgttatcctcgtcatctttaccatctttcgacccatccagatacctttgcttcaatctaaaaagccataaaagagtaaaacacaacaatagatcataatcttgaaaattgaaatagtaatatcatcatttggatgtaacgatcagctaccaaaacatacagaaacactacaaatttacaaccaaagcactaatactagtaaacattttgttgtcaataaaaaatttgtaactcatatagcttttaggtttacattttaacatttcatagcaatgtaagccttacaaatgtatagggaagaaagattcatattattttattctcaattttttcactaataagcataatccttatcgttttgtcaagcttcctatgcataattccaaatccatatacgattaacacgaatagtaaaacagatgggatattaacataaagtaaatgcagagtgattactagaagaaaaaaagaatgtatataataccttctttaagagctctactttctgaagtttcttgatttaacaatggagttcctctttctgtgtttatataagacacacgcaaaaaaagaatatatgttttttttttttttttttgtcgtaaagaatatatggtttattctcgaatattgtttcctcccctaaattacggtagcaatgctgatattttatttctttccatgttttcgagtagaattaaagaggacgaagctatacaaatctttagtttctatgttcacgcacaagtgataagagttcagttaaaggaaaacattgtaattacagcatgatcaagaaagaagattttgtttgtgatttgtgccaattaattttctcaaatattccttttttgctttaattgaaaactttgttaatattcttacggaaatttggcgccggaggtggctgaggttccgtttgcaagttgcaacaatgttcttattggtcttcatggccactttggtagtttggttgtatagaaattagaaaaaagattaaagtttgttgtcgtaagtttgtcacacttctgtgatgactatttgtactgatactcgatagttcattttaatataatactaggagacatcgacaaataataaatttgtttcataaaattttaaactactagtagctgttggtgttgatcgattgatcggtaattcatagcctttgaaatatacatttaacaatttcaccaatcaccatatgctcatacgcactggtatgtaactaaaaaatgactagaacttgtaaaatgtcccatgcaattattacttagtgcgtattttgaaattttgtttttttatcctttattatctttcacattcgaataaatatcagctatatgtgataaacaaagttttgccacttgatgagtagtactacgagactgaaacgtgacatatcgtggacccatgatttaatttgatcaaactatatgacaatgaagacggaaataataggttaacttaaatatgtgagacatttttcgtatactatttatatgccaaattcactactataattggtaataggcagtgttgatggtggcgagtagcatgggatatgttctaatgggatattttacatgcttatccactaagggacgatatgtttccacgtcagcaaaatggttaattccattttctttgttaaaaaaccttattcaatggatatttaatatcatataaaaaaattaccatctaaaagtacaattagtttgactatatgctattcaagtcctcatagttttattattcaattataagtcagtcataatagaaatttaaacttgtttccatgttacacattaaacaccagtttgaaaaaatcaactctgatttttataataaaataaatgtaatctcaatcatctcctgaacttcaacaagtaaaacgttaattagttttgataatttcactgatttgtttcataaaaacacctatactcctataaataattaaatattgtaggcacgaggtatatagtagagaacgaaagttggggtcaattatagaaatatttaaaacatacgggcaaaaaatagaaaataaaggcaataaaggaaaaagtatagggtcaagaaggaattataaagttgataattttcttgatttaaaaattcagtatatatatcagaaaagccccaaataaattttgggtcgttaaaaagaaaagaaaaagagaaatagaattttgcgtttcaagtactccatctccgtctcttttcctccgcatctaaaaccatctgagaaatatctccgacgaaggagaagaaacgaaaatg

SEQ ID NO: 23072 - DNA, 3003 bp, Unknown
  misc_feature (1)..( 3003): 2750-1469P.txt file - cDNA_ID_2129864; gDNA_ID_1620352; Annot_ID_154365
atctcaccgttcttacaaagagacgaaacgcgatgaaagtaagatgtggaagaaggagaatgagcttgttcatcgtggtgtttagaagaaggtttcgatgatactgaaaatggaactttattcgggatagtgttgaaaggaagagaagccattcatgcctctctgataaacgtctctgaagataaaacagagttctttcgaatcctcgtatttaaattattttatttattatctcctcgacttcttttcgtaaaatgttctccaccgttgattcttgtggcaaatacagacacgtgtacggttttcatctgttactcgatacatatttgtaccgatcgcgattcgtatgtgtaccaaccggttttcgatttgatctcggtttagttgaattataacgttgaaaaatatataattcatttattagaatatacttcaaaagtaacgacaaaaaaaaaatacttcaaaagtatataaacaaaaaatttgagataataacagaagaagaaggtgacattttttataggcttttaatatttatctgaaacctatgtatgacctaaaagacaataaaagcattagctaacacaagcatcaaaacatatacgggaatggaagaggaatagtaagccatcgctgaaccggttgtaccgccttcggctcctcctcctcctcctccttggccgccaccgccttgtccccctccgccaatagtaccgtaaggataaggaggagtataaaaataaggatacggaggagaatacatcgtcgaaggtggtggacctggtggttggttgcaacagcctgtcgtcggaacaggagggcagcgagaacgtggcggtgaagactgtgaaggcggtgggggtggtgaatactgtggagacggtggaggagggttaccatatggagagtagcctgtagaggacggtggttgaggcggttggttacatgggtaaggagtgcaaaaaccagcgtttgaatccaaagctgagtttagattgacacagtttaaaagtgatagataaaaggtaataagaggaacagagagagaagcttgaagagacaacatgatgatgacttagagaaaatgatgagtgtttggtctttggttttgagatttataataaaaagagatgaattttttcctcggtttcgtattatctgccgcatggcattacacatgtcgggggtgttggaggatttctgaagaaaacgtttgtgtcttttagctgatgtagacaaatttttgtcatgtaatgacaaattaaaacgcatttgtattactttggaatatatagatatataccgatcggtaccattttcatcaatagatgtcccaaagaagatggattatgagtaacatgagttttaagataattgtgacaagtcgaatgaatcttttgctatgggaaagatgaagaactatgaattgtttcaagtaatcaaataatcaaattttacgttgaagacggggtttacacgatggataatatgtggctccaactaagctgttgcatgctcccgagttgcaattacattcaatcgctctggcccatgtagtgaaggctgacaagagcaaccagaaaaaagttgatgagggtcatttgttagtaaggtgctagccttcacaataaactgcttaattatgataactttaaccctcgctttgaaattaccatcgatgatggctttttggacaagtttggaaaaagtatccaccaaactcatgatttgcttgtgcattcatggtgctgggtgagtttgttttgactagtctgttgtaggattcaactacttttcaaatgatgcacaagctagtgttgaggtgtgactacactttcggacagtattgtatccgaggaaatattaattctgatggtgtgggttgtggtcttgtcgagagtggaatgaggactaacataacccatatttaagtctgcatgctgcatgttttttattaaaaaactgtgtgaggtatgttaatcttgataaataaattgatgatatataacaatacttatttatgaaacttagatatgttataagtttattcaccaaactgaattcaaaatggctttgagtgatgagtttcaaaccggttcgatagaacaagattttaatctaatataagctcatggttgagcatgcaccagaacgtcacatagaatcaatttaaatccatagtaaaccctgtcatatggtttagtattttacaaattacaacccactttatcaaatggtttcaatattcaatgtgttgacatttacctatatattttaaataataacaagacgataaatttacttatttaataactcattgtattggtttaaccaattagatgaatgttgtttacaatgattcaaggataccgaaaccgagttcaagttttgttataagatgatctacaaccgtgagcttgacacaaatattatcagtctaattctgggactaaagagattatggatcacatattcataatttcatgattacataaaaaaagtaaaaataaataaatgatatatagataaaaattggtgaaatgtattaaaagttgcaatgatatcacccacttaatttagctatgatattttaggttaatgtaattaatgtttttcttatatcaaatttttgtttagccaaactaaacaaatttgagaaatataataacatgccataaaataagttttatatgaatccaattaataccctaatttggattttcatttaaatatcacaaactttaggtttatcagggaaacataataaagaaatgttatataaaaatttagcaacacttttaaaatctaaaatctctgatattctgagaaatgtcaaaaaaaatattccagattgcatataataataaaatcataataaaaagaattaaaatatattgatacttcataaatagaagtcactgtccaagtctctgcttttttatacatcgagaggcagagaaggtgttcttcttcttgtccaaaagagaagacaaaacctaaatg

SEQ ID NO: 23073 - DNA, 3003 bp, Unknown
  misc_feature (1)..( 3003): 2750-1469P.txt file - cDNA_ID_2129881; gDNA_ID_1620352; Annot_ID_154369
tttgtttttttttttttttttagtttcagttgtgagatgtaactctttcatatgtgacttttattttcatttccttgaattttttagccacaagatcaattaagttacaataaaggaaaatcattgtcagttggctttataatattatagcttttacaagaaacaaatattatatcgcaaaattcagcaaaggagataatttaatgaaatttctctgttggagttttgatccttgaattgctattggaattcttgattgctctctccatctcctttgagttatctttgtcttcctatgttttttttggatgatttgacaaagccgtctagtcccaacattcaatttacatagcaaggtttcgattttttcaaaggacatgcaccaccaagccaagaggagagagaactaaaattcttaccgatcacatcacactccatcttgatctgaacaacacgcaatgcctaagattaaaatcacatttcgttacctgaatttccgggaatttctataaaaaaataaatatcgaagagagttcacttactagaaaatataaataatgctttgttcctctaaagagatctctttcatgactagtccacatagctcattttcatcaaaacagagatctctaagcaagtgtaatcaggtgtcttgcttgactaataagcatcgatcgtctccgagtctaatctctttgtccctttgactgttccttttacccattcatatcctcactacgtgttcatatctgcctcttccccacccaaccttcattttttaattaattgtttttcaaattttacgtactttacaaaactaactctttaccaaatcaagataatttaataataacttgaaattgattggagtgggggatagagaaagatatagacacatctgtaataagagagaccatgtgttgttacttgtttttgttgcagttgagtactgacccataactgcaaagtttgttgtccaaacaaatactattattttctaattaaaatatataataaatttaatacattgatatatatataaatatgtatatgtatatatatattttttgttcatgttgaatttaatacagtaaaaggttaattatatgttttccaagtggtacttctttactcttttttttaattggcaataaatcttttcaagtgggagtatattttaaatttttttttttttttcacaatactgattgcaacttttttgtttgacaagttgttaactgttaggaatctcggaattgaagtcatgacatgttctcgttcccagatgggatcggaaaggcttgttccaatcgagagagtgcatttttgaataaaactatataatctgtaatgaaaacaagatccggaagagacggtctcctctataatcaaaataaaatataaaacgattgtaaagctattccaaatcaattacaaacgactttttttacaacaaagaatataaaaagaccaagtttagctgtattctctagttttatattaaatgaccagctaatatatatgtgcaattttttaaagagaaaaaataaatatatatatatatatatgtgtgcaatgggtgagatgaaagggaagaagaatatcactatcaaaaaaaaaaaaaaaaaatccaaattcccattttagcagccatgagttctgtgggtgtatttagtaagaaggaaaaggatggaatataattttgggtattcacattagcacaaacaatagatccaacctcctcaaatttcaggctcaattaaaaacgtagtggtggacaagtaatgatcaagatgagatgttatagtttcataaattaatagtaatattgtgttggttttctaataagtccaacaaatcggaggggacataatttttttgttccagttagaaacaactatatagttgacatatatgttttaaaatttagacttcattactaagaaaggaaagacttataagagtttagacttttagtgatttgagatcaatataataaacgactattctttttataataaagaatttagaaagaccaaaaataattagttgttaagaaaaaaaacttagctgtattgacaagtttttatattaaatggttggctattaggcctgttacggatccggatatccgggatttttgaggtatccggatccggatccgtatccggcggatccgtcatttcagtctctggatccgtatctgccaacctcggatattcgggatcctgaagtctgtgaaaaagtacgagtatccgcggaccggatccgatccggtttttttttatcatcttctttcctcccgaacacaagcaaccgaacttcaccgccaagattctttccagaaaaaacagctccaaatctgcaacgaaagagtgaatccaacgccaaggggaagaagaagagatagaggcagcggttgtttcggtggaggttgaggatgagggtgatttggtggaggaggatgacgatttggtgccatggtggtagagatggtcgtttggtggaggctggtgtcgagaggaatgagtgaggaagataaaaggattaggttttttggaaaatgggccaagatatgggctggaaaatatcataattttaatttttagtatggcccaataaaacccataaacataaaacattgaatattaccggatccggatatccggtcatattttttatgattatccggatccggcggatataaaatattactatccgtatccggaaccgtttcacacggatatccggtttttcggatcggatcccggttccagatacggatacccgcggatcccggatatttgttccagggctattggctatatatgcaagagggagaaggagaagaaagatatcacaaaaaatttccaaatccccattatcgaaaccatgagttccgtgggagtattttgaaaggaggaaattgatggaaaaccatttttggtatacacattaacacaaacagacaacccaaactcctccagtgaatcactggccatg

SEQ ID NO: 23074 - DNA, 3000 bp, Unknown; identical to SEQ ID NO: 1051
  misc_feature (1)..( 3000): 2750-1469P.txt file - cDNA_ID_2129887; gDNA_ID_1620352; Annot_ID_154370

SEQ ID NO: 23075 - DNA, 3003 bp, Unknown
  misc_feature (1)..( 3003): 2750-1469P.txt file - cDNA_ID_2129894; gDNA_ID_1620352; Annot_ID_154372
attttccccctattttgatattccggctctgtgagatgtaattttctatttcgtttattattttttaaaattttatgtaagatgtaattttctttttttctctttggtttttttgttaattttttttctgaacttacgtattatgttttttttttttttaatgttcttgcatttttaagccacaatcaaatatgcagaacacaagtaaaaaaaaatgcagagagttcacttctagatgtccctagctttgtctgaaacccagctataaacaatgtccatccccctgaatcctcaaaaacaagtcatgggtatttcatgactagtccccagctcattcttatcgaaacagagaagttagactttgacgctgattttgaaaactttcaaatatattatatagaagtaatccatcatcagtttcacatttctctcgcctcttttgtgtttttttttcttcacatttgttgtacatatgaatatgatacaaagagttgataaataagaaccttaaaatacagagactcaacaaatatatctgatctgtttatcacaccattatttgatgagttgtgttgtaatatttgatctgatgaagtataataatcctctcagcgtttgtcatgtgagctcagtgtatagttgatgttgtctgatataatctattactccatcttcagtcaagtatttaaccgataaccctcgcgaaatgcattgcctgaaagaagcagaggaatgagcaagagaaatcattttttagtgtatatgaactgttctcgggaaggataaataaatctcacactaccttaatctactcgaactgatttgattaggaacagtattgtcaacgattttgacgttagcctgcgaaagaaatcgagggggcactattcagtaaaccatgtgcacaatcacggactgatacagcagagtcagaacagaaacctggtaatacttacacagttttcgtttaagatttcgtcaccagagatcatattttcaacatcttgtccttctctacggatgcacacaatgccataatctttgcaaatagttcttaacttcaaaaaccaagtgttgaaaaaggagcataactgtgagtaaatttgataaacacatctacgtttatataacaatgctaccttggtttacctgttcagggatccaaacaccgggagtgcagaaagatagcagtaaatccgagccacatagtagcatgactttgagagattctagcattagaataaatttgtgtttgtcatttgcgtagtggctagcacgtatgataaaaacatagcaagcaacactattcagacgacccagcaattactcccaaaatgtaagtgagataaactttgaatagaaagatgctaaaggcgacacaggacacttcttgcagttatcttaccctcgggtacatgtcgatttgttgttaagaaagtcttgacccttgataaaaccgtcaaagttcgttggtagttgctttgagatgcctgtagaaacagcttccacatttttgtaaacaacgcattgttccactaaagagaactgattaaaagcttttcgaggaataagaaagtacctcccacggatcaaccattacaaagtcagagctttgacatgatacattacacatctctaaacgatgttctgcagataaaaggccctacacataatctgatgaaattattagttctaagggaaactaaacagaatagtaaacagaagaactttgggagctaaaaaagaaaaagaagctcttagtttcatcacacataacatgtccattagcataggttcagaaaaaaaagagtcattatggaaagaaactaagattctcaagatgacaaataccttcttcttatatgcatcattaacaggagacatatatcctccaagaacatgaaatccttttgagcgtaattcatctctcgccagctctagcgacaaaaaaaaggaagagaacttatcagtttgatgtaaagaaacatatacatttgaacaaaaggtcacagcaatggacaagaatcaacaattgaaacctctaagttctgcagttcattcttgtcatatgccggttttataaaccaaaatatacaaagctaacacaatcatatactcaagaaacggtttcactcaagaagtaaacaacaaggcatataatcttaagctacttttgactataaaccagtattggattttcccattgaaacgagtcaaaacactgatcattatgcctcaaattgtgaaaactttcggattgatagaatctgaaacgccattgataaacatataaaaaaatgaattatatatctactctggtaaaagaactgaccaaacatgcgtaaatgcatgaaagtaggaggattgaaactcccagttgccacaagcactacacaagttttgtccctgtttcagacaaacaatcgaaaatattcaacacccggacggaattttaataataaacctggtgagaatctcatcatcataagtaaccaagcagatcaaatttacaaaatcagaattttcacaaaaaagacaaatgaagggaatcaaaatcgagaataagcttcaaaatttactcagtgtttgatccataagataatttctcgactggtaacgggacatccattgaactctgatgattgaatctcagtctcttaatggtagctccggcgaatgatcagggacagcgaaaataagacgacgacggcgaaagtattaaaagatagagagaaacgacatcgtatgaaaaaggtttgttaaaacgaaacgttttacagctaacgagaagatagatattagacacaatacgaagccgtttaaaactaaacgcatcgttcaggtagcgagggttaaaaaagctaaaaaagcttcattctatttttttcagtgaaaaacgaaagcgaaaatgaaatctttatccccaaaattttgaaattcaaatccgcgctaacagtctctctctctctctcgctctatctctagagtaggtcgtcggcgatg

SEQ ID NO: 23076 - DNA, 3000 bp, Unknown; identical to SEQ ID NO: 1089
  misc_feature (1)..( 3000): 2750-1469P.txt file - cDNA_ID_2129965; gDNA_ID_1620357; Annot_ID_154538

SEQ ID NO: 23077 - DNA, 2076 bp, Unknown; identical to SEQ ID NO: 1069
  misc_feature (1)..( 2076): 2750-1469P.txt file - cDNA_ID_2129994; gDNA_ID_1620355; Annot_ID_154448

SEQ ID NO: 23078 - DNA, 3000 bp, Unknown; identical to SEQ ID NO: 1079
  misc_feature (1)..( 3000): 2750-1469P.txt file - cDNA_ID_2130009; gDNA_ID_1620355; Annot_ID_154453

SEQ ID NO: 23079 - DNA, 3000 bp, Unknown; identical to SEQ ID NO: 1077
  misc_feature (1)..( 3000): 2750-1469P.txt file - cDNA_ID_2130020; gDNA_ID_1620355; Annot_ID_154456

SEQ ID NO: 23080 - DNA, 3000 bp, Unknown; identical to SEQ ID NO: 1076
  misc_feature (1)..( 3000): 2750-1469P.txt file - cDNA_ID_2130032; gDNA_ID_1620355; Annot_ID_154459

SEQ ID NO: 23081 - DNA, 3000 bp, Unknown; identical to SEQ ID NO: 1075
  misc_feature (1)..( 3000): 2750-1469P.txt file - cDNA_ID_2130043; gDNA_ID_1620355; Annot_ID_154462

SEQ ID NO: 23082 - DNA, 3003 bp, Unknown
  misc_feature (1)..( 3003): 2750-1469P.txt file - cDNA_ID_2130072; gDNA_ID_1620358; Annot_ID_154551
ttttgttgactttcgaaataaatgagaaagtgtttgttgacttgccatttgagtcatgtcgttaaataggttcaaaaaaaaaattacaacgttaatgactcgtttatttgctctgttagaacaaaacaacgtcgtttattgcacagaccaaacaacgtcgttttgtcttgaaacaaatttaaaccttatatccccaaatcgatttcattatctcgaaatcacagacccaccttgacctcaaaatcgcagataataaaatcgaattggagattcagggtttaaatttgttttaacagacaaaacgacgttcttttgtctctcaataaacgacgtcgttttgttctaacagagcatatacacgagacattaacgccgtaaaataattctgttaacctatttaacgacatgactcaaatgggaagtcaacaaaagctttgtcatttatttcgaaagtcaacaaaaactttacgatttatttgtcttccgtgaagttcaagattaaatcgtcccaaatttgaaagttcgtgatttttttgacaattttcccgtataaaaaaattctattagtattttataataaatatcatataagaatatcttttagtgcttaaatatattttaataaataaaaacagaactagaagtcaaaattaaacgataaattattctgttattggtcaaatatatattgaaacttgatatataaaatgggatattcaatattgacataactattttcagttttaaacatgtataaaaaaagaactttggcaaaaatttattaaaacgaagttgctaaaggagaagaatcaatgtagtggaacaacaacatgctcatgagaaaaaataaacacaaaattaaatgatcaaaattttaataagaaagatggatgttttttttttttggtaaaagaagatgggtggattaattttgatttaatgacgatcatttaaggtcaagaacaaaaaaacataacaagcaatcttacatataaacaacataacattaaatatctaataaatatgcctatgtaaattttataagaaagtgaatgccgtaggcgagtgtttctaattctatcaaataggcacggctcttagatatattatgcatgaatttgaatattcacatataacaatttaaacatgaaccacgatgcgaaatgtcttaacgctaaaattgcaatgcttttccaacataaaaattaggggagaaagcagaaaactttattaagataaggaccttttatgctatatgagcctatatatgagagtatatttaaagtctatatatggtatgcacatgcaactgcatgaataatttgtatatctagtgattaatataatatattaaactaaaaccatatcttatgtgtttttggcaatgtaacttcacatgatctgcgagcatcttacaatcattgacgtaaagtttttgccttgattaatagttgttgttatattttactaatatatgttgtttgctgtgctgttgtgcatatactattatagctgcatgtgcggccaaggaacgatgacgaaccatgataaatgggaaaatgattgtttacaacttaatttattttctccattacaaacaaatttatagctttttctattcccaattgcttaacatagccgtctcacaattagagaaagcgaaaacattaattatcccaatacaataatgaatatattcaaacgccgaagggaaattgtcaagagttgttaaggttttaaaaaccttaaacttcaatacaaccttcacagttcacacccttagaaaatggtccagttttggcccaaatatttaacaacatttgggttacgagtatttgccctttacaaatggatcaacaatctccctggatcaatatttagtggccggtttcatgaatcaacatattctttttttttttttgtctaaagaatcaacatattctaaatcaccaaaacactttggtcaacaattttcgacaatatatggaaattaggttggattatcatgcgacttttttctgattaattttatgtatttttaatttacgatgtaattcggactactaatttgtattatgataactttacattttccatactactcaagtccaagtaaaatactattgtatatatatctttggattttacataaattaatggggaggcctaataaaatatactcggagtatatcatttgactttgaaatttatcgagtcaaatcaatgattgtatttttggtaaaaacaattattatgaagactttgaaagtttttaatgattttaatttcaaaaattagtaaatgctggtctggttatccatccattggaagagaaaataagaccttttcaaagctagttgataaaaaaagttctcggtcctatccctcatcttataaagaaattattaatacgtttagggattcaattcacagaagatttaaaaacaaatggaaaataggatattaccataataattatggttcaacaacaatttcgatttctaatttgaataatggaaatttagatcaaaaatagttccgactcatagataaattgaaatgtgccaaatgtcacgtaaaccagcaagaggacaaagtcaacaccacaagagacgacgacgagcacagtgtgaggttatgatatataccctctgcgagactgcgactgctattactgatttgatcccaagttttttttttttttttgaaatttattttttctttatacacaattacatagtggtaagagattctagatggcttcttaatgtttgagatttatatctagtttaagtaggaaagctatattatttgaagaaagaaaaaaacaaccaatcaaagtcatgcaatgtgtgtgagagacattataacatacatagataagatataaaaattaaagcaaacaaaagtcatattttacttcttttataaaaaaagaagttaagcaataacaaacaaacacataaccacaaagaagacaaaacatctttaaccaaaaacatg

SEQ ID NO: 23083 - DNA, 3003 bp, Unknown
  misc_feature (1)..( 3003): 2750-1469P.txt file - cDNA_ID_2130076; gDNA_ID_1620358; Annot_ID_154552
tcttaatgtttgagatttatatctagtttaagtaggaaagctatattatttgaagaaagaaaaaaacaaccaatcaaagtcatgcaatgtgtgtgagagacattataacatacatagataagatataaaaattaaagcaaacaaaagtcatattttacttcttttataaaaaaagaagttaagcaataacaaacaaacacataaccacaaagaagacaaaacatctttaaccaaaaacatgaccaacatgactcttcgcaagcatgttatatactttcttttcttcataagctgctctcttagcaaaccctccgatgcatccagaggtggcatagccatctattggggccaaaacggaaacgaaggtaacctctctgccacgtgtgccaccggccggtatgcttacgtcaacgtcgcctttcttgtgaaattcggaaatggccaaacaccggagctcaaccttgccggccactgcaaccctgcggcgaacacttgcacccattttggctctcaggtcaaagattgtcagtctcgtggcatcaaggttggttcgttcattcacatacatccgatcctttaggtctagatggttttttttccgagatagaaaataaatagcttttgtttttatctactcaaattttgattctataatttagttagctactttgaaatgacatttgttttgatacttatgtcaaaattgttataaggttatgttgtctctcggcggcgggattggaaactactcgattgggtcgagggaggacgcaaaagttatcgctgattatctgtggaacaacttcttgggaggaaaatcatcatcacgtcccttaggtgatgctgttctagatggtatcgatttcaatatcgagcttggctctcctcaacactgggatgatctcgccaggtagtagtataaatgtataattaagaaaacattttgaataaatgacaaatgttgtcgtgactgaaaaagactagttatcaaaagaagatgttgaacaccaccaaacgatttgggtgactaatttatctattttagttccggtccaaaaagataacgaaattcgaactttatatagaaaagttttgtttaggtgtttaaattccttctttgtgttgactttttttttttgtgaaaataacaaactaaacttcaaaaaaaaaaatgtgtacaggactctctcaaagtttagccacagaggaagaaaaatatatctaacaggagctcctcaatgtccatttccagacagattaatgggaagtgctctcaacactaaacgttttgactatgtttggattcaattctacaataatccaccgtgttcatacagttcaggtaatactcaaaacctcttcgattcatggaacaagtggaccacttcaatcgcagcccaaaaattcttcttgggtctaccggcagctcctgaagctgccggaagtggctatatcccaccagatgtactgacttcacagattcttccgactttaaagaagtctaggaagtatggaggtgtaatgctttggtctaaattctgggatgataaaaatggatacagttcatctatattggctagtgtgtgaaaagaatcgttatggccattgtatgtgtatcaattctctcgtatgtgtatcaattctctcgtctttggtttctgaagaattgttgtgtgtgtgtggtgttagtagtctaatttaaattgtttgtatcaatatacttaatcaactttgctttttcaatatttttttttaataaattatggattcgcttttagtatgaactgatatagatgtagctagctgcatgcaagatttgtttttttttttacatgaaaggtttttttagagatacgatatctactttggaactatatttgaaattgaaaattatcggaagcgcaaagaaacgagatgaatcatgattcagaagaaaaataaacatattgtaagcacatagaagacttctgtccacatcagaaggatgaaaaaagatttttgactaatactccttctgtatattatatttgatgttttaagttttggcaaaccgatattatttattaactatttaaaacataagatttaactaattgtaaaattaatatgcagaatataaactgtcaaaaccaataaaaaaaaatctattttaaaataactttttgtaataaaagatcaagtaataaacagagagaatatatactatatatatatatatatatcgtgttcaaaaaaaaaaaatcattatatatatttagacaaaggattagtctaaaatatctaatctaattgagctatgaacggtttaacatgcatgcactagttcatttatttgttatttgcttcataaacaaggattgatccaaataatcccttcaaaatgagtatagtcgtcaaataactcattcaatcgatttttctaatggatctaaaatgatgtaccattttggctagccaaataaaaatagtttgatgatttcatttaatttgttgccatcatttaaacttttgaatatgaaaagagtatgtagagtaatagtaatggggaacgcataaacattagttgatttgtgctgatttatgttgatttatgcgacactatattatcttacgtaccatgaacacacatttcacaaattatagatcatatattggtgtgaaaaataaagttaattgttacatcttcgactatagctggagttttcatcctattaaatattaataaaaaaatacaaaaaggcacaaaacaggtgccgccatatccaatatatccaacatcgtcaattattcagagccgaccatttacaaaaacgaagaccttttgtgaaaatctagttcaaccataaaaacacgtgccacaatctcattcttcagagttctcccaccgaaccatctctctaaatgcgttcaaattatataagtgagtgatatataaagattactaaaccacatggtataccgattttttagcctcattctcttttgttacaagattctactatg

SEQ ID NO: 23084 - DNA, 3003 bp, Unknown
  misc_feature (1)..( 3003): 2750-1469P.txt file - cDNA_ID_2130107; gDNA_ID_1620358; Annot_ID_154559
ttttttctatgtggcatgatgcaaattatcttttttgcacttaagtaatttttggagatgtctgatagacacggatatggagaactgtttataaaaaagtgcatgcggatctaaaatctatttgtcgcattgtaattggtaaatatacttcgtagctgaatttactcccaaacaaacatattgtattgttcttccttccagtaaaacttgactatatttctaaaacattaacaaaaaacgaataaataacaaaaaagctcatcatttatatgataaaaaaaaacgttatatttattatgaaaagatttaaaagcttatcatttatgtaattatatttaacaaagaaaaaaaattagaaaaattatcaaacaaaccaagactcaaagttatttatttatttttcttttgcaaaataatattttatgcatttgttaaatgttaaaaaacccaaaaaaaacttcaactaatttttatttggacgtttaatacccaattgtttttggttggaaagtaaatacacgaagtaataaaaccgtgcaatttaatacacaaacaagtaattgttgttattttcatactcacgatctcacaataaaaattaatatcatattatcataaactaaaatattaataaaattaatttttattcaaaattataaaattaatatcatattatcaaaaaaaaaatagttaattgagatggtaaggataaattgcaattttatttttgttgtgagatcgtgagtatgaaaataacaacaattaattatttgtgtattaaattgtacgattttattatttcgtgtatttatcttccaacaaaaaataattgggtattaaacgtccaaataaaaattaattgagatcttttttgggttttttccctttgttaaataccatattaacttcattttcataaatatattttaaaaatttccttgttttttggccgtttcgtataatgtggtccaccacctattgaccaatgcttaaaaaaactaaataattgtgacaaaaaataataaaaagaacaaaaaattacttgagattgtcaatgacgtgaaccatgactagttgatcaacaagaagacggccacgttgaaagctttgaattacagctatacatttaacaaatacatacactatcatgtttccgtaactgtacttacgtgaacacttatttatagtacaaagacgtgttttgttttcgcccaaaccaactcgctttttttctattttctcctaattcgtcttcgcttctttccctaccaaaacacaattcttatctctacaagaataagagaagatctgtagattttaaacaccatttctgatttctacggctgcaaaatttcaaaatcgtcaggttagtgttttattccatttctccatttttttgtttttggattcgtagttaacaaagttcattacatcacaaacaacatttttgtgaatcctttcttgagaacatgcataggctacatgcgattcttgattttcttttatatgaccttagggttcttattacgaactaataaatttattaattgatttttcttttcttttttttttctcctcgttctttctttcttaaacccaaattgattccagaaaccaaaaattaccttactaaaccccaaatgccaatttagctgtgaaccaatgtgatgtaaaatttacaaagattcctggtttactaatactagtacatgtatgtgatttttatatgttcaaaccggttttcacaagcgatggaacatgaacaatagcgtttaaacgcgtaaatattcataagcgttgttggccggtcgagccataactttgaagtggacccgatgagttgatgggcacatagcaccacaccatccatttaagatcttttgctattttgtttttttcttctaaagtttttttcttgtacagccaaaaagaaaggaaaaagaaatatatatatatatatataattttatttctgttgttaataggagtttttgtttcgttaattaaaaccaatttagttagctttttatatatttaatttcctaattatgggagtcttgattttacctacgactttttgaaacagcgatgttttagattggtttagctttgatcattgacgtggaacatcgcaataaagggtttattaatgcagttctaaaattacagttttgttggttttctaaaattatagtttctcttaaacaaatattcaaagaatttactccactcaaagtcagaaaccaaaaggaaagcttaaaattcgaaaacgaaaaaaatagagaaaactgtatttattctattctttgtgctttcttgtttttctatttatgattgttgtttgatttgaggagaattctcaaaggcgcccaaatgcacactagtatttataggttttaagtgcaattgttttggataaacaaacaatagtggccttcttttttctttctagccgataacatgcatcattttccaataaatatagggtaagtgactaagtatagtctaattctatacagctgggaaaccagcttagtggcaacaccactagactttgcaaaatgtatattaggtatgatgtttaaatgtggagaatttaggtcagatttatttaattatcggcctaattaaaccactagattttattagtttatgattttagaaaatataaatcccaaattcattttccaaaccatgttatagagcaattgcgaagggaataggtaaaattctaatgaatcaagaactcgctagaagtccttttactgtgaataatatatattttgttttccttcgcatatgctttcaacaatctaaaaaaattatatattgacttcaagggctatactcatcaatcttttgtgttaatgatgaatcaatgatacaagtcaagttagaatattaattaactatagattaaaaagaaaattcaattttataggtgtcaattaatacgtaaacaatttggatgttacagaggaaattaaaaagaagaaaaaaatg

SEQ ID NO: 23085 - DNA, 3000 bp, Unknown
  misc_feature (1)..( 3000): 2750-1469P.txt file - cDNA_ID_2130140; gDNA_ID_1620358; Annot_ID_154568
ctttgactgtaagtttcactcgaccgacaacccctctcaagcagcatggatcatgcgctattccaatggtacgtttctatcagcgggacacagtattggacagagatgcttcacaactctggaagtggaacttcaagcgctagtaatgacgatgcaacaagcatggttaaaaggtcatagatacattatcttcgaaggggacaatcacacagctatacaactagttaacggagaaaagcgcaacttcaaagtccataattgggttcgtgagatcaatgcatggaagcagaagttcttaagtacagaattccattggacgcgaagacataacaacaaagcggcagatagaattgcaaaagctccatttccaaatcatgctacttttgaatctttcttctatgtacctcaatacattgtaaacatcctccatgaggatcattgttcttcttaatcaataaagcagacgttagaaaaaaaagaaaagaagaagctaatggcttaatataaaaaacagttcgatggaggaaaataattgtctcgccggcaaaaccagttcctcaaaatgaaggagttttgatatttatttgaaaactcacatggttctgaaatgatgttggcattagcacctctaccagtaaaattgtaccaaacctcccaagagaaccgtggttctgaaccactggttcatgtctctgaaatagctcatttcgaacgtatggcccaatatttatttttgcgggcaataatatatacgcgtagacaatagactggacgtgttggctttatatcttgctttcgaagcattgctttatgtagtttcctgaaattttatagtttgtgtatttgtgtgtatgaaattatgtagtttgtgtgtcaagtgatgtaaaacattttgacacattttttcaaacatataaatttttagactctatatttggattttattattgggcaatactataaatctaattcaagtgtctaaattatttatttttcattattaaaattataaaacttatttgaattctcatttttggatcctattgttggagatgttcttaccggctaaaatattcctcataagcatatctatctcaagacaactatgtttttcactggaccatgatatatacaaaaccgactacgattctaatttaaattaatcgcgattaaaattgattgattttggagtgggaatgggagattaactgacgattccgtgtaatgtaaagaaaaaaatataactcaatttatttatttcttcttttgttaatattaagcaaccaattacacgttgacacatgtcagattctctctctctctcattctcaaaactctctgaagagaaccagctcttcttttaatcagttttgattattttttttcaatttaatcaaagaaaatcttatgaaagagcttccatttatcaccatgatgctcttattaatctccaagttttgtcttttggttcaagcaaagttccaattttaccctctaaaaaatgtcgtcccgtggccgagaacatcgaccaactctcatagcaaacgatgcgtcatattacgtcctactaaatatatgttggagaaaaagaacgaccaattactaggtttactggggataattatcccatgactagattgtgacagactcctttagttttcatacagaaaagagtcctttagttctatatgttagagtagtacgtaccatcgttttggcaagctttttgaactatatgtgattaattttgtttaatttcttcgttttgatcttatgatatcagtcgttgtacacctttatgttaataaacctttaaaagaatccaatgtatgtaaatatgcaaacgaaaaccccgtgaattttttgttgtacattgtgcctaatggtttggtttagccttcactagttgtcgatggaggggtcgttctctcatggtaccatcaatttgtcgccttagagtgtgttcaacgagttgagtacttgatgacatatgaatttcataaatctaaggttgtggagaagtattgccaaaaaaattaggaacctgtccgaatgcccatatattaggtgtttacatcaaggacaaagagaaatcatgaagcatggacacacatattttcaaggttcatcagtagggctgttggctatgttcacatgcaaaaggagaccgattgtattacgtacttggtatgtaatacatgcatagtttcataaaagtttgagctaataaatatctgaaatatccgaaacgtaattatatatataaaaaattaattattttatacttgatgtaatccaatgatacaatatacaattatgaataaaaaatatcagttatttttaaatcaaaataactgaaatactcaaaataaccaaaatatccaaactattagttatatttatcaaaacttaaactaaagttttttcgaatttaaacaatttcttatttgtttttataatattttggatacccaaacctgacttaaatatataaaatactcgaatgaggcctagaaacctaaaccaaaaaactcgaacaccgaaacgtcgatgattctttttttttggatataatgttagttttaacatggaagtaatctagaaatctaaacccgaaaagtttgtttgcaagtttaaaggttagtaaaattatctcgatggtttatactgttagtgagattttttcgaagtttaaagtgttatccaataacaatttaaaggttaaaaatgttattttcccctaaatatactaatcggtaagatatccataggtaataccaaaaccaagaaagaaagaccactaatctgtttatacggtggaaattagtcccacgcctaaaaatcttgtactctttattgcaatgttttttttttcttttctcgaatatttctataattctatatatatatgtatggaacttagctgtatcggcaaagctttgtggaaccacaagtgattaattttggagaaaaccacttctaccagaaatttttagcatg

SEQ ID NO: 23086 - DNA, 3000 bp, Unknown; identical to SEQ ID NO: 5060
  misc_feature (1)..( 3000): 2750-1469P.txt file - cDNA_ID_2130256; gDNA_ID_1620759; Annot_ID_167099

SEQ ID NO: 23087 - DNA, 3003 bp, Unknown; identical to SEQ ID NO: 20585
  misc_feature (1)..( 3003): 2750-1469P.txt file - cDNA_ID_2130272; gDNA_ID_1620759; Annot_ID_167105

SEQ ID NO: 23088 - DNA, 3000 bp, Unknown; identical to SEQ ID NO: 950
  misc_feature (1)..( 3000): 2750-1469P.txt file - cDNA_ID_2130308; gDNA_ID_1620341; Annot_ID_153968

SEQ ID NO: 23089 - DNA, 3000 bp, Unknown
  misc_feature (1)..( 3000): 2750-1469P.txt file - cDNA_ID_2130308; gDNA_ID_2926222; Annot_ID_142464
atcttgttttatgtacttcaacaacattgtgataggcttatgattaaaatttggattgacatcaactgaacaagatttgaaaagtattcgtatgaaaaaataaaaagataacaaaaattatatgtcatttaagtcaatatttttttatcttctgtcattacatatatcaatattagagaaatgatcatgtcttaaatgatttgaaaattgtctaacttgattataaataaactatttctggtttgatgtattcacctgatataatattccaacaacagtgttatcgactcatgattaaatatatagaattgatataaactgaataagatttcaaaagtattcatatgaaaagaataaaaaaaaaagcaaaaattaaagcagcatttaagtcaatacttttagatcttctctcattgcatctatccatataagagaaatgatcgtgtattaaattatttgataggtctaatgttttaaatgtttattatttgaaaaaacttgaatgtcaatgttatcaaagactcaaaataaaattactaaactaataagaggttaggtaacgaacaagtacaacaaaaaaaatagtaaaataaaaagagtataataaaagtagtgcttaatttattaaaattaattttttattttatttttattttgaagaaaacaattaagagtaggattgatgatatatttaatttgcttatttaatttgattaatattttaatttaaaaaatatagaatgacacatgtcattttcttgtgtgatgatgtgtcatttatttggagagagttggccaactttcatatatatgatttataatctccaaaaacaatgctgtcaataaatcaactgtcagaatctaccaaatttatccaacggtcagaaactcagaatctagtcattacattgcctctgccattgaaagtaaatattgtccgttggattcttcatttttacacattgcaaactagggatatcaataatcagccattgtgccaattatgttgagattattgtaactaggtaacgactaacgagtgacaatgaatggcatatagacaaatttattctttattaaactgttatctgaaaattaaaaaatgatttcttccttaacttttaggtaaccgttgtttaacatatccaaattttaagtttttataattattttactatcagtttatatatgttattcattcacacaaataaagatatttgaaaataagcatttaataaataacatgatatatatcacccaaaggatggaacaaaaaaaaatagaaatttgacactattgaattagcattaagttacaccattacctcttacttattattatttattttttctcttacttaatttcaatcctaagtaacaattttgtacataggtggattgtctaaatattcttgtcgtgtaaattattgattatatttttgaaaactaaaacacacgatagagctgaccagagaccaatcaccagttagacatgccaaacatgctcagacattattaattaacggaatgattaaaaacacagctcgttagcaacgagagacattcattatagagttgaaaagaagaaagaaaaacgacatagacatataatggaatcgatggagacagagagtggtatggtcagtgcctcagtggtcactagtcaaaggaaaatcgtttcctctgtctaaccaaaaaacaaaatgtatttcaattttcttaaccaatttccagttttttttttttgtattatatcaatccagttaactgattttatgtttgattcatttctcactgatatctaaacttattgattttcgtgcacattttcaaatttgaaattttggatgtaagtatgtacagttaaaaaaagttatgtacaacattttagtaaagaacagtgtttttttttgtcagatagtacataaggagttattacacgattttttaataaccacgttttgtgtgaacattttccccaatacatttggtttcatattcatatccaacttactaatataaaattagtactaatctttctgttgacgaaaaaggttaattattttggaattttaaaggtcgattaaaactactccaccatcaagccatctccaattttaaaaagtaatgtcaattacatttcccaattaatttttgtggcttataaagtcttgacatctctttgctctttggacccgccttaatgtttttttgttcatgtaagatctttttctctctttcctctttccatgtttatgttttctattatttagttggcttttggtattttgttggtttctgggtttaagccatttttttcccaccgcctctgcagctctgcttttttagctgctattttttttttttgcttttggtatgtataatcggatttcttctttatcatttatcaaatgtttgaattcttccatctctcataattcttaagtggtcgtggtgtgtactatctcctaagctctctgttttttttttgtttgttcattggctatatttcaggtcttcttcttcttcttcaagaatgagctaatactcacagaagaagaagatttttctttggatttttcactactggtaagctcggttcctccctcttttgactgtaatttttaaattcggttttttttttggtgtttttctgaagaagttctgattattttatttgtgaagtttggatctttcttacagatttagtaggattaaagaatgttgttgtctgtagttaatcttcctctgtaaatctatatgctttgttacaaatctatgcttcaggaatctagggtttatattccactttgtttactttaataaaatatagtttcttaaaccctttttgtctgatgaatcaaaatctaattactttatttgaatcaagctaaaataaattggtactttaacatccccacagtgttcttctataatcttgattttttggaaattttccagaggcattgttgtgaaattggatggtagtagcattggaatg

SEQ ID NO: 23090 - DNA, 3000 bp, Unknown; identical to SEQ ID NO: 23089
  misc_feature (1)..( 3000): 2750-1469P.txt file - cDNA_ID_2130308; gDNA_ID_2926222; Annot_ID_203374

SEQ ID NO: 23091 - DNA, 3000 bp, Unknown; identical to SEQ ID NO: 951
  misc_feature (1)..( 3000): 2750-1469P.txt file - cDNA_ID_2130333; gDNA_ID_1620341; Annot_ID_153977

SEQ ID NO: 23092 - DNA, 3003 bp, Unknown
  misc_feature (1)..( 3003): 2750-1469P.txt file - cDNA_ID_2130357; gDNA_ID_1620341; Annot_ID_153985
tcctccaatcgtgatttctcttctggatccaagctgatgagctctacgtcttcctcccaggtcatcactcttctctttttatgattgtgaacttgttttcgatggttttgatcgatttctggttcagttttttttttatccttcttaaaggattttatactatagatgggtcgatcaagtgttattgatatgccattgaagtgaactaagcttgaaatgagccaagttaagtcttttatggggattcttacgaagttactgaatctgatgtgaatattttgtggcagatggttcagctcgtagctgacaagcatgtacgttacattctgatggcagaaaaggtacctagaaactgtatagaacctttgctcgttttctctgtttatgtcactgtgattgtatagcttatgttcttcttttcaattgctttttgaattttatttaatttgctagaagaaagagagttttgagtctgtggtgatggatcatctaagaatgaatggtgcatactggggactcaccactctcgacttacttgacaagctcggctgtgtttctgaagaggaagtcatttcatggctcatgacttgccagcatgaatctggtgagtacttgagtatcagatcagctctttttttacttactgatagaatgatgtaaaaaaagggatacatgggctaggcagtgaaagcaggtgtctttgacaattatgagaaaataatcattggctgtgattgctatataagaactagcaataagatctatggggacctttaaagttgctgggtggtttcatattttggttcgtattcataagatgtcgccacagtcgaagttgaaaacaagttgttcttttctgagcaggtggctttgccggtaacactggacacgatccacatatcctatatacactcagtgctgtacaaatcttggccctatttgacaaaatcaacattcttgacattgggaaagtgtcaagttgtatccttttgcacttagctttttgtcaatgtcactaactcgttcttcttcacaaatagtcatggtggaactttcatatgttaattaatcaatgatgttaaacaagaaggaaaaaccctgccttatagtagatattattatgttttcctatatacaatattagatgttgctaagttgcagaatgaagatggatccttctcaggagatatgtggggagaaatagatacgaggtgtttttccttgccatgtattacaaagacatttatatatttcctgttggtgatttcactatgttgaatcttaacagcaagctgtttatgcaggttttcgtacatagctatttgctgtctctcaatattgaaatgtcttgacaaaatcaatgtggagaaggccgttaagtacattgtgagctgcaaaaacctggatggtggttttgggtgcacacctggagcagagtcccatgcaggacaaagtatgttatgctatttgagtatttttctgtgccatcttcccaattgttacttgcaattagtgttataggtgactttacagaattaacaaggccaaccgcatcactgccgtttaactattccaatgactagatactcagatgtttatttttctgtagtcgacgtgctattgatacatctttatgtaaattgtataggacagtttcatggttgggagatatggtaaaaagacggtattctttatttgtttcttctgttactgcagttttctgctgcgttggtgctcttgctatcactgggagtctccatcatgttgataaggactcacttggttggtggttatgtgaaagacaattaaaggctgggggcttaaatggacgtcctgagaaactcgctgatgtaggcattaagctcatctccaatgagagagacctttgtatgatttccttggttcttacacattttttactgttcttatttccaggtttgctattcttggtgggtcctatcgagcctaatcatgatagatagagttcactggatcgacaaagcaaagcttgtcaagttcattctggactgtcaggttcgtctccaacaagaaaattcatatcgttactaataagccagttttgattgaaagctctcatctcatctatctaaatttgaatttgaataggatttggacaacggaggcatctcagaccgacccgaggatgctgttgatatcttccacacctactttggagttgcgggtaactttcatttgtctcttcttttagctcatctcttgctgtgaagccaaaagtggtcttatttcatcaaattggtgcagggctttccctccttgagtatcctggagtcaaagtaattgatccagcctatgctttgcctgttgatgtcgtcaaccggattatattcaccaaatgactgcaatgggtatatgatcttaatggtcaaacaatatggccgcaaggctctctatatgatttgttcattgaataatttacttggcggttttagaagttatgtatgctcaaggaggaggagattgcaatttgggtatgggaacagtctcaaatctcaatgttgtataacttgctacattattgaggtttctgatgtaatggaaacgaagttgtgttgctgctacattatataaatcacattaatgtgttttttctccacacttttcattctgatttacttcttgaaaaaagtgaactaatgtgtttaggagtgctcaatacttatagaccgaaccaatttaattaacaaattgaacaatttagagaaattgcaaagattatagtacacaaatcataattacaaataaattttatttccattgcagtaaactaaaaattaaaactcttgtatcgaattttgcaaatatatttccttttaaattttttaccttggggtttaaaaaaaaagagtaaaagaaaatcaggatgtctaaaccctagtacgccattagagagggttcagctcaagtgctctgtttttgtttgtttggtaaaaccctaaaagctttcgagccgactcttcaatg

SEQ ID NO: 23093 - DNA, 3000 bp, Unknown; identical to SEQ ID NO: 956
  misc_feature (1)..( 3000): 2750-1469P.txt file - cDNA_ID_2130361; gDNA_ID_1620341; Annot_ID_153986

SEQ ID NO: 23094 - DNA, 3003 bp, Unknown
  misc_feature (1)..( 3003): 2750-1469P.txt file - cDNA_ID_2130369; gDNA_ID_1620341; Annot_ID_153990
tgagacgggtggagagtgaagaagttggatttatttatgaaagagtaagaagagggaaaggtaaaatttgatccaacggctgtgattggtttaatctatcggaagctggatgccgttggatggtgagatatcaacgttgaggatggcgttgggtaagatgtgggagctactttatgttaattggattgtgattgtcggttcttccttcactcctacataccaattattgttgtcacatgaatagtaaaaaaatctctaacattggagtcttggaccattggtctaacatagaaaagataagtatttcggtagtaatgtcaagattcttattattttccaaacgcaacttacaattttagagaagctctctttggttacacacttaatacacgtcaaatgcataaacaaactcatcaaaagccgtaggaacaggcaggagcaataccttgtaatgagtgtgtgacagtataaaatcgagctaagaaccacgggaaaaaaaaatggtctcattgcgtatgacaatgcggagaatagtaaatcaccgtaccatggtcggagagtagatgaattcttaatggtttatttcgtacctatattaactagttagttaagtttagttactttcgtaaaatatatattaaatctttcttttgcatgcatgtcatagcaatcagtttatatgaaatatatgcagaaattgttttttggtccatcagatctatacgagagagttgaagaaaaaagttgatgcatattaccgtagttaggacgataatgtaaaacacacgcattggatactctcgtttagatttaactactgatgctaaattgctactttgaaatctttaaaatattctataagttcttacatctgtcgatctactgtcaatcaataaatatatcagtttgctattcggaaaatctaaactaataatcggataacttaaatattgttttctcaactttgtcgttgcttgtataacaataaaaaagtgatgtttcgatggtttcgcttagtactaaattttccatggaacattaatcatgcttacgtttctactttctataacaatgcaaaagaaaacccgaaaccaaaagcactactaatgatatcaataacaaaaccaatgtcgcccttatatcaccatcatttagatcataaacaagacgtgataaataaattacgctaagaacagcatatagctgtaaatatgagaaattagaagggtacaaaaacaagaatgtgttggtcttgtagagcttgtggatcggaaatcggatagcgacagaatgagatgtagagatatataaaaagaacaatgcacatgaaatccacattgcgtcccatgtgacatgccaacagctcacctgacttaaattctaactttctctactcgtagtttcttgctccagtagtttctcatacctacaaagttttttgctaaattccaatccctacctacaaagtttgtcagagttaatgtcgttataatatcttcttaatttatttttttcccacaagttcttgtaaatacaaaaattgaatatcttgtagtataagtatatatcaagtgaagtttactctttttgtaagtagtagtattatttacgtgattaatattataatttgtttctatgcaataagtcttgactctttcaaataaatcctctcacttgatctgtacgaattttctggtatttctatgtctgtgaatattcataactttttgttatggttaaccgaggatgagcgatgtccaaaagagattagttgagtgctctttgatgatgaaactctatgaaatagaaacacatctctctttgaagattattgttcaaagcaaacgaagtgattggtcaatgcagctcttgagaattcaacaagagcaacaacgtaatcaattagctgaagtagtgaagtctatcattttcttttgctatgatcaaaattgtaattcattaatttattggtttgtgattgtgaaaaagttttaatgacttttaaaatatataaaaaatagataaattaaaagattttaaatgattactagagagttttgtataatttttatgatttgtttttctaaaattttgtaaagtctttctataatcttgtaaaatctccttgaatataattataaactttaatttgtgattttttcaaaattataacatatctccaaaatatagtatactattcttagttattttcatcaaaatgaaaatcacacgcataaacacaataactatggtatttgtaagtaaagttacatgaatagggaaccatccatgaagaacttgatgttttattttcaaatattttgttggatatttacttttcatatgttagattaaaatgctttgttttaaaaattgcttgtgtgttgatttttcacaaagagattatagaggagcattcgtgggacttgacccattagaatatatatattgttcatcactgttaatgagatttatgcatctgttcgtatcattggtttttgtttatatccaaaatcatgattcacaatctctctttttttatgatacttttcatgattttaatttgtgaagaaaataagataaaatcataatcgaataacacaatattttataatcattaacagtcatggaaattgttgtttaagttgaataacacaaaatttgtaatgattttattaaagtatcaatctaataactccagatttacaaaaactttaaatttcttttttacaaatcaaaatctaataacaccaaactttaaaaaaatcttacaaaattttaattaaataacaaaaaaaaattcatgacattacaaatcatttaaaatctatataaatcacaaaccaataacaccctctaaataaaaaatatcaaattaaaatataatcgtcatcttcatttttttttcgttccgcatatggtgccgtgtttttatttctttgatttgtaaatccttctatggtttctcaatcgagaagaaggaacccaacactgagatccatg

SEQ ID NO: 23095 - DNA, 3000 bp, Unknown; identical to SEQ ID NO: 1108
  misc_feature (1)..( 3000): 2750-1469P.txt file - cDNA_ID_2130607; gDNA_ID_1620360; Annot_ID_154616

SEQ ID NO: 23096 - DNA, 3003 bp, Unknown
  misc_feature (1)..( 3003): 2750-1469P.txt file - cDNA_ID_2130611; gDNA_ID_1620360; Annot_ID_154617
ccctgaatttttttcaatgaatcaatagttgaataataaatgtaactgttgtaacacttttatctcaagtcacatgagctaggaacatctttggcaaaagccatacattatcggaaagcaacatacctttacagcatgaaaaggcgaagttttggtgcatttgcagcatccaagctttgttgttccaggatatgtctttgcaagaccatgtatctgaactgcaatgttaggatcaactcttccatccattgcttgttgtttaactaaaatctcctcttcaagcacatcttcgtcctctggtgtaatatgctctactggtggaactgaaccaatacagctacagatgctcccttcttcaaaagtgtagaaaaacatgttttaacttataattagttttatttagtgcaatagagaaaaataccttccactttgttgccttctttgccagtccaataactaggttttagaaagtagaagatcgattttctcacaccggatgcattggggatgatgttgtcaaagtagagagccaatacaaaccagaaaaagaacgttcccacgagccatatgtagattttattctgccaaaaacacagtttgttcagagaatgatacctacacaactattagatccaaaatctatctcagaaaggttggcatacagttgtaataacgcaagtgctctcgccccctgcacatattgctctttcactccaactgattccagagtctccgggagatgatgtcgcttcaagaagcagctgcagacccgcagaaaaggtattcggtggaaagagtgaccaaatgacacggctaccaatcgaatatgcgcttgaataagggaatccagcagttgttacaatctgcaataagaagtagaaatcgtaagagtccaagatttaaataagaaccaaaatttcagctactatatatgttagcaagagaggccaaacctgtgttataaaaccaaccagaaacacaaggaaaccaacagttgttgccgaagatgatttgctaatgatagatgatagcgcgaatgctaggccaatctagcaacacaagtaaatatataataacttaaatgatacacaaataatatctttgaagaaagcagagtacataatttgaaaatgaagttttttaccatattaaactgaaaaagaaagaaaagtaggaagacaagaacaaaactgttcttcaagaaaaactcaaactggaacatcattccaaagaggaccaagaagagtgaggagacaaaggtaaggattccttcccatatgagccatgacaaccaatatgcagattcataaacacccatcgttgtcattgcctgttgagcaacaaagaaacaaaacaatgatccaatacgcaaaacctcaggctaccaaaaaacaagaacagagattattataaaacctcgcgaagttttagctctttctcggtaaccacagacccgagttggagaacaaaaccaaacatggagaaagcaagaaagaacactggtcccataagataaaatgcagaaatgatcacttcaccaccaatcgctggacgcgcaaattccttaaatccaaaatcccaactaaactttggatctgaaaatgtataaggacttgacttattattccatgttataagaagcacccacatatgtatacatacacactgctacaaaaatcttcctaacacaaattaagattcaagaatataaagtacctccaattaaagaccttgcgatttcacgctctgcagcaatttgaagaggaacaaggaacttaaacgtaggatcttcacgccgaccacgttttttctccgatgaagagtttgtttgaattccatagctgatcactgtagcattcttttccacaaaatgcaaagcccctgttacttgcgatggatgtgacataaaccatgcatctacttcctcaggctttgtaaatgattgaacctgaaagagaccaaaccacaccagaaacataactattcagattttcgtacattagagactatggaagatgatgaagagacataatcatgacaaaaaaccttattggttggaattggtcgtccaggattgttagccataattgcagagacaatgtcagtgacacgacggctctggttgccactccacacgaagtcaaaacatggaagtctcacgaaaaacttatcctcacatggaagaatcggaagagagactaatgctttaggatctgtgacattcttgtgcctagtcgaggttaagtcgctcgctttggaagattcctctatagagaagatgagaaggatgaagaagaacgaagagaagagatgaagacacgtggctctcttgttcctccatgaaagcagtagattcttcttgaacaaagctgtgaattgctgatgaaaaagcggcaagccttctcgcagagtcatgatcacagaggaagaagaagattagaggtttttttttttttttttgaaacaaatgaataacgtttatctttaattaggtttttcgtaaggaaacgcctatgaaactatggacaaagactcttatcaattattctagagaaaaaaaaagaagtaattttgtttattactctaaaaaaggtttgaaagttgagaattcttaaaaagtttttttcctagttttttccatgattttattcagttaaaggaaacgcgttttctgtatttgtaagtacacttaagttttttttaatctttccgtttctacatagtattaaatttgaaatgtttccaattagtatttattgacttcttgggaagactatctgtatccaatccatcattacaaaggggtaatgtatcagattgttgttacactgtatacaacaatcaagagggttttcttggattttcatcaactattatttgattaattaaaaaccctaaaaaaaaaatattagaagagaagcgttttggagaagaatactaaaaagtggtgtcagtaagaaaaattttaaagactaacggagctctttttcttcttcatcaatg

SEQ ID NO: 23097 - DNA, 3000 bp, Unknown; identical to SEQ ID NO: 1103
  misc_feature (1)..( 3000): 2750-1469P.txt file - cDNA_ID_2130642; gDNA_ID_1620360; Annot_ID_154625

SEQ ID NO: 23098 - DNA, 3000 bp, Unknown; identical to SEQ ID NO: 1100
  misc_feature (1)..( 3000): 2750-1469P.txt file - cDNA_ID_2130689; gDNA_ID_1620359; Annot_ID_154580

SEQ ID NO: 23099 - DNA, 3003 bp, Unknown
  misc_feature (1)..( 3003): 2750-1469P.txt file - cDNA_ID_2130798; gDNA_ID_1620362; Annot_ID_154668
taccttttctatctctgaagtcttagtgtttatatccttgtaggaaggtccgctgttgacggaagatcttattagagaaacagaggaattagtacttcggacagggaggtcagtgccatcttttatttgttgtagtttgatataaaatttacactccacagcgattctggtgattgaaagtgaaccaatctgctaatgaattctgagttggtgattgaaagaccagtaacagtcagttagattgaaataatagacgtattatctggctgaataatatataattccgtttcgttattcagacatccaattatcttgatagattggattattgtctttcttatggttcagcatgggggctggatgttctcaactcttgtctgacatgcaggctttcaaggtgatcatcttaatgaataatcttattactgtttggtatataagcactcatgtaaggaaagaaattgtagctgatatgaaattgataagatctgtacctctgtattaggcagcaaatcctggctgtattttggaagattttgtgagatggcactcgccaccagactggactgaaaatggtaacatgtctggagatgactcttcacccgttcgaggtcaattaagtacccggatgcagaaagaaggtgtgaccatttctcagtttctctatgttgttaaaccattactgtaatatttcaagtcgtattctcaactggtcttaccaacgttttaaaaaaaatattattaggtaatttatggcgtgagctgtgggaaacagctaaaccactccctgctgttaaacaagcacctctctttgatgaagatttagctgtgtaagtttcaatagcatgtcctcttaaacgtagtgaaatctgtatttgatcactcatggagatcttgtccatttctcatttaacttatacagagaaggaatcttgaattatttggaagacattccagctgctgaactttttgagcagctgtttacttcgctagtaagtttttcccaacaaattgcgtatttttctttttgtgaagctttctatctgtaaggtcaatctcaaattctctcacttgcgctacgttaaatggatgtcattggttacacagttaaggttttagctgtaaatagcactttgacgattggattggttaaaaatatttcaggtttccctggggtttgtgatggtggagccagttttagctacaaacgatgacttgtcaaagcttttctttgaatgcaaggattatgtagtcgctatttgtcaggggggcgcatggaccgataagcttgatgatctatgccaggtactttactagagagctttgcacagattcaaaaacgtatctacatgcttggaaatctatcactttaatagagttaagaatgttttatcagatgccaaagtaaggccatgtggatatgaacattatgctcactaatcatacatcctaattgcatttatttggtcataataggtatacgagaccgtggaaacaatgttattacgtccagaagaagttttgagatcaatgaaacaaacagaggagtcgccatcaagtggcagcgaaacgaaacggcggtttaagcggctaggtttcatctttcgtggtagtaaagaaagaaagcagacaagagttccatcagaaactgaacagaaaagcaccgaacctagcccacgccaatcattctctagtctttttgatggcaagtcgtctctgttttcaaagagacctcctagacctgaaaatgtgacgcttgtctgaatccatattatttatttgatttgtttcatctgcttttaagtcatttctcagttttttgtattcttcttctggggttttaggttgttaagttgatcaattggttggtaactgtaaagttatcttatttaaaacatttctgaaggtatggtgaaatgcaaataaatggaaatgaataagatgtgtaaaagcttttagaacatttgtgtaaattattagatttctgagatgctgttttagatggttgcctaaaattaagaagttgaaagagttgaatgaacattcaaaccaattttttaccatttaagataaataagttggaaaaatgattcaacctaaaaagttgaaaaaatgaattaattataaagaattttttctcaacttgttcatctcctattttgcagagaaatgaactgaattttattcatttcttttttcaactcaaatttttcatccatatgcaaccatttgcaccttaaggtttctacacaagatatacataagaaaaatcaaaactctctagagttggttactttcccacaataaacttttcctaatgtttaggttgttgtttgatcaattccttggtaactgtaagtaaattgtttcattataacatttctcaaagtgatggcaaaaaaaaagaaaaaaaacatttctcaaagaaaataacatgggccgttgggcctatggactatttgatgttactaaaacgcagacgttttcgagagttcatattactgaatccaaatttagaagcgtaataataatcagagatcttataataataatgttcatattattcgttttacacaaggaaataagacacgtgtaaaatcctctgaattttccatattctttcgtgacttgctcaaagcagagaaaggtcatatgcttttctccagttcctctctctgtctatctctctcctccttcaataatttctgcaaaccctaactttctcattcggcgctcaagtttctctccaccccttcggtgagatttcaattcctcggttttctcttgttttcattttcgtcttgttgctgaaagtcacgaatctgagcagtttttatgttttgaaagccataatagcaggatttaggtttctgattttgagaaagtagtgttgaggatgaacagattccattttccgacgatttttgattgattgtgttgcgtttatgattacgagtgttgaatctcaccgacatcttgttgttacagagatttggtgcgatg

SEQ ID NO: 23100 - DNA, 3000 bp, Unknown; identical to SEQ ID NO: 1129
  misc_feature (1)..( 3000): 2750-1469P.txt file - cDNA_ID_2130810; gDNA_ID_1620362; Annot_ID_154672

SEQ ID NO: 23101 - DNA, 3000 bp, Unknown; identical to SEQ ID NO: 1128
  misc_feature (1)..( 3000): 2750-1469P.txt file - cDNA_ID_2130854; gDNA_ID_1620362; Annot_ID_154690

SEQ ID NO: 23102 - DNA, 3003 bp, Unknown
  misc_feature (1)..( 3003): 2750-1469P.txt file - cDNA_ID_2130856; gDNA_ID_1620362; Annot_ID_154691
cttcgattcattgcgcgaatcatccgtgatgttggtgtctagggttttatcaagagtttctcgcagcgcaggcttacgctcgtctttctcctccgtcgttactccgaagaggaatcagattccgattgttgcaagccgatttcactccctcgttcacggaacccccaacaaggttaggcttttaagctgattttacttgtaattcgttctggattttatcgtcgggtttatgctagggtttaaggggtttgtctaaacaaaagattgttatgttctgattctattgctctggtcttctttattacagtgtcacgaatttaattgtgtatgtctgaatgttaatgttttgattgctctttcatatgtcttaatttggatgtgaaattctggcaatccttgtgaatttgaaagctgagataaagctcattctaggatttgtgtacagtgaatttacttaatttggatcattttttttaatggcagcttgttgcagttccagtgtcgctccgaaaccatggaactctagatttgaatgttcttcaaaggttcggctttttttcctcttcctcagctgaaccgaagggaaatgagagtaacaccgaagtaccaaagaccggcgaaacttctgagaatgtggaggtggggaaagctacaggtgaggcaaaagattcatgtattttgacttagaataaagagagattactgtgtctaatactgaacgagtttctttttctgagttccagatgcagagattgacttcgacgatttgtcaagagacgatttagtgaagcttgtgagtgagaaggaagatcttttgaaggttcagcagaaagacataatggaaatgaaagataaatttcttcgcacttatgctgagcagcagaatcttatggacaggactaaccgtaatgctgaaagcgccaaaaagttcgctgtacaggtttacttctctactccgcgaatcctttttcttctttcttgtattaactcgttttgctttgtgtataatccagtgctgaatatgttttgttgtgctgcagaactttgcaacgagccttttggatgtggcggataatcttgaaagagcttcttctgttgtcaaagagagtttttcgaagatcgacacttcaaaagatttggctggtgctactccactgttaaaaaacctattagaaggagtggagatgactgagaaacaattagctgaggtaaaaacgtccattatatatatcttttgaggtaaacaatgataataagactggtgctgagaatgcaattttgtatgtaaaactgcaggtgtttagaaaagctggtttggtgaaagaagatcctttaaatgaaccgtttaatccaaacagacataacgcagtgttccaagtcccagatgcttccaagccaaaaggcacaattgctcatgtcctaaaggtactaaactattcaaaggattgctctctttcttgctttaactcttaagcctatgttaacttttagaaatccacacaatatcatggattctctgccatcattttataactgtttttttttcttccatatttgcagtctggatactcattgtacgatcgagttataaggccagctgaggttggtgttacttgcgccgtggagaatcaagaaggcggcaaagagtctgcagcttgaaatacttaaaacatcgagagttaagcttttgtttttaacatcttcatgagttctttttttagttaatagttctctttctttgcatattcattggaggaacaagattcccataaggtagcatgactatgctctgtacttccagggaagccctggttctgtaacttttacacaaattcataagccaaagccaaactcttggtaaaagcttcaaatcttacatttatataacttcttcctaacttacaaacacactacatagagatctagaagacgtcaaagtggaataaccgcctagcataagatacaatataagacatcatcacagctgaacacattttatagttgctcatcccaaatcaatatgattctcttcattcttcagtcccttcagaattcagacacagtcccagattcaaattaccagtttttgcttcctgcagagtaagtttataaaacacaagtatgaacaaacactaaccactttcattacattgcttgagttttaaatgaagcttaccttagtttggtctgagtctgttaggttcatgtctagctcaacagctttaggtaatggagattcagtgtcgaattcttcagtctcttcaatttcagaatccttagaaatcactttttctctatgctcaagcatcgcaatctacacaaaatcaatcattttccactaatcccacacaactaaaaccctaatttaatgatttggggaaaaaaaacttactggagcgtatctgaatcttcgcttaggcgactcctctgtctcaccggaaccattagcgtcggaggcagtaaccgtcgctgaggtaagtggagtccacttatggagaagtagatggtgtggtgagttactgttgttgctgttgttacgaccgttggatttagatgctctgaaaacaccgacggatgaggttgagacacgtacccacttcttcttccatttccttacacggccactgaacaccgccgtcgccgccggaccactgtatctcgatgacgtccggctcaatctcgatcctacaccttccattctcttctctctcttctcactagccgggaaaatagttgctttatctatcagctagaaaacgctgcgttttgatgtgatatagccacaaacgcggcgtatttatgtgatatggcttcaaaacgcggcgttttagtgagataattgttaattagttgaaacgtagcgttttaaagagagatttgttgattagtcgaaacgcagcgttttaaggagataactctgtttatctgaaagtagaagcaagaagaagtggcgcttcattcattagctctgttcagtataagcaagaagagagagcgaaaatg

SEQ ID NO: 23103 - DNA, 3003 bp, Unknown
  misc_feature (1)..( 3003): 2750-1469P.txt file - cDNA_ID_2130862; gDNA_ID_1620362; Annot_ID_154692
aaattgcttcctggatgcaccactttaaaggaggtaatgaacacatggattttattttcaacaaattatacaatttttttttttgtcttatatcagtgtaattcgctaatgaaacaagtaaacaggttgaagaaactctggctaaaagatgtcaagagatggagcaggaagccaaggagcaagcgacagacaacgccatccttgagcagattcgaaaggtcatcatctaattccatatatcatttgaagcattaacatcgttgatcaaacatcatttgcttctttttttttagatggttgaagtagagattcctcaatctttatttgaggaacaaggaagacagttttatggagctaggcttctagagattcaggcaagtgttttcagtgactgttgttgatctcttactctcttttactgtcactcagattcttaaggttgaatatggtgctgcagggaaacatgaagcttaacgaagaccagttggcttctctttcaagtcaaaaagcagtaaatgagtttctagaaactcaaagagagagcatcaccaacataatcaagcagaatatagctgttggagatatcttcaagcgcgaaaacttagaggtatatttatatgcatgatactctgtctccaagaaagaaacaatacatttttagtaacaaaaacattgtcgaaatacttgaatgcagttctcaacagatgaactagttaaagaggtcgaaaactcgatctcagaattcaagaaacataaacaagagttcgacgaggagcgtgtgaaagatcaggttagttctcttgtgaatctaagcactatcagtttcttgagcctatataagataactgaaagagagaggttcttcttgaattggtggttggttaggtacaagagattttagaaggagcaaaagtgcttgaatggttaaaagaccgagccgagattcaatacatcactcgttgattagcatataggtaatgtatgtatgattggcatgttctgtttttgtatgagcaatttggttttgatgtacaattatgattgattttgtcagaagaagagaactttgactatatttgaattgataggtgcaataaattattaacagaaacgttgctttttattttgtaatttaggtcactttttgattctatagtcaatgtgttttattggatatagatggtatagatataagtatttacgtcgatttcatattgaatttgccaactaacattgagtcattttgactatgacttgttttttatttcgacaaaaaaaaaaagagactcttcgtcttttctagtttggttctatatggactaatcttccctctgacctcatcacttttgctacttgtcttagctgtatttacgaactacttcctcatgatccatgttaaattatggaaaggtaaattaaatttcaccaatccgagtaggctagtacttacaccattttcccaactaataataaacacagttcaatacaaaaaaaagaagtttctaaccaactagtgattggatttattaataaggaataatatcgaagatactgctaatttgaaaacagaattttattcaaaatcagcaattctccggagaacttttcatctattttgaatgcaagactataatgtcaaagatgtcaatgtttgatctgagtatttcaaactaacatttataattccagtttactttacagatatctgataattaatttatgtgtttatctttgtcaactgtatttgatattaattcaaaattcctaaaaatgttttatcctcttgcatcatactttaaaacaaatatgaatttcgactgatagcgataataaatatttacaatattgtaattggataatataaatctagtgatatatatatggtccctaaaactggtaaacaactttggttgtacagtaaatgtttttgtagagctacacataacatttacagctttaaataaccataagttaacttggttagagaaaaccaaaaactattgaagcatccgagaatctagtggtgaattataacgatattattgcactgtaagaaaagaaaagaattaaaaaaaaaagtaaataacttgtgtggtcaaacaagcaaagaaccaagtcaaggaagagtaaaaaaagacacaagtctgtctgtgaacagtgtcatgtttgtaaataaagaaggaaactaggggtgaatattttgctaattggagtttccatcgtacttcaaaaaaaaaaaacgattgggtcccacactcacctctccgtctcttccacctccatagatagattttttttccttaagcaaaaaagattttatctcactctcaatagtgttagtattgtcacagagaaagcttcagatctagaagaagaagcagagttcataaagagaaacccattttaaaccctagaaatcaagtgtcaatctcggtaattaaagtttatgcctttttctttttactgttagatttgatcaattttgaggtctttagtctgttccttaaggttttgattgctttggttttatcaccaatgctgtccgattctcttgaagattctgttttttttgttcagagatctgcttcttctttctgtgctttgcttctgcttgatcggattttagatattgcattctgagcttgacttcgtttgctttctgtgtcatggtgaaaaaagggtttttgagcttcgtaagtcaaattttttgtttccgattcttaatgtttggtctgtggagtttaatctttggttagagtgattaagaggttttagattccgaaaaagattctaactttgattgagaatatctacagcgtatcttttggtgtttgttattgttttttcttagcttcgtaatcttagttcagtttcattataatctgatgcagaagaaagatctgatttgagcgatgtataattcattcttagtttagttttagtctctcattggtttttgtttttgatattttctgcaggaaaccttctgattccgcaacaatg

SEQ ID NO: 23104 - DNA, 3000 bp, Unknown; identical to SEQ ID NO: 1120
  misc_feature (1)..( 3000): 2750-1469P.txt file - cDNA_ID_2130917; gDNA_ID_1620361; Annot_ID_154649

SEQ ID NO: 23105 - DNA, 3003 bp, Unknown
  misc_feature (1)..( 3003): 2750-1469P.txt file - cDNA_ID_2130927; gDNA_ID_1620361; Annot_ID_154651
aagtgtaagaaaaacgaaattcatcataccgttttgtaagaatttagttgcttgcttgttgttatgtttttttcatctttcgtttagaaattcatatatggactagaggtaactattgcaaaatacatatatagtttcaggacctgagcaagaccattttctaaaacagaatctagaggctttttctttgtaaagagagtaatttaccttgcaaaaataatgcatccttttaacacttaatctgtccaacttgaattccactggagaaagaaaggttcttatcaaccacagaggatttgccttgagaacaaacaatatatatatatgatgcagcagaaacaaaaaggcgccgttcttgaatcaaagaaatcttattgaaggtcttgtgcaaaaaagataaaatatccctaatacttacccctgtcaggtccttggttcgatgtgttacccaagcaaggaatctttttcataatttcttttagcttttctgaagaacggacctggtgaataaggagcaaattctaagaaagagaaatgcatatatggactgcacaagaactagaggtaattattatacctcctcacacgcagaagttaccacatttaacctttctttgagttctgttatctgcacagtaacaacagaaccaagaatatacagttacatagacgctggtaaaaccaaaacgttttcctccaaagaatcagataacagaaccgccggaccttagtgccaaattgagtcttgaaggaaaatactctaagctttgcctcaagtcgtggcaccttcattagctctagtaagtactgcgataaacaaaattgatggcagaagtcaatgagttagctaagtaagctaattactaaccatatttatttatagtaggaaccaaaaacagtgcgagattgataacttcaacagacctgttcatactttcccaaggctgccttgtcaccagtgtaggtctacaacaaatcagtcaatcacgacaaagaacaagaacccgtgtcaataaaaagtgaataatgatgattaaccaagaactgacaaatatcacaaaataaataaatagaaagtaaataatgcaactactcaaaagtcaaaaccttaagaagctccatctcctcatttgttgggcaaaactttataagtttctctatttgatcaacatctactacagactcatccattgccaggactgcagtctggacgatgcaaagaaaaaaatgtggactattatcattaagctatgaagcgtaatgacttcttacccaggtaattaatgtaggttttgtagcttaccatcatatcaggcagcggcatcgaaagattaataaccttgttattggctctcatatagtaggatctaacattaaaaaccctgtaactggctctcctaaggtcatgctggaaaaccataagagagactatactttcaaaagtctccaccagaaaagagcaagttaaaaaatatatgtgacgcaataaccaaatgtgttaagaatatttcacattaccagtcgaattttttcaggttttgcctcaacaaagaaaagggtctctaattctgatatatcaagttctattgcactggcaaaaaaaaataagaaatgattacttgcaaagcaatggtcaataaaacgtcagtacgtattatcacatagaagtaagagaaaagccaagataaagttaaagtccaatacgtttgtgaatctccatgtcgtctctgtaactcatcccataagctcccctgcaaatcgcttgttattttaacccaatgtaaaggcttcagggaggccctttttttagctggacgtggaaaaccccacaccattcctgcacccgtatgatcaaaggcatcaaacatcggaggtaatcttctaggcataggaggaggacgtggtggtggtggtggtactcttccaggcatcggcgccgccatagcatcagagccagagatctcgacaagcgacattggattaggaacaaacagacgatttattacagtttatatacaagaccaaacagattgttttagatcatgttcgatctaagtcagagcatataagagaatgatcaatcgcataaatagacttgggaaagcacagttgactttgggcaaaagaggttgtccaggtttgaacagtcgagaagattcctagaagaagatagcaaggaaacattgttagcattaaaatgttcttttttaaatttcgatgcaagcaagaagtgcgagatctgctgggccatcattatggtcatgaaaataacctatatttgagtcaaacctagttattttccctttagtagtttactattacacaagtctccaaaacagagcattttggacataatcatgagccctatccgcttccaaggagaaagaaccgatcatgtacgtatcccactcactaatatgctaatccaaagacggttaaggattcggtttatggttttgcttacaaaatatttcaacggtgagaaagagaaagacaaagtgaagctttattggaaaatataaaaaaccttgaaaatttcattattttttgtttttaagattttttttttggaaatttcagaattttcatttttgtcctattttcgttccctaaaaaaaaaaaaaatatgaacgaaaagaaattagcaagaaaaaagtgtaaaaaacagaggataatgatagttattcttctttttttcctataaacatcagagatagaaactacatacaactggacaaaaaaagggtagaaatttcttaagaaacaaattactttgagtttttatttccaaagaaacaacaaaccatttgcaaattctttaaaaacttaattgaatttcgaaaaggccaaattatggcacgtttttattttatttttgtcgtatggcacgtttattatataaatccgtaccattagttatctcctcttttatttcccgcccattaaaacatccaactttcttctgttcttctgagtacgaaaccctaaaaagtgacagagatg

SEQ ID NO: 23106 - DNA, 3003 bp, Unknown
  misc_feature (1)..( 3003): 2750-1469P.txt file - cDNA_ID_2130943; gDNA_ID_1620361; Annot_ID_154656
aacgatgtggaaagagttgtagattgcgatgggctaactatttgaaacctgacatcaagagaggagagtttagctatgaggaggaacagattatcatcatgctacacgcttctcgcggcaacaagtaaaatcctagcttgccgaaatccatataaataagggtatatataattaacacattattaaagtttatatatatgttttacttaaaaggtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacgatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattacgacgacaagaacttcatatgatccgttgattgcttaccggactagagttgaccggttaatgtcatatggttctcttagatatttgtcaagttatagtaaaggtccactatagggtcactatatattaatattcagtaatggattctcttagttagagaaccttgtgatgccgtggatcaattagtatttgatttgcgggagacacgagttttttttccttctattgttgtttgtggatttacgtactataaataataaataaaacacccatttgattgcaagcgttcactgtactaaaaccatttgatttaaagtttgagccttagtttgtctgacagtctgagccatgttaccaaaaacaatgaaaaatatgtaacacattttaggtttttggtgatatgaaactccgaagaaacaaatccctactgactactgagaaagtcgataagcttttttgtggataagtttcatggatatattagaagtagtaaccattaaccaacaaaaaaatagcttaagtgagttatcaagggatcgatgaacaattatgagatccaatgtgtttttgttaagaggcaaaatccgatgcagtctctatgagacaaaatttccatgggaaaaacagagagttctgaagtctctctaccttaaacatgtgcaagccttagcttcaaatgctccgtaaggttttcatttaaaaacatgaaataagatagagaaatgatacttgatccaactgatgaagattaacaagataattttgaagcaacttctgtttgtataatatgtcgtacaaaatctgctaccaatttagaggccaaattattttcttttctagacagtttgtgaggtgggcagctgaaggtgtttaagccaagattctcaagatttataaatcttgaatcgaattaagctatcagccggaaattaggaaatgatatgcatatagggactaaagatatagttgttgcattaaaaagcttaaagagagaagtggatgtgaaaagaaaaaaaccacagatttttgcacacaatcttgtgtgttgattgatatccaagtagactaattagactgctttgttctacacgataattggttgtttttagatatcaatacgaaacatgttaaaatgtgaaaatattttagattagatgataacacctgaatttaatgacaaaaaaaaaaaaaagtggatagagactagagggacagcaaggctgtgtgacatatatgggcagatagacaaagaagccgaaaaacgtgcaccgtccaagattctggctactatacctaatttccttcccgcagggacttgacaaatatcactatctgccatttttagttttattttgtattggtgtcaaagaattgaaataatgaacaacggtcgtaaaaagatgtaaatggtgtttgattgattaatgtttttttttttttcttagtatattttagcaattgcatattatcatataacattaattaataattattgtgttgtagataaatgtcatgcataatgcagtaataaatgtgtgtgcatatattatatatacacgttaattagatgctaaaatgagtgacatatcttttaattctttgataacaccatttccataaatcattgtaaaacttaccttataacaaaaaattaataaatgttataggggtcaattgacccccataactctacactagccccacctctgcggataagcttaacatgtctattaatattcattagtttacgtggtttaaaagtttattgtcacgagtgcatgacacttaccgtgatgttgactatatgaagaggtagatcgtacgtgtacaaatgacttcatagatctttgatcttttttttcttcttcttcttttttggtaatattctttagttttatttgatctattgtcgttgtaatgatctttgattacaaaggaaaaaaaaaactaagacccttgacgaaaataataaccgtattcgtaatctctgatatcctacattatgtactatttctgatttttgtttcttatacgcacttttgttctagatataactaagaaaatg

SEQ ID NO: 23107 - DNA, 3000 bp, Unknown; identical to SEQ ID NO: 1116
  misc_feature (1)..( 3000): 2750-1469P.txt file - cDNA_ID_2130955; gDNA_ID_1620361; Annot_ID_154659

SEQ ID NO: 23108 - DNA, 3003 bp, Unknown
  misc_feature (1)..( 3003): 2750-1469P.txt file - cDNA_ID_2130966; gDNA_ID_1620361; Annot_ID_154662
tttagctaaagctaaagttccattaaaagagtatttacgtgtgattaatgcgttttcttctctcatccattttgcttccgcagtacttcctagagctaatgaaggttccaggagtagaatcgaagctgagagtgttttccttcaagattcatttcggtactcaggtctggtggtatttacctataacgttttggtttttgtcagtgtctaagtaactgtagattcttgatctccttttttatgatgattactttgcagataaaagaacttaataaaggtttaaataccgtaaattctgcatgtgaggaggtaagatatttgcaatacttaaaactcaataatttacgcagcccatttgcgtttatctttcttagacattttctccttattgcttgtttatcagatacgtacttcacaaaagctaaaagagattatgaaaattattctctgcctggggaacatattgaaccaaggaactgccaggggtgagtattataattattttcttacccaaatattttttttctgtagcttaagacataacacaataaaatttctctgttcaatgtgggctaagttcaagaatggcgcctttgtttcattacatcataaatacttgttttgtatgaacgcaaatcctttgtggttgataaagaccctttgctctgctttctgcaggcagtgcagtgggattcaagttggacagtttattgaatttaagcgaaaaatgttctgctaacaccaacatgactctcatgcattatctttgcaaggtaaatttcaatcaaaagaagtagaatctatttatactgaaacccctaatctttctttttctcaggtccttgcttccaaggcatcagatctactggacttccataaggatcttgaaaatctcgaatcagcttcaaaggtttgcatttgtacgtactttttatccgttcttagctgtaattggctcatcatttgattgtcctgttgattcagatacatttgaagtcgttggctgaggaaatggtagctataaccaaaggactccaaaaactgaaccaggagcttaccgcatccgaaagtgacggtcctatttctgaagttttccgtaaagtatgttgttgtttttcaatcttatccatcttttatcaatcatgaatttgagattaggtctatcactttgccacattactaaatctgcttccatcattttgtaaaatcaataacagctagaaataattcttcagctaagtttgttttttcctacataacttcttccggacgctaaaatctagttttatgttttcgacagttattgaaggacttcatatccgttgctgaaactcaagtagcaactgtatcgagtctttactcctcagtggtaatttttgtcaacctctactagattccaagtaccttacatttaaaaatgtgtttgatcctgaaattaattacttttgtttttgaatcttatgatggtggaccacagggaggaaacactgatgcacttgtacactattttggcgaggatccgaacgattatccatttgaacaaggtatacgatgaacttcatcatcctcatttgtgctaatatacataaaaagtggctggctcattgtttttacgtagctaataacaatacatgattatcgatattgcctgcagttaccgcgaccctcttgagttttgtaaggttgtttacgacagcagcacaccaagagaatgtcaaacaagcggagttggagaagaagaaagctgcaaaggaagcagaaatggagaagacgaagaaacgagtcagtctcactaataaaaaagcaagcggagttggagaagaagaaagttgccttatataactgaccatagtgtggtaactcagatattttgtgttgatttaaacaagcgatggaaatattttcactgtttggtgttgttaatatgtgtgtggttacaaccacgttttttttttacgatcaacttgtgctttttcccatctgtcgaaacacgttattattgatttttagtaatccccaattgcaattattgtatcacattcatatttacagtagtttataattgaatcggtattagtgaaccatatattaaaattttaatcagcgaagacccatatattaaaggttgggcttaatttacttaaaggccggcccattgatgacttacggagtcacgtgagacgtgacattctccttatgggttctttgacttttgttcatttcaatccttggccagtttggtctttctcttcgtcgactcttttgctgaatgtgatttcgaagttttgtgtgaatgaatcaaaatcttcagataagtcggaatcaaacttttaatttaatttcagacagtatgacacatgtgacatgtcatgtctctcccctcaactcttgccatgtcttcgtctgtaagtttcctgagaatattctccattttcctgcaatccaatcttctctcttctccaatgataatggcccagcagatctcggatacgctcttcttgcttaatcgaaattgaaattaaaataaaatattttagtgctaacaaatgtttcattacactatgttcttctaggaatctagttcaaaacttcatttttttctcttaaacttgcttctaggtctgtaatgctaattttattgttttgtaatggaaaggatggtctaaccgacacatatataaaggagtggggcttggtttagttagcggcccattgggcttcctgactttgttgttttgggtagataataaattcgatgccgttattgattaactattcaaaaaatggatcagacaatactctctgtcttgtcttatcttgtcgtccctccaattttggacaagtcttttccacaaagtcaactgtgctgccattgatcattctctttatattttttctgggaatttttgctctgaactagtgttatttgctctaaatcggtgaagaaagcagtttgctattaaatctctctactaaatcatctgtttggttcctgatccaatg

SEQ ID NO: 23109 - DNA, 3003 bp, Unknown
  misc_feature (1)..( 3003): 2750-1469P.txt file - cDNA_ID_2131002; gDNA_ID_1620364; Annot_ID_154762
taacaaaatagaccaaattaacacccactccttcttgttaacctcacgttataattatttcaagaaaatttagatttcatcatttcctgttgtttaaaaaaaattataatctcatacgtgttagtccacagcttcggaattaaaacaaggttcgctctgttttaggactgagtttcgacgtttctcctgtagactgggttcttcttctttctctgttcttcgtgctctgtctgcaggtggaagacgagtctgtgctgggtttttcgtctgggcttctgagctctctgctttgtttctttttggattcaaggtttttcttgttttattttcgggcatgtgtgcttggttggccctagtggctttgtatgttttcagggcctatatgtccttttgggcttttggccttgtaatgttttaatggaaatataaaattttaaaaataaaaaaaaatagaattaatcataaagctctctcaaaaatatgtcatttacaatcacacctaaacgattctgcaccaattaaggtttcattgctgctcagcaactcttttcttctttcttttttttggttttgcaagagttccaaaataatttgagtagtctattgagcttgttaccgttacgcgctcatgacactctgattatagtgaccagtgaggcagtgaccactctcaactaataatgatatcaatgatcttgctacaagttgtctgtattaactcatccttgtttgtatccaagtaattattttagtgactaaggcaataacacatgcagattcacgtcaatcagtttgtcccattcctgacagataacttatcatattcgttacaatgttgtcatttttttaaaacaaacacgtacgacatgtataatttagaaggtaatactcaagaagttgtcaataaattcagtatctattattttatgaagatgatatgatttgacctaaccaaattcttcagcttggtgacggacgtataacgaatacttattggttgtcatctacaattatatatgaattgcttcataaactatttcgtcggcaaaaatttctttccaatcctgaagcgaaattattcatgttggtaatagactaataggctaattaacagcgcttaacgcgtgaattttcttaaatcatctttcctttaattaattatcttctcaaatactctacaattatataaatgattaattatgatccatgactttgtctattgtatataaaaatatatatattataatgttgttaatatttacaagaaagaggacttttttgaaaaggaaacttttttgtctcctctataattttggtgcaaagaataattatatatgaatgtaaacgtttagtaagacatgctttgatgaaaaaagctcatttggtagcttactggaaagagctttttaacggggtcaattataaaaccttaaaataatatctaggcatccctcttggaggacaaccaaaaaaaaaaaaaaaaaactactctgtagagaacaaaaagatgaagtctagttggtaaaaatttaaagttttcgtgttaatattaggttgaaaaaactatattctgttaaaaaaaaaaaacatacacacaactaattaaattggacctacagttattttttcaacgtactacgtatttacgttaggttagattatgattgatcaaacgggttctatttattaaaattaaacaaatttaattgatacattaatgtgtcacgagttcaactaaggaattaaaatactgtgcatggaaatattgaatttgcatatactgtacacgatgagaattaaataaattaaaatatatatatatatatatataccccagcctcgatttgaagtggacaggttattttatttcaaatagaacgatataaatccactgtatatctattattttttaacagaattggacctacaaaaaaaaatctgaaattgttgtatcgaagtgagttggtcagtcagagattatgattgatcaaaccaggtcccattcatcaaaataaatgatatttttagttttttttgttgttggaggaaatcaaaattaatgaatatacaatgtactagaggcattcaacatatttaatcggatatattaatgaattcaaatatattgtttccatgaaaagaatttactatttagatactaatcgataatcatactattgaacttcgatattcacggagagaaattatagaatattaaattttggataaggattagctccgatttgaattgtggctgagaatgatatcggttcatgctggtcaaacaagtcccatggtttacttaaaaagggagaaattagcaaaatgggtgaaatagtctgttttctttaaaaattataatttatcaaacgacacatatataattactttttatcttaaccatgcatataacacataaaacaaaaacaaagttttccaaaatgtgatcatagagtaattatgtatatacaaatcaacaattgtaagaaaaaatgaatcatctcataatatataattaaccaataatgattagcaaatgatgtaaaaaatcaaaattaattaattaaatttcctaaaaatataaactaaacaagtacagtatttagcttgaaaaaagatatttatgaacaatcaatatatcacatgttgtctgtcgacaaagacaaatgtaaaaaacaatcaatgacctttaatttcatcattttgattgtacttgactcgtgttttttgtctaccacgtctcgtcgtctctttgatttattattgattgattcattcatttataatttccacgtttcaaaaatgtcactagctagctaagtttatgtagctatattcttttaaccttagttctcaatgcagtaataaccaaaaaaagcaaaaaaacaattgttgaccaacaacaacaaccaaaaaaaaaaaaccactatataagcatgccccatgacccatatatgacaccacgagaagcaaatcaaaatcagttactctccgtccaaaatg

SEQ ID NO: 23110 - DNA, 3000 bp, Unknown; identical to SEQ ID NO: 1153
  misc_feature (1)..( 3000): 2750-1469P.txt file - cDNA_ID_2131018; gDNA_ID_1620364; Annot_ID_154767

SEQ ID NO: 23111 - DNA, 3000 bp, Unknown; identical to SEQ ID NO: 1154
  misc_feature (1)..( 3000): 2750-1469P.txt file - cDNA_ID_2131039; gDNA_ID_1620364; Annot_ID_154773

SEQ ID NO: 23112 - DNA, 3000 bp, Unknown; identical to SEQ ID NO: 1155
  misc_feature (1)..( 3000): 2750-1469P.txt file - cDNA_ID_2131052; gDNA_ID_1620364; Annot_ID_154778

SEQ ID NO: 23113 - DNA, 3003 bp, Unknown
  misc_feature (1)..( 3003): 2750-1469P.txt file - cDNA_ID_2131080; gDNA_ID_1620363; Annot_ID_154718
cggcattttccgaaaagtaaaattgaagggacgcaaataatatttatacttatttaggtattttattttatatccgaaaaagtaaaattgaagaaataaaaattgaattttggaaaataaaaattgaatttttgaaaataaaaataaataataaattaattgaaatatgagtgaaactcaaattatatgaagtctatgcaaatgaaagttaacttgaattattcttcatttaaatgatcaattatccttcatttaaactcaaatattaaaactggacttttaaatagtatctaacaattcacaaaaaatatctaggagatgtgaggataaaaagtttggcacattcttaaataatttaatataaatatgcaaactcaaatttaaaactcaacccaaaaactttttttaccactatcaaaattttgtagaaatatttaagaaatttgtatttgataatcagccaaactaaaaagataattgttgtgtgattacatgaacatggtacatcaatagaggagcaaaaccaaacacaaacaatctaaacaagatggactcctcaacacgaaacattaccaccaaatacatacaacttcgtcaaggaccttaaatttaagactactctatgccgaaacatagatagtagaaaacagagcaaggaacataatggcgagaggttagatagagtaaagtttaggtaaaatgaattttatatagctcctttacgtctttgtcaatttcatacttttatcaacaagacatatttccgacttcgattcaaagtcgtacattggaaaattatgctttagaaaaaacaaacttgacgaccaaaaatattttttaaaacttaaaaataaaaaaaaactgttaataaaaaaagtttcaaaaatagcttgagcaatgcatgaaagagagctgggagtgatagtagaagcaaaaaaaaacctttcaggagatatatataacccaaaggccaaagctctatattagaacacaaacattaaacattaggcatggaaaactctcaattagtttcgatcactttcttagcttacactataatcatatcaatcggctccatcaactgcatagacaacaataatcttgtaacaaaccaatccgctctgttcgtgtttggagattctgtgttcgatgctggaaataacaactacatcgatactctctctagtgtccggtctaattactggccgtatggtcaaacaacattcaaatcccctactggaagagtctctgacggacgtttgattcctgatttcatcggtaccaaaattactttttcgtttccttattttattttaaaacattttctttgtaactgatcgataacatggcagcggagtacgcatggttaccgttgatcccgccaaatttacaaccattcaacggtaacagccaatttgcctatggggtaaactttgcgtcaggtggcgccggagctttagtcggaaccttttctggattggtattcattagtaactactttacattggttttatttatttgttttcttttgttgaatccatggtaattgtttgtcttgtctatttttttttctttttcaaaaaacattttcaccactgcaaggtgataaatttgagaacacaattaaacaacttcaaaaaggttgaagaaatgttaaggtctaagttaggagatgctgaggggaagagggttatctcaagagctgtttatttgtttcatattggactcaacgactatcaatatccattcactacaaattcttccttatttcaatccatttccaacgagaaatacgtagattatgttgtcggtaacatgacagacgttttcaaggtaaaaaattttcaaaagggtttttgtagagtttctattgtgaacaacttttggtctgaaaaatgagagatgatgttgtgttcttaggaagtgtataatcttggaggaaggaagtttggaatcttgaacacgggaccgtacgattgtgcaccagcctcattggttatagaccaaacaaaaataagatcttgtttccagccggtcactgaactgatcaatatgcacaacgagaagcttctgaatggtttgagacggctaaatcatgaactatccggattcaaatacgcccttcacgactatcacacttccctatcggaaaggatgaacgatccttcaaaatatggtaacaaaacttggttaataattgcaatatatataacagagtctttactataaactttttgatcgttttgaagggttcaaggaggggaagaaagcatgttgcggaagcggaccattgagaggaatcaatacgtgtggaggccgaatgggactgtcgcaaagttacgagttatgtgaaaacgttacagactatttgttctttgatccttttcatttgacggaaaaggctaatcgacagatcgctgagctgatttggagcggacctaccaacattactggaccctataatctcaaagcgctgtttgaacttaattaaagctcactatctcgtcgtgtcatcttgtttggttttcattcaaaattttttgtgtatttgaattgtcaccagaatctttcagttttcttagactcttggtctccaaggctttacgcgagcgatatatatcactcgtttcgattttgagtttttgaccgtttgaactttgaagagtgtttcttcaaattaaaccaaaccaattttacaaaaccaaaattcataactgattcttttggttcacactaaaccgagtttatcaaaactactttaaaatatggtttggtttaaccaaattatacgtcttaatcaatgattaggagactttattaaagtctataaccgcaattcgtcatcaactaccatttccttctccaatggagttcttctctgagagtgagaggaatcactgaaaaaataatactgaccatttcccaaaaagttatgtacttattctgacgaaatctgcaggaaattctcaatttttttaaaagaagtagctttttggagttatg

SEQ ID NO: 23114 - DNA, 3003 bp, Unknown
  misc_feature (1)..( 3003): 2750-1469P.txt file - cDNA_ID_2131084; gDNA_ID_1620363; Annot_ID_154719
gattttgttctgtatcattacccataagctcaatctaacaatcggaatcattccttcgcttaatgtagctgctggtcttctcggcttcttcttcatcaagtcgtggactgggttcttgtctaaattagggtttttatctaaaccctttactaagcaagagaacactgttattcagacttgcgttgtctcctgctacggccttgcttatagcggtaaaaatcgttacttgcttagatatgggttaatagtaatcttcttgatttggttacgtttagtttcaattcctatgtgttgatgatgaacaatgggagatatggatgatactaactttggatccacttgatgactttgctgaagggaactgtagctattccagatttatgatgatcaagtttgatttttttgtgtgcctaatctgatatagtttcttgtttttttaggaggatttggttcgtatttgatagctatggatgaaaggacatataagctcattggttctgattatcctggaaacaatcctgaagatgttataaatcctggattgtggtggatgactggctttttatttgtagttagcttcctcggtctcttctgtctcgttccacttcgcaaggtagcgtctcattactgcgatattagtattaatcaaaacaaaatatctaagagaacactattgtttgatctgttgatccttattcaatagtgtatcttaggtgatgattttggattacaagcttacgtatcccagtggaaccgctacagcaatgttgattaacagtttccacaacaatactggagctgagcttgcagggtaattgtcagagattcatcttcaatattcaactccctgcaaaacattgcttgagtttcattaaaaatttatctccaatattattcacatcagaaaacaagtcaaatgtcttgggaaatacctgagccttagcttagtttggagttgcttcaagtggttctttagtggtattggaggtgcatgtgggtttgatcactttcccacacttggtttgactctattcaagaacacgtaagttaaccaatttcgtacagtttaacaataagtaaatgagaatggtttagcatgtggatataattggtaacgagtcatgattttttctgctgtgcaggttttactttgatttcagtcctacttttattggatgtggcatgatatgtccccatttggtgaactgttcggttcttcttggtgctatcatctcttggggttttctctggccatttatatcacagcatgctggggactggtatccagctgaccttaaagccaacgatttcaaaggtctctatggatataaggtacacaataaaccgattaagtaggaagaatttaatgttagtagatgaatttcataggtactctcattgtggtggttactgattctctttcatataattactgtacttataggtatttatcgccatttctatcatccttggtgacggtctctacaacctcattaagatcattgttgtcactgtgaaggaaatctgcaacaaaagctccagacaacacaacctacctgtctttaccgacattttaggtgcgaatatatatgatcctgattcacaatcgcgtttgttagtaatagtcatagttattaataaaggtgtctctcatgaccatactgacaacgtctgtctcaaatattttcttaagagtttctttctccattcttaattcagataaaagtaagacctcagtattaatgcgggagaagaagaaaagagatatcatatttctcaaggaccgtatacccctcgagtttgcggtttctggttatgtgggtcttgcagctatttcaaccgctataatcccgttgatattcccaccattgaaatggtactttgtcctctgttcatacttagttgccccgggtcttgctttttgcaattcttatggagccgggctcacagatatgagcatgccttcaacctacggaaagactggtcttttcatcgttgcttcaattgtaggaaataatggtggagtcattgccggtttagcagcatgtggcattatgatgtcaatcgtctcaactgcagcggatctcatgcaggattttaaaacaggttacctcacactatcatctgcaaaatccatgtttgtaactcagcttttgggtacagcaatgggttgcataatcgctcctctcacgttctggctgttttggactgcttttgatattggagatcctgatggtctatacaaagcaccttacgcggtcatctaccgcgaaatggctattctcggggtcgaaggctttgccaaactgcccaaacactgtttggcactttgttgtggattcttcatcgctgctctgattgtaaatctaattagagacatgacaccaccaaagatctctaagttgataccacttccaatggcaatggctggtccattctacataggagcttacttcgccatcgacatgttcgtaggaaccgtgataatgctcgtatgggaacggatgaataagaaagacgcagatgattactcgggtgcagtagcttcaggtctgatctgcggagatggaatttggaccatcccatccgcaattctttctatattaagaatcaatccacccatttgtatgtactttagaccatcctagacattgttatcatgttaaaaatttgttgcattatggcagataatagagtttttatatctcactctagaacacaaagtgccaatagcaacaagtatgtggcataaagtcaaacagacaaggttgaccaacgaaactttatttgggcttattctgtaagcccatagacttttgttaagaagcccatacgaatctctttcctcgtcttttcgaccgaaattattaaaacctctaattcctcctcaaaaaccctaaaatcccaattgagaaaatttagacgctcaaggttttgtttacatcttgtccggtggcttgaaacaaattcaacttctgcgtactgtttctttgttgaatcatg

SEQ ID NO: 23115 - DNA, 3003 bp, Unknown
  misc_feature (1)..( 3003): 2750-1469P.txt file - cDNA_ID_2131093; gDNA_ID_1620363; Annot_ID_154722
catgttgatttgattgagctttggattggaatttttttttttatttttttttttttttttttttctttggattggaattcattcggtaagtaagaatatttcgtgattatagaacttctaattatgtaaaaaaaataaaataatgcgtgaaaataataaaaagttgttaccctttttttttacttaggtcaagaggtcacaacacacgccccaccttgaatctgagagagagagagaagtacgtccccacaccttgacatggtcatggagcccaagaagaaccaaaatctaccaagtttcttaaacccatcacgacagaatcaggacaacgacaagaagaggaaacaaacagaggttaaaggtttcgacattgtggtcggcgaaaagaggaagaagaaggagaatgaagaggaagaccaagaaattcagattctttatgagaaggagaagaagaaaccaaacaaagatcgtcaccttaaagttgaaggaagaggtcgtagagttaggttacctccactctgtgcagcaaggatttatcaattgactaaagaattaggtcacaaatcagatggtgagactcttgaatggttgcttcaacatgctgagccatcgatactctctgctactgtaaatggtatcaaacccactgagtctgttgtttctcaacctcctctcacggctgatttgatgatttgtcatagcgttgaagaagcttcaaggactcaaatggaggcaaatgggttgtggagaaatgaaacaggacagaccattggagggtttgatctgaattacggaattgggtttgatttcaatggtgttccagagattggttttggagataatcaaacgcctggacttgaattaaggctgtctcaagttggggttttgaatccacaggtttttcaacaaatgggtaaagaacagttcagggttcttcatcatcattcacatgaagatcagcagcagagtgcagaggaaaatggttcataaagctcaaacctttaaatggcttttaattagatatatttagcgagaatgtgattgctagtgaaatctcaaacttgatagcttattcatagcttattttacttcgatcagcaagagaacaatggttcctaaagctcaaaccttttttggcgtttgctttagattgtgcatacataaagtgagaagatgaaatatggttttgctgaaatctcaatgtgctcattcatagtttattttgctcgacctttctttaatcaatagctttgatgtactgattactttataaagttaagaagtaagttctgctctttaaactgtactgaatggaggcttctctgcataattaagcaaacactctgatgattgagtttcgttgtacaaaggaaagtttttgccttagttagaaattcatcttgtttctttgcccagaagctggcttgctgatagaatttggactacgctacgttttcttgggtgaaaaacaatccgcgtccttccacgagaacagtgaaactgtacgatgttcttattgtattgtgtcaacagcccataatcaatgaaatgggcctcaatgacagtataagccgaaaaatattcgaatgcgatctagaactaatctgaaaccaaacttctcaaatcattaacatttgattagggcctaaaagtccatccgtattttaaaaaaaagttgataacaaatgcaaaaatacaaatatacattactattaaaactcaatctttctgattatatgtggatggagaagctgttttgcagtgtggatttgaattttgaagttcttgttcaaaaaagaaaagaaacttggtcaagcttcaaaagaaagaaagaaataaagacaagtatacaaatacgttgacttcaattaatatgaagatagaagagaaagatatagaaatgcgttttaaattggcggtgggagatatgtgattcccttggtcccgctttctcgtttgattcggtaacctaaaccttctccatccaagaagacacaaacaaggaagaaattaacctacgtacgtacatcatttgaactacttatatctattataaatggaaaatctattttcttcttctctctcttttaaccgaaaaaggaaaagtcctcgaaataactctttaatataattcatgtggaaaccttctatatattttttgcatgcttttttgaaattaagtaatggcatactaattagaagaagacgaaaaataatatgtctaagtaattgagtttcgtggtcaaggcaaatcaagattgcattctttaattaagtgtacaaattatgatgtaagaaccgttatttggcataacctaatatatattaaaaactgattttttttttttttaacttctgtaagaaatggttttcttaattaccaatcatgatctattattgtaaaatgtgtaattttgtgttgcgattgaagtgttcttagataaagatatgtcatatgcatgatatcatctatttgattttgagaaaataaaaacataacatgagaacatcgtagagagtaagatacatgacaaagagaaagaataagctaagaagtcatccaaaaattgggaggcctactctcaactaccaaaaatacaagtgtttgttgtgttaggtcatttattcagtcacctaaccctaactatatgaaatacgttaaaattcatatatagaaaaataaagaagaaatactattagtcaatataattttttttaacaaaataaaaataaagaaagaaacactattagtcaatgaattaaaaaaaaaaaaatccatctttcgatcaagaccgtccaagtattctcctttcacataactcttacgttttacactaaacaagacgagatttttatgagcttgtggctcccacaacaatcctcattgatttctccatatatatcacatgagaatccaactcgacttcatactaacattcatcccaaaagttccattctttttcacaaagccattgtgctgttttctccatttggatcaaaatg

SEQ ID NO: 23116 - DNA, 3003 bp, Unknown
  misc_feature (1)..( 3003): 2750-1469P.txt file - cDNA_ID_2131097; gDNA_ID_1620363; Annot_ID_154725
gaaccaagtcgttgaagatgttgagtgatcagaaaacgaagcttctcttcgccgttgatggtagagccaagttcgagcctcaactgccaaaagggtacttcggaaatggaattgttctcacaaactccatctgtgaagctggggagcttatcgaaaaaccgttgagtttcgcggtgggattagtcagagaagccattaagatggtaactgatgggtacatgagatctgctattgattacttcgaagtcacgagagcaagaccttctctttcctcgactcttctgatcactacatggtcaagattgggtttccacacgacagatttcggttggggagaaccgattttatccggtccagtagctttgcctgagaaagaagtaactctgtttttgtctcatggagaacagaggagaagcatcaatgtgcttcttggacttcccgctacagccatggatgtgtttcaagaacagtttttacagatataatatgaacaacgacaaaatacaaatatctggcaattattgtcaaaacctattcgttttactctgtttttcttgcttccttttttttttatctttttgatttatgctgaattattattgttatcttcatcttaaacttgtctgtatcttgcatcaagtttcaaccataaatttatattatttcaaactatattgtaataatattattacttgaactgtttcagagatgttgatgtttttaacaaactaaaactcatatataaataaaataacaaaagtctaaagataaaatacagaggacaagaagacagaacagagtgatcctgttcttgtcttaaggacaaagttagagtagaaacaaacaaagacttagattattgcagtttgttctctattacttgccacacaaatgaagattcttctctaaaggtctgaaatttaaagcagtaaacccatagacacagagattagatatcttggacttaaacacaacctgctccgttgtagttctgaagccaggaacgttgcaggaatctttggacctaccgatcaagcttgcttgacaggaagccattagagaatctttctttgcttcagcggcgcaagcaacgccttccagagacgttatgtctagcttgtagagtccaagctcatttgtggttcgatttgcagagaacgtaatcatctctctagttctcgatgaagctgaattgaatctgcagattattctcacttccacacctgtatttttttgttcagttaaaacaaaagtgagagacattttaactataatttcaaacaatgttgataagattctttaccgggaatgaaatagctgtgattggagaaactgttgttggagcagacgtcgcagtaaacaagacccattacagtgatctttccatttggtttggctgaagaatgtttcagagacagagagtttaaggacagaagttgcagaagtaacagaagcattatcagtttctgcttcatgttcacaagtttcagtttttttctttatccttggataaacacttgtttacagatgaggtttcctttttgtttatgtggttgatgaaagaaacagacaaagaatgggccaagtggttaaagacaaaagaacaaacaaagatcaaacagtaactccattcaaacaaagcttcaagcttgtcttttttataaaactcaagactcttgtggaaaaagagatgagtaaagagaggcacaaagagatgagaggccaattaaaggaaaagtagagaaactgagagattggttggttaggtttaacatttattgagctctcatgctctctattttaagggtttttgtctatgaatccccttataaaaaatggctaaaactggaaaatggaagggagaaggtaagccactagtgtgtatatatatgtgtatggaccactgaaagtgaagtgtaaacatcatcaattcatcagcataaacaccaagaaagtagtcagaggatatggctctttaaatatcaatacaagaagccaaactatgatattttcccggtttactctcggttgtggctgaattctggaaagagaatttcaggttaactaactatacaaagataagctcacattatagacttttgttcgtcacattatagaacagcataagactttattgcataacaatttcaggtttaagtgtactagagaagataagcttacattacaagttcatcagttggaaacaatatatgggcttgagctttaaagaaggcccattaagcttgaaattgttcttcatgtaagattgctgcagattttactttaattttttttttctttttttcttttgcccttaaattcttgtaatgcttctaggtgactccatccactttatgtgttgtttcccaatcatttctattttcaactttattttttcctttcacaaattattttaagttttaacattattttcttcaacatacgaaatttatacagtagtttttttttgcaggtacatataaatcaatagttgagaaaaagtggaaaacaatagagataaaaaaaattagatgtaaattcgctgtaaaacaaaatgtttaaatttcttttccgttatcgaatctcttttatgaataacaaggtcgagtactcaaggtaaggaaacagaccattagaaaagtgccacgtcagcttatttcgttcttcacttttagcttctgaaaagtactttacctgaactaaaacgacggtgacagactgactccagtagctgctaacagtcgatttttaaaatattatatttatttgcaggaaaaaaaaaaagtgaaggaagaagaagaagttggagaagccaagagcaaatctaattctctgactactctcattttcatgtcggagacttgccgaaatctaaagaatttcttcaacggagactgaaaagctttctcttttcttctttcgttatcttcgttttagtgttttcccctttgcttacatttgaagaaatcgagagcaagcgatagaaagtgagagagagagatg

SEQ ID NO: 23117 - DNA, 3003 bp, Unknown
  misc_feature (1)..( 3003): 2750-1469P.txt file - cDNA_ID_2131101; gDNA_ID_1620363; Annot_ID_154726
cctttgcttacatttgaagaaatcgagagcaagcgatagaaagtgagagagagagatgtatgtggtgacgcctcctcaaagatccggttttggatccgattgtgatttacgggtttaccaaacatggaaaggaagcaatgtgagttttaatgtgaaagctttaggttttggaattacttgcttctgtgtttatacttgagctagttttctgttatttttcctattattgtgtataaattaattattaatccgttcatgggctcagtttactctgtttccaatcttgtaaagcttaaaaattgggacttgggtttgtgttagaagtgtagctttctgggtagttgtctacatttaatcatgaaatctttacctttaatcaataccttaggacattatctgaatatgcttgctacatttataggaatgcttcttcatacaaaggttatatagttgatgctgtctgtatattgctttcaatgtcgaatttaaatctggtttagtagtaacctagtggaattaaacattttgaggtttgttccttaaatccttctacccaaagtgttaacatattttctaaatttgtcccatttctgcagatattttgtcttcaaggaaggtttatcttcgggccggatgtaagatcacttggtctgaccataagtcttattgtggcacctgttacaattttctgcatcttcgtcgctagcaaactaatggatgacttctctgatagttggggagtctcaataatccttgttgctgttgtcttcaccatttatgtgagtacaaaagtttagctttgcattgtaaaacgttttgtgactggatcattcataacaattaatgcttccctcaggatttgattttgctgatgcttacatccggaagagatccagggattatcccaagaaattctcatcctccagaaccagaagttgttgatggcaacacgggctcgggaacaagccaaactccaagattgcctcgtgttaaagaagtggaagttaatggaaaagtattcaaggtcaagtactgtgatacttgcatgctctatagaccgcctcgctgctcacattgttcgatttgcaacaactgtgtagaaaggtttgaccatcactgtccttgggttggtcaatgtattgctcaagtaagtttctcggtttttcgttttcctgtccgttagtttctgacatcagtctatataattcatctcattctccttgggaatttgcagagaaactatcgattcttcttcatgtttgtcttctccacgactcttctctgtgtatatgtgttcgccttttgttgtgtctacataaagaagatcaaagagtccgaagatataagtatcttgaaagcaatgctcaaaactccagcttccattgctctgatactctacacattcatatctacattcttcgttggaggcttaacatgtttccatctctatctcatcagcacaaatcaggtaccctaatcatttgcctctttctgaaaaaacctctctcattcgatatgcgtgtttaatcgtttgatctttctttattctgtagactacatatgagaatttcagatacagttatgatcggcatagcaacccacataacaaaggagtggttgataacttcaaagaaatctttttttctccaatacctccttcaaagaacaacttcagggctatggtaccaagggaaaatccaatgccgtcgagatcagttgttggcggttttatgagtccaaacatgggaaaggccaatgatgatattgaaatggggaggaagggtgtttgggcaatggctgaacatggtgatggcaaagatggcaataacaatgaacggtttcatgttaacgacaatgagttaaacgagttatcaccagacatggggaacatagtgaatggtgatgagcaaatcaataggccaaacaatcacccgaggaacgcaaactgggaaatgtcaccagaagttatggccttatcagcaagaagagcttagaagcaggttaagagaaaattgaaaggtgttttaaatgtttgatgtattgatgtgttgtgtgtttacacgggaatcaattgtgaattggtgtgatattttcagatgttatgagtatttttagttgttcttcagacatttaaatcgtaaatcattgtgtgttagtgtaatctatgacttatctttcacagaatgagaaaacaaaatgaataccgacgattttcatactgtactttgcatatgataaaaattgcagaaactgaattttcagacaagtggaccagaagaccagacaactcttattatagtcttcattgaagcacggctctgtaataaatgcaaaagagctctaaaggcttcttatttgttcttcaaagctctaaagtctaaaggttagagatttaacatcacaagccaacatttttggtttaggaaattgaagattagcaataatataaagtttttttggcattgaacaaagacaaaacacaatgaacataatcaacaaattggtcaaactaaacattaataagtgcctcaaagtatcagactaaatcattttcactaacatttatgaaaaaataactgttattaactgaggacgaaggtaactgaccagtcaaacatcatagacaaagacaataaagagagtcaatagcattgttcataattgttatttgtatgcacatgttataaattatataaaaagactaaccttatttcaattgagatgtcactattactgttttagcatcctcttctactctttatttagaacctttagtaccttaccatgtgagtgaagagttcaaaaacctctgcaaaaactttcttttttatctctctctcttctttaaacttactttcaaacactaaatagccaaaacttaagataccaaatttcaacaggtcggctttttcgtttgtcttctcttaagactttaccaaaagagatttgtggtttctggagttgactttggttgattttggtgtatttacaggggaaaaaatg

SEQ ID NO: 23118 - DNA, 3000 bp, Unknown; identical to SEQ ID NO: 1138
  misc_feature (1)..( 3000): 2750-1469P.txt file - cDNA_ID_2131128; gDNA_ID_1620363; Annot_ID_154732

SEQ ID NO: 23119 - DNA, 3000 bp, Unknown; identical to SEQ ID NO: 1141
  misc_feature (1)..( 3000): 2750-1469P.txt file - cDNA_ID_2131145; gDNA_ID_1620363; Annot_ID_154738

SEQ ID NO: 23120 - DNA, 3003 bp, Unknown
  misc_feature (1)..( 3003): 2750-1469P.txt file - cDNA_ID_2131157; gDNA_ID_1620363; Annot_ID_154741
tttcactttaccagccttgcacatcccttgaatgatgatggtatatgtaataattccaatatccatctctctctttcgcatatcctcgaataccatcaaggctttctctagcttcccattataacatagaccatgtaacaagacgttgtaagtccaaatattgggagcgacaccatccatttctctcttttgcatatcctcaaatatcatcaacgctttctttaccttcccgttataacatagacaatgtaacaaaacattataggtcctaatattgggaggcacgccacgagaaaccatatgactaaaaacttcttgggcgacattaggtttgcccacttgaccaaaaccttggataagagtagtgtaagtgatagtgttcccagtcaatcctttttgggacatctcgtagaagattttcatcgcatcatctaccttcttacacttgcaaaacccgtttatgagagaagtataagccactacatctggaaaacaacccttggtttccatcaaataaaacatttgtctggcctcatctacacaaccttccatgcaaaacccattgatcaatgaagtataggtgaaaatattaggagctatagacatacgaatcatctcattgtacaattcttcagcatccaaaaactttccttctttcacaaacgcatcgatcaatgcattgaaagtgattacatcaggtttgattttcctcttcgtcatacccctcagcaatgaatcagcatctctccatctaccagagttacaaagaccgttcacgagagaggtgtacataacaacatccggtctaatcccgtagttttccatttgatcgaaaaggctcaacgcgtaattcacatgcccgtttttgcaaagactatcaatgattgttgtatacattacaacatcaggtttaatccccatctccaccatctgattcaccatagacatagcctcctccattctattcccgagacagaacccattgatcagagaagtaaacgtgacaatatcaggctcaaaaccaagtttcatcatcttcccaagaaaagatgaggcaagataaggctgagaagattggcagaaacaattcatcaaaagattgcaagtatagagatcatgtgaaactcccattatctgcagatggtcgcagagattgatcacaacatcaaacttcttcattttggcaataacattcaataacttagtgaaatcgataattgaaggaagaggacgagactcaaccatgtgagtgaacaaatcgagagcttcattaaactgaagagagtgaagaccatttctcaaaatctctcggtaattacaaaaagctcgaacccagaaactaagatctaaaaggcggctaaaggagagagcttttccagaattacctttcacaagacgatttcggtgaagttgaaaaaatctcatcgccattaacgcaaatcccagacgaaattgattatgccgttgatcgatttactacaaaagctacaaaaaagtttggatgagatcgaaggtcgttgtatttaagaagcctaattttcgtttacttggaagatacgaagaagatgaaatttgagatttgagtaaagaagcggcggaagagaagatggcgaatatttgtacacgtgtattggtttgacttttgtataatatcgttgacttcacgtaaccagtctacaacgaccggttaactaaatcggtttgttcatttacagatccctagaccaagacttcatgttatgcctgattgcgatcacttgcagaagaattcctcctattattgaaaggaagtataaattgaaattttgtctaatttggtctcaattttgattttagttttggattgtgttctttgctattcaaaattcttaagagtaatttggtctcaacaatatcttaaactttatatgatccgatttaatccaaaccgttcaataaaattaatttctatcaatctaaaccgttcaacaaaaataagtaaataacaaccaaaaaaaaattaaacacattttaacacattcctcttatcactagataacaaaaaaaaaatctcaattattatttagttatgtttgattaaaaaatttatatttataagtttagtatatcaaatttattcaaatatttagtataaaaactaaataaaccgattgtacgcggtaaactgcgggtataattttagtataaaaccaaaaatgaaaggaaagatcttcacaataattaaactctatggcttaagaatcttattaaacgctaattccgtaagaattatatgaaacgctaattcggtaagagtttagtaaaccagattgtaacaaacgtgtaaatatttttctggttatgaattttttaatgaaccggattaaaccaggaattaaactgtgcgtttaattaaatatgaatttaagtactcaatcagcaaattggtattgactcaacatgatggacataagaggtttgtgacttctcataagagctttgtattttattgatttgaacacttttcttagtagtaaattaaattcatggtcgaatctttgtttatatatgagtagttttatcacatagccgtaccttgcctttggttggttttgttctgcttttctaacgaaccatattaaaaccatgtatttagttatatattaaaaaggtttaagtataattaaatagcaagaagattaccaaatccggcccaaaaaaatggtagtgactcagcttgatcagagagtctcaccaggattcgaatagggatattgatattcttaacttaattataaattatatttaggacaaagaactatatcttaaatcttaatagaggtggagctatggagtgacttttgggcgactcaatcaactaggttctcgagtgagatctcttttcacaaagagcccttatcaacataacccaagactttaggtgaaagtaacgcgtaccacaaacaccggtgaaaagaaacctatatcttaagggtttgtgacgtgaatatgatgaatccaatg

SEQ ID NO: 23121 - DNA, 3000 bp, Unknown; identical to SEQ ID NO: 1143
  misc_feature (1)..( 3000): 2750-1469P.txt file - cDNA_ID_2131161; gDNA_ID_1620363; Annot_ID_154742

SEQ ID NO: 23122 - DNA, 3003 bp, Unknown
  misc_feature (1)..( 3003): 2750-1469P.txt file - cDNA_ID_2131219; gDNA_ID_1620365; Annot_ID_154801
cataaggatcatcaccaccggtcaggaatgttatctcgtcttcgctaatctgaaaaccactcaacaagacttgtgtcatttttaagtactaagaatgatctgatctttcactctagcgtaaaagattatacctttataacatcagctaaattccagatactcattatctctttcctagcagcttcttctgatggccacaacggcaatctcaaattcgggtcataagataaaagactccctgcagccttagcgattttcatagctacaagctgagtagaacggcaaggttcctcaatcaaactgatagatccgtagtgaaagatcttggcctgtaattaaacaaaatcaaaccattggacttagtctcattccaaatgtggatcaaaagatgaaaaaaatctaccttttggatgaggttcttgtcaagctcagattccaaaagaagcatatcagcactcggatgcctgaagaacaaaaactccctctctccatcacctcttagcgtaacaaaggccaaagcagtccgtgcattatggtcgaatctcatcccagagttgtcaacattgttcagccttagaatatcagctaacattcttccaaactcatcatcaccaacctgagttcataaacaaaacttaaaactaagattggattcaaaacaagagcccttagattgatcatcaatggtaaatcaaaatcagacctttccaatgaaagcagaggagccaccaagtctagagacaccaacagctacattagcaggagctcctccaggagctttcttgaaagctggtgcttcagccaatgaaacacctcccaccgtaggaacaaaatcaatcaacatttcaccgaaacataccacaagagtttctgaatctcttgtgtcgatcgttagattcttgagattacctattaccaaaagagatgaaaaatcaaaactcgaaatctaacaacttcaaagttcctcgattcaaacacttgtcgcatgtacagatttcgttcttcagcagaaacaaacagagatctatctatagaacaaaaccccaagatgatatatgatcaaagaacaaaactttaagccaaaacaataaaaacagatacttaattccatgaaaacgaaaaacccaactcgaatccagctttataaagatcattcgacagcgacagatcaagaacaaaagaaagaaagattttaaaacgaacctgagattgcatcctcacccatttgagatcttcggaattcgaaaagacgaaaacggaaacagaggggatctacgaggaacagagagaagaattcgagagagcgagagaagagaaagatttgaaaattcgtgtgcttttattttgttgctaattgttagtagagatgaagagacgaagttggttatgtattagtaaggaatttatgctgacgtcatcaaatatgtggatttttccggtctactatgttacactcgtgtgactacaaaaaaaaaaaaaaaaaaaaaaaaacgttagatcttttgatgtcataaagaaaaaaataaaatttatttttcgtatatggaaagaaacaaatgtcaaatagtttgcaacgtgttacttaccaaaaatataaaaaaaattgcaacgtcttctccaagagaaaactttaaaacccttctgaattttatttttttccggtcaacactgtagcttttaatgttttttgaatcgtaaattaaaacaagaattagtaagctaagatttgtatagtggaaaaattgcgtgcttaatgtgtctggcatgaaacatgatttggatgttatttattttcccgtaaactacgattagaaaaagaaggagaatcgtcgttctttgagtgacaagaaagaaacatccgtttttgattctagttgttatgtctttgtttatttttcttttacatttttatgagataataataaactacaagttgatggttctttattgaaagaaatagtaacgaaagcagaattttagacttggaaacgaagtatggacttgctactagagttgacttgctgctaagtgagaatgaagaggtggggttggtattttgaggattgtgtctaaaagtcatgacgaaggaatgcatgaattttgtcgatagattacatgttttgagtattagatattattatatcgttttaaagtcggttgtttattgttatgtctttaatattggagtgtgagttgtctaactagatttattttctctactaatctcggtatggtttcggttaactcgtggacaaattggttgttggcaggagaggaatttgggcttcaataagtttgaggaggcccaagatagtagtcgaaactggttgttgagcccatgaaaatttgtgaagctaccaaaattaatattccacaagctaccaaaatcacaagaattttagtgagatattttagtgtcgccatttgcaccattcaacttcttgtcttagcaacacaaaaagattcgcgatattttagtgtcgcgattttttcttgatatggagatgaagaaatcattaagcatatgcgaaacggatgcttaataactttcatatcaaaactgttactacgttcccactcaatttcactgataaaatgagtatatgtatatatagaagtagtttaaaatcacatttattttgcggaagatcatgccattccacgagctaccaaaattatcagatcttttgttcttattggagtttaacgcattagacatttaatttgcagaagaccatatggccatgctacaagtaccaacgtttttattgcgacagaccaaagaatatactaatcgaatcagtgacgtgtaataaaccgaggaggaggaaaaagaaagtgtaaagataagcgaagcaagtacatgtggcagtcctaggcttccgagcaactcaatatctcttccccagatcctcctctctcttcttcactcttttaacggacacttttcactgatctattcactcactcaaatcgccgccggagctaaatcaatcaacaatg

SEQ ID NO: 23123 - DNA, 3000 bp, Unknown
  misc_feature (1)..( 3000): 2750-1469P.txt file - cDNA_ID_2131243; gDNA_ID_1620365; Annot_ID_154809
ggttctgtagttgaagaagttgagagtgttgttactaatactactggttgtgatgaatctaactttggattcactgatcagtctccggtgcctctttcatcgccggagatggtggagcaggtgcctatgacgtcaccggagacagttgtatcggtttctccggagatgggggagaaaggaagtgtgttggaggttggtaatgtggtgaggagtaaagattggtggtggaagcaagaagggaatgttggaagagggaaagggaaggagtatgtgatgcaatggattggttctgaggtgaaggaagagagacagagtagtgattggattgctgagacggcggaaggcggtaagaaagttgagaagaagaagagtagtaagagattagaatggtggctttcgttggatgaagagaaggagaaggggaagaagaagaagcggagaatggtgagagagtggtggaaagatgagtataggaaagagcttgctaagagaatgaagaagaagaagaagaagaaaactttggagtctgagttttatagtgatgatgtgagtggaagtgtggatcaaaggcggcacggggatggagaagtgtataggaagaaaagaagaggtgttagtagtaacagtataggtagtagcatagactggtggttagatgggctaagcggtgaacaatggagagcacggcgtagaaacagtcaagattcagttaagagttgcggagtcagtagcacgccgagcatgagagggacgatgtgctatgttgctcctgagtgttgtggtaataacatagatgatgtgtctgaaaaatctgatgtgtatagctatggagttttgttgttagtcctggtttcaggacggcggccgctggaagtaactggacccgcgtctgagatcatgctgcgtgcaaatctcatgtcgtgggcgaggaagctggcgagaagagggagactcggtgatctggtggatgaaaagctgcagttgttagaccaagaacaagcggttttgtgcattaaggtggctttgcaatgtctgcaaaaatcaccggtttcacgaccttcaatgaaagatgttttagaaatgcttacaggagcgataagcccaccggatttgcctacagaattctcaccatcaccgcagactcggttcccgttcaaggcacgaaggaagcagaatcgatagagcggtttctttggtggtagatgtgtgttggtttatagcatttgtcctacaacactgtctttgttagtgatgttttagtgtttgagccacttatatttgtttgcacaacggtgttttagcttcgtatatctgattatgattaattattgtagtttagtgatcattttcttgtaaaactcaacatcaatttttgctagtttttctcgtagatttatgctgaatttgcataaaggatgcagcatatgaagagtattctgagatttgatataaaaaaatctgttgaaatctctaaaagtcatatgtttgtacaggatcctcgttattgggcctattaggaaattatagtggccctaatctagtcattacgtcttatacacttggttaggactggccctttgttgaatatcaaaatacaattggtctattgggctttggagaacgttatatttctaatttttttctaacattataaattcatgaaaccactaacttttgggcaaagccggtcttgaagatataatttttttacgacaaaaaaaaaaaaaaaaagcctccaagttaaaagaaaaaaaaaaaacatgtacattagtgagttttgaagagagaaaaaggatataatggtgggaggggtaaggtgattattttcaaaaagcttcaaaaacacgatttaaccatattggtagaaataaaatcatatgaaataacttttggccatgtttacatatctttcgttcgtatagtttttcataacgattttagttgtatggttaaaattagctgacatttaccatctataaataacatatcaatgtcgtgctggtataaacctttactgtcccacaactaccaaccatacaaatactaaaaagaaagtgtcaattatcgcataatttaccacgaacaatcacttttcaagtattttattttaggttgtatgtttgtttattctttttcaagaagtgattttcgtggaagttttagttatatataagctctatagcgttaatttcctgttttgggctcataggtgtggttcatgcgaaataccgactaccttttgccaaagatttgtaaaaccaaagtctaattgacgaaaattaccaccacctcaccttgtaagaaatggcttaataattacagtcgtactgtttaaaacggtatatcattgaatattgatgcctttcaaacgaattttgttgacatcaacaatacgttgattatatatcattttgagtatattttgttaaaattttaatgcattaattaaaaagacgataatatttaaaacaatttcaacaaaacgaatacttgttacataacatctaaccaaccggataatttggtcgctaaaatctttgttttttagtgaattgcatgtgcaaagtttatcttgagaatttggaggatgtcttaaaatgtagaatggtaataagaaaagagtaagcatgtgatctcgatcggaatagaacatcacatatttgattatattattaactatagaagaagagctgatgaagaccatcactgcgtgcgtaccctatcaaacgtatttttaattctttttccgatacgactaaccaacgtatcttcttctctctattaaataatattatcaaaatatctttttttaaattaatttgctcaatcttcaagactgcaataatttttcaactttacaacaaagccctgagctgttcttctaaagactaagatcacaaaatccgcataagatcagatcttgctgtctcatcttcatcatcagaagtagagaatcttttaaaggaatatttacttttattaatttaagaccaccagatg

SEQ ID NO: 23124 - DNA, 3000 bp, Unknown
  misc_feature (1)..( 3000): 2750-1469P.txt file - cDNA_ID_2131255; gDNA_ID_1620365; Annot_ID_154814
atacttagattaagtgtgtcactttcacataatcatcaatcatattgatatatgcagatagactcgtctgataatttcgaatgtccaacgcaaatagaaataatagttttctttatacttttttttgtaaactttcaaatcatatagtaataaaaaaaagcatactaaaacttgataaaacaatttttaaatccataaatagtttgtaaaaaatataaataatagtgaaaaaacattttcttttaattctatttattcaaagcaaactcttccattttgtaattaagtccattaccttaattacaatggaatccaagcaaacaatagaagaaataacaatggaattaatcaaagagaaatttttgtacaaatatctatttttatccagtttaactaatattttattaactttaaatcttaaagcccatgtaatattgtaaatgaaaagacaaaaaaaaaatgaattaatataaaaaacctataagattatgtgttttacataaaaatcttaacataatttctaaaatatgtccttaactctcttttgatgccttaagtcattgcttgaatagcttttgcaatggaccagtcttgtaagcacatccgctcaaaccatatgtttttttgtctttgtaaagataaatccctttaacatttacaattgagctgaaatgctcaaccaattatagtttaatctttttttcgaaaagagttttaacaaaccatcttaacatatgttgtttacaaaccgttggtagcacgtcagagaaacattgggtgaccacaacaactctttagcaaaagcaaactgaatgattgcacttttgctataatcattctttttgtcctcatcaaactcaactccaacaaccagagcaactgttttgaagaactcatcaatagctgctctgtcaactaggggaccagaccagaagcaagcaaaacatcttgtagatagtattcatctgttgacgaatcatctgagctagatgaactccaaggttccttggtagaaggttcttttgataaaggaaaaaatcgcaagtaaatcctcctttttgggcatcaaactaatggacataacacaaagttcactataatttcgacacagtccacatcttttttgagagaatccacaattagtttgatagaatccatatcaactttgattaactactggttgcagttataaattttgttcaatcgtaaatttaactactatatatacggttaaaatggttgtgattaaatacagttacgggtatagagattacgattaaatacgattacggttattagtgattatgattaatatagtgacgaaatcttacgaattatctaactttatatagcattataacatatttattttagaaaagaccattttgtgacgtaattgtttttatatgcgatattttttttgaaaacatttatctaaacgttagatattttttttgcattatacattgttttaattatatttttaaatttttaactatacggtaaataatacggttaactaacagtttgatatgtttacggttcacgtgtaacactaaaaccaaaaattataaaacaatgtgaagagtacaagtctaatctttgtatgaaccgagcaaaattttatatcaatacttttctcctaaaattgagtctacgagtaaaactttgtatgaactgttttattgtaatctattttacggttagtggttatactaaactattatgatttaacctgtggtacactacggggcaaatattttatttatatatataataatataaattttacggttttcgtttattattaaagttatataattttatattaatgttgtaactaaaaaaattggtgatgataaaataataaaataaatatttaacatgtgttatatcaatccaaacccgttctgctattcatatcaatctaaatccgtcccgttatattttttgtctcatgattttttagttttgtataagtttaaatattagttgttgaattagttgtgattgtgattttatgtcgaaaaagttatggacttttaatttcataaaatatttaaaccaagataaggaatgtttttaggtgcacatataattgggtttgctcattttacgggattgtaaatgtattttggtttgtttcacaatatttgctttaattgtttgcccaaatttaattgaaataattcaaatagttcaaattttggttgttttaagatttagtgaatattgtaggtgagataaggagaatataatttattgtgttttgcgtgacatatgggattgccatatatttcgaatctttttggtttattatacaattatttgttttaaaaatattcaaactataattagaaaaaattcaaataattaaaatccagtaacagccattataaataagtctaaactcaaggatttattttacaaaatggctgcaaaaatgtatatgtagattattcattaaacccaaagggcatataacgcgacaatatcaacagcccaaaaggcccactaactgtttgattatagacaaagaagagaaataaaccaaaacaacacgtgtacaaacgtggaagcctctgaaagctgcatcgaaacttcacacacctccatcaccgcctaaattatcatcgcaggttttcgcctatcgaatgctgatgttacggttataattttttaacacagcagctccagaaatcgatttgaaaaattattttttgtttgttgtatgatctgtcaggaatagttgaattaaccctcaaaccggccggttaattgttctcgggagcgacaataaaccgaattttaaactgaaaaaccgaatctttggccggttatttatcaaattgtaccggaaataaccgaatgaagccctcccttaaacgacgtcttcttcttctttctcgaaaattcgccaaagcttcgatccgaaaacttcttcgccaatcttccttttcttctcacgaatttctccttcaagctccgttcccagcaatg

SEQ ID NO: 23125 - DNA, 3000 bp, Unknown; identical to SEQ ID NO: 1169
  misc_feature (1)..( 3000): 2750-1469P.txt file - cDNA_ID_2131349; gDNA_ID_1620367; Annot_ID_154870

SEQ ID NO: 23126 - DNA, 3003 bp, Unknown
  misc_feature (1)..( 3003): 2750-1469P.txt file - cDNA_ID_2131363; gDNA_ID_1620367; Annot_ID_154873
tattatgcataccagatagaaaagacataaaaacaaccagaaacctttgaataaaagagtcaaatgcgatcttaggcagagccagaccgagtagaagaaggctacaaggatctttgcacgcagagaagttggagacccataaaaagcaacacaatcatttcaaactcgacccgttcagcagcttagcattcaacgctagctcagcgttccgtgcagctgataagcttgaccaaagccattttgtaggtacagctttaagtagctgttgtgatgcgttttgaggctgtgctaagaaaacagtgaaatttagacatctcataaggtgagcagccaattcgaactcactgtgacccgagaggtctcccacgatgagcatcaagttatctatttcaggattgccaattgcgcagcaaagaaagtctacaataatcttctcaagtctggcatctttatccccgagtggcctgagatgtctcccaggatcagcacaaattttgtttgggaaggtgatctgattgcccggcaaagaaattccactaaaatcttgctctgtctggtacgtctgtctcctgaaaccatattatcaactcaggatcaacaacaagatacatacctatatatatatgtaaaagatagagagagtgtgtgtaattgacctaaaggggagcacatcatcccgattccagcgtgtttcgtggccagagagtaatcaccaaaaccggtgatttcgcaccttccaagatactcaccattattcgcaagggccattctcatgttccgccaaacagcctcagcagtgagaccatcagggaccgggcaatcctcgacatcccaaaagaagactgtactatgccctcctcctaggttttaccatattacaaaactgattagatcgactaacttgctatgaaagatcgatcacatcaaattccaaactgcatcacaacagatctaacgctttcaaggacaaggagattacaatttccagagaaaacatatatatcttaccgctgaacttaggcatcgttttggatcggtcgagaaaactagatgcttgcttgctgaagattaaagagagaacaaggttggcgctaatcttcttctttttatgtttctcggtagcggtgtcaagtgggccacaaacctacgggcttggcccaataaatgggttgttgatgtctgcaaatcttagtaaaacggtaatattccgagtatgatgtctagggaagacaaatttcaaatccatgaacagaatctaatccaaataaatttagccatcttaaatcttaatcatactacgtatattgttcctaatatatgtaaatctccaaagacgtaaaaaaagataaggaacttaccggggtcaaaatattgtaatataaaaccgtatatttctctaaatacttagtcttttatataacatatcacatttaaacaaaatttccaattacagatttttaaatgatatttttatcatcatttaaattaaaaatatttggttaatttataaacataataaatgcgcatgaagaaaaagaaaaaaaaaatcaaaataattgaattatgggttatgaccaaggaataaataatactaaaaacataaaaagagatctaaaagaaggttcaaacttgaactaggtgggtcaagtcatagagatctcaaccaaatgagccaattgacttgaaagcttgcaaacaatttaatttatatattttaattgatgtcagttgacctttttctttcaacgtgggtttacttgtggttgcatcgtttcttgaatgtgacagaaaaggatcggtaaaccgttttaaaggacaaggacatatctcgtcaaaaagcttagagagtacctcacgatctctctcacttatactttccacattttgagagattcacattttcttagttatcctcgataacaacttactgcaatataggagaccaatcaaatcagcgcaaacaaaatagtataagattatgtttgtgtatgatttgtacaagacatcaagtaaacttatagattgtatagatcaagctgatgataatttttggcagatctgtgcctagggttacggatgccaaagacgatgtttttcaaaaaaaaaaatgaatcaaacataaatccaaaatttaacctacctaatattgataaataacaaatgtgtaattcaaaaaagttcacttgtgattatagattaaaaataataaaaaaaaatcaaaaaaaaaataactttaatcgtgaaatcgtcataaatatgatctttaaaaaaaaaagatgaatgagttaattatccttaaaaaattgatatcttagtctctaatttaaattcaacatattttttttttaaagccacttggctctattaaagtaaaagctctaagttttacatgagcttaatattactatacaaacaaaaattaaaaggttttaaatgttgagaatttttgagaaatgctttcttggtgtgtgttttttcttcaaaaatatttctttgagatgtgcattttcaaaataaccctttttagttaaatttgaaaaaaaatatataaagtctataaggtttttagaggtgaaatttggagctgtgcacttgaaacggtgcgtttacattaattggaaaaggaatcgcaccggtgatgcgataaccggacgttaccaatcgaatttccgataaaacagcaattttcgaaaccaaaccggttttgaacgagcaaaagcttgaaaacgccgcgttttaaacagtttctcgaagacgcattatcggttttattttaaccgaacaccaccactggttcactatcaaatactaattatgaagataccggtatctttggaacggtgtttttaaaatgttgttattaccggtgatgcgagaaccggacgttatcaaaaattccggtaaaacagcaatttcaaaaccggtttggttttgaacaagcaaaagctcgatgtccggaggaggaaagagaccgttgtagatctgtcttcttcatcgaagatg

SEQ ID NO: 23127 - DNA, 3003 bp, Unknown
  misc_feature (1)..( 3003): 2750-1469P.txt file - cDNA_ID_2131378; gDNA_ID_1620367; Annot_ID_154877
tgacacatcacgcgagtaccaacctcgagcggaagcacccccattcttctcttcttcgaagcatccgattctgaattcgtgagagcgagtatcgcaccagaagtatgattctgattcgcatctccgccgttggttgccggattattatggttcgacgccggtgtggcgattatcatcgccgtctctgtatccgcagacgatcccatttctttagtcgggtcggagattttttccgggtggattcttttctcatacggataaagaacatcatttggaaggagtgtggcccaataacaactttgaatgctcaattgggcctatctttataattggcctgtactatatgtctctcttaccgtcctttttttttgggtgcaaaaaatctcttaccgtcgttaatacacgttttataactgttggcttatgtttagttttataatcgccaggttacatttaaagaatgattagtaggagcaaacaatttataaaaactaaagagataatgagagataaataataagtgacagagtcagtattttgtcgtgaatgggaaacagccaaacaaggctttatgattcgtactaatcacaagattcacagatcaaaaaatcacaaagttccaagaagcaaagacgaaaaacacaactcatcatcgtgtccttgaagttatggtcatagattcgcacaccatgttcctctagattaaccaaaatgattttttatgaacaaaaaagattcacatggtcactttactgtatcttgtatgtgaaattttacatctcatttttcttaaagaatgttttacttttacatactatcaatttacttttatttttcggttatgaattgaagtggatgacttacttacttttgaaattcgaatgaagaaaaatagaattgattcctatttcagttgttcacatgtaaacacgttatatacttatatggcaacttgactaaagggaaaatttaaataaaatgatttaatttggtgacatatattcatctttctaatttttgtagctactacacaccgtgtatcctttttcataataatgatgtgaaattgtataattgtaagaaaaaatgagaaaagagtgacgaaatctttaaaacagacagaatttttttggttgagcaaacaaaacttagttatcaaattttggaaataacgtgttgaagtggctgattcttttacctacaatgattgattcatcgacaaatatcttgttcgtatatcatcaattctaaattcttcaaaaataaagtaaagatactcaaatgtaatgaaatgacgaagctggaaaaacgtattttaatttaattcattatttgaccaacaatttgcatcatgtgaatttaaatcttgataggtcaatattagtataaactaccacactacatgcgaaaatcattcctcatttagtgcaattacaaatgataaacggaaacgttatcatttgtatttattttgtaaaatatgtaattcaagaaactgctcagaatataaagacaagaatcctctttcttccatctctatctctccgtaaacagttgctcaaaaccttcttcctgaaatggcttcttctctcatcttcctcctcctcgttaccctaaccttttcagcatcaaccctaatctcagccaaatccaacacaacaacaataatcgaatcaacttgcaaaaccacaaactactacaaattctgcgtctcagctctcaaatccgacccaagaagtcccacagccgacacaaaaggtctcgcctccattatggtcggcgttggtatgacaaacgccacctccaccgcaaattacatcgctggaaacctatccgccaccgtaaaagacaccgttctcaaaaaggtcttacaagattgctccgagaagtatgctctcgccgctgattctctccggctgacgattcaagatcttgatgatgaagcttatgactatgcctccatgcatgtgttggcggcgcaggattatcctaatgtttgccggaatatttttaggcgggttaaagggttggcttatccggtggagattcgccggcgtgaagctagtctgagacgtatttgtggtgttgtctccgggattcttgatcgccttgttgaatgatttacatttgcattaactactttcgtaaaatctctatttaaattatcgtatttcatgaatttaatatgaccgttactttattactttcgtctttgctacaactttcaaattgccaagaagaacaatctttagagatcacctgaatatttggaatttaatatttctcaatcaattgactaatcataccaaaaattttaagtgacgaagatttgggggaaaaggcttcttaagaaatgggaagtactagagatatttgtatattcgttatatatctttaggtaactttttgctttatctgtatgcattatacgtgttatcgcttcagagatgttttacactttaaaaattgcgataaggttacaaaagtgtcatcttaaaagagaaaggtaacgtcgtctatatatttttttataacaattttaatgcagaatagttatcgacctcataaactagtactgcttttaagacgacgtcgactgctatgcgaatcaaaatcaaaagacgtatgactttttttaatatcattttaggtggaaacatttacataaattattgaaagtgaatgttcgtaggtcattgactagtctacagttttcgatatcagttcaaataatcgactcataattgaactaaaagcatcaaaataattaaaccatatacgaacactaataagaccggttttagaataaaccggactagtcggtggataaaatcgtcatttgacacggagactactatttcgcgcccaaatgatcccagaagacgcgcccagagtgacagtccttttagttattcttcttcccagtaatccacaaaccctagaaaattttctcaagaaaatccgaatcacgattctgggcattgtggaggattgacaaaaatg

SEQ ID NO: 23128 - DNA, 3003 bp, Unknown
  misc_feature (1)..( 3003): 2750-1469P.txt file - cDNA_ID_2131382; gDNA_ID_1620367; Annot_ID_154878
ctgtggtgacgagtgttgttctatgattattttgcaggggaactacttgcctcgggagcagacggtatgcctcagaggcttagatgcaatgcaagtgtgttttgcatattttgaatgagtagtgaaaccaattgtgcagttttgtttttgttatgatgcaggaggtgagctttttatatggaagttgcatcctagtgaaaccaatcagtcctggaaagttcacaaatcattatcgtgagtcctttcatctaaataataagctacgctgactgggcttctaagagccacggttttttgtgtttgaatactgttgctctatcaagaagggagaatgataccttaggctaatttggtgaaatgagaatgaaagtttcaccaaaattgcaactgtgacccaatcgaatgtaggctaagagatatattttgacttttgtttgccctgctagatttcatcgaaaggatgtcctggatcttcagtggtctcctgatgatgcatatcttatttctggctcagtggacaactcttgcattatatgggacgttaacaaaggtgaaaaagtcaaagtgtagatagttttatttttttgttggctccagctttcctgcttctcacaattttgtatttgctaaaaggttctgtccatcagatactggatgcccattgtcattatgttcaaggtgttgcctgggatcccttagcaaagtatgtagcctctcttagttcagacagaacatgccgtatatatgccaataagcctcaaacaaagagtaaaggtgttgaaaaaatgaactatgtttgccagcatgttatcatgaaagcagatcagcaacggggtgatgaaactaaggttagagagaaaatagtttcttccagattcatcacggatacacagtattcctaatttcaaaatgacattttatgcagacaataaaaacccatctctttcatgatgagacattgccgtctttctttcgaagattgtcatggtcacctgatggatcttttttactcattccagcaggttactatcccttaaaaccattcttgtttttcagatagctgtgctagatcatccacattgtttactcgggcattattcatgtctctaacagtccctgttatcactgtgttgcatgtccaggttctttcaaggtttcacccacatccgaagctgtaaatgctacctatgtcttttctaggaaggacctttcaaggtaagataatcacctcaccatctcttgtttgaaagtcgtaaggctttgtggaacatattgtaatcatataagctcttctttaagctgagccaagtggccttaactggtcaagcttatgtatgagataattagaaatcagtacaaagtctcacactagctcaattcctttttccacaagcagacctgcactgcagcttcctggcgccagcaaaccggttgtagtggttcgtttttgccctgttgcatttaaactccgtggttcaagttctggtacatattatcttatctcacaccatttttttagtttcttttatgatagaaaagcaaggccttcatgacgttgatagttttcttaaatctgttacttttggtgatctcaaatggtgttttgaatcatgcagaagagggtttcttcaagcttccttaccgtcttgtctttgccattgcaactttaaactccgtgtacatatatgacacagagtgtgtcgctccaattgcagtcttagcaggtctccactatgctgcaataaccgatataacatggtgaaaagactatgcacattcttatagatcggaatggtttttctctaaattttcttagttttaattctaaccaatgatcttttggtttgttcaaaaggtcacctaatgcatcgtatctggcactgtcctcacaagatggctattgcacactagttgaatttgaagataaagaactaggagaagctgtctccatttcaggtttgctcttagtcctttcactcttgaaccttccagaacccgattgacccatcaatccaactacagttggaaagaaacctgttgatggtgaggagaaaaagcatgatttagagaaaggcgatgaactaatgacagaaacaacaccagacgagagcaagaaacaagctgaattagaacaaaacgaagagagcaaacagccattgccaagcaaaattaccacggatggtaaggaaaaagagcatattatgcagaaaaccgatgatgaagtaatgacagaaacaagacatgaggaagagaatcagccattacagagcaaagttaacacaccggtctcaaataaaccagcaaggaaacgcatcacacccatggctattgacccctgatgtcgtcattttccatcagtgttttttttttaactctgatacaaatagctttctcataggctacatttagacatcaaaatgaatcgtattgacggccatgttggaaatggacttgtttctttagtcatacgtctcgtctctaaaggcaatgtacatatagacacatgtatgaacgttcacatgagatggttttgcgtacattgtggatcattattgggctcgtattaatacataagttagttagcttggcatcaatgtctttaaggcccaaatttcatatatagctaaatgcaacaatgtcaagggatgttgtgttgatctttaacggcccgtttaattaattgtagaataacaataatagaccagtaaaagaaaacataattttaccctaaatttaattttctaaaccctttcttccataacagccgtaaaaaaggttaaaaaataaatcaaaaacccagaaaaaccaaactctctcatcgtctcaaatggctatggctctcaatctctgaatttgatcctctgtctctttctctcaatcagatttcaataattcttacaagttcaaattttcatttttcccagtttcaattaaatttgtataaacaattcccacctatacacacaaacatatacagaaaatatcttctctctccctccaatg

SEQ ID NO: 23129 - DNA, 2649 bp, Unknown
  misc_feature (1)..( 2649): 2750-1469P.txt file - cDNA_ID_2131411; gDNA_ID_1620367; Annot_ID_154888
cctcgtcagaatctttgagaacctttggcttgatggcacagtttcccatctcgtacgttaacacagattatgagaaaaaatattttctctctcttaatttgccttttatcttccgatagattagagagagaaatgctgaaaacgaaggtaaggtatggtcaaagaagagttatgtccgataaattctctgcggccatgaaggaatatagacagacaaagattttatatgggtttttgtggttaacctaaaaaaagacgtaatttgatttgttttatagtaaggaaactatagatataattaaaaaacctctaatcatagaaaacatagtaatcgaatatttattctgatacattagtatatattttatgatactgaatcgagcaggtgatattacgagaaaaaggaaacaattataaatgatttataattagtatcttcttctttttattttagaattagtatctttttgttttgattttataattagtatctctgttgtccttgtccatttgcattccacaataatataataaaagaacttccacataaacggtcatattatacgtggccattatattaaaaaccctcaatctgtgagcatagtgcaaatagtgatgttgttttattgtctgatgcatcatcataagaattaagaagtagcaagtaatttgtttaaaaaaatcggaaaatcgcatatgagaactacaaatacgaaatataaatctcggcccatgaaagataagatttgggttaaaggatgaagaatttggcccaaaatagaaaattgaaaagagattgatactggcccgtgaatgtgttggtgaatcgatgtgaaccggttttgcaatttctaattccatgctctgtttcgatatttaaatgttttgatacttgtatcaaatttttttggcagagtggtaaagtttctgaaggcaaacgagcttcaaaggtatatgagacctgtggctataatttgtgttcttaaaactctatgagctataagctattcaaaagctgaaaatttgagaattttgattgaagatcttgtggttgtttggtttgttcagattttggaatcatgaataggaagactattattattattataactttcgtcaattttgcttatctagtttgttgttgaatttcattaagctgaaaaagtgaaaatattgatctcaggactctataagatacacatgtacggttaaggagaagcgttctgatgctaaaaaggctctacacaatcttctcttccacaccaaaggaagtagagattttcttcaggtctgcagctttgaaatggcatccagataaacacccagggccttctcaggtatatatacatttaatgtcaaaaaaaggttttgcatgttttcttgcgatcatcttcagaaactaatttggtaaatgtggtggaaattcacaggagcacaagagaagttcaaactctgccttgatgcatatcaatcactctgttcttcactttcttgatcttttacagagaaacaagttgatgtcaaaacaatcttttgaatatcttttgaatggttaaatgtttttttttcctcttctaggttaggctcatgatagagactccaataggttttatatttgcagtggcatggtggttagaaatcctcacttgttatgttaacgaaatcatcattattttgatgaaaataatgtaagcttaatcctccaatgttttgacttttaaacatgcaacattatttgtaaaaaaactttatttgtcaaaaagcttcctccaaagtttttgacttttacttaaagacattatagataaaaaaaacaatttaaaactttatttgcaaaaaaacacttttatgtaaattatgtgaaaaacatgttgaacttatgacaccacaaaaactatggaccaaaaccgggataccaagtccagttagtcttcaacgtatttaaatttaatacttaaaattaattttctttctaaacaatttgattgattaaaaaattttagataaaaataaaaacgatttacttaacttatgacatcacaagacttaaggactaaaaagaagagatgccaagtccgattaattttcaacgtatttaaattcaacacttagaattaatattttttttctttataaacaatttcgttgataaaaaagttttagtttaaaatcaatacaatttacttaaaacattatttgtaagaaaaaaaactcaaacgaagtattaaatatacatgaagatgtgaaaaacatgttggatttatggaatcgctaatgactatggttaaattgcgggatcaaaaatccggttagatttcacgacgtcatattaatttagtatttatagaactttttataattaaaaaaaaaaagagttgaaaattttataacaaaaaaaaaaaaaatgctaaatatacatgaagatgtgaaaaacatgttggatttgtggaatcgctaatgaccacggttaaatagcgggatccaaaatccagttacatttcacaacgtcatattaatttagtatttatagaactttaaaaaaaaaaaaaaaaaagaaagagttgaaaactttataagaaaaaaaaataaaaaaatgctaaatatacatgaagatgtgaaaaacatgttggatttgtgcaatcgctaatg

SEQ ID NO: 23130 - DNA, 3 bp, Unknown
  misc_feature (1)..( 3): 2750-1469P.txt file - cDNA_ID_2131421; gDNA_ID_1620368; Annot_ID_154897
gat

SEQ ID NO: 23131 - DNA, 3000 bp, Unknown; identical to SEQ ID NO: 1181
  misc_feature (1)..( 3000): 2750-1469P.txt file - cDNA_ID_2131435; gDNA_ID_1620368; Annot_ID_154906

SEQ ID NO: 23132 - DNA, 3003 bp, Unknown
  misc_feature (1)..( 3003): 2750-1469P.txt file - cDNA_ID_2131445; gDNA_ID_1620368; Annot_ID_154908
gaataagaagatgaagaaaataggtcttcacgcaagagcacttggagaaaaccgtgagaaagtaagaaatgctttcaaaagttttttcaagaagtttggtggttatctaggaggtaaaactcaccgaagagaactaactgaagctaaatacaacgcggattctcacgttggtgctgacgtaaaaggatttgaatccattatcgataagttttctgacttctttaatggttatcttggaggtcaccgaagagaactcttttaccaagtaccagcaggcgaattcgccgatgaaaaaattgctattcatgcttctttggacgccaaagctcacggaagaaaaggaattcgaagggaactatatgctcaagctcctttatttaaaaatttcttcaatgttggatttggaggtaaagctcaatacgatgccgcgggaaagatgaaagtcgccggagatgatggattcaggtcactgaacagggcacatgttaaacattttgcttcgacagaagcataattttatccattttttcacaacagaggaaggaagccatgagttcatctttattaatataatgtgtttgtttttcgacaaaatacgaaggaagggaaatgccgtgcgttatttgtctatatgtaactatgtaaaagttgcaacatgtttaataaataacgttcgtatcgcatacatattaattaatgggctcactttcgaattaatagctgataaatattttacctatagggtgatcaaatccgggcaatgagtgaatctatctaacagttctatctacatcacgttaactattgatcattttatttttatttatttgaaacgatgacaaatcaaagagatttcatttgttctcatctatcatcattattcattactttttaatctttattagtcttaaccaaaactatcataaaaattccttaatgcatacaaaaaagagaatattacgtgattagacacttttttgaaagtttatccgtaattaggcacttaaaaatcattaggcactttgaataattaaaattacttgttcaccctcatatcgtcggttttctataaccaaacaaatcaaatccattttcactaaaccaattcagatttacggagccacgattttgtagttgcctttgtgatttaatttttttttccagaatcgtaaaaatccaaatccaataaaaaatcctaaattacaatttctcgaaaaggggactccggcgacgagatatccatctcctccgtcactgtccaccaccactgcttttcacactacactctcgtttgctctttcaaccgtaaaacaccaaatccaattctcttgtcatttcctccaaatctctgcaatttcttaaatcgatttggatttactttgcttgaaaaacccttaactcgtactgtccaaattcaatttcaatttcaattgaggttacttcgagaaaagttcaagaatttcggaacaactaaggtaaagttttgtcatgttgacttcagagatcttgttcgtaattctgtgataatgtttgataacttctctgcccagtttgtttgaaattcagtacttgaggttctctattggacagaagatgaacatatggactacaacacttggacaatccgtaatggacaaccacacattttggttgcagcgtatgtgtcgttacaaaattgaaaatcaatgtccacgaccatacatgactgcacagcttggtgtttgataattcaaggaaaaagccacataaaggttctatttcttaatcttacattttggaagaaatcaaatcattgatttaagaaataatatgtaagcttggatgctagagctttaggtgatcctgtggccagattaggatattgatttaacttttcttactgctactcaacattgattgtctggtattaagttgtaaaagagtaatttgacttatccatttgtgttgatataattggttattataatgtgattagtcaatagaaaaccttagagtacataatatcaaacttttaactttgttaatttttttaggcgagtgggtgaatacatcagttagacttgcttttgcacatcatgtgatcatcgtttaattgttatatgatcggacggtcattatttctcattaacttctatttaaactgcaaatcttaccacgttcatttgatccgaattaacccattattctacacgtgtttggtacacacaattacaaaccaaaaccaatgaccggttattcttttttcgtgattcagtttatttggggtataatggtctattttcactccaaaaacaaagaaaaatatctcaaccttggaaaatacctgttttgtctaaactttttcccaaagtgccttattacggaacattccctacaaaaaaaccatcgtcatgtactggacaaaatattcttcaagtttgttttcatgttgtgttgggccgtttaattcgcatgtatcccatatcggaccttataaacttataagttataaacattaaaatataatccatttgtcaatccttttttccactttttttaattaagataaatcttaagtattaccaaatcattattaaatttttatatttattattctagctttaccatttacacatactttacccccattgtattttcattgccgaaatgtttcaaaaaaggatgatttaaggggcaataataatatttaaaaaaactgtgtttagtgatgaaacaaaacccgccgttggaaattaaaccagcccatagagagaaaaacctctcttaacgaagaaaaacaacaacatggcccctggtttctcttctctttcgaatctatcttcttcttttatccaatcctttcctatttttattctcaccttctcctcgtttttcccgaaactgttcttttgccctcttctctcaattttaatccaccaaacaaatcgaacagtgttcgataacttttagattgcaagtcctgtttttgatttggtcgggagaaagaaaactagggttttgatg

SEQ ID NO: 23133 - DNA, 3000 bp, Unknown; identical to SEQ ID NO: 1184
  misc_feature (1)..( 3000): 2750-1469P.txt file - cDNA_ID_2131449; gDNA_ID_1620368; Annot_ID_154909

SEQ ID NO: 23134 - DNA, 3003 bp, Unknown
  misc_feature (1)..( 3003): 2750-1469P.txt file - cDNA_ID_2131469; gDNA_ID_1620368; Annot_ID_154915
aaacagagaagtatggatcagtcaaaacaagagacagagacacaaaagttgaaactttgattggcaaagtataaccatgacagagatgcaccaagtttagatatttttctcattacaaaacaccaaatctcatgttatatcagaactagattgatctgcacttatgtaccataaagctatccaatttcttctcacaacactccaatggaggaattttaggtaaaacaaaacagtaaactatagtctatggatcaatcagagacaaataaagtcagaaacttttgatagcattacaaaaaaaagatgaagactttatgacagagatacttacaggaagttcatcaacatctaatttgacgaaatcaacatcattgaacttatcagccatggcatgaatcgcaggctcaatcatcctacatggtccgcaccatgaggccgagaaatcaaccaccagctttattattcacagaaaccaaatcagttaaattccattgaaacacgaaatcgattgaatcgaatcgagagtctgagagacgttaccagtttgtttgattctttgatctcgttgaaatgaagttgccaccgagcggaagagctaaactttaggacgcgacttggctcagattcggtccctgcagctgttgcatcttctccacttccaaacacagttgataaagctcctcccattatcgtctctcgtctcgcttctctctctgattgcgtttaagaacgaccctgctttctttggtcaacgatcgtgtcgtttaatattcaaacatcgtgccgtttctaccactagagctggtcaactatgggcatgcccacctcatttagcccatttaaaatctaccccatttaaaattatttaattttaagatttataaaattgcccatttaaactcatatacccatttagatataaattaaaaaagcaatttaagtgactcggaacacaaaacaactactaaatcaagaatgtgtctaaccttttataaaacaaactaaaatcaacacttaccatcaaatttcaaattcttaccaatcgaaagacactaatatctataaatcaaactcaaacatgttcaagttttcaaacacaataagtttcttattcttcttagttccaaaacatgttgcttcttctacatttgtttcatggtgcacttgaattttctgatcttgaagattctgctcgggtactaattgcaatcatccttgcatattggttgcaaatcatcaatgtcttttagggtacctacaattcaaagtatgaattcgttttaaaacatgatcactgcaagaaacctcgttttaaaacataactacacaatatttttaccttcatattccgcaaatcctcgcaaccaattatgagtacaaagcagagtctgaaagttcttcggaagcaaccagttcatgtatggactcgagacccgtgctctgatgctaaaagcagactcaaatgctactgtcgtgataggaatgctaagtatgtcatgcaccatagatgctaagttaccaaatctgtgttggttttctttccaatagctcaaaacatccaaatttcgaaaagcctttctatgtaaccttggctcatccaaataaacatctaattgcgtcttcatgttgtccacatcactttctaagcttctttctagctcaaaaaggattacaatatcattttggctatgggtgcaatcttggatcctagatgaagttgcagattcttgaaaaaacttataagcttatgagtatgtggatctttctacttctaagtcgaaagctaaagaactcaaaaatgtattgaaagaactctacaaagattatgagaaaaggaagttggcaagtttatgtggagcttttgtcggctctctcaactatgattcgcttgtggagctttttttgactctctcaatattaatgtgaaaaataaagaaccggaccaaactgaaactgtataatcaaatcgaaccaaaccgaaatattaataccaaagatttggattgtagctctttcgattttagattttgttgtaagtatggtttttttaagagagaatgtaaaatttattcaatctttttaaaaatgcatcagtttacaaatgtatcaaactactgttttcattttagtgtcgcaaaaaattagtcgttaaagcatagtataacacataatgtgttattgcatttgaaaatttttatttgttggcaaaatgttcaccaagttgtattttgttgtggagcattcataagctttggaaaaaagtatgaaaaatttaggagataaacaattttgttaagaattaaaagataaatttgtacaaagatttcatttgatgaattacggatcaaattatttaggtttcagtttataggacctgaatcaaaaataattttaatttaagtaaaactaaattgagctgaaaaataatagagtttattaaaaatatatattttttagtttttttatctattatatcatcattagaaatatttgatctaatcctattatgaagtagtttacctacaataataatgtttaaaacgataaacaaaaaaaaaaaattgaacataactatcataaattgggttaattggtattgttccgtcagtcagcttaattagtattgctcagtcatattaaacgttacaaagtccggatcgaattctgaccgaattcaaacggtaaataaatcgaacttacttattacatggatttaaaagcaacccactataaagcccagtggggttttagaacccaaataggaaaacgacgtcatatcatatgtaaatctcacatcactcacgtcgacaaatcggcatgaccaaacaacggcagagttctctcgattctcatcaccggtgaaccaaaaggtttagggttttagcttcatccttctgcttcaaagcttcaatcttttctctcgattctcatttccaatttcataactgattcacaaatgcaaagcttcgtatacccataaagttgaatttgtcgtctgcaatg

SEQ ID NO: 23135 - DNA, 3003 bp, Unknown
  misc_feature (1)..( 3003): 2750-1469P.txt file - cDNA_ID_2131473; gDNA_ID_1620368; Annot_ID_154916
tggttatgaataaatctgaatcaatcggctctcttgatgaagttgcttcagaggcccttgcactaggttttggcgagcctatagctatttcagccgagactggacttggtatgaccacactttatgaagttctgcgccctctactagaggattacacggtcgaaatgttaaacggtaatatacccgtatcaagataatcatacctcccttaaatttcttcttcactgaacctcgcagtcttataatagatataggcagtcaagatgatgttctgaccgatgagaatctctctgatgaaatcgacgagtccaagttgccattgcagttagctatcgtaggtaagcctaatgttgggaagtcaaccttgctcaatgcattgttggaagaagagcgtgtattagtgggtccagaagctggcctcacaagagatgctgtgagagttcagtttgagtttcagggtaggaccgtttatctggtaagattagaattcttatttttcttatactctgactccaactattattctcttgatgttagacagagaagtggaaccagcgttcaatattattcactttgtttgatgtttataccggatatctgttaaggttgatactgctgggtggttggagagaacagagcgagacaaaggaccagcatctttgagtatcatgcaatcaagaaagagtcttatgcgggcacatgttatcgcgttagttctcgatgctgaagaggtttgtatacacacatactctcgtgattcatgttttttttttcctgcagaactgtgaaaacagaagaaagaaaatcaagagatgctcacgctatgttttgtatttgcaatatccagatcataaaagctaaatgtagtatgacacattcagaagtagttatcgctagacgtgctgtagaagaaggacgtggtctagtcgttatcgttaacaaaatggatcgtctaagaggtagagagaactctgagatgtacaagaagatcaaagaagctgttcccattgaaattcagacagttattcctcaggtaataataaaaattgcatcttttattaattctcatttcttcttttgccattcttcgtatttcccggtgatggaaacataatatttgcttgcagataactggaataccagttgtgtttatctctgcattagagggaagaggacgtatggaagtaatgaaagaagtcactgatacatacaagagatggtgttcaagactttccacaggccgcctcaatcgctggttgcgtaaggtttgtactttaaatgttacagactatagtatatacaacaaaacatatgacatcattatttgcttaatcgttttttgtgtgtgttggcgtaggttatgagccggcattcatggaaagacacggcttcacagccaaagatcaagttctttactcaagtgaaagctcgaccgccgacttttgtagcgtttgtgagcggtaaaacgcagttattggaaagcgacataaggtttctgactagatcattgaaggaagattttgatttaggcgggactcctattcgaatcatacagcgggttattcctcgtgcaccaccctccggtacaggtggtggtggaagcggaaacagctcgagtcgagtagtgcaaagaaccacctcagacaaacggactctctcggcctaagaacccattacaagtgaagaaattttccctacattaactagtttgtgtcccgttttgtatgatcatacttaaatacatctttttcacctatacacattcgaaaatctaaaatagttggatggagtttaaccttaaacttcattagtgtccattaggtacaattaatagcagtaatataaagaatctataatattgtatagtacacgaaaaatatgtcatcgtatgcaaaatatttggtcatagaaaaacaaaattttaactaagaaatatgtatatagattcactttttatcacgtagatcattgaaatagtcttcgtaagctttgataggaatacgagcatccatccacgaaatcttcaacatcttacgttgtgagtccaaactcatccacgagactagactcggtaaggttacaatggctccaatcatggctatgactttcgttgcgatatcgtaaaacaatgtccagttctcatctttgttatctttctcctggtcgttgctcatactgattacaaagatctaacttcttctgctctcctttttttttttttttggttgtgtatgtgttttgatttataatttcaaggttgctaatgtgacgcgacctttactattatttattgggatctctgaagacagtcccgaaaaggaaataatataatttgacaatatcaaaaaaggaaacatttaacaaagaatctttcattaattaatttcgagcaattgtgtcaacaataaaaattcataatcatcttctgacatgactttaatgtataggaagctcatgatggagaaagcaaaggcaattaattacactatcggacttgtccaagattgcttagcattttttttgcacagagcttgaagattgtttatctctatgacgttttgtttacttggttatgttttttattttcagtgcggtgacatcatcccttgttgttgggatcaaataattgaattgaggatgatgttctgttctttcttgtttttaaagtatggagaaagacacaagtttgaaatcaaggtcagctgatttctttgacgccaataattcattctgtattattttattggctttaaaccaatttgcatattagatttattaaaagattctgctagttgtctgcttaaaaagtctccatttatttaaaagttctaatcagttcttgtctggggctttggtcttccctttgatttcttggtaagagttccattcctgtggaatctgtaaacagaaatctctatgagctatcttttttttttccagattgttttcatcggtagatgctagactcaaaacaactgattctttgttgttgaaagaagaatg

SEQ ID NO: 23136 - DNA, 3003 bp, Unknown; identical to SEQ ID NO: 20478
  misc_feature (1)..( 3003): 2750-1469P.txt file - cDNA_ID_2131596; gDNA_ID_1620743; Annot_ID_166548

SEQ ID NO: 23137 - DNA, 3003 bp, Unknown; identical to SEQ ID NO: 20623
  misc_feature (1)..( 3003): 2750-1469P.txt file - cDNA_ID_2131704; gDNA_ID_1620763; Annot_ID_167250

SEQ ID NO: 23138 - DNA, 3003 bp, Unknown; identical to SEQ ID NO: 20623
  misc_feature (1)..( 3003): 2750-1469P.txt file - cDNA_ID_2131704; gDNA_ID_2926194; Annot_ID_201300

SEQ ID NO: 23139 - DNA, 3000 bp, Unknown; identical to SEQ ID NO: 1208
  misc_feature (1)..( 3000): 2750-1469P.txt file - cDNA_ID_2131758; gDNA_ID_1620372; Annot_ID_155022

SEQ ID NO: 23140 - DNA, 3000 bp, Unknown; identical to SEQ ID NO: 1214
  misc_feature (1)..( 3000): 2750-1469P.txt file - cDNA_ID_2131772; gDNA_ID_1620372; Annot_ID_155025

SEQ ID NO: 23141 - DNA, 3003 bp, Unknown
  misc_feature (1)..( 3003): 2750-1469P.txt file - cDNA_ID_2131826; gDNA_ID_1620372; Annot_ID_155040
ctcttggtccatccaagtccacaggaggcagcaacaatagcactaataacaacactaactcatcgttccatgggaatctaatgactcccgtgggtccttgtgtgcctagatacagtttggttgctggaaaccaggttgattcaagcaatatacatgttcctgcttatccaaccaccgatctttgttatgatttttttgctttacaagagcatggttcgggctctagtcactcaaaaagtctcatctcaaaggggaaaaacaaagtcatggtgcctgaagatgatgaggatatcgggatgataaggtggttgcccaagaaaaaaagatcaagaggagagtagtaatttatctatgtccctttgtgtttttcagttttctgttttctattgaggcctatgttcacctcttctttttttcatgcaattgtttttctctttttgtttctttgttgtctttttgatgattttgatgtttcgattaattcatcaaatccctttttcaattcctacatttcatgattgttcttaaatttttgagattttcagaagtcattttcgtaagcgaacttaattttttcaaaggttagagagaatctgcaatttgcttaaaaacattagttaaagagacattatctcttcattgacaatttgttagccttggaaaattgaaaaaaaaaaataagaggcagaaagaaggtctatctgatcttctattgttgtaattgtaacctcacaaaaaaaaaaaaaaaaaaaaaaaaaaaaaaaaaaaaaagaggcagtggtttccttttgacgattagggtttcgctggttccagtttgcccggttttcttccttgacccagatccgatttactagattgtattacaaatgtaatcatctttcaggatatttgtaacaaaaagatacaactgttatccaataaaactgttattttttttatgtattaatataatcttgtaatcctagtaagaatttataaaacttaaaaacctgtaaggctgtaactgatgtttgcatctccattctccaaagatcttttctattgaacaaaaatcaaaactatttttgtttctcttgttcaagagaaatctccttttaaagataatttcctgaagacatttattccatagtatgaagatcgaggtctagaagttgatagtattgaaaattgtctattggatcaactggattgttttctcaaacaaatgaaagtcaatattgaaaaacacaagtgctttttcttccaagcaggagattgataattttgcatttggagcttgtgcagatcatttatatattaatttaagttcgtgaagatttaggtttatggttgtagatacctcacacaaagcttacatagtagttacataggaataataccgaacatcgtcgcttcatttgagatgttgggttgatagacccaacaataaaatcatcctaaaagaagtaagctacgtacttattatttataaaggcttgtcctcctcccttccttaaagccaaagccaactctttaagtctcgctctcactgcttctggcgaaagctcaagttgaggatgacctctcagaaaatcatcgcttccatttccatattcctcagattcaatcttcttaaagcacatatacaatagcaaaacggaatctagaattttatattataaaaatgttgccacgatttttaccaatatcttattcaatgtcgaccaaattaactattgaaaccctaatatcactgcttttatggaagtttgtttttcttgttcaatcatcgtggtctagaagttgatagcattgagagttgctatatgatgaaactttatagtttttgctagacaatgagagtcaatattgaatacatgaggaatatgaatacttctcaacttgcaaatttgtatttttacttcgcaaattaacaatcttttatgaaattttaaacaagttttttgaaaacatcaacatagatggaaaatctgactaggaatttcacagaaatatgtaaaatcgatttctaagttcttgttgttagttttagatgttatatattaatgttcaggagataacgtcatcaagcggggatagctcagttgggagagcgtcagactgaagatctgaaggtcgcgtgttcgatccacgctcaccgcatttttctttttgtttttgaaattttatttctcgttgcaaaaccaaacgacgccgtataaatataaaagaacaaattgacttggagcgacgttgcttcgttagaacgttaggtcgcacgtgtaattgacttctctaagaatcaaattcattgggtttcagaaaaaaaaagttataaactttccatagagaataatacaaggtcgaaaaatgacaaattcttaattctttacatgaaatttaatatttctgaaattataatacttggttcacgtataaaatcatccatagataagtaataacaccgtccatgcatgaaccaatattataagattctaacaggtaacagattacatataacacatgctcaacaaaatggcatagtcatatttatgaggaccgagaaatgtggatcactctgctttctttgtaacaatttagaacttcgttcatacatgatacatatcgaaatctacaatgtctataattttttttttcttgacatatatatgtatttaccgttgtataaaacattaaatatctggatttatgatacagtttgttgtcattacaaaattaatcttaaaacgataccttaaactggagaaatagtcatactttaattttactttgaaacgaagtcaacgaaggttaagtaaaattgttaatggtgtcaccgcgaagttcgtccaaaggcacacagtctccaacatgtatctcaataattaattaacataatagcccctttattaagcaaggatttgacttttcaccactataaattcacaatcaacaattctcattatcatcaaaacaaaccaactttccttctctaatcaaaacaagaaagacacaaagatg

SEQ ID NO: 23142 - DNA, 3000 bp, Unknown; identical to SEQ ID NO: 1238
  misc_feature (1)..( 3000): 2750-1469P.txt file - cDNA_ID_2131856; gDNA_ID_1620375; Annot_ID_155123

SEQ ID NO: 23143 - DNA, 3000 bp, Unknown; identical to SEQ ID NO: 1244
  misc_feature (1)..( 3000): 2750-1469P.txt file - cDNA_ID_2131876; gDNA_ID_1620375; Annot_ID_155128

SEQ ID NO: 23144 - DNA, 3003 bp, Unknown
  misc_feature (1)..( 3003): 2750-1469P.txt file - cDNA_ID_2131947; gDNA_ID_1620376; Annot_ID_155152
gttatgacaaaacatcatgtcatatgtactgatgtacacggtctgacattttggcaatgcaaatcacttcatattatcccgacaataaaaagctaaaatgaaataaaagaaaaattaaagttgcagttaagtgtgttaccaaacattaaaaccaattaaacgcaacacaatatgttgaccaaacaaaatctaaaaaaaacaccattcagtaagaaaaaaaaaacgacccaatatacaataaatttaactattatatcaaaaaatattataatcgacgatcaagacttagagcatgttcataagtgatactcacaaagtatcattaagagtttttttagtattatttataatgtttgtttaataaatctatataatattttttgtttttgtcaaatgtgaccaatcagaagaagtcacgtcagatgatattggtatcacaaatattagtgggctgatactgatcaagaatattctaattgctttactaatataaaaataatttttggacttgtgatactctaaaaatatcacccatgtacatggtcttatatcctcttgacgaaaaaagagttatatcctaatgtattatattaatattgttatcgcgtcgcaactctaattcagatatgggtaatagcttgtgtgggaagtgggagattttttcatttggactactgaaattcaaatactacaattcacatagtcgagagtttttaaaaaattatatgtttgaatatctgattggtatggaaaatttctagatacatacacctatttatcccttaaaaaagaaacgaaagaaaaaacagttccatgtgtttttaatttagcaactgtatcggagcgtgtctcagcagaaattcttgggcctatttttgtccaaattccaatagccgaacagtcaattgacacgtgtataagacatcaccatcccaagtaattactctctattgtactgtacagattggtttgatgataaatattcaaatatatgccaaacagtaaataataactaatcaattttttaaaaaaaaatcaacgaatattttctttcataataaaaaccctaaataaggaataacaaagtaaaaaaacaaagtttttaaaaaaagatataataatattaatactattttggttattatggcttcatcattgatcctttgtgcataagaactaaatgagtaattgagtactatataatactgcacaaggctctctctgtgcaattgactgtccctaccaaaattaactctctctatctctctctctttctttctctgtgtaagaagagtctttaaaagtgagtatatttcgacacaaacgagctctgtctgtaatggcatgcttagaaatgtacaactccaatggtggtggtggaactcccatgagtcctagaatctccttctctaacgatttcgttgagattaggccagagacgaccaagacgacgagatcaagccctctctctaaacaagagggttcttcttcttctttttcagataatttcgagttctctgtctcaaactacacaatgatgccagctgatgaacttttctctaaaggaaagcttttgcctttcaaggaaaccaatcaagtccagagaactttaagagaagagcttctcgttgaagaagacgaagaagaaggtccacgtgatgctaccaacatcttctctctcaagccaccaatcttctcatcatcttcttcttcttcttcttcttccaagggaaggtggaaagggcttttgggccttaagagggcccatgttgggtctaagaacaatgaagagcgatttgttcatcatatgattaacaacaacaaacaatctcaggtactttctctgatctgccttggatttgttcatatatatgagcatggtgtcgatgaaagtcgtgtaatttgtttttatttctcttaaatacgttatgtaaaaatacactttttgttctcgaaatgttcataggaagcaattggtggaagagaagggtcaagttgcagggagatgaagaagagtatgtagagcttaaaaacaaaaaaggctttcacttggtttttgtttttttaggaacatggctgcttccaaatttttaaaaatttagatttatgttaatcttagatctgaaaaattactaaaaaaaaagacacttatgtgttgttgacggagatggtttatttcattaactgttttccactacacatgtttcatcgattcttctgagtttttatcttgttttttctttttcttttgaagggtgtgagtattagatctatctttgtcgactatttggaatggatgtagtttttttttttgtcgttgtacaaaagaaaaaaagaagaacagagtgtgagtagttcagaaaatttaagttccagttgttttttaaaattgaagcaacgcatatgtctattgtcttcgtctttagacatctcttgtctgtccattcgttattagctattaccattcaactccaacttctctctcgttgactgtgttatctagtgattactatgcctcagagattcagaaatatgtcatataaaaattactagcgtttctttattgcagtttccccatataatggcaatgcagcgagaaatttacatggtttcctaaaatattgaaaggcccaaaaattattgtttggtcttgttgggcctgaaatggaaataagcaaatacatattcatatttttttattttttttcaaagaagatattcgatatttatcaactgatataagataagctattgggcttctattttaacagttgtaacccgccagtaaaaaatgcgctagcttatattattaccgtgactcgatctttcaaaatgccacgtggcatttattatgtggatttggattttctaacttgttctcctcacgaaacaaaattcacccacacaagacaaagcgatcgtcgatcccacccacaatctaagatcgccggccgattctcgtcgccgacaaaagaagaaccgaggaagaggaaagcaactatg

SEQ ID NO: 23145 - DNA, 3003 bp, Unknown
  misc_feature (1)..( 3003): 2750-1469P.txt file - cDNA_ID_2131961; gDNA_ID_1620376; Annot_ID_155157
tatttgaagattcttatacaagcttaaagacacttacatttctctatcttaaaccccaagaaaactttaagaaacagagagagacttcttactattatttttgacttgattcttgacatttttgactaacaaaaactcaatcatcatcaatggcaaaagctctgttcttcaatttctgcatatctcttcttattattgccatacttgtgagccatgaaatcataccaacagaggcaagacacttgaggacccatagaaagtcaatcaagaacagtactcttactgtacacgaaggagccggtggcttgagaaccggtggtggctctgtgaagactgacattagcaaagaagaacatggcgttgatgagttccggccaacaactccgggaaacagccccggcattggccattgatccattagaacctaaataattacaatatttacaaacttgtgcatagtgtaccaagcttaatgtgtttgtctttctgatattctcttctcttttcgtttcatttttctttttttttacaattattggttaaagtgtattatatcttgtaaatacaatcaaattattattcgtagcaacctacgttgggaattgatgtttttaattaggtttgctaacataagaagtcatatacggagatggaattacctttaacccaaatgcaagaaaaaaacttgctaaaataactcaagtattacttaagtaaccaatttatagcggtaactcactaatgttaagagattatatatggttcgaatcttcttagtcatggtcgttgttagatctatgtagatataattcaaattcaaggagacaaaataagatgtttacggacaaaaaacattccgtaaatttatttattgttgttgacaatgtaaatatttcattaaaatgaaaagagtttggtgatctctacaaacaatacaaaaaatctgttaggtgagcactttggagttgagtgagtgatgtaaaaagtaaacattggttgatatctgtatatactactactccacacgtgtgactaaagctcggtcgatcttttaaaagtaatttgtaactacaaaatcaaataaaataaaatatcttcggaagttcttattcaaatcttctttattatttgcaaagttgctagcatgcgactgctgtacatatgctttccatgcttgagagtctgaaagacatgctaaccaacacagaactagaaaaaaaaaaaaaaatacctttttctgggccgtattaaaaagtgatggcccgttaattttccatcaatatgagcatctagttaaagcccattagttgtgcacaaaaaaaaagagttaagcccaataaaggtataatcgaaacccatttatacatcctccacttttttggtttttttcctctcttcttttttccttttaacatacatccttcgttaccttcactattcagtgtctgtaaataacatatataatatcatcataacaatattttttcaacttctcttatttataattccatagtttgtttgtttttttttatggtaaaatacaactccctagtttatatatttttttttttcccctttaacttttcattttatcaaaaaatgtttttaaaaagagtagaggactcataaagcttcgtacttgttttatttatataattaataactcgtatcaatgtcaataactatcatccatcccttttttcttcctagttcaaaaaccttttaatattgtttgtataaatatctagttatctactattagaccattaatacaagaaaacaaaacttttaaactgtaaatagtggcttgattttgaatgacgagacttgtatgtatacgagtggggtctagaatattagtcgctgtctagtacatggtttaatggttcggttggtgcaagtaattaattatgagaatctttgcttattttttaaaactaataattccacaagtaaatagtttaatacgtcaattatatatgtctttgtctaatgaaaattttaaaacttccacttaattctcagccgtccgatcatccaagatgtgaccttttcatgggcctagaaccgcgaatcgtagcaatgtgggcaacacgtcgagaggaatctcttagacgaagtaaacgccgttagacttcgagattccccgttattaactccgttagtgaggcaaccgttggcaattgtaccggaccgtaccggtttttgtcgtcgtacgcacacaaaagtccaacacactcgcatagcaacccaaacatgtgtaacgccgattttgcccccaaaagtctcatacggattctcatgccacgttccaaacaaaagtatttggctttttctttacttttcttttttgctattagtatattttgtttttgttatatcattttaattacaccaatttaccacgaatctcgtaataataatagtataatactatacacataatagttaatatctttatcaaatttaataagcttttaaaatatttttgatatataattcattgttctgtttgtaaatgtatttgtagctcactctgctagtaaaattaaattacagctttagccaattgaactacaaagtttaccacttgaaatataaataaacggtaagtatatgtaaaacaaaataaagtagaaatacaatcacaaaaactaaaaatttgtcttaaaatgtcattatgtaaagaccattttaaaacaaaaaaaaaggtaaaaagaagacgactgaataatattacgaaaggacccaagccaaaagattaacagttaggtcataagagaagggtaataaagtaatttaaaggaagagtatgtcatcttgttcctctcctttaattttccagtctattggtcctcagcctcccttctccttcaggtggcgttgctctctcgtccccaagaaaatcgcttcttttatttttttgtttactaaatcttcacataatctttttaaaaaaaaaagtcctaaatttcagatgattcgatgttcttttcagacatg

SEQ ID NO: 23146 - DNA, 3000 bp, Unknown; identical to SEQ ID NO: 1250
  misc_feature (1)..( 3000): 2750-1469P.txt file - cDNA_ID_2131969; gDNA_ID_1620376; Annot_ID_155159

SEQ ID NO: 23147 - DNA, 3000 bp, Unknown; identical to SEQ ID NO: 1251
  misc_feature (1)..( 3000): 2750-1469P.txt file - cDNA_ID_2131973; gDNA_ID_1620376; Annot_ID_155160

SEQ ID NO: 23148 - DNA, 3003 bp, Unknown
  misc_feature (1)..( 3003): 2750-1469P.txt file - cDNA_ID_2131982; gDNA_ID_1620376; Annot_ID_155162
ccggataaataattagggtttcgatatttgtttcatatagttttttcttttcattttctctgcattttgaatgttctttatttatggtatagtacagttacagtggtacagaggaggttttgctctttatatataacatttaatgaaaaagccttgtcatttcttcaataactctcctgctcttatagccatagcccatatttttaaactacttcctttttgttggattctctgaacaataatgcattaactaacctagttattattaataatttagggtttaaaagaaaataaatcgtggtgggtcacatcacttcaccaattcttgatatggtaattatttgatatatgttggctttgttctacctactagagatgaaaaagagaatttgtgtgtatcagagtctaagatttgcttacacctttctgtctggaaatcttttaagtgttgtcccagaagatgcactttatacttgcatgtattatcaatttagcatcaatcgcatcgatcaagttctttatattaataatattgtttcttaagtctctcttttggttttacttatatttcctcgacttttcttgcagttggaaactctgactttgctcaaggcattatggacgcaatcgagtttttctttcttcctgattttgtcggacgtccaacagcgaaaagacactcaccacgtaaaagtcaaacgactaacaaagaagtcagcttatttggttgattttgagtcctgcagacagttttggtataaagtataaaccaaaggcctcgtatcaatttgaacaaaagatctccactccatcccgaaacaaatactaccttgcttttttttttctttgtaccctattaatatttttttgacatttcttttggttcaagtaaaaaaaaggagaaattagtgtttttggttgcaaatctatttgtaaattagatgtcaagagaagtgttacttgccctagtggtttatcacatatccgacgtcaaccggaaatattaaattaaaaagtatgaataatctatctttgtatatccgcatttacatttttttttgtttctggaaaagtatcgatcctgttatatatacctaaagtttaaaatgcgaaataagaaacaaaaagagtttagtttatgaaaacattatcataatgataccaaaaaggctaaggaaaaacaaattacaaaaaggctacatcattttttaaaagagagtgtgtgcttcacatataaacaaggaaacgcatataataatcatcaagtagctagatgaagctaaagaagtagttaagtgtgaatgcttggcaattaagattgtgttggttcatttattaacaatctttgaccactcactaatttatttttggctctctcttctatatcatcaccgttttatctttataaaccatccctcaagactctcccaatattacatgatgtgtttaatcctcacgaattcgcatgaatcaaaaccggctgaaaaacagatgtaacatttaagttaacatactcacaccaatctaaattattagactttcattcactttaacacatttgtccataccatgatgatcataacaatcagtagctaaatcaatgtgagtgtggcttagatatttgatctgaatgattcatgagaaacatggatacttaatgttcatgtgcatgtgcatataatagtatattaatctcaccagtaggatgcttagtatagcaataaagagaaggtggtgaaattgatgagcatcggccattaaattaagcactgacccattaattgcgcacttacccataaacaccattcactccttttcattaacttaagagtaaaattatacatacacctcgctatctctaacactagtcacactagtgtaccttcctcggtactcttatcaatgtctcgtgtcgcaataaatccatataaagatttctaactaggtcaatccaacatccaatttaatacaacagtccttagtagattctaatttaagtgtgtctctatatatatatggaccgacaaaatcaatgacctaagatttgactatatatttcatgcaaatatgataaaatgctattcatccaattaatcatcaatattgtaattgggctggccttttgcttatatctttaggcattttctttaacaaaattagagccaggcccatcaattaaattgaaaaatgcttagaagttgtcacgtcactgtccatgtcatccatggtgggattgggctggcctaaaggacttttctatgtaaaaattagaggcaggcccatcaactaaattaaaaaatgcttagaagttgccacgtcagtgtcaatgtcatcagtgtctatttctaacgccgtcaagtaacggaataacgcaaccgaatattctttcatcacatggccgcttctgcagcacgtgactttcaagcttctgttttccttatgaactaagtttttctgtttcctccaaactattttttttaattagaatatcttgttatttataacgaatatatcttcttcttttacttatttttaacacaaatatttatttgtttgatacgaattctcaaaatgagaaaaacgaagaaaaatagaaaaaaatcgaaacggataaatacagagaatttagagaaaaaaggtttgtattttaggagacaaggacgagtgaagtcgtgctttttctttttttatttcatgttaattttaatatttttgggttatagtttcttaggaagcaacatcaatcatcaaaacgcggcggctcttgtcgtatcaaagcaactgaacgttgtcgttttgggacaatccttatctcttggggcaaccaattattgccttttttcttcctctctttccttattcgttctcttcttgaagatatttttccatttattttctcgaatcttcttcttcttcctagattccagcgacttaacaacaacaacaacaacatattctctgctgggtattagattcgaatttctctttttgtgatcagaaatg

SEQ ID NO: 23149 - DNA, 3000 bp, Unknown; identical to SEQ ID NO: 1246
  misc_feature (1)..( 3000): 2750-1469P.txt file - cDNA_ID_2131990; gDNA_ID_1620376; Annot_ID_155164

SEQ ID NO: 23150 - DNA, 3000 bp, Unknown; identical to SEQ ID NO: 1248
  misc_feature (1)..( 3000): 2750-1469P.txt file - cDNA_ID_2131994; gDNA_ID_1620376; Annot_ID_155165

SEQ ID NO: 23151 - DNA, 3000 bp, Unknown; identical to SEQ ID NO: 1218
  misc_feature (1)..( 3000): 2750-1469P.txt file - cDNA_ID_2132042; gDNA_ID_1620373; Annot_ID_155057

SEQ ID NO: 23152 - DNA, 3003 bp, Unknown
  misc_feature (1)..( 3003): 2750-1469P.txt file - cDNA_ID_2132046; gDNA_ID_1620373; Annot_ID_155058
cgtagttagctctggctactggatggtataagcaatgataattttacaagtactcctttagtttctcgaactaaaatgccctgtccataaataataaattaccaagtctacaaatgcacgtatgatctgaataattttatgaggttattcaatggaatgacagtaacaatagtattcctttatcaaatttacttcttaaagatatgcattttccaaaaatattaccagtcgcaaaggagggcagtcttggcacaagatcagcagcatcatttgcagtccgcctagagatcctgaaattaccaacttcatcaagatcatcatcgtcttcaaaatcatcaatgtcatcaacagtcagctcttgagcttttggtgaatcaaaagattctgatcgcatcaatggtggcgcagatggtgactcacaccactcgggatttgtaaccatgggagaagatgaggaaattaatacaggaataggcggtggggccctttttggaggtgagccagaagattcaggaattgtagccaaaaagaattcatcagcagtacccacgctgttctgaaatatacataagactcaagcatttagaaaatgacttatataagtcgatggagaaggagtccgttatatgttaatagcaaaaggttttccagaaatgaacaggcattatcctagaaactgttgcaagcaactcctagtaatgcttaacaaaagttagaagtatcaattaagaaagcaatatgttacatgtacacaccatataaggcaatccaatgtgatcatgatagtcccgaatcgcttcagcgagttcgagcattccacctaaattgaaacaatacacactattaatctgaaagaaaaaaaacagaacgatcacgaaaacaaaagaagaaagaagctagtagtacctttcttagcacagttaatgacataatcaacactaacttgatctaaatcaacatcgtcaagagtcacagcaccaggaggcattataactttcttgattaagctaccagccaacataaaatccaatagcttccgcctatcccggcgatatctctgaagaatctcgacagcattttctctatacacgcaagaaaatacaacagcacatcgatcaaaatgcaatagcaataaaacgaagaagattgtacagtagcccaaaaacaaaatcaaaagaagaagaagaaagaaacatactcttccatctcgatccagctgcaataatagtcacacggattctcagatttccaattgacctgtgaaatcaaaagccacgaatcagtaaatcaaatcgaatcaagtctacttcaagtacgagaactagagactacatttgaatgcagatttagttttagaagtagagtttaactgaactaaccaatcattttatcagattcctcgcaaacaccggaattatccaaaggaaggattgatttagtgagaatttagagacgactgaatacgaatatgatctggtaaatgtagatgaatgaactgttttggagaacttcgagcagaaatttcgaggtggtgatgagcaaatctagagaatgcgccggggccgaaagatctatctgtatattattatttgggaaaaacaaaatgaagctgatttgtctcaactttaatttactctatctccctaattttctttctttgacttcttttgttattccagaacaccgaatttgtcaaaattgaagtctcaacttcattcatagtgaagaaaatatactatgggagtataatattaattttcattactgattttaagtaattagataattatttagctttttagtattcctaaatcttatttcttaatgaagatttgaattaatttggaaatcttaaaaagattaatgttattcaattatcactgattttaatattacaagttgaaattcctatgcttttcactaatgatatgaatattgggccctcatgggccaccttcttcctaaacttatcttctttacttctttcacaagccttgtatacaagggcaattgcctccacatgaataaacaagaaacctcacaagaacttctatgtttttttgacatggtatcagattagccaacacatctttccacattgtttatgttttcgaattttggaccgaactggatataaacatagattttgtcaagcccatatgattttttgtcaggcccactatatcatatattaaccttacgaagtaacaagcaaaactggattaaccactttacctataagatcgtcggcagctgggtggattttcaaaatacctcctataaaggacctaaaccaatttccagttttaaaagttttgcttaagagagtgagagcctgagaggaacattatccactgcatccccatgagaccatgggtcccactccaccgcaaaacagtctgtcacgtgtcatcacctccctatacctacaggacacgtgtctacaccaaatcgagtgaacatgtgacgtgtcgtcaccaaacctgagccgctaaccactgcctgatctggagggtatatccgtaacttaaaatccttttgtcgtctacccgtaaacagacaacttttaagaactacaaaaacgtacaagttggccagttgtgtcttgcaagatttaattaattttaattcaagtgccgacctcacacagaaaaagatatgtttaacacgtggaccaatgaaagagttgctttagatggaggagtaatctaagccacaaatctcgtttgtgaattctaagccactaactaaagttcaaactcacgcgctctccacttcctctcttcaacttgcttctttgtcttctctctctttcctccttcgcactcacaaatctacagaagatagaagaagatagactcataatcttttggatttggatttagatctgatcataaaggtgacttcttttgattattttattcttaagaattcaaatgtttttctcctgttggttgctgaatatagtgagtgacttgttagcaggttaaagtatcattcatg

SEQ ID NO: 23153 - DNA, 3000 bp, Unknown; identical to SEQ ID NO: 1219
  misc_feature (1)..( 3000): 2750-1469P.txt file - cDNA_ID_2132070; gDNA_ID_1620373; Annot_ID_155064

SEQ ID NO: 23154 - DNA, 3000 bp, Unknown
  misc_feature (1)..( 3000): 2750-1469P.txt file - cDNA_ID_2132084; gDNA_ID_1620373; Annot_ID_155069
gttcagtttgtaaactcaattaaaaaaatccagggattaaatatttaataaacaactgcttttaatattaggttttatcgttggcacacacacaaaaaaagaggcttttatcgtcgacataaaataaaaaataaataggaggatttatcgttttaaaaccacaaaataaaagttaaccaaaaagaagaaagaaaaaaaaaacgatcgccgaccaaaaaaaaatcaaagatcaacggcgcatatagcgcgttaggtggacgagcccacgagcaacaaataccctctgcgactctctctaatgtctattcacttccacgcaactatttaaaaaggaactcttagattttcctttatttcttttttaaaacataaaatccaaaaatataaataaaaagaatttagacagaggagcagaactgagtccactagtcaaccaaacagagagatccgttcgttctcttttgtctttcggattcatccctcaattcggtttcatcatacaagagagaagtgactgtttcttcttcctttctctttcgagtggtttctcttcgtcttgcttctcaatctttttgttacaggagatatcgaaatcggttttgtgttgttggtctaaaaggttagacttctgagtcctgatcctattgtgcttttttgattcagtagtagttaacctaacttgatttggaatcaacaaactgggtttaaaaactcaaatgctttgaggtagtagtttgaagtttgtagattttaaggatggagaacaaaccaagtgtattaactgaaagatatgaagttgggaggttattgggtcaaggtacttttgctaaagtgtattttggaaggagtaatcataccaacgagagtgtagctatcaagatgattgacaaggacaaagttatgagagtcgggcttagccagcaaatcaagcgagagatctctgtaatgaggatcgctaaacacccgaatgtcgttgagttatacgaggttatggctacaaagtcaaggatttactttgttattgagtattgtaaaggtggtgagcttttcaacaaggttgcaaaaggaaaacttaaagaagatgttgcttggaagtatttttatcagcttattagtgcggttgatttttgtcacagccgcggagtttatcaccgcgacattaagccggaaaatcttttgttggatgacaatgataatcttaaggtatctgattttggtttaagtgcgcttgctgattgcaagcggcaagatggtcttctacatacaacttgtggtacacctgcttatgttgcgcccgaggttattaaccgaaaaggatacgagggtacgaaagcggatatttggtcttgtggtgttgttttgtttgttcttttggctggttatcttcctttccatgacactaatcttatggagatgtataggaagataggtaaagcagacttcaagtgtcccagctggtttgctcctgaggtaaagagactattgtgtaagatgttggaccctaaccatgagactagaatcactattgcaaaaatcaaggagagttcttggttcagaaagggtttgcatttgaagcaaaaaaagatggaaaagatggagaaacaacaagtcagagaggctactaatcccatggaagctggaggttcaggccaaaatgaaaacggagaaaaccacgagccgcctcgacttgctaccttgaatgctttcgatatcatcgccttgtctacggggtttggtctggcaggactttttggggatgtatatgacaagcgagaatctaggttcgcgtcgcaaaaacctgcttcagagatcatttctaagctagtagaggttgccaagtgcctgaagctgaagataagaaagcaaggcgcaggcttgttcaaactggaaagagtaaaggaaggaaaaaacggaattttgacgatggatgcagagatattccaagtgacgccgacgtttcacctggtggaagtgaagaaatgtaatggagatacaatggagtatcagaagttagtggaggaggatcttaggcctgctttggcagatattgtttgggtttggcaaggcgagaaggagaaagaggagcagttactgcaggatgaacaaggagagcaagaaccatcatagcaagttcagctacaagcctacaactgcaagcacatgaattgttgcaggaacatgaaaatggtaaccctcttgcgacttcagctgaaacagaagcaagcatcaagaaactctaacgaaaacagaggaaggaaaacaataacaattgcacaaaatggattctttttgcatatagactacaaaaattgtagatagttgattgatttgtaacaactacgagctttttttttaccttgcctcttgtgaagttttgaacgtatattgtttcatgagtacagtaattgaatttctttaagagtttggtcgatacatagcagcaagatttgtgaaattttggtttactaaataactatttttccagtttccatctagtctttttgcatcttaaactctgtttcaatactcatatgtattactggacaatcattactgataggacataacaactttgtcaattaaccgactaagaaactcaaaaagaagaagatcaaagaagaaaaatcaaggagttgttgaaacatttaaatcctaagaggctaagatgtccccggttcttttaaatgtcgtctgtgttgattgattgttgaaactttgaatctgaaggaggggtacttttctactaatcaatgttcctgttaacaatgtttcaggatttttgaaatcaaagttcgtattttgatgatgaattgtagactattatgtgtctgtgtgctgaagattttgaaagtttcttaatgcttgagccttaacgggcccagtttaaagcccaataattggtaaccctaacccatatttttaagagaaattccaaatcgatttggactttggcctataaaagtagcgtcacgagattgatatctagtaccgaagaaaatg

SEQ ID NO: 23155 - DNA, 1581 bp, Unknown; identical to SEQ ID NO: 1186
  misc_feature (1)..( 1581): 2750-1469P.txt file - cDNA_ID_2132128; gDNA_ID_1620369; Annot_ID_154931

SEQ ID NO: 23156 - DNA, 3003 bp, Unknown
  misc_feature (1)..( 3003): 2750-1469P.txt file - cDNA_ID_2132171; gDNA_ID_1620369; Annot_ID_154944
tctctctcatctgttacatatcacaatcttttgctttaaattgagatccttcttcaaagccgtatctctttctctagtgtaattctcctctgaaattcagccttagttcgtctctttcgttctgggtttctctgtaattgtagcccaattccaatcctgggcatgtatttcaaagtgtttccatcttcttttgtcaaagttgaagactttgctcgttttgaatccgtccgctagtagaatcttcttctttgaatcgattttgatatctctgctttatgggtttccacacttttgccagcaatgtctaagcttccaagaacatgcctttgactagattttcccggtaaagctttttgcttttacttcttttttcctggcacgagaaattaatgggttcagttgatgaggttgagatatctaagactagggtttcatgtcctcctgctctctcaacatctcataagattctcatcagtgaagagaaacctaggagatggtccgagagttcgttgcctgatgtctctaataggattaagcttttgaaatttggttccccttctgctagactcaagagaatggctgaggaaagagatgaagtttcacgctctgtcaacagctcaagctctagcagccacgatgtggtgtcttcccggaaaatcgagtgggcttgtttgatgaaaatgggtaagcaatggctacagaacccgttgaacatggttatgtttttgtggatctttgtggttgctgtctccggtgcgattctattcatggttatgactggtatgttgaaccatgctttgcccaagaaatcacagagagatgtctggtttgaagttaacaaccaaatcctcaacgcattgtttactctgatgtgtctgtatcaacacccgaaacggttttaccaccttgtgcttctctgtagatggaagcaagacgatgttacaacgcttaggaagatattctgcaagaacgggacttacaagccaaacgaatggatacacatgatggttgttgttcttttgcttcacttgaactgttttgctcagtatgcgctttgcggtcttaacttaggctatagaagatccgagagacctgccattggtgtagctatatgtatatcttttgcaatagcagctcctacggctgcgggtttgtacactattcttagtccacttgggaaagattatgatcctcaaggagatgaggagaatcaagtgcaggctgtgggagaaggaccggttagtaatcgcaagttatctcttgaaaggagatattcatttgcttctaatgatgtgagtaatcctgaatggagagagggagttcttgacatatgggaagatatttcattggcttatctctctctgttctgcactttttgtttgtttggttggaacatggagaggattgggtttgggaatatgtatgtgcacattgcgacttttgttctcttctgtttagctcctttctttatattcaacttggctgctataaacattgataacgagatggtaagggatgcacttggatatactgggattgtgctttgcttgtttggtttgctctatggtggtttttggagaatacagatgaggaaaagattcaagttgccgggctataacatctgttgcgggagacccgcgattgctgattgtacactctggttgttctgttgttggtgctctttagctcaagaagtccggaccgcgaattcttatgaaatagtggaggataaattttgcaaaagaagagaagaaaatagtaagattgatgatgaggttgtcgtatctgcattgcctcgtgaagacggtgtgtttgatccgagttgcttgcctaagaagatgaccacgacgatgatagctagctctactcttagcccgagcagacagaaagatgaaacttgcttgggagagaaaggtgatgaagctctaagtccaccttctcctccattcatacacagagaagctagttagaacttagaactaacagattttaatgaaagtttgttaatgtaaaaccagatatactatatctaattgaaagtaaagtttaaattcgttttggggtttatggaatttacgagttataaacaatgtaaaacaggtttagttttctttgaattttcacgtaggaatacaagtgttgtttgaagtgtttcagttagagaattatgtttcttctcatcatctcatgtgagcttaaccacattacgttgatttggaccttaaagtgaattaaaaaaagaacaacttagcattagttgcttatgcgatcaatggtctcatcacgaccctgatgagaatcgtgtctaccatccacgtaaaatcaacagctgataaagtattaaaactttggtcaagcgaacatgtagaaacgattttcttgttcatatttgatgcatgtgtagcaactggagttttagccaatgttttgtttgtgtagcaattgcagttttcttataattcttctaatttctgcaattcactgaatttttcttacaatacaattttttgccttgatatacatacttcataatacatcaacaaaacaaagaaatgtggcagcaattttgttggtgttttatgcaatatgcatctcaatggcaattaaattccaacaaacaaagaaaactgataattatttgctttttatttaaattttgtagtgtaaagaaaatgattgaacatgaatttttcaattccaaatttcttcaattgttgttgtcaattgtcatacctatgaatatatgtatgtccatgataattcattagccaatatatccatttgagagatgttcattagctactatttttcctagttgataaggtcttaattaattatttatttaaattgtaaatggtctttattttgtgctgctatttctactaaaaattttattaaagaagaagttgacaaaaaaataaaagaaaaataaaaaataattgatcgcactgtcaaaccaaaaaaaattgaaaaccctaaattggttgaatgggaaaatcgatg

SEQ ID NO: 23157 - DNA, 3003 bp, Unknown
  misc_feature (1)..( 3003): 2750-1469P.txt file - cDNA_ID_2132179; gDNA_ID_1620369; Annot_ID_154947
tgagaccttgtggtgaatcttctccggaagatccttccaaagacccgtcatgatcttctgctgaaacggcgataacgcgtaaaccaccgccttcaatttcaccggctgctttcccattttcgacgaccaaatctccgatttcgataaatgcaactaggagacttttcaagccggctaatatgcatctctccgtcacaaaacgctgccgtttaagtgtaaaggcttttaatttcaatccacttaagcccaatggttagaatatgggccttttctttatgaatttgctaaaatccacgtggacggtagagatgctacgatgcagagagcggtctatggtgagggttattacacgagatcatgacgttaacacgggaaacaggttgcttcaaaagaaatcaattcattcgtacgggcctttaatccacgcgccttcttcgcatccccacgcgcagtcgtgtgtgatgatggctaatcctccaacgttaccgatctcagaccattccggtggtggttcccaatctcagcaacccgtatcaacaccggcgtttcgcacgttcctctctcgcctctcgtcgtcaatccgccaaagcctatcgcagcggcgtccatggttagaactcgtagatcgaagcgcaatttcacgtccagagtctctcaccgatgcgtattctcggatccggaggaatctcccttacttcaaggtaaactacgtgacgatcgtctccttggtgctcgcgctctcgctcctctcccatcctttctctcttctcgttctcctatgcctcttctgcgcttggatcttcctctaccttttccgtccgtcagatcaacctctggtcgtcctcggccgtacgttttcagatcgtgagacgcttggtgttttggtaattttgacaatcgtcgtcgtctttttaaccagcgttgggtctttattgacctctgctttgatgattggtttcggaatcgtatgcttacacggcgcgtttagagtcccggaggatcttttcttggatgatcaagaacctgctaacaccggcttattgtctttccttagcggagccgccacttccgccgcagttgccgccgcatcaactcctgcgtcaggtcgtgtttgaaggactctcttctctgtagacaacaaactcaattactatgattcttttattgtatttctgaatgcgactatgtaaggggaaatgtagaattgatcttcttggttttaagctgagaaattcttatgattcaaacattaaatggattcaacaatatctcgcattactcttccttagctctttttgtgacaaagattatggaatggttgattactattaagctttgagactaattgtgtttagtgtgtttagatgttgggaactaaaagtgtccgacgtaaaatggcagtgtcatcattccggctgttttaacgaatctcgtgtaaatacttttgtttttggttatggaaaatgacatgtgggataatcatcgagacaaaggagtaacgtaacaaagaagtttatcgtgaatgtttgttaaaatgcattatgaaagatttgaatattacttcaagagaaaaagtctatttcgttattggcagttagtttattgtttgaacgttacactctagtacagtgcataatatgctatgtttgttaagaaaaaaacaaaaacaataaaatgaaatcatgagattgttaaaccaatatgacccaacgtcccaattcatccgtgttctgactttaggttttctgcatctagatgttgtttgtattccaaattcatctttagagtttgagtctttgagatatgaatcttgatttacatttatatatattttttaaaatgaatggatttagacctacatatattattatgcaatagtcaattttcttataaataattaatattgttaagttattgagaaattcgtctaatacgaatagaaaattatttacccattttttagagtttggataaccaatagaagatacaacaaaatcattaatctggttacatataattaaataatatacatgtgaccttgagtttttgtttacttttgtttgttaaaagagtggccttggtattaaattgccaaactattcttactgatgatgattaatgatcatttgtgtatttggtaagacaggaaaaacttgggatttaaggaagaagcttgagacacaagcactagaacgtctagacgtgatatgaaatgacttgagttcaattcaactaaactttgttgaaattatgctaagtgttcggtgcaacaacttaattacctcaactaagtctttgctccctttcaatgtctcaacttcttctcaatttcggatggcgccaaaagaactagtaaactatttttcaagtttataacttatggcgtggaatataaaaaaacatgattacgcaatatagaaagtattcataaaactaataatgttttgatgggttaatatttaaaaaaatatcaagataactaaaacaacctttaaagggatactaaataatatcatttttactaacatccagatatttatttggcactcgaatcatttttaagaggtgtttaatctaatttctaaaccaacattatattttgaaaatggtatcatcatgatcctatgtccattaacatattttaacatatattttctgccaacatttttgaggttgatcaactcttaaaatagaagaaaactaaaccatggttttccatttgaataagtgtgaaaggaagcaagaaaacatagccaacgaactgataaagacacataaatatgttggtgaccggtaatttaatttttttcttttgaataatcagcacctaattcttccaacccctaaataatttagtaaaaaaattaaattcaatttactttaactataaaagggatatttccctcttcataattctctcaaacccttctctcatatatctcttaatctcataaacgttaatctcaaatttttcgtaatctcaaagcttaaacacacttaatg

SEQ ID NO: 23158 - DNA, 3003 bp, Unknown
  misc_feature (1)..( 3003): 2750-1469P.txt file - cDNA_ID_2132221; gDNA_ID_1620370; Annot_ID_154963
atatataaatttgtttgcaatctagttattcttttataattttaatatttttatttaatagaagaaaatatattaagatgatttacctccacgtctaggcgacccttatcaacataattttggtcgattattatcggatttttggtttctctaaatgtaagactcttaaaaagtatattttttgcgtatccctttccattctaaacaaaaataaataaaaataaatatcacttaaataaactatatcaatattgtcacaatagatccagctttagtattgaaaaactatttaaattttttattaccggccatgtcttaattctagctccattatccgtcctaatgaaagtgcaattagttacttggacattctcaactatagattcttctccatctcttcctacacttcccacactgtattttaattttatagataaagaagaaaatgtaatatatatatatatatagaatatataaaattagtatatgtacaatgctattgatgaatcacacacatatataccttattccatgaccaggtccacaattcatccttgcgatattgatattcatacttccgctgttaatagctacacaatcatctcctggaaagttttataagaaattttaaaattaaataatcttaaaataccatttgagattactttttaattagtgagtgtgcaagagagatatctagctatatataccagttccaataactgtgtcgtatatatcgacatcacttgattctgagatattaattccatcagtgttaggactatcgtggggtgctacgagttttatcttcgttattttaactcttttgcattcgctaatcgatatatggttttttggactgttgaatgaggttattccagttatcatgagatcgttgcatctttgaaaatgcaattgctgtaagaaaaattgaaagaaaaaaagaattcatcatgaactttccaaaatattgacgacgatcaatgtatataaataaataaaatattttcattttagaattcagaatgaattttagtgagaaaaagataaactcacggtaggccgtttagaagcaggcagtccttgctggatatattgaatatgaaaaaaagaggaaatattaaattaacacttttgtttatatataattaaaaatcatatcttttattgtgtatataaatttctttcaagattgccaaaaaataaaattgtttcaccttccaaaaagacgagccacgtccatgaattgttcccgaaccattgactgttaaaccgattatttccttaaaactaacccatctaaataacttatagtccgaccaagctgctttatttataggtgcaacaatctttccgtcaaactgcataaatgaatacatatacacctttattaatcagataatttgcacataaaattgtaaaaagatttataaaaatatcgataattaccttaacttgtacggaaggagatttacaagggccttggaaagtaagaggttgtagtaaaaatgttttgtttgatggaataatgaatgtttttgaattcccaccactaccacacatagcgctccatgctttcacaaaagcctatttattttatcaaaaaatcaaatgtattagaattcttaataactcaaattttgtgacaaaacgtatgactacgttgtaggaaaatgaaaaacctaataatagttatgtatactcaaaggctgtatgatattatattggtttgaatttttttttgaaaacttacaaaattcagatattttcataatataaaacaagataaaattttgcaatataatacctttgaatcatcggtaataccatttccatcggcaccaaattcaagcacatcatagatttggccgtttacaagaatagaatgcagtaaagtcaacaagaacacaccacgtagtatgatttcctacaacatacaaaatcaatgttagaaagaaagaaaacatactaacttttataaaaaactttactaacttcttatcattgtgtgatgatgatcagatgtaactcttaccattgtgtgatgatgatcagatgtaatgtagtgtatatgtatgtgatgttgatcacttaaatatacacatacaaaatcatgggtatatcttattaaaacatgttcatggatatagttttaaactttacatattttatgcctaaaatcattagttattatggatattatttcgcatataagtgatataatctctcttttatataagatttagaaataaataaaatagaatttgaagaaatagtaaacaaatacaagttaaaatagaaatgaaaatacttgaatataagggggtactaagtaaaaaacattttggaaaactcaaaaatagaattaaatttggatattgtgatctcattgcattattaacttatatttaacaaatacgagtaatattctgtgtaactacacagccattgacattgaaaactaaaatgcttttctaattatttggtagtgtgatttgcaatatatatagacagtaacttgaactaaaatctgatatgatgaacttattaatataatgtattaatcggtttgatgtacgataaaatgttttaaattatccactagtagggttgcatacatggtacattcaatataaccctttcaacgacaagaacaagcactaggtttctgattttaagctctaaactatgtgatttaatttatttgtttgaaaaaaataaagtgtgctagaatatgggatcatgatcatttccattctgaaaattaacgatgtacatttttttttaaaagatagtgtatattaattagtttgttatagttttgaccaaaaaattaaaataaaattatcagttagttaaatttaaaatccaatctgaaaaagatatatatgtaacaaaatttgtttttttaaaaaacactctctgcgtctggaaaaaaaaaaaaagattaaaaaccaataaagaaagtttcggaactaattagggcttccttttgcttacatg

SEQ ID NO: 23159 - DNA, 3003 bp, Unknown
  misc_feature (1)..( 3003): 2750-1469P.txt file - cDNA_ID_2132235; gDNA_ID_1620370; Annot_ID_154971
gtttcaatgtcttgaggacaaatgagtttgagttttgtgatattagcccatgacaaatcttgaattttgaatgatattgggctggtttgaatttggtccattagttttcatcaaaacacaagaggggtaaaacggtctttgactatttgctgtattagaggagggctgtattagagaggacagaagaaactaccctatcagcctattttttaaaaaactgtctagttctcaaattatttctctaaaaactgcctagttctcaacttatctcattatacttctaatctagaagggcatatttttagtcataactcatttttcactttttgttgtttacttacacatattaatgcattttaactttatttgtctttgcccatcaataattcaaagattattattctatggtttttattgtccatgcacttgtttttaactatttttagtcagttttaatcatttctttatacatttttagactttgaatttcagtcacaatagtttatatatgatctgatttgtgttgttaaaaatttatttataaattattccggtaaagttttcttacttaaatattgaactacattttgtgtgatatatagttgttaaaaaatcatttttatacattaaattatatttttattttgcctatggcatcaaaaacctttggcacggctctgtgtacgccgaatgatgaatgtgtaagtgacgaggaagaagatgaaggcactgggcttactaatgggctgcgtccgagacagtcctcacgtgtaaggaagcccaataagaagtatttggattaagagagacttcgtctccacattttcaagttctgcaaataagtgtggaagtggtctccctaattgttaggaaccattatcacctctttcccattatttcccaaattgtaggactggtgttcactccattgcattgttgttttgttcttctatttaagaaatgaaaaagccaaaaagaggcaatatcgattgcccaaaaatctgagtctcattgttctttctttcaagctttcttttaccttcggtactaaaattgtgatacgacgaggtcatatctatcaccgaaccaggtaactattaagtggataacgtctctgttgaagcgaatggccatgaaacctttcggtaaaaagtcctggtttaagataatacagattatagttctatcataattttgtcagtttgcactgtaaccatttgctttaaaaatgtgaagatttaaaactggtttgtcttgccttattgattaaaaagcaaaaatcattaataagatcctctctgattcattttatttcttctacattgggatcttcatacgaattgggcattggcaagacacggccgagctgcagaatatctatagccaccggcaatggattgactagtgtcccttaagttccgtgaagttaattaagaaaatagccggctttacccgggacacatatgcatactactcaactatttttttaaaacaaatattttaacaaagatttaatgcgttctaaatcccagggcatttttgtgtgttaacgtcttccgcaaggtacctccgaccagtgaccaaccaccgttctatcgccaactttagatttcgaggggtcaatgtctgtatagatggcttcaagcggaacaggggaaacttacaagttacaacacctcttgaaaaaatttatgtactcgaaatttcgggtttgatcttctccaagaggttcccaaagtcaaatagtgcttggaggaactagtgaagattgactgcaaacataaccgcccacacctcagaaagtcagagataatatttcgtgatacttcatgaatgatggaaacttggggtttaattaggtcccaaatttttcggtatatgtgattaaaagggtttaaaagtcttaggtaaagaaacattaaaagccaattcggttttattgtttgtgttatgttactagagtaccttacactatttcgtgtctttgatcttaattttaaatcgcatggatgatccctagctagaataattgtatcataagcaaaatgatcaagagtggggctcacttgtctaatgcgttttttgcagcatctctaaccctactctattttttctctaaaactctattttagaatacattggcttcaacttctctctatatgttactctaaaatatagtaaatggtaggattgttctagatatatagtaactctattttatttacactgcctctattttagagtgatacattggaaagaaatcatgctctattttagaattacattgagatggtctcaatgattttttttatatcttatgaatgccattatgacttgtgatctgtgtgtggatataagtaaagtctaactatacaggtggggtattaattgatttcttgatgatttttatagttgatatatatgtgattatttttgtctaactagcagctagctatgagaacattaaattaatttattgtcttataaccgagaagagtactatatacttctgttggcccggtctcgttggtttctctgatgcatattgcgtaacgggttttggtgttttcgtggagagttaaaagcggttaagaaagagcttcacatacatgatcagtgattagcaagttttgttgcctcgcaattggttatatgagacattttaagaatgctaagtggttatttgattttcttgttttagttgtatgatattttattgtattgacatggattactactgtgtctctttgtctagtttttgttttgttttttgattgtgtaaccaactacccagttttgcagttaagattatatggattaatttaaggctcactcaaatccggtcaactattctaatcttctttgtagatcaatgattaataatggaatcaattatgattaagtaaaacacaatgaaaccattgaatcaaacgttcttacagaaaaaaatacttcttgtttttcctcagcaaatagtttcctcaaaaaccattaccttccatg

SEQ ID NO: 23160 - DNA, 3003 bp, Unknown
  misc_feature (1)..( 3003): 2750-1469P.txt file - cDNA_ID_2132238; gDNA_ID_1620370; Annot_ID_154972
gtcccaaatttttcggtatatgtgattaaaagggtttaaaagtcttaggtaaagaaacattaaaagccaattcggttttattgtttgtgttatgttactagagtaccttacactatttcgtgtctttgatcttaattttaaatcgcatggatgatccctagctagaataattgtatcataagcaaaatgatcaagagtggggctcacttgtctaatgcgttttttgcagcatctctaaccctactctattttttctctaaaactctattttagaatacattggcttcaacttctctctatatgttactctaaaatatagtaaatggtaggattgttctagatatatagtaactctattttatttacactgcctctattttagagtgatacattggaaagaaatcatgctctattttagaattacattgagatggtctcaatgattttttttatatcttatgaatgccattatgacttgtgatctgtgtgtggatataagtaaagtctaactatacaggtggggtattaattgatttcttgatgatttttatagttgatatatatgtgattatttttgtctaactagcagctagctatgagaacattaaattaatttattgtcttataaccgagaagagtactatatacttctgttggcccggtctcgttggtttctctgatgcatattgcgtaacgggttttggtgttttcgtggagagttaaaagcggttaagaaagagcttcacatacatgatcagtgattagcaagttttgttgcctcgcaattggttatatgagacattttaagaatgctaagtggttatttgattttcttgttttagttgtatgatattttattgtattgacatggattactactgtgtctctttgtctagtttttgttttgttttttgattgtgtaaccaactacccagttttgcagttaagattatatggattaatttaaggctcactcaaatccggtcaactattctaatcttctttgtagatcaatgattaataatggaatcaattatgattaagtaaaacacaatgaaaccattgaatcaaacgttcttacagaaaaaaatacttcttgtttttcctcagcaaatagtttcctcaaaaaccattaccttccatgggcgcctccttctccctctttaccgacgttggaccgatcccgcctcagtatcaagtgttcatcaacttccgaggcgaaaaacttcgtgatgggttcctagggtttcttgtggatgctcttttaaaagagaatgtcaacgtttttatagatgatcatgagcttagaggcagagatcttgatcatctcttcagtaggatcgaggaatcgagagtcgcattgacaatcttctccaagaacttcaccaactcaagatggtgcttagatgagcttgctaagatcaaagaatgtgtggatcaagaaagtcttacagtgattcctatcttctttaagatgaaaacagacgatgtgaagaaactgaaggggaattttggagacaacttccgggacctgaagttaacgcatcgcggcgagcctgaaacttatcggagatggaaagatgctatactgtatgtttctaagaaaactggcttgtcttcgtcacgatacaggtctggactttgtccctttgcttatgttctttgttggaaacttggaatactctgtttcttgactctgttcttggttagttcaggacataagcttgttcactgacagatcttttgaactctgttatgacagtcgccagaatgatttggtcaacacaatcgtcgaggaggttaagaaagttctaaacgatatcgccgagatcgaacgacaaattgctgaagagaagcgcaaccatttggcggcaagaacagatgaattgattagacttgttgtccggttcctaagtctgtttcttctttttacaatagtttttggtccttatgttttaggccttctcacttttttctcttttcttgtgggtcgtttgataatcaatcgagctgtggaaagtgagtggtgaatggtaacgtttgcgtttctatgagaatacgtaaacgcaaagaatctgagactgagagtttcattttggttacacattgttgcattcgatatttttttctatgaaataatttgatttcgattagtttgaccttgcatcaattattgataaaagtgattacgattaataacactatctcctttataacctaccacctaagacttttggtcaactactagatcaatgagacttccacatgttttatttggttatgatcttgaaatagaagaaaaaatacaaatctaaagataaatgtttctttcaaagtaaccacttttcactcttttgctttatttttcttgtgcaaaaagttcccaaagtctccgcttctctattccaaacagttaaaacccaaagaaacacatagtctcttcgcttgaccaaagctcaaaaaaaggtcagaataattcatatgaagttgttgagtgtccctaaaaacacgagatgtctaatgaagtcatcaagcagctcggtagtcgtggtcgtgcttgaccaaagctcaataatggatccagcacgaccacgactaccgagctgcttgatgacttcattagacatctcgtgtttttagggacactcaacaatttcttatgaattattatgacctttttttgaaaaaaaagtagttaaatctaaatatctaatacaagaatagtttaaggatagtttacatttgttcattgaatatagatgaacaaatatctaaatatttgtcctatatttccaatttttccataaaaaataataaagaagacagttgccaagagttgacttttgaaatgaatttttcctaaaaaagaaataaatgctttgacttttgaaatgaattggtccaaaacaagaaatgaatcttttacttttccagcttcttcttctccatatattcatgaagaaaaattaaagcaagaaagtctcaactctcaaccctcccatg

SEQ ID NO: 23161 - DNA, 3003 bp, Unknown
  misc_feature (1)..( 3003): 2750-1469P.txt file - cDNA_ID_2132260; gDNA_ID_1620370; Annot_ID_154978
gctacagaacaagaagtttcttccatatatttcggttttcttagtttgttgtgatgtagatatgatctccgtagatattctaagatagtgtttgtaatctatttaaacgcttgtaatttcagttctgaacatatcgaaaatacatttctcttccattatgatctctgaatctatagacagtagccctaggaatcgattttgatgttgttgttgttgttcatgctctagggatggatcgcgattatatcagcgaattgccggattctttactaactcagatactcttagagcttcgaaccaaagattctgttaagacaagcgtgttatcgaagagatggagaaatctttggttaaacgttcctggactcgaattattcacccttcaattcacatatcctgatcgcgaagaaatctttgtaaggtttatggacagatttatggagtttaagtgcaggtcacgcctgaaaaagttcatgataacgtatgtcgattgtaaaggttatcgagatcgattaatggagttgatcggtacactggttgatcatggacttcagcatttgtatgtttttatgcatacttttgacagagttgatttcaaacgtcaaaacatttacaagagcaagacattggtctctttgaagcttcataacgtagagttaaagaattcagactttgttgtttctctaccttgtctcaagatcttgaaactggagaatatttgtcacggtgaggatggtcctttggttgtggagaagctcatctcaggatgttctgttcttgaagatcttgagctgattaggccttttgatattaggacacataaagttcttctgcttctgcgtgtgagctctcagactctgaaaagctttaccttacattttgcgatctataaggatcgtacagatttttcagttgagattgatgctccaagactcaagtatatgactgttgaacagagtcaatctgatagcattgtggtaaagaacctgagttccttgttcagcatcgacattggtactaaatttaatcctttgagacatgaggatctaaggatgcgtaatgttttctacgattttttaaccgggatatctagtgtaaaacatatgatcatctgtttgtggagtctccaggtatgtgtttatataacaatttaatgtattaattctcaatgaaacatatctgatttgcatttattcttcttgcagaggttttctccttattcaaaacccggactgattcccaaattccagaacttgtatcatttaaaagcacagatgtggagctcatcaacacacttattggaagcgtttcttgagagctgcccaaatctgaaaaacctcatcttggtaagaagaatctgtgattttggcaaaagaacattgttgaaacatatcgtaaaaactcagcttgttcatttcgcaggaatataatgttgaattggatcgagagcaagtggactttaccaacgtgcctcaatgtttaatatcgacgctggagtatgttgagattaaagaaccgaatgagaaaagtacgattaaactagtgaactactttcttgagaattcagcagtcctcaagaaacttactctacgtttctcatattcatcttctatctacctaaagagctacaagaagcttcttacatcaacaaagctttctcccacatgtcaagttatctttggttgttgaacattgtttcagtgacgttattcctgtagtttggctttttgttgctttgatttcaatttcaggacagagtttcagtttaattatagttttctcttttttttttaataaaaatttttattttcaacataataattgtagtttatatacattttaattaataattgcatttctctggttgtataaaattctaattgggttttggattcataatttatttgctattaaaagcttacgttactgttggtttaatgagttcttcagaatcctaccttgatcgttacgtttctgtgtaatttttggcagaaatttattaaaagctttccttactattcgtttggtgagttctacagatatgctattaagaacttcactgaaagatttcttgagtttaacagttcaagatgaagaatgatcatcacagccgttgatagcgggattcaacatctagatgttgagacacaaaatcctagtcctaggtatgttatagatggaatacctatgaacatttctaagagcaggacattggtgtctttaaagcttctataagaagggatgtagaatccggagttttgtgtttctctaccttgtctcaagatgaagcatcttgaaaatataattttatacggaaaccatggtcttgtgaagaatctcatctcagggtgtcctgttcttgaagttatcatttctaaacatgtatctgatgtcagtgagagcatgaacattatcattatggtttacgatgttaaaaatcttatggtgttaattataatgtcttgtacagagttggattgtctcatatgcttgaaaagtcgtattgatctctgtttcttggagtagtttaatcatctttgcattcaaagtggtttcgaaaagtcccatggtcaattgtttaatatgttggtatggttgacttcaaggttctctgttcgaaacatttgtccaaagaaacaacattttgttttttagaaataacatttgtcaaaagacttttcttctaatccaagaagcttctttggctcgccaatattgactcaaatattttcacctttatcaattacgtaccatctaagaaagcagttgaagactcgctcgctacatcatcctggtcaatttctgatcgaaatcgtatcttgcattcatttttgtgttaggtgcatatttactttattcattcttgatcacttaagtttttgtgtgtgtttctggttaggttgtaccctgcagatttaattgggtaatctatagtttcacaatgatgttttaatattataagctttgtgttttttttttactctccagtgtacatcaacaatg

SEQ ID NO: 23162 - DNA, 3000 bp, Unknown; identical to SEQ ID NO: 1205
  misc_feature (1)..( 3000): 2750-1469P.txt file - cDNA_ID_2132303; gDNA_ID_1620371; Annot_ID_154987

SEQ ID NO: 23163 - DNA, 3000 bp, Unknown; identical to SEQ ID NO: 1206
  misc_feature (1)..( 3000): 2750-1469P.txt file - cDNA_ID_2132317; gDNA_ID_1620371; Annot_ID_154992

SEQ ID NO: 23164 - DNA, 3000 bp, Unknown
  misc_feature (1)..( 3000): 2750-1469P.txt file - cDNA_ID_2132402; gDNA_ID_1971812; Annot_ID_175798
agttgacaaagcttaccaagaaggacattccattttaatggactttatgaacagaggaatcttgaaaatacaagaagacaacatggtggttccagagttctccatgagcaacctattagatcttcaagattgtggattctttggaagatcttctcttggatttgacagagtttacggtggagacaagagaaaggggctagggaaaatcatcttgatcgatgatatgatacagacaattcaatcgaagaagaagaatatcacgacgattatcgctagcggaaaccgtttacgtagagaggttcatgggaagttctttgagaaaccagagatgcaagatcttgaagttgtagtcctctttgagccaacgttccatgaacttgttctgtctttatctaagctaaagaaactccgagtacttgttatcagagactgtgatctaatcgataacatcgataagctcagtggtcttcaaggcctacatgttcttgaagtctctggtgctagctctctagttaacatccctgatgatttcttcaagaacatgactcagcttcaaagccttaatctttcgggacttgcaatcaaatcttcgccttccacaatcgaaaagctaagcatgcttcgttgcttcatcctaaggcactgctctgagctacaagatctgcctaacttcattgtggaaacaagaaaacttgaagttattgacattcacggagctaggaaacttgagtcttactttgatagagttaaagattggaaggactataaaggcaagaacaagaactttgctcagcttcagctgcttgaacacctagacttctcagagactaaaatcatccgtctgccgatatttcatctcaaagactctactaacgatttcagtactatgccaatcttgacccggctcttgctgagaaactgtacaaggcttaagagattgccacagcttaggcctttgactaatcttcagattcttgatgcatgtggtgctacagacttagtggagatgcttgaagtgtgtttagaggagaagaaagagcttaggatcctcgatatgtcaaagacaagtcttcccgagttagccgacacgattgctgatgttgtcaatctcaataagcttctgttaaggaattgctcactgattgaagagcttccaagcattgagaaactgacacaccttgaagttttcgacgtttctggttgcattaagttgaagaatatcaatggatcctttggggagatgtcttacctccatgaagtgaatctttcagaaactaatcttagtgagttacctgacaaaatctcagagctatctaaccttaaggagctcatcataagaaaatgttccaagctaaagactcttccaaaccttgagaagctaacaaatcttgagatcttcgatgtttcgggctgcaccgagttggaaacaatcgagggatcattcgagaatctgtcttgcctccacaaagtgaatctttcggaaactaatcttggtgagttacctaacaaaatctcagagctatctaacctcaaagagctcatcctaagaaactgttctaagctaaaggctcttccaaatcttgagaagctaacacatctagtgatcttcgatgtttcgggatgcaccaatctggataaaatcgaggaatcattcgagagtatgtcttacctttgcgaggttaatctctctgggactaatctgaaaacgtttcctgagttgccaaaacagagcatcctctgttcttcaaaacgtattgttctcgcggattcgagttgtatagagcgagaccagtggagccaaataaaagagtgtttaacaagtaagtcagagggctctagcttctctaatgtaggggaaaaaacccgcgagaaacttctttatcacggcaatagatacagagttattgatcctgaagttcctttgaatatcgatattgttgacatcaaaagatccactgatcttaaaacagagtatatagccaaagcagagtatgtctctatagcagagaatggatccaaaagcgtatcttctctcttcgacgagttgcagatggcatcggtaaaaggttgttgggtagagaggtgcaagaacatggatgttctcttcgaatcagatgaacaactagagaaagagaaatcatcatcaccatcattgcagactctttggatctcaaatcttccattgctaacaagcttatacagtagtaaaggaggattcattttcaagaaccttaagaagctaagcgtagattgttgtccaagcatcaaatggctattcccggagattcctgataaccttgagattcttcgtgtgaagttctgtgataagttggagagattgtttgaagtaaaagcaggagaattatcgaagcttcgtaagcttcaccttcttgatttgcctgttttatcagtacttggagctaatttcccgaatctggagaaatgcacaattgagaaatgtccgaaattgaaagctagagaagatgaaccgaggattggagcaaggattacagatgaaatttcagaggatcaacctcacaagtaagtgaagttaacaactaaacaaatcgaaactttattttgttttcacactctctgttctgttcttcttcatgtgcaggaatactattgggcctgaaacccaaactcctacccagcccacaaaagctacagacacagtttaatctctctgttcttcttcacacgacgaggatgaagaaacaaaatttccgctgatcttatattatctcaccgttaataattatccaagtcttgaactttgacagagcttgtaattcgaaacttttcaaaatggttactttgtgttgtgttgtgtgaactcttaaaataaagaataaatgaatgttattttatttttagtcgtcttcaagttttggtctgcgatcgtgaaatttacgcagagagagatcagaatcgaagaaaacattgcaatataaaagagtcaccttcgagttcgtgtctcactccgataaagcaatg

SEQ ID NO: 23165 - DNA, 3000 bp, Unknown; identical to SEQ ID NO: 23164
  misc_feature (1)..( 3000): 2750-1469P.txt file - cDNA_ID_2132402; gDNA_ID_1620707; Annot_ID_165323

SEQ ID NO: 23166 - DNA, 3000 bp, Unknown; identical to SEQ ID NO: 23164
  misc_feature (1)..( 3000): 2750-1469P.txt file - cDNA_ID_2132402; gDNA_ID_2926173; Annot_ID_199630

SEQ ID NO: 23167 - DNA, 3003 bp, Unknown; identical to SEQ ID NO: 20076
  misc_feature (1)..( 3003): 2750-1469P.txt file - cDNA_ID_2132434; gDNA_ID_1620707; Annot_ID_165338

SEQ ID NO: 23168 - DNA, 3003 bp, Unknown; identical to SEQ ID NO: 20076
  misc_feature (1)..( 3003): 2750-1469P.txt file - cDNA_ID_2132434; gDNA_ID_2926173; Annot_ID_199644

SEQ ID NO: 23169 - DNA, 3003 bp, Unknown; identical to SEQ ID NO: 20416
  misc_feature (1)..( 3003): 2750-1469P.txt file - cDNA_ID_2132471; gDNA_ID_1620735; Annot_ID_166230

SEQ ID NO: 23170 - DNA, 3003 bp, Unknown; identical to SEQ ID NO: 20416
  misc_feature (1)..( 3003): 2750-1469P.txt file - cDNA_ID_2132471; gDNA_ID_2926170; Annot_ID_199420

SEQ ID NO: 23171 - DNA, 3003 bp, Unknown; identical to SEQ ID NO: 18298
  misc_feature (1)..( 3003): 2750-1469P.txt file - cDNA_ID_2132547; gDNA_ID_1621126; Annot_ID_172317

SEQ ID NO: 23172 - DNA, 3003 bp, Unknown
  misc_feature (1)..( 3003): 2750-1469P.txt file - cDNA_ID_2132580; gDNA_ID_1620660; Annot_ID_163780
tggctccatgtaactaagaatagaagttacagaacaatcgtaattaccaaaagagacgtcttcctttattcttttcctgttcagtagctcttcttcttgtacacataaacggcctctcttggacacaacaactttatccaaggcggtttcgtttagttctgtatcttttccagatatctctttctcaagattattctcgtgtaacccatgcaacctacaatcattctcatctggtgcatataacaagctcatcccgcatttcaccacctcacagcaatctagttttcttttggctctgccatcagtaacaaaaaatttgaacgaggctgtggtgttgcaacatctattgagatcatcgtttttcttggcatggtaacagttgctataactgatgaacacatgatcagagctaagtcttcttgattcttcatggctagacgatccacactgctctttccatcccccaagattacatgtaaagctgatgtaatcaccgtcttcgtttctgaacttgcacttgcatatcacggagaaccggctggttctatcttcatagtccttgaaagagacaaccgtgcagagagaaagaccaatgaatttatcgtcgcaccagtgtgaaggcaggttggtttccattgaagatccaattctctgatggcggaaccatagtggcaaatcattccctggaaaacttacagcagataaaggttccaaaactagttcctggaaaaaccattaaggatagcaatgtcactggaataataacagaataaccagagattggaccttatgattaagttgaaaagatctattcgccagtatttgactcttgagctgagtatgagccacaattttttcttgtgcatctcggtttagcttgtagcaatccgtgaatacgaaagtagaatgggtcttttcagctatcactagaagcgtcatgggttttgaaactgtttcgagtgagatacagccatgaacatccaagtactgatttgatggaagcactggaagagaaatgagatttttgcaattctttaagtaaagagatttgagatgatgaagtttcttgatgcttcctggtagattctcgatactgtttcggctcaagcataaagactgcagcgaggataagcagctaaaattgtccgggaatttgtacagattacaatctgtgagatacatgtctgataactgagagcaacctgagaaaggcagcaactccaaacctctgaaatcttggactttagatccaccaaacgaaaacagcttgagattactcatacacattgttctgggagtttgtttgatggatgtatcatccattagcagaatctctaagcttcccatgtttgtttggggattccatgttttaccagatgcccatgttacatgcagacaggagactgcaactttggtattacagtatgtgtaaattccatcatccgagtgagagagaaacccatgtccttgagacctccttaagctccaaaggcctcccttcacggacggtgagccatttcttaaactagcagtagcaatctagcagacgttagttttctttgcttcaaacctcattcttttgaactaaccaacaccaaaagcttgttcgacttcaaactgaactctgtttttctaatctcattactatcatctgtgtttatcgcttgctcaatttttgctccaatctttcgacatggagaacccgtgtgtaccttatatttttacagtggaaactgcagctccggtcccacttgtatctttgatcatccgatgttggtatcaacacacaagaacatatcttccatggcttccgagacacagcacttgaatccgctaggattgtcctcttcacttggggcttcatcaagtgatattgtggaagcatcagccaagaaacccagaatatacaagaacacttcttccgtagcgtctgatacaccacactcgaatccattaagattttcttctccaattggagattcatcaagtgagcttgtggaaagatcaactaaagaaactgtaatcaacaagaacacaccttccatggcttctgagactctgcatgctaatccactaagattttattcttccattagagagtcatcaagtgattgaagtgaacttgtggaaacatcagattagaaacccatagtgcataagaacacaccttccatggcttctgagacaccgcacttgaagtcggtaggactttcttcttcgcttggacctttatcaagtgagcttgtggaagcatcaactgtgtctgaagtcacacaagaaaccgttagtagaggtgtcattgaagtgaagacttaaaatttttgtggttaaacaaaatgttgtattttaaaatattgttcttctaatatatattttctaatattaacatatgcttgatccaaaaatttccatgagtaatatatgaaaacaacataattaagtaaaaaaaatacaaggcatttttccaaattaactcaaacaaaaatccataggatatttttcaaaagtataaacaaaacaaggcatttttccaaattaactaattagaatattacaaattttgttagagaactatttgatttattgaattgaaaagatatttgtaatatagtaatattaattttactagtaatgaaaatcagttattcataattacagaatcaaactgacatttatccttttctgtagatgacgtggatacctaatgcaccgtcgattaaatctgcgtagtgaaaccccgcactgctcacagcaccacctctctcgaaccatcgagtctcgaacccagagaggactttcctcagtgagtcctccgttccttagcttctcttccagatccaaactctcaccaaactttctcacaacacacacacaattcgattcgatccacactcttaaaatcccaaagatctctctgattttgaaattcgattcttccccagatcaacttgtgaatttttccacaattttggttcatgattttgatttcgtgaaggacttatg

SEQ ID NO: 23173 - DNA, 3003 bp, Unknown; identical to SEQ ID NO: 23172
  misc_feature (1)..( 3003): 2750-1469P.txt file - cDNA_ID_2132580; gDNA_ID_2926174; Annot_ID_199702

SEQ ID NO: 23174 - DNA, 3003 bp, Unknown; identical to SEQ ID NO: 17818
  misc_feature (1)..( 3003): 2750-1469P.txt file - cDNA_ID_2132651; gDNA_ID_1621089; Annot_ID_170621

SEQ ID NO: 23175 - DNA, 3003 bp, Unknown; identical to SEQ ID NO: 17818
  misc_feature (1)..( 3003): 2750-1469P.txt file - cDNA_ID_2132651; gDNA_ID_2926192; Annot_ID_201162

SEQ ID NO: 23176 - DNA, 3000 bp, Unknown; identical to SEQ ID NO: 6335
  misc_feature (1)..( 3000): 2750-1469P.txt file - cDNA_ID_2132684; gDNA_ID_1621089; Annot_ID_170634

SEQ ID NO: 23177 - DNA, 3000 bp, Unknown; identical to SEQ ID NO: 6335
  misc_feature (1)..( 3000): 2750-1469P.txt file - cDNA_ID_2132684; gDNA_ID_2926192; Annot_ID_201175

SEQ ID NO: 23178 - DNA, 3000 bp, Unknown; identical to SEQ ID NO: 6346
  misc_feature (1)..( 3000): 2750-1469P.txt file - cDNA_ID_2132692; gDNA_ID_1621089; Annot_ID_170641

SEQ ID NO: 23179 - DNA, 3000 bp, Unknown; identical to SEQ ID NO: 6346
  misc_feature (1)..( 3000): 2750-1469P.txt file - cDNA_ID_2132692; gDNA_ID_2926193; Annot_ID_201208

SEQ ID NO: 23180 - DNA, 3003 bp, Unknown
  misc_feature (1)..( 3003): 2750-1469P.txt file - cDNA_ID_2132716; gDNA_ID_1620686; Annot_ID_164607
gtaatcggtttagcaacacgaggagtagcagcagagacggttcgagccgtggttaccacccttggaacagacggtttctgggcggcgcgtaggttaaggtccagtgaagacgcgcttctcattatcattgttagttcttgtggggaatatttcagtggaggaagagaagagagatgaaaagatatttagactgcaaaaatatcatggagtttccggttcttgtcaagccccacactattagtcaatattatcaaattgaccccaaagttttatcatttttggttacacccttgcatcattacatgttcattcaaaacgttatcgtaatacaagaatagtaagttaatctctaactttagatacgagaacgaaactaaaagctagttagcaaataaaacattttgaaagtatttgcattatcaggccaaaaacataagtagccttttctgtaaattctacgactatcttaactagatatcatttttggggattgttcccttatttatatatatcaaatcttatcggaaaacaattgttataggcttcaggaccaccataatcgaatacccctaaagaaaatatttcaatttgattggctacggaaagacgtaagtaactggatcaaagaatttgattctgtcccacaaataagttactttttgcattcttgaacttatttccacggtcatgagtcatgaccaaaccaagacatttggatttggatatatcgaataattttgctagaattgatgagaaatgactgacaagctttgatagtatatttaatgactaattgctgatgattttttacaatgacctaacaataacggaataactatggaagttttattattcaagataaaaccagttaataagtgttcacgatacaaaaaatcgattttcatcatcagtagtataaatgtggtataactaaaaaaataaagaaattgaccataaggtgatccaaatttcctaatttcatttataaaagggcaataaatatacactaaaaatgatatggaacttgaaaaaagcaattaaactgtgtttttctgctttctttatatagtataaaaatatttttttaatgaatcatatgtacaagccttcttcctcccaaacatcaacaaggaaatgcaccatctcctgtaccaatatcatcatcaatttaaaaaaaactttcctagcaacaatgatatatactagattcaaatcctgatatgaaaatgttctaagggggataaagaatcttctgctgtaagttaattaaaattaagagttatgattagcagaaaacaactaattaaccaaatcaaatcaccttaagaggtattggttgaggaaaaagcttgtttgtgctcaataagctatcatacgtcgagttccagctgaaatcatatgaattcaaagtttcattttaacattgacgaattcagtagaccaatcctatataaacataaaaatagttcgttcaatattcgtaactgtttgtggttgtcaccttattgcaggttctggaactagacattgttgtctggttaagcattcacgccattgttgtctcgtgtggttccacaaaataagtccttttatggaaggaaatgaataagtagtagtgtatcttttagtgtatagaataactgaatgagtaataaatactgcttgcttcataacataagtttttggcatccaaaacaacctaggccttagaagttagaacattcaaaagttaccatggtttacaaattcggtagagttgcttgtgctgcattggggatcaaaaggcgggtttgaagattgggactgaatcgttatattgtggtccatatcacacgtacttgtgctccagaagtcatctgatgaagcactatctttcttcactatctttccttggattttgagtccctttgatggctcatcgacttccacaactaaacgcctttctctgttgcagcatccgaaacagtttatgctctgaaagattgaacattatgtcaatcatttgttactatggtctaatatgtttgatctacttggaaagaaatcaatttggttctccgggtcgctcacattgatgagagttttgcaatttgatcgtagagattccattagccaaaaagggagagtttggaagtaagctgccgggaattggaagaaagagcaacaacgcttcttactaaattgtgttcgtaattttagcaagaatgaataacaagaacacatagctagctaatacatgacaggacaaaagcacaatgaacatgaaagagaattaaggaaactcaaaaaagattagcaaggaagtgtagtaatatgcctcatatgacaagcaaacatatgcatttaagcacaaaaggaatccatatgttataacttacaagcaagtaaggcatattatgccgcataattacatattttaccttgatttagtacaaagtctgtctctgaactgaagcacatatatacatccacatgatttaatagaatcttgaaaagaattcaaaagaaagaaaacaaaagtttaaacaccttccaacaaagggtattgttaaaaacactcgatcattattacgttgattttatatttcttctcttcttcacgttatttacagtttttttttcatgtaaaaatgatcttttcgtttgattcctatcgtaattgtaagtaaacaaaataaattttagtattattttaagatgagacttatatagatatgaatctatgtgaattattaaatttaatgataataaataaccaaaaactttaataaaataaactgttacatattgtaaaaaaaaagatttttataaatgtttatattcaaagagagaatctttattgagtacaaaaggaggaatatatgtgatagatctaattacataatctactttacataaatagaagaagatatcgtggagtgattgatatgtgattgatctagtcagatatcatgattgatccttaacaacttatatagtagttatgaatctacgtgaactatg

SEQ ID NO: 23181 - DNA, 3000 bp, Unknown
  misc_feature (1)..( 3000): 2750-1469P.txt file - cDNA_ID_2132716; gDNA_ID_1620621; Annot_ID_162300
atcggtttagcaacacgaggagtagcagcagagacggttcgagccgtggttaccacccttggaacagacggtttctgggcggcgcgtaggttaaggtccagtgaagacgcgcttctcattatcattgttagttcttgtggggaatatttcagtggaggaagagaagagagatgaaaagatatttagactgcaaaaatatcatggagtttccggttcttgtcaagccccacactattagtcaatattatcaaattgaccccaaagttttatcatttttggttacacccttgcatcattacatgttcattcaaaacgttatcgtaatacaagaatagtaagttaatctctaactttagatacgagaacgaaactaaaagctagttagcaaataaaacattttgaaagtatttgcattatcaggccaaaaacataagtagccttttctgtaaattctacgactatcttaactagatatcatttttggggattgttcccttatttatatatatcaaatcttatcggaaaacaattgttataggcttcaggaccaccataatcgaatacccctaaagaaaatatttcaatttgattggctacggaaagacgtaagtaactggatcaaagaatttgattctgtcccacaaataagttactttttgcattcttgaacttatttccacggtcatgagtcatgaccaaaccaagacatttggatttggatatatcgaataattttgctagaattgatgagaaatgactgacaagctttgatagtatatttaatgactaattgctgatgattttttacaatgacctaacaataacggaataactatggaagttttattattcaagataaaaccagttaataagtgttcacgatacaaaaaatcgattttcatcatcagtagtataaatgtggtataactaaaaaaataaagaaattgaccataaggtgatccaaatttcctaatttcatttataaaagggcaataaatatacactaaaaatgatatggaacttgaaaaaagcaattaaactgtgtttttctgctttctttatatagtataaaaatatttttttaatgaatcatatgtacaagccttcttcctcccaaacatcaacaaggaaatgcaccatctcctgtaccaatatcatcatcaatttaaaaaaaactttcctagcaacaatgatatatactagattcaaatcctgatatgaaaatgttctaagggggataaagaatcttctgctgtaagttaattaaaattaagagttatgattagcagaaaacaactaattaaccaaatcaaatcaccttaagaggtattggttgaggaaaaagcttgtttgtgctcaataagctatcatacgtcgagttccagctgaaatcatatgaattcaaagtttcattttaacattgacgaattcagtagaccaatcctatataaacataaaaatagttcgttcaatattcgtaactgtttgtggttgtcaccttattgcaggttctggaactagacattgttgtctggttaagcattcacgccattgttgtctcgtgtggttccacaaaataagtccttttatggaaggaaatgaataagtagtagtgtatcttttagtgtatagaataactgaatgagtaataaatactgcttgcttcataacataagtttttggcatccaaaacaacctaggccttagaagttagaacattcaaaagttaccatggtttacaaattcggtagagttgcttgtgctgcattggggatcaaaaggcgggtttgaagattgggactgaatcgttatattgtggtccatatcacacgtacttgtgctccagaagtcatctgatgaagcactatctttcttcactatctttccttggattttgagtccctttgatggctcatcgacttccacaactaaacgcctttctctgttgcagcatccgaaacagtttatgctctgaaagattgaacattatgtcaatcatttgttactatggtctaatatgtttgatctacttggaaagaaatcaatttggttctccgggtcgctcacattgatgagagttttgcaatttgatcgtagagattccattagccaaaaagggagagtttggaagtaagctgccgggaattggaagaaagagcaacaacgcttcttactaaattgtgttcgtaattttagcaagaatgaataacaagaacacatagctagctaatacatgacaggacaaaagcacaatgaacatgaaagagaattaaggaaactcaaaaaagattagcaaggaagtgtagtaatatgcctcatatgacaagcaaacatatgcatttaagcacaaaaggaatccatatgttataacttacaagcaagtaaggcatattatgccgcataattacatattttaccttgatttagtacaaagtctgtctctgaactgaagcacatatatacatccacatgatttaatagaatcttgaaaagaattcaaaagaaagaaaacaaaagtttaaacaccttccaacaaagggtattgttaaaaacactcgatcattattacgttgattttatatttcttctcttcttcacgttatttacagtttttttttcatgtaaaaatgatcttttcgtttgattcctatcgtaattgtaagtaaacaaaataaattttagtattattttaagatgagacttatatagatatgaatctatgtgaattattaaatttaatgataataaataaccaaaaactttaataaaataaactgttacatattgtaaaaaaaaagatttttataaatgtttatattcaaagagagaatctttattgagtacaaaaggaggaatatatgtgatagatctaattacataatctactttacataaatagaagaagatatcgtggagtgattgatatgtgattgatctagtcagatatcatgattgatccttaacaacttatatagtagttatgaatctacgtgaactatg

SEQ ID NO: 23182 - DNA, 3003 bp, Unknown; identical to SEQ ID NO: 23180
  misc_feature (1)..( 3003): 2750-1469P.txt file - cDNA_ID_2132716; gDNA_ID_2926202; Annot_ID_201912

SEQ ID NO: 23183 - DNA, 3003 bp, Unknown
  misc_feature (1)..( 3003): 2750-1469P.txt file - cDNA_ID_2132747; gDNA_ID_1620621; Annot_ID_162317
gaccacagaacggcatgagctactaggtaagcttaagcttgctcttccagtttcgtgcaatacgaacatagcctggatcaatacgacttcttcttttaatactacttgagccacaaccatctgaagaacttgatgaatacagagacaaccgatgccacaaaatgtaactaatacaaaagccctaggtacctgcagtaacagaaaagataatatattccaagcaaagacagtgtgttttgcagtagtctccagcactttgatgcagatggtactttgagacagtatgtgaggaaaagattttggtgatcaattgttttcaacattaactgatttaacacaaatctttcattggcgacatcatagaatagcgattagggtatgaatttgatcacaagtgtctaaacatagataataagattatgacatgaaacatgacacaactagatacatgaaaggattaaaagtttctctccaccagattggaattcgtcaatgagttcttgtttgattgccaacaggtcctttgtgcataccctccaaataatttttcagtttctcccaactttgcaacgtagattcccaatcctggaacatggaaaaggcaaacaattcaaagtctttacttcttaaaatctaaatgagctcaatgtaatccaaaaaggattttacctcaaggttttccctaaactcttcgttgtcaataggaaaaaaatactcagctggaacaaaaaaaaaaaaacccaattcttaacaacaacaacaacaacaggaacaacatcaaaaggctaaagaaaaaaaggagagaaaagaaatcaatgttcgtgacatacaggctttgtatcctccataacctgctgaacctgtgcctagccatttgcacaccatcaaacccttttccggcaatcctgctgctgcctcaaccaatgaagaggacatggtggagaaagttctatctttagattggccagacctcttagtgctataggatctcgttccgcggccaaactgtaaacatccatcaaaaataaatcaatcactggaaagaacaagaccaggaaacattcatatgattcatgtcttcggctcaccttcgcgcacacggatccgaggttccttcatatcatcatcgtcatcatcgtcttgctcctccagccgaaaattagggcttttttgctccttccctcttttaataatatttcgatcgattgggaatttttattatttttgtactactgaacgaacccattcaataactttgctaggtgaccggcccaagcccatacgtttatactattgttcttttctttttctctgttttgtgcaaaatatttatatcattcttacgaaaattgatatgaggtacacatttttaatttttttcatatcattttacttttagtttttcaaattttaaaaaccaaatcgtttctctattttttattattattattttattgctctaatttttgtttggtgagtatcaaaataattgaatgttcttcgaattatttaataagctttattgaaataatgaactttcctaaagaataaaattaattttgtaaacaattaataaataatctgtgttgctatgaatgaattacagcttggacgcggatgaagatcgtatatggctggtagatgttaagatttattattaaggaggagcaagaagagtgaaggcactgcgtcatttgctgtttttactgtgctattttctatgataattatgtttgatagaagaatttgatatttttttatttatttcttgtcaataaaccttaaacatattaactgaaaattctacgattttttaattaatcatagtttatttgctttctacattgttatattaataagattatatatatatatataaatgaattcaaattaaatatttttcctttttcttttgtcattgtagattttattaaaaacatgttggtggaattacataaaattagaatatttttttatttgtttatttcattaatattgttgacaaaaatagttaattaagtaattttataagtttctatcttaaattaatgtcagattcagcagttaccatttgaattctaaattattcaacgagattccacaaaaaatcacaaaaacaaatagtgagattcagcggttaccatttacacaaattgttgaattcattaaagttagagtcaccgtgtttagtacttggttcattaattatatagttctatagaggatcatgaaagttatgtataatctaatgcatatatgtaattagtgaaaacaccaaaaaaaacagaaaatatggtttagagggattgacatggcataaaaagcaatgttggatcgctgaattattttttcttggttcggtaggactcggtccaatgttggatttgcgaatcgctgaaataaagagttttggttcggtgggacttggtattggttgggctaattcagcgtgaataaaaaggcccaaacgtatttaaatattgggccgggtctgtgggaaaaaggcccaaacgtaaaccgaatcgtagattgaaatgaccggtctagtttcagtcttgttcgcgagcgtcgagagaaatcgagaggaaaccctaatttggcgagtggaggagcaagatgatgaggaacattggatctgcgtgtgcgaaggtaataggaaatatcggaattgattctcatgtttcaacggaggttttgttgcgtctcttatcttcctcaaaatatcctcaggaaccttccatatcgtaaaaacaacacaatgtaattagtgaaacaacaactagaaatagaatcatgtacatttatgaatcttaaagaaacagaacgtaccgcaaaagctgaccggagagttctatcgtcgaaacccaataaaaggtctctaacactcgagtaggctccaagacatggatcgtttaaacacttccccacattaaagattgcgtaaaccctaagtttctcgtttctatcgatgattaataagaaacgttgatctgtgttgcgatg

SEQ ID NO: 23184 - DNA, 3000 bp, Unknown
  misc_feature (1)..( 3000): 2750-1469P.txt file - cDNA_ID_2132747; gDNA_ID_2926201; Annot_ID_201877
cacagaacggcatgagctactaggtaagcttaagcttgctcttccagtttcgtgcaatacgaacatagcctggatcaatacgacttcttcttttaatactacttgagccacaaccatctgaagaacttgatgaatacagagacaaccgatgccacaaaatgtaactaatacaaaagccctaggtacctgcagtaacagaaaagataatatattccaagcaaagacagtgtgttttgcagtagtctccagcactttgatgcagatggtactttgagacagtatgtgaggaaaagattttggtgatcaattgttttcaacattaactgatttaacacaaatctttcattggcgacatcatagaatagcgattagggtatgaatttgatcacaagtgtctaaacatagataataagattatgacatgaaacatgacacaactagatacatgaaaggattaaaagtttctctccaccagattggaattcgtcaatgagttcttgtttgattgccaacaggtcctttgtgcataccctccaaataatttttcagtttctcccaactttgcaacgtagattcccaatcctggaacatggaaaaggcaaacaattcaaagtctttacttcttaaaatctaaatgagctcaatgtaatccaaaaaggattttacctcaaggttttccctaaactcttcgttgtcaataggaaaaaaatactcagctggaacaaaaaaaaaaaaacccaattcttaacaacaacaacaacaacaggaacaacatcaaaaggctaaagaaaaaaaggagagaaaagaaatcaatgttcgtgacatacaggctttgtatcctccataacctgctgaacctgtgcctagccatttgcacaccatcaaacccttttccggcaatcctgctgctgcctcaaccaatgaagaggacatggtggagaaagttctatctttagattggccagacctcttagtgctataggatctcgttccgcggccaaactgtaaacatccatcaaaaataaatcaatcactggaaagaacaagaccaggaaacattcatatgattcatgtcttcggctcaccttcgcgcacacggatccgaggttccttcatatcatcatcgtcatcatcgtcttgctcctccagccgaaaattagggcttttttgctccttccctcttttaataatatttcgatcgattgggaatttttattatttttgtactactgaacgaacccattcaataactttgctaggtgaccggcccaagcccatacgtttatactattgttcttttctttttctctgttttgtgcaaaatatttatatcattcttacgaaaattgatatgaggtacacatttttaatttttttcatatcattttacttttagtttttcaaattttaaaaaccaaatcgtttctctattttttattattattattttattgctctaatttttgtttggtgagtatcaaaataattgaatgttcttcgaattatttaataagctttattgaaataatgaactttcctaaagaataaaattaattttgtaaacaattaataaataatctgtgttgctatgaatgaattacagcttggacgcggatgaagatcgtatatggctggtagatgttaagatttattattaaggaggagcaagaagagtgaaggcactgcgtcatttgctgtttttactgtgctattttctatgataattatgtttgatagaagaatttgatatttttttatttatttcttgtcaataaaccttaaacatattaactgaaaattctacgattttttaattaatcatagtttatttgctttctacattgttatattaataagattatatatatatatataaatgaattcaaattaaatatttttcctttttcttttgtcattgtagattttattaaaaacatgttggtggaattacataaaattagaatatttttttatttgtttatttcattaatattgttgacaaaaatagttaattaagtaattttataagtttctatcttaaattaatgtcagattcagcagttaccatttgaattctaaattattcaacgagattccacaaaaaatcacaaaaacaaatagtgagattcagcggttaccatttacacaaattgttgaattcattaaagttagagtcaccgtgtttagtacttggttcattaattatatagttctatagaggatcatgaaagttatgtataatctaatgcatatatgtaattagtgaaaacaccaaaaaaaacagaaaatatggtttagagggattgacatggcataaaaagcaatgttggatcgctgaattattttttcttggttcggtaggactcggtccaatgttggatttgcgaatcgctgaaataaagagttttggttcggtgggacttggtattggttgggctaattcagcgtgaataaaaaggcccaaacgtatttaaatattgggccgggtctgtgggaaaaaggcccaaacgtaaaccgaatcgtagattgaaatgaccggtctagtttcagtcttgttcgcgagcgtcgagagaaatcgagaggaaaccctaatttggcgagtggaggagcaagatgatgaggaacattggatctgcgtgtgcgaaggtaataggaaatatcggaattgattctcatgtttcaacggaggttttgttgcgtctcttatcttcctcaaaatatcctcaggaaccttccatatcgtaaaaacaacacaatgtaattagtgaaacaacaactagaaatagaatcatgtacatttatgaatcttaaagaaacagaacgtaccgcaaaagctgaccggagagttctatcgtcgaaacccaataaaaggtctctaacactcgagtaggctccaagacatggatcgtttaaacacttccccacattaaagattgcgtaaaccctaagtttctcgtttctatcgatgattaataagaaacgttgatctgtgttgcgatg

SEQ ID NO: 23185 - DNA, 3003 bp, Unknown; identical to SEQ ID NO: 19834
  misc_feature (1)..( 3003): 2750-1469P.txt file - cDNA_ID_2132751; gDNA_ID_1620621; Annot_ID_162318

SEQ ID NO: 23186 - DNA, 3000 bp, Unknown
  misc_feature (1)..( 3000): 2750-1469P.txt file - cDNA_ID_2132763; gDNA_ID_1620621; Annot_ID_162321
aacaaacaaatcaaccggtcacatataatgagagtctgtctttacgtttctatttcgcaagtgctagtaataaaaggtacaaatatgtatgcagagacaacataaatggaatgttgcataaagaaaggtcttaccttgagcaaaaaatttgctccagaaacaagacaatgcatttcatcttctttctcaatactaacgcccagccgttccttgaacaagtctgcaaatttaaatgccccgccacctgtgacctgaaagatacacgtacgcttgactcatatgtttaaaacaagtaataatcaactaatcaaagccgaatcagcaaatcacattacatggatatacaagacttataaatataaaaaacgtttcacctaaaaacaataattatgagggtcttaaatgttatctggtatctcaaatgaaagagcgagctaaatatatgcagaaggagcctcaaaaggtgataaagataaaaacaatcaagtcataaaaatgcgattaccttgataacaccagtccccaaaggcaaggtctttgaactccaaggataaggatctattcatttagttgaaaagaaatggagaagaagacgaattgaagagtaaatcaccagaaattgatcttataatacaaaacaacatttcatacactgaaaaggataaaagtaataatacctcggcgatgaagctgcttggaatgaataaaatccaagcactcattaattttgtgagtctcaaacttgacaaaatgaagtctaccaccaagaacaggataacttctcaagttgccattggtaatacccaatctctccttgatcgtcctcttccgcttatcatcatcattagagtagtcctcatgtcgtgaaaaatacaacaactttatcaaagaacctgcaaataaacttaaaagggttcataattctcaaacatagcacttaagaaataaacatcgaaattgccaaaaccaagaagtgacaccaaatactactggaagaaccacaagcactagatcaatggtcaactacagtgaaaataaaaaagaagtgaaatttgttgtcacctccgatatcaagagccaaatgagagatatcatcagactgattaggcaataaaatggtgggatctctctcctcgaggttcccctgaatttcggctttgcttagatcaagctgaggtctagagcctgatctgtggatcggagtaccagaagtagaaggagccatatttttatcagcagcaacagaaacctgagattttgcttcagcttctcttttattgtcaagaattggatcatactcatcctcttgacccgccattttttttttttattaaaaaataaaaaaggaacccaaccaaacccagaaaaatcggatcaccaacaattgcctaattctcccaaaccaccacaaaacccttccttgcaaagtttaaaaagtcaaacgacacgaactgatgatgataagactttccagggtaaagaagtaaactgttcgagcttttgctaatacgattatacgactaagcttagaatcgcttaagcaggctgaagcggacctaactccaaacaaaatttgtatttatatataattgtttgttaactaattaactaccacataaatttcccaaaaaaaaaaaaaaactaccacacaaatttgtagtttttaatgaatttgtaagtggattaggtttggtgtttcacaataatgaccaaactcgaactccacttgccacttatgagtttttccaagtcatagatgaggattactgtgttggtttcgatatcttaattaatccgtcacacttaattctttatgttttacgattttttgaagtttaagattttgctaacattacactattcacgataaatcactttttcagatttaagatatttttcgccggaatttagaaggtaggatatcctttaaaatgcttttgtgaagatggattatattatacaattggactatttggtgtagataaaatcttatgtgggaaacaaatattttaggaacactaaaccaaaaataccattgttacattttttaatgataaaaaagttcacttgcaaatgtaacaagatacaacctcgttgggttgatatgttaagaaaactagctgatggattggtttttcattgggtctattgggccaatgtcatgggcctgatgacttttattcagtttcttaaatttatattccagtttaatataacatactctttagtgtgtaagcatttctaaccacgcgactagccgactacgcgaaagaaagagaattgtcatactagaaaaccgttaccacgtacgtaattaagaagagtccattatttttacaaatagatcccttggccgtgtatttggacaatgccgacatgcatcttatgaataagggcaaaaaggactttcgagtttactggcgaccacaactcgcaagccaacgcgagcctctatttattattttgtatccttttttttggtaaaagaattttgtaacaatatccattccctagctagattcttcttcttcttccttggatttgttctcgtaagcattcttctccaaaacgcccacttgttaaatttgatccagtggatttgggttttgttccgtctttaagctccatggcgattgcataattatgctctcaggatgggtttctctcaggccattcgcttgaatcttgcttccttctcctctccctctccctgcgatgtttgtttccttacctttctctatattatcccctatattttcatttatatatcgctgctgattcacaacactttacttactcttaactttatcaaacttgaatttttgacttttgctggccttgttctgattgttccttgttctggcttaaaaagattgcaaatttcaatactgttcctttaatttgaataagtttgcttgcatccatattgattagtgtctgtccaaaataatcaaacttttgattttgattttgatgtcggccatatgattttttcttatg

SEQ ID NO: 23187 - DNA, 3003 bp, Unknown
  misc_feature (1)..( 3003): 2750-1469P.txt file - cDNA_ID_2132763; gDNA_ID_2926201; Annot_ID_201874
ttcaacaaacaaatcaaccggtcacatataatgagagtctgtctttacgtttctatttcgcaagtgctagtaataaaaggtacaaatatgtatgcagagacaacataaatggaatgttgcataaagaaaggtcttaccttgagcaaaaaatttgctccagaaacaagacaatgcatttcatcttctttctcaatactaacgcccagccgttccttgaacaagtctgcaaatttaaatgccccgccacctgtgacctgaaagatacacgtacgcttgactcatatgtttaaaacaagtaataatcaactaatcaaagccgaatcagcaaatcacattacatggatatacaagacttataaatataaaaaacgtttcacctaaaaacaataattatgagggtcttaaatgttatctggtatctcaaatgaaagagcgagctaaatatatgcagaaggagcctcaaaaggtgataaagataaaaacaatcaagtcataaaaatgcgattaccttgataacaccagtccccaaaggcaaggtctttgaactccaaggataaggatctattcatttagttgaaaagaaatggagaagaagacgaattgaagagtaaatcaccagaaattgatcttataatacaaaacaacatttcatacactgaaaaggataaaagtaataatacctcggcgatgaagctgcttggaatgaataaaatccaagcactcattaattttgtgagtctcaaacttgacaaaatgaagtctaccaccaagaacaggataacttctcaagttgccattggtaatacccaatctctccttgatcgtcctcttccgcttatcatcatcattagagtagtcctcatgtcgtgaaaaatacaacaactttatcaaagaacctgcaaataaacttaaaagggttcataattctcaaacatagcacttaagaaataaacatcgaaattgccaaaaccaagaagtgacaccaaatactactggaagaaccacaagcactagatcaatggtcaactacagtgaaaataaaaaagaagtgaaatttgttgtcacctccgatatcaagagccaaatgagagatatcatcagactgattaggcaataaaatggtgggatctctctcctcgaggttcccctgaatttcggctttgcttagatcaagctgaggtctagagcctgatctgtggatcggagtaccagaagtagaaggagccatatttttatcagcagcaacagaaacctgagattttgcttcagcttctcttttattgtcaagaattggatcatactcatcctcttgacccgccattttttttttttattaaaaaataaaaaaggaacccaaccaaacccagaaaaatcggatcaccaacaattgcctaattctcccaaaccaccacaaaacccttccttgcaaagtttaaaaagtcaaacgacacgaactgatgatgataagactttccagggtaaagaagtaaactgttcgagcttttgctaatacgattatacgactaagcttagaatcgcttaagcaggctgaagcggacctaactccaaacaaaatttgtatttatatataattgtttgttaactaattaactaccacataaatttcccaaaaaaaaaaaaaaactaccacacaaatttgtagtttttaatgaatttgtaagtggattaggtttggtgtttcacaataatgaccaaactcgaactccacttgccacttatgagtttttccaagtcatagatgaggattactgtgttggtttcgatatcttaattaatccgtcacacttaattctttatgttttacgattttttgaagtttaagattttgctaacattacactattcacgataaatcactttttcagatttaagatatttttcgccggaatttagaaggtaggatatcctttaaaatgcttttgtgaagatggattatattatacaattggactatttggtgtagataaaatcttatgtgggaaacaaatattttaggaacactaaaccaaaaataccattgttacattttttaatgataaaaaagttcacttgcaaatgtaacaagatacaacctcgttgggttgatatgttaagaaaactagctgatggattggtttttcattgggtctattgggccaatgtcatgggcctgatgacttttattcagtttcttaaatttatattccagtttaatataacatactctttagtgtgtaagcatttctaaccacgcgactagccgactacgcgaaagaaagagaattgtcatactagaaaaccgttaccacgtacgtaattaagaagagtccattatttttacaaatagatcccttggccgtgtatttggacaatgccgacatgcatcttatgaataagggcaaaaaggactttcgagtttactggcgaccacaactcgcaagccaacgcgagcctctatttattattttgtatccttttttttggtaaaagaattttgtaacaatatccattccctagctagattcttcttcttcttccttggatttgttctcgtaagcattcttctccaaaacgcccacttgttaaatttgatccagtggatttgggttttgttccgtctttaagctccatggcgattgcataattatgctctcaggatgggtttctctcaggccattcgcttgaatcttgcttccttctcctctccctctccctgcgatgtttgtttccttacctttctctatattatcccctatattttcatttatatatcgctgctgattcacaacactttacttactcttaactttatcaaacttgaatttttgacttttgctggccttgttctgattgttccttgttctggcttaaaaagattgcaaatttcaatactgttcctttaatttgaataagtttgcttgcatccatattgattagtgtctgtccaaaataatcaaacttttgattttgattttgatgtcggccatatgattttttcttatg

SEQ ID NO: 23188 - DNA, 3000 bp, Unknown; identical to SEQ ID NO: 4809
  misc_feature (1)..( 3000): 2750-1469P.txt file - cDNA_ID_2132864; gDNA_ID_1620733; Annot_ID_166147

SEQ ID NO: 23189 - DNA, 3000 bp, Unknown; identical to SEQ ID NO: 4809
  misc_feature (1)..( 3000): 2750-1469P.txt file - cDNA_ID_2132864; gDNA_ID_2926179; Annot_ID_200058

SEQ ID NO: 23190 - DNA, 3003 bp, Unknown
  misc_feature (1)..( 3003): 2750-1469P.txt file - cDNA_ID_2132868; gDNA_ID_2926179; Annot_ID_200059
attaggggtcaactttactaattgaaccatcaatacattttagtttaaaattgagtaaaactaaaaattctgatcgaggaactagaatttcaaaccgtatcataattatgctcgaagttacgaggctcccattagtaacgattttctaaagcttggtgagtggtgacgagtgatattttaaacccaaaagaaaagaaaaagccttcagttttttaatttcaagggtaaagtgatgaatgtgaggattttggttagttgagacgagtttgataaagtgctcatgcgtaagcagaatttaacttcagatccagcagccatcataggatcggatgaactagcgaaagaaaagcttcttagtgggccaagcaaaccaccagggacatgaattttttcctttcttttgcttgattataaattcgtttttaacataagagtgatagaggcattacaagttttaaaaggcttatctctttaaaagtttttcttctttaacttaacgtcttatatttaatgtccatttggatcctccctttttttttttttcttcttataacccacttgggaatattaactatttttaatggttttgtttttgtctcacatgtaaggtgagattacacgtccctcaacaatgtgtgtaaattggtgctacgaacactactgtgaacccccaaccggatgtttaactaacccaccctggaggacattgacctcaatctctataatgaagctagagctaaggttaagattgtatcacatttacgttacctgtcttcaacaaagaacctctagaaaacaatgtaaacaagtgtataaggttactggacctagcgctaaaaactgcttcgtcgattgttggtatgtatggcgaaatttgcatagtttatcggaacaagtagaatagcagcaggttatcttccacgacctaagggctctataaatgaagctttccatgtgacttcaaatgctatcttaagcacaagacgcattcgatgaccatggagaatatgttccacaacatgagagtttaagagaacatccaactggctttacaatagtatgatgcatccaaagccaaaagaatagagagatataaaaagcaagacaacccataattcgaatatttcggggtggtcttggacctcttggtgcatacccatgccaaaactctggttgacaccaggtgctttgagtcatttcttaaatcattttatttttctctgcaaactagtaacactattaactttaccagcctgagaaaaatctgccatgacgatacaaaaagtctggagactttattcaacgaccttattattaaccatcaaaagtaaacattagtctcacagaaaaaagacaaaaacacagtacgagagagagacagaagcatcacacaacacacctatattatcacgtctttttttctgtgatcatattattacagggtcggattctctggtgtgaacttgagagagatactgtttacacagtgtcgctcatcggtaggagtagggaaaccttctcctttaaaaacgtgaccaagatgtcctccacaagcagcacatgtgatctcgattcgtctcccatctggatcaggctgggtaaaaatgtaaaagctattagtttctcaaatcatataattcccagtgataatgatcttttgattgagaaatgttacggttcgggttatagctccggggagtccatcaaagaaagctggccagccacaaccagagtcgaatttggtggtggatttgtagagaggagttccacatcctgcacaacaatagatgccatcgtcgaatactttgttgtattctccagttcctggatatctacattacatatagtagaccgttagaataatgatatgttaacagatttacagagcttatgaccttgctttagctctacttcacactctaagatattcattgatcctttaaactcagagaagaagactctacttaaactgctttggcttctcggtggccattaaggtagactaagctaagacacaagactaactgagtattttcatgtcaccgagagaacaatcctaatagtaaggttcatagcaactgagacaaccatatacaacagcaagtcagcaacagagttttagtgtaagaagaaaaagtgataaactttgaaaaaatcactctaatctttcatagaatatatctcctaatcgttaatttaaggatcaggtaacaacatttattccacaaaactcaattttcaagttcaatgcatcaaatctctccaacaccaatcaccaagtaaacttgaaacccataaagcattctcttttataaatttatgatcatcaatttccaaatcaacacatgcaagaacactatctgaagcagaacactcaaaaccagatcaaaactgagtcacgaaatcacttactcagtgcctttctgtctgagaatcctaaattgttcaggagaaagaatcgcacgccactcttcttccggcttattgaccgattcaggagcagaagaacccattgccacaatacgaccaccgtggaaacctcgacggagcgacggaaatgacaaaggagatgatgagaaacgaaggaggttacgacgagacggagaggccaaaggaggtttaacgaaagcagctttaatggtggaaacgaaagtgagagacgtggctgaataaacacgaccaggtgttatgatattgaacgccatttgtttggctttttatctcctctcttccttcttctcttgacaacagctttttctgactctctctcaatcttttctcagatttttccttttctctggaacactcttctaatttgggccttacgtttgggccctttagcccaatatacatacactcgaaattgcattattctctgttcaagtttagctatgccatccttgtcggaatcattcgtgtacctggttcaaaccctaagggtggtttaatgaggccatgtgatgagcctctgacaaaagagaagttcgaagttaaagtcacatg

SEQ ID NO: 23191 - DNA, 3003 bp, Unknown
  misc_feature (1)..( 3003): 2750-1469P.txt file - cDNA_ID_2132902; gDNA_ID_1620733; Annot_ID_166167
tagtttccagatatactgatatagtgaagaatatgaactctgaagtagttgccatgtcttctagttcccttctttaaaagtagcaaccgctatatatagcaaagaaggttccaaggaccgtataaattccatgtgatatgagctagttgaaggatttaagcattataagaacaagatttgatcggataacacatttctctttagttatagatgtgacagctttatttcatctctttgtaaagttaatttagcaaccattttttttactttcagtagatttaaagccatcatttaatcaatagatactgtgtggattgtctgaggaggttagtaggttacacttccctcttaagagagatatgagacaaaaccacccaaacacacaaatctcaacattaaccaacaaaatcatacccaatttgagtaataactatgggcctgaaaggcccaatgaagcccatcacaaatatccagtgagccaatgttctggatgtaagttacatatcatgtaacagaaaccgattaaagacaaagtggggcttttcttttgtggtacaaggtttgtgtcttttgtggttaattcggatcccgtggctcacacgttatctcctcactcactctaaaggagagagatctgtgacatcgatggaaattccaggggaccaattgcttaggttaacgactaaagaagggaaattaaaacttgcaagaaaaagcggctcggacacaaacaactgatctctcaccgattttgcagtttgtcaggaccatgtactgagattctcgataactatgatctgaacagagttttatatgacgacgtaaagttaattaagaacacatgagagattcttgaaatgcatgagattatcttgttgccctgatagattcagagttacttgttgttacaaggtctacgaaaaagtgaataattgagactcttttaaaataatttcgtgcatacaatgaatcagtcaaattttcattatttttcgtaagaaactgtaattaattaggaagaagtgaagttgcacatatcgtggtatccactattactagatatatctttcgaaataaagatatatagcgattaacgcacacaaagtccataacatttgggatttggcaacctcatgtctcaaatatttgtattaaaatattaaggcatttgacagactacactcaatcataataactcaacactaagacaatcataatgactcaacactaagacaatgcttagttccacactgacttacttttaagttttaactacataaagtcttagaagttacaaccaactccacagtagtacactatacctgtgttataattaatgaacttggttagcttgttcgcttaaagagaccaaactataaaatcattttctttgtatctatattttttttttttcataggctctttttatatttcagttacccctaacacatactttcctcgtacccatagctatgaaatgtaccttcctatctttaacgagttacaaaaaaaaaaaaaaaaatcgtttccaaaacatctctccatctccaatttttatgattgaatcttttgtaaatatctaatttatatttaatccgcctatcttacaccatatcatctcttatcccaacatcttatgcactttgatcctctcattttcaactgatttttaaagatatcaatatcatactgcaaaagtcaccccttggtcatatatcgaacgattaattccattccgcttatagacatcgttcttgttccaacaattgttgtactttcagcatgttgaagaagctgtgtaggttttttaataattaaacaagataataattaagatctttttttctaagctggactgacaattttgaggctctttacaattattacaacaattaattctttacatttcagggtatgtatgtatttgtattttataaacttcgaggggtcaaataagaaaatctgaaaattagaggtcttgtataaatgttacagatcttaatgcatcgtgctttggaataacgtccctggacccttgcgacgagacccatgaaacgttggattggatatatagcctaacaaattacaaaatcgatttgattcttaccccaccacaaagtctcatgtatttatgtgtgtacggacactggattcagattttttttgcgtgataaatacatatttattactatacttattctcgcagaagatcaataattattcatatagcaatagaaaaagaaaaaccctataactacatattatatatatatatatatatatatcgttggttttcaaaaaaaaaaaaaaatttgatcaagcaagattcgtaatttcttatgaaggacaataatatcacaagccttttcgagtaaattaacattgtcctcttcaaactttaacaatatctataactatagccaaaaaagattagaaagtgtaatttgaaaatggcttaggcaaaagcataatttaagataaagcaagtcttttcatatagtacatagttttttgtcttctagcatgaatcagactctatcaataattttggcaggtcttagtagaaatagtaccaaaggctaccactcctctatctaacccttttaattattatttatttttcacaaaatttaattcatagttatggcaccccaaaaaaaagtacgaaattattacagttttggaggtttctgaaacctctgcctattgtggaggcttttgattcctttgaagcaatcaatgacctctctgtctctcatttgccagcaaagagagattgtttaatgttgtttatggttcacatttttatacaatatcacattttcactgaatcttcctctgcgtctctcaggtaatttaattctctcttttctctcccatcactctgtctcttctctttattgggttttagataaaatgatggaataataatttcatggattcaggaggaagaagatcattcagttgaagcacacatttaaagggttttgttgagaggcaatg

SEQ ID NO: 23192 - DNA, 3003 bp, Unknown
  misc_feature (1)..( 3003): 2750-1469P.txt file - cDNA_ID_2132959; gDNA_ID_1620694; Annot_ID_48636
tgaattattgtatacattctatcattattttcacctcttacgtatgatacaattctgacatacataaacatccaaaagtatcaaaacaatttgccaactagttcttactattcttctactcgcttttccgggagaaaaaaaaaataaaaaaaaattcgttgattaacatttttaataaaaaaaattgttcctgaattatgcctttattagttgggttaaaatataattatattgacatatctaattaaacctctttacactcaaatcaagacctacaatttcacaagtttaaggttgggattactcgatatatagaatgaaactattgcaacaaaaaaaaataaaaaaatgaatgaataggattgatggtgtgataaaagaagagatgaatacaaagaagaaacgaacacaagtattgtgaacaagtcaaagcctaactattgaacaactttagaagacaagccaccaaatgtacaaacaaatcctcccaataacaaactacaaaagagaaattaatcaattagaaatcataagacatatcgacacatgctaatggtattatctacttacacctcatcaaactcgtgcatgggctattgttatccacatatgtatacagtcatggttatgtcccctcaatctcttccagcttgagaactatttgtaaaccactagtcaattatttcatattcagttcatagatagcctataaacattacatattatatctctagagataacaaaggggagcaggaagtgttagtactgtcgaccttatgcgcccatataattcttccatagctttagattttagtgtttgggctattttaattgcacccgaataatgacaggtaggggtccatgcaaactcatattcatgtgcatatcatcataaaatatccaaaaatctatcttatctatataacttcattgaacaaaacatatatatattcatgcagacgtatggcatgatacagttaatggtctgaattgctcaacgtaaaccatacatgcactagacagtttcatgggaagactaagattttgggactgcaaaattcttcttggaattgtgtagcggctttcaacgtatctttaggttatattcggtgaaccctttatttaccggcacagaatattacggttgatattcaattgatcaaacaatgtgaattagacgtctaattattgatggtcgccatatgaatatcttcttcttccttttccaaaccaacaccaacatcttttaatcgatagaagtgtcaattcgagctcgactctcacatctaatgcgtcattataagattgaaaatcagagacttgaagttttcgtttaggaacttaaaatgaagtttataactattgcttaacgtttttgttgttcatcccaagaaataattgacgttttcaagttaggtttttccaacccaatttattttattatccaataatattataaattctctagtgaaatttcattccttagcttccacgcaaagggtcgcttgagttttgagtaacacaagattggagagatcaatgagaatgttggcattggatccaatcctactatttgggaccagcttcactcgattcatcgcgtcctatttttgtccgtttacacatcttcggatcattcaattcttgtttaatcatcttcattagtaataacgttgccactttatttttaagacggatttatcttctgcaactcccaaattcatattcgctaaatcttctctaaactcagcataatagttaacttgaaaaagaaaaaaacgaaaacgataactaagatggtgaccactcgcatggtttagtgatgaatttagttaaaccgtatgttaatttccttggttaggctcttcaaacagaaattcgaaaacgatatcaaatgctccatgataagtttatgatttcttagcattgtctaatctaagagactagtaagaacatgaaaacaatattcgttaaaccaagtggtaaaacaactatatacagtatgtgtttttcgattataatgttgttaacttttaagattattatattttatattatttcttaaaatatgttgaggtttaaaagatttcttttcagaaaaggattaatgtcttcagcaatatatgctagtaatttactaagtgatattttgcaagtttgttggcaatatttaaccttttctgaataaaataaattcaatattaagaaacaaaattatatacatatagtagtatttaattgttatctatttttaaattatatgtgaataaaacaaagcaagtgtaactgtgtaattataacattggtacacgcacgggaaaaaacacagctagcaaattgaaacgttaatttggtaaagaagaaaaatattttatttttaaaaacacttaatatagttttaattggtgattttcccaattctgaacatatatatgatgataagttttccatcccaagttgttttttctcattagtcactggaaacattaattaccagcaatcagtagttactttggtattccccacacaaattcaaatttaaaagaaataattagtagtacttcttatgactgttttttttactgaataaaaaagaactatatataggttgttcttaactataaccactaaaaaaaggttctaaaattaattttaaaaagaaaaatatatgaagttaacttttatatattacacatcaaattccaatttcaggggctggtaatttggtaataattaaagaaactcaatggcaatgatttaagcacttctttatataagtccaccaaactacactgatctcctcaacaccacacacagcaaaacaaaaagctctctacactcaaaatataacgaaagaacaagaagacatcatcttagctcactatggctttgaagacggtaacaatatacaaactttctctattttttccacttttgatttaatgaatctaaaagaaaatattttggatgattggtatataggcgacgagtggtatgtggatg

SEQ ID NO: 23193 - DNA, 3003 bp, Unknown
  misc_feature (1)..( 3003): 2750-1469P.txt file - cDNA_ID_2132959; gDNA_ID_1620694; Annot_ID_164869
gtgtttaaagctgggcctggaagcatctgtagcttttcacttgaggtttttctagactttatttatatgatttttagttcactctacttcagttatgtagatatatttattatgagttgaattattgtatacattctatcattattttcacctcttacgtatgatacaattctgacatacataaacatccaaaagtatcaaaacaatttgccaactagttcttactattcttctactcgcttttccgggagaaaaaaaaaataaaaaaaaattcgttgattaacatttttaataaaaaaaattgttcctgaattatgcctttattagttgggttaaaatataattatattgacatatctaattaaacctctttacactcaaatcaagacctacaatttcacaagtttaaggttgggattactcgatatatagaatgaaactattgcaacaaaaaaaaataaaaaaatgaatgaataggattgatggtgtgataaaagaagagatgaatacaaagaagaaacgaacacaagtattgtgaacaagtcaaagcctaactattgaacaactttagaagacaagccaccaaatgtacaaacaaatcctcccaataacaaactacaaaagagaaattaatcaattagaaatcataagacatatcgacacatgctaatggtattatctacttacacctcatcaaactcgtgcatgggctattgttatccacatatgtatacagtcatggttatgtcccctcaatctcttccagcttgagaactatttgtaaaccactagtcaattatttcatattcagttcatagatagcctataaacattacatattatatctctagagataacaaaggggagcaggaagtgttagtactgtcgaccttatgcgcccatataattcttccatagctttagattttagtgtttgggctattttaattgcacccgaataatgacaggtaggggtccatgcaaactcatattcatgtgcatatcatcataaaatatccaaaaatctatcttatctatataacttcattgaacaaaacatatatatattcatgcagacgtatggcatgatacagttaatggtctgaattgctcaacgtaaaccatacatgcactagacagtttcatgggaagactaagattttgggactgcaaaattcttcttggaattgtgtagcggctttcaacgtatctttaggttatattcggtgaaccctttatttaccggcacagaatattacggttgatattcaattgatcaaacaatgtgaattagacgtctaattattgatggtcgccatatgaatatcttcttcttccttttccaaaccaacaccaacatcttttaatcgatagaagtgtcaattcgagctcgactctcacatctaatgcgtcattataagattgaaaatcagagacttgaagttttcgtttaggaacttaaaatgaagtttataactattgcttaacgtttttgttgttcatcccaagaaataattgacgttttcaagttaggtttttccaacccaatttattttattatccaataatattataaattctctagtgaaatttcattccttagcttccacgcaaagggtcgcttgagttttgagtaacacaagattggagagatcaatgagaatgttggcattggatccaatcctactatttgggaccagcttcactcgattcatcgcgtcctatttttgtccgtttacacatcttcggatcattcaattcttgtttaatcatcttcattagtaataacgttgccactttatttttaagacggatttatcttctgcaactcccaaattcatattcgctaaatcttctctaaactcagcataatagttaacttgaaaaagaaaaaaacgaaaacgataactaagatggtgaccactcgcatggtttagtgatgaatttagttaaaccgtatgttaatttccttggttaggctcttcaaacagaaattcgaaaacgatatcaaatgctccatgataagtttatgatttcttagcattgtctaatctaagagactagtaagaacatgaaaacaatattcgttaaaccaagtggtaaaacaactatatacagtatgtgtttttcgattataatgttgttaacttttaagattattatattttatattatttcttaaaatatgttgaggtttaaaagatttcttttcagaaaaggattaatgtcttcagcaatatatgctagtaatttactaagtgatattttgcaagtttgttggcaatatttaaccttttctgaataaaataaattcaatattaagaaacaaaattatatacatatagtagtatttaattgttatctatttttaaattatatgtgaataaaacaaagcaagtgtaactgtgtaattataacattggtacacgcacgggaaaaaacacagctagcaaattgaaacgttaatttggtaaagaagaaaaatattttatttttaaaaacacttaatatagttttaattggtgattttcccaattctgaacatatatatgatgataagttttccatcccaagttgttttttctcattagtcactggaaacattaattaccagcaatcagtagttactttggtattccccacacaaattcaaatttaaaagaaataattagtagtacttcttatgactgttttttttactgaataaaaaagaactatatataggttgttcttaactataaccactaaaaaaaggttctaaaattaattttaaaaagaaaaatatatgaagttaacttttatatattacacatcaaattccaatttcaggggctggtaatttggtaataattaaagaaactcaatggcaatgatttaagcacttctttatataagtccaccaaactacactgatctcctcaacaccacacacagcaaaacaaaaagctctctacactcaaaatataacgaaagaacaagaagacatcatcttagctcactatg

SEQ ID NO: 23194 - DNA, 3003 bp, Unknown; identical to SEQ ID NO: 23193
  misc_feature (1)..( 3003): 2750-1469P.txt file - cDNA_ID_2132959; gDNA_ID_1620624; Annot_ID_162453

SEQ ID NO: 23195 - DNA, 3003 bp, Unknown; identical to SEQ ID NO: 23192
  misc_feature (1)..( 3003): 2750-1469P.txt file - cDNA_ID_2132959; gDNA_ID_2926208; Annot_ID_141846

SEQ ID NO: 23196 - DNA, 3003 bp, Unknown; identical to SEQ ID NO: 23193
  misc_feature (1)..( 3003): 2750-1469P.txt file - cDNA_ID_2132959; gDNA_ID_2926208; Annot_ID_202400

SEQ ID NO: 23197 - DNA, 3003 bp, Unknown
  misc_feature (1)..( 3003): 2750-1469P.txt file - cDNA_ID_2132963; gDNA_ID_1620694; Annot_ID_164876
cccgaattccagcacagaattacacttaaaccttgcgatgcttgaggtggaagacgatgaaactgcatcaatcagcagcatggagagaagtaacaacagccttttttcttctacttgttcatctagggagcttcaaacataaggaattatgcttttagctaatagagaggttaggtacttaggttagaggtttgtttcttagtgtatggagtttacttgataactttatgttagacctgagctccctgctgttatctggaccagaaaattcattcccaagacgaatcattctcaatatcaactatgcctatctttattaggcatttcctcaaagtgccatatcttatgttttcgtttttctgaattaatcaaaatcgaaaaattctctaaaaacctactttagatctagggaatgttactaagttttcggatgaaatactaactttttaaggaagcactcacaaacttgaagtaactacatatatgtttaatttcatcgaagtgcgtaattttgtttaactcttatcgaagcaaatttatgtaagaagtctggttagaataaattgatggcttgagacatgccacattatttttcgtatatatatttgtccgtatgtattcgggttgcttgagatctttaaaatctgactatttcttttttttgttaaacggttttcttaaataaatgaaagaaaagtttacaaagaaaaaatacgaaactgttacaaccagaaagataagaaagaggactagcagactatttcatggtgtatataatcattttttattttgtcaaacataatcatatatattatatatataacatgagggattatattattgcttggacgactttcgtaacatataatagtaactatatatattattcattattacatgtatacgtcaatgggttatgctaatttatttggcgtttacgggtcggcataatttttttttttgttctaatggtaatgttggctctaatgttctgagtattgtttaatttgttatcaattaaaatattttatattttaagctaaataggagtacaggactatagaaggcgaatggtctacaaatgtgaaattgacacgttaactaagacctaattcgatttgagcatcttggtattttctttaatattcgtagacctccgcaatgcctgaaattagagcatcttactgtcgcctaacatttatgcgtcttctatattagtgttcatatgttcaagaggagatctacgttgtacgagttgtttttttgtaatggttaaaatgagtatatcttcacacatctacaaatctagagcttaaacaggcttaaaatcagatctcaataaatcatcatgtatccaaagccaaaggtaagctgatttcaaaggtgtcggaggaagaaccaaaaacatagagaatatcgaatacataaataaatgaattaagtacccccacttgccacaagaatataaatttgcatcaaactttctcttattttacaaaccctaaaagagctacatctttcgcgatcactaatgtttacatcaatcaactatttaagtaatagaagctttccaaaaagaaaaataacaagttgaagatagtcgatagtgattatgattaagtctcactttttttaatacaaaagataaagtaggtctggtgataaacaatccatttgatttttaaatcacaaaagatatatttgtttttttataacaacggaacctacttgtgttataaatatatgaattacaacaatacatattgggaattttacaacacttggatataatcttactaacaaaagctatattcaagttcttcttgtgaatctttgttatttggtttttgaaaaacattatagattataatagaattttatgcgctacatgataaaaaattgtcaacgggtatatgagtaaacacatatcacatatatatatgatatgaacgtcgaagctgtctttctactttttgtggtcttcaacattttcgggtcgatgtctcaaatgttgtttgttttttactaaacaaaagaaaaagaaatcatagaacttattagtaaggactataactttttaaaagattttggttgtagaaattaggctgatatttattttgtaaaaactataagattttgaatttttgactttgacatgaatattagtagggtattacgtaaaatttgcaagaaatgagaattcaaaaagagccaacaaaaccaagtcctgaaaatggacatgactaattaaagaaagaaaatgaaaaaacaaataaacttccttactatagaaattattgtttctttttaagtcaatggtttgtttttttttggtttttttttcatgttacttgtttgtacatccatattagtcttctattatcatcatgataatacaaagttttgactctaccaaattataaaaatcataaaagacgaggagctccaatcacgttcaagtaatagtatagatatatggaaaggaaataattaaaagaccctaattaaaatttagttcaagacctactttaaagccttttacaaaaaaagaaaagaattctctaagtcgaaatcgttatcgtagtacgttcatgtcttttctccggccaccgaaacgatgccatctgtttagtgcgcctttataattcaacgaccctttgtacttttccgattcctctttctctataacttcatctctcccattctcttcactcttctcaaaaattcgatctttagggtttttcttttatcctcttatcgctaatctggagctctatagagactataaaggtatgtttttttttcctcaattacaggctcggatgctcaaattttgtaaaaaatgactattttctattgctgaattgctcgaattgttgtgaatttagggtttttgattgattcgggagctcgagatttgacttcttttagctgattcggcaagtttgtatctagaaaggatcgattggtgaggtcaatagtggttggtgggttttagtaatg

SEQ ID NO: 23198 - DNA, 3003 bp, Unknown; identical to SEQ ID NO: 23197
  misc_feature (1)..( 3003): 2750-1469P.txt file - cDNA_ID_2132963; gDNA_ID_1620699; Annot_ID_164995

SEQ ID NO: 23199 - DNA, 3003 bp, Unknown; identical to SEQ ID NO: 23197
  misc_feature (1)..( 3003): 2750-1469P.txt file - cDNA_ID_2132963; gDNA_ID_2926208; Annot_ID_202407

SEQ ID NO: 23200 - DNA, 3000 bp, Unknown
  misc_feature (1)..( 3000): 2750-1469P.txt file - cDNA_ID_2133014; gDNA_ID_1620377; Annot_ID_155183
aaaaaaccaaagaagaagatatgcttcaaaggacgtgtctaacgatacgtatgaggacacgtgttatcccaccaacctccatcgcacaaagagctcaactccggtcaattgatcatcgccggaaaacttatcctaacaatgaaattttgtttttgctcaccgggtaaaaaaggacaaacatcaattaaccaattttaactagttgctataaattccagcaaacttgggtaaagataaattgattaaattgaagagtccataactgatggtctaccatattgaaactctaaaaaccatagaaccagcgacgaaaaggcaattaacatcagcataggaaaagaagctataatcaccaaacaaaggcataatcgaaaccatgaaccgtcttgagtttaagacaaagatgaagcggcagatccaacagagcaaactataggagaaaccgcacaggaaacaaaaacagtaaacatgaagaagcaaacggcaaagaagccgatacgaagccggccatcgctgctttgaaagccatcaataccggacgagagctggccaacatcactaaaggagtgaggagctgccagatgataagcccgcatactcgggacatgtaaaccggaaaaacctccggacggcaagaagttttatcaaccttctctctctaaaagatttttcggagagaagagagagaagttttttgttgctgctttttatcacacaagtgttaactatctataatgtaaagtgagacttgatgatcaagacattgatgacatggcaagagaagaactaactatggttaaagcaaaccatggttgagttagttccttggaccacttgacgctaacggcctcctgcaaactcagaaaaacaaatttgtttgtcttggaggcaaaaggaaggttgattgtcatgttgtgacagctcaaacttggaggagcgtctggggtcatctagaagagcctaaggagtgacagctcagcgattagggttttttttggcataagggtttagagtctccactataaagaggaactctaggcaaagagagaggggtggtgcgagttatactaaggtgtgagagaagagagaaactttgttagcataagcttaagagcattgtattctcttattcaagatacattacagagtgaacctaagtgctagtgaagggcattaggtgttcacttgcgtgttcttgtttgtaaacaccaaagtgatctatgtggatgtcggattcggcccacttcggcgcaatccgcattcaataggcttcaagacgagttaggcccaattcacagcccagcatgggccaggccgcttaacaggtgatccgacattaataaagaaacggaaggatcacgacttaaactgcgcattaaatcccgagttagagattcgtaacgtacgacgtaaataaggcgagatctgcggcgtgaaatcaacaaacagtttaatacgttcgattcgatgtattgagtataaatatgagttgatgacatttgtaaaagtgacaatataaaaaaaacacgaagactatacacaaatttcagaagcacattcttctcttttcaattcgatcattgctcgtctaacaagaccaaaagatccccgttaaaacaaccacaagattctaattgcggattctgacatccacaatctagtggattccgagcacagtctcggcccagacgtagcctttaataggtgaactgggttactaaagtcttgtgttctgtctctcttttacacacacaatctctctctgttctgtctctctctgtttctctattctgtttcttgtgttttgtggtttgaacaaaggaaagtcgacgccttgtgttcagtaaacttaacatataagcaaagccaaaaataaaaactttcttaggttgtacttggaagatgaaatgtaacatgattcgaaggcatctcactgatcataaaccaccaaatccacatctgcttatttactggtgtgatgtaccgacgcattattattgttgctactaattagtgtcaaaataattaggcacatcctttatattccatcactatgcattccaatgaataatgttggttatctgcaggggatttgccaaatccatttaactgtccacgtcatcatttaaagaaataataatactaatcaaatagacccacgtgtttagtttagttatagaatttagagcaaaacgagttttgatttaaaaagcataaccttatcctccacatcattaacataataataacattatttattagggataaaaaatctcccggtaaagaaagaaaagagccattgacgtctcctctctcgctctccatcattcttcttctacttttgtgctctgcttcactttttcttctttccttttttctctctctcaacgaccaccaccatgcccggagttgccttctcctgtgttcctgcctccgatctgggaatcttcatctccgaatccaccaccttctcacgctccatctccgcctccctctcatcttcctccagttcaccctcctcctttcgctgttgcaccccattgaacctcaaatcgctgcgttctcatcgccgtcctaagatttctcatatttgttgcgacggaagctctatttccggatctggcctcggcgatcccgatctcgagtttctccaagcctctgtcctcgttgcaggtccaccttttcccatttccaaataaatgtgactattctcttatttattcaaatttccggtgacgtttactcgtaccctgtgacgtctgttgcttttgcccaactctgattgcgatttccctccttttttagggttacctttatggagtttgtttgtgattccattttattattgttgccacaaacctagatagatcccttttaatcacctcaacttaattcaatttgtgctgattaaaagggattgtagcattagcccattcaattttatttcattgctcaacttgtgctccttttttcttaacaacaataacagagacaagtatg

SEQ ID NO: 23201 - DNA, 3003 bp, Unknown
  misc_feature (1)..( 3003): 2750-1469P.txt file - cDNA_ID_2133032; gDNA_ID_1620377; Annot_ID_155191
aatgttcagttccaatggttccctagctaaataaaattcagtggtgagtagtaacaacaagtagttactcttgagatggtgaaagagatgatcgttgacaaaacgggaggtctcagggcctccgtggccgtcatagacgccaacaaaggttccatagggaccagaagaagagagggtggtcaaaggaccggattcgacctggctctgatcctcgaggaggttgttggcctggacaacggccatggagaaatcaccaaaaaggtggtgagcagagtctttgtaccagagaaggccgtcttgtttgcctttggaatcagaataagtgtgggaagtggtggaagaagagggccagagacaagaggtcaaaaagttgaagaaaagggataacatcgggcctcatctcatatcatccccaaccaccgattgttatgctaaaatgaatgaatgaagtatgttgaaaaaacaaaagaagagagagtcggaaacttccattcattcactcacacaaagaggagttttgtttagtaaaaaaagcaacagctggatggagatctcaaggagatatagagaaactattaagttgtaagtaacatgtgtggagagagatagagtgaaagaaaaaaagaaaagactctctctgtttttgatttcagatatttattaggaacagaacagaggaagcccttttccttgtatatgagaacagaggaaaagaagagagacaatttatggatcacaagatttccagagcctctctctctctctctcaaataactcttcttctatatttgaccatcaaagaaaggacaagaagacacacatacgtgtgcacgtgcactccttaactcctcccatgtgggatttacaaacatacaatagctgttctcattattattatttccttcttgccttgcaccaccattgttaactctattcaattcaaagtttcaaaccctttgaccaatgcatccccttattgggctttgattatatgggccctttctatttgatatttttcaatatatggcccgttaataaatttaatatatagcttcggccttataagaagaattcaagcccctcaccgatactctagtccaagccgtgggcagaaccaaaataagagaacaaaaaaaaagtttgttttctggaatcgtcgcgatagttgctgaactccgtcgcaacttcaatggcatctgctcactccatagccgccgtttctgttctcgatgcggcctccaagcaagcaacacttccttcttcttcttcttcttcctctgcgctctaccctctttcttctcttcgatctaaacctcgccagcagcttctctccctacgcagtgtcgctctcaaaggtatcttctcttctttttctctgtttatttggaatacgagttgcttctcctaaacgtaatagtccaattctacctttgttgggtacagtcgcatttccagtttgaattttaatatagtttgggacaacgaagaggggagtgattcaaattagcacaatcgtaatgagtagttgttgatatggttagtttgttgatgagccaacaatgattagtttgtggttagcttaggtcgagtaaaggcgcaggcaaaagaagcagaagctagtccaagtccagtgggagtgggagacgcattcagtaatgtgaagcatcttctcctgccggtgattgatcggaatccttatctttctgaaggcaccagacaggttattgtttagcttgttatctttttgagaacatgttgacaccaaacaaaaaagctgattacacttaatttgataggctgctgctacaacaaccagcttggcaaagaagtatggagctgatatcacagttgtaggtaagaacaattagtgttgcattaatatccccttatgtatcatatgaattatatagccgtgttgatcatctgtgaccaccgttgttgattcagtcattgacgaagaaaagagagaatcatcttcggagcatgagactcaagtatccaacatccggtggcatttgtctgaaggtaaaattgaggaattacttgtaggaaattgtaggtaaactatagtgttggaatcccttattgaagaaaggttaactataatgtggtggttgcaggtgggttcgaggagttcaagctgttggagaggcttggggaagggaaaaaagcgacggccataataggagaggtggcagatgagctgaagatggagctggtggtgatgagcatggaagccatccactctaagtacattgacgccaatctactcgctgagttcatcccctgccccgtcctcctcttgcccttgtgatcgctcccgccaaatgcttatatgatagacataccacttgttttatttttctctgtgtttggttgccgtagaagagcattactaggagaggggatggaaatgtgtcaaggtgtgagatgcatgtgtcaagcatttcctgtcttatcatggttgttgttgttgtgtcctttgttttctccgttactcacatactaacgtgttcggccacaaattaaaaaaaaaaaaaaaaaaaaaaaaaaaaaaaaaaaaaaaactcaattagaagagaaaatctttttaatcttatcccctaatgaattacttggtacatgtagaatagaatcaaattactacaggaggcttaataaacacaacttataaatttgataggcacgtcaaaagttaaaacagggatttgttaacctcagtaattagctacgagggttagttaattaaccaatcaggtgaaatcacacggattggtagcgagaggggtatttaagtaactgtacaaggagcgttggtgtttgtttgtttgcaaagggcaggaggcacacaagtcttccaaacggaggagccaccggcgttgttagctttctctttggctgattccttcttcttcttctctaattcttttccttggtttcagagtataataatccccagcttctttgatcctctctctctctctcttcctctgttacatgatg

SEQ ID NO: 23202 - DNA, 3003 bp, Unknown
  misc_feature (1)..( 3003): 2750-1469P.txt file - cDNA_ID_2133061; gDNA_ID_1620377; Annot_ID_155197
tttgtgcagccaccttttggtgctttgttcattaggcatgccagcgcagaattcaccacagcttctgcctacggaataattagatgattactgatataagaaaaaagacaaaaaagaaaagagttttcatatatagtatcttacctcagaagcaccaagagcaaggcgtttcatgtaatcatttgttacatgctgcttggcagttccagtgacagcatcatggtgctgcgctatccctaaagcatccccaagactgtaagtgtttggacctccagagttcttgcccaccagaaattcaagttgccttgcagcctgttttggaaaaaaaacagacaaatgcaaggccatgtaaattcattttgaatttcactaagaaaatgggaaatcggactccgtaagatgcagtttgataccatgtagtatccgctaagagcccgaacatatcgtttaagagcaggacggctggtgaagtagccagtccagtaagcgtatgcccgatccgcatatctgcagagagtagggggaaattattgactattgagaaaatcaagttgttgaacaaaaggaatatgtaaatttatttggtgacagtactaaaggcactcacgggaaaaagtcatgagtcttgagaggccaagtaacattggcaacattcttggcatcaacatagagagatggtgtggagtacaaggcgttcacacggccatcctgttgaatggaattattggtgatgagaatctagtctccaaagacagcgagattgatattgagcaatcacagcaagcaagagatatgaaaaccttgttaacataatggataagtctgtccatctgtctgaaccaagactcggcgaactggtactgaaaatcatcgcccattgtccacatcacatggttccctcgactcacattagcctatgtccacattgactactttcagaattaatccaagattacacacacacttgaaaaaaaaaaaaatactactcaagacttacataaacaagagaagcattgacgaaatcattaaccgcctccttaatgttatagccatcgaaacgagggttgtcctgcaaaatgacgagtgaaccgaattcccctaaaccaaaaaccaaacgggagaaagaagaagcgaacctggaggggtacgtaatcgtcggtgacttcatagtgaaagccagtgggagggccgtaatgaacaaagaagatattggtgaatatctgagaagaagaatccagtgtttttgatcctctccagatgacttcaagtgatttctcggcctttcgcttttctctgtcttggtaatcgattctcgcgaaatgcacagaatccaaccctaactgcacccccaccaaattaaaacacactcataaggaaataaagaaataaatagattagaagggacctctgctccaaggaggtaagcttgaacagaggaatgaccaaagggatcgatttgccaagcagcacgtggagttgtgttgaactgttgctttataaaccgatgcccctttgtggtttggtctatcatatctatgtaatggcacgttgcttcatcattcatagcccatcctccatttctgcacattgattgtgtgaattgtatcaacgctaggtagccaaaatgataaaattaaggtcgtgacctacttacacaaactctagttgcccggatttcactagtctcctcacttgctcttgtctctcggggctttgttcttcccaccaacgcgtaaagaaggcctttttcatgtacattgatgttcacataagagaagaaaacatatattatggttttatgaacaaaaccattattaatgttttaccatttccgcaaacacaaactttctattgggatcacgaagtagagaatccaccaccgagtctaggacgttcctcacgcaagcgttctgaaactcacaattcatttgggatatatagtacgttagactcgtctctacatacatacatatatatgattcatcattcatctgtagataacatacctggattctgttgttagatcctacgtagtactgatcaacagttttcaaccagccgacatcgtcatgcgaatgcggaacaagatgaacatttagtttccccggaaccactttagcttcggttccatacttcacgtatcccccgcctttgacgctctcaaccaacgacaacagaagaagaaaaacaataacacaaagtgatcctttcaataaagacatacccggtttctccattttccgatggcagagttttcagatgtttttctttcttacagggtgtggaggaaacttataacaagaaaatggagagagagcaaaacaagggtcataacaaaagaccaaatccttatcgtttgtttttgctcagatccgtcggtctttgttagagtctctctattgttttactgtgactagattgtcatttcaccatatgtaataattaattaggttctacaataatcttattttcctacaaatttaattaaaatcttgaccctaaaatagtactttattaaatctttttttcttctactttgatgtcaacattaaaattgaagttgatctgttttgagttttgacaatagtcatttaccttttctttaattttatttaacaaatagttttgggaaaaaatctccctttctttgataatacacaaatcaatcaatatagagataattaaaccacgtctttacagagaatagaagcaaatctttgagctagtaacattttagtataaaaatctcaacaacaagtcatttacatcattgcaactgttttgttctcttcatttgacttgggggttgtttgcttgcaaaggaggctttgtttgtacgtcgtcgtttttattccgtatataaaatataaattaacgaactaatctttaaagcctctgagacgagtagaaggttctctctggtgaagaaaccaatgcatttcggcgacagcctgaaactgaaaagccatcgatcgaccgagaaagcgaaaagagagagagatg

SEQ ID NO: 23203 - DNA, 3003 bp, Unknown
  misc_feature (1)..( 3003): 2750-1469P.txt file - cDNA_ID_2133067; gDNA_ID_1620377; Annot_ID_155199
tctctctccttcttatagtcactttcctgttgattgccttctttgcacccagacactggacccaatggcgagggaggcacaccaggaccatcaggttagatgcaaagctcgtccacacactcccctgcttcaccttcactgattctgctcaccacaaggccggggaaacatgtgctatatgtctcgaggattacagatttggagaaagcctcagacttctcccctgccaacatggtacttactcctattcttctgtggaaataaactggcaacttgccacccttaatgtgttcattgaggtcttggaaatgtatatttatgagacacagatcttcccttcacaggattgaaacatgtgcttactattctaggaagactttgataggtttctcttagattctaactttataaaatagatttctttctagcataaattcctctgttttagggttgaaggtacaatatattccgtttctgtcaattccagtttgataggtaagcaccgaatgcgaactttttggtattactcattgcttcgaatgatatgatgggtcgaatatgtacatcagaagaataaattaaagatttgaccttttttagtttatgtaagtgggggtaattcatagcagttggttgatttgaagctcttatgcagcttttcacttgaattgcatcgactcttggttgacaaaatggggtacatcttgccctgtgtgcaagcatgacataagaaccgagactatgtcttctgaggtgatcctgttagactgaaatgtataaatcctttcagtagttattttgttgtttttgcgttgggttcaatacactgtttgtgttgttttgttgcaggtacataaacgagagagtccgagaacagatacaagtacgagtagatttgcctttgcccaatccagtcaaagccgttagagttattatcggcttagcagctgaacactcatatcagtgctcggttacctggatcaggtccaggtttgcatcttatattgaatggttaatcatggtgggataagtttaggtaaagggaccggatctgccatactggtcgtgctttgctggattcccagatcaaaaagatatgagttgctttgcctctttttctttgcatgtgtacatttacatacgctctgagtcatgtgtacatttgatcattgtgtgtgtgtgtgtgttatagattgaaaaaatgtgtgtgatagtacagatatgcaaacaaattgatagaaaacaaatgttggtctaatcagattttctctctccgatccaggcaaatctctaatgttatcttgttgataatttctttgcctaaagtttgtataatatgaatattgaatctgattcccttacatgggggaatggaatccattgaacgtggctttgattttgtcttgtctgtagtaataataagaaaagaacacgtcatcctcatctctacctaacgactcatccaatacgatgactcgttcatgggtttgttagttgcgcaattccatcaccaaaactttctattacatactcaacttcttttgattactaaattcagccaacatttccttctcatctctaatcagtgaacacgttttctatgcaggctttggggcctatcttaccatagctgtctaagaagactattatcttatattctttattgtagatttcatttacttgcgtatggaattggaaacaaatttctaattgttgaatcatataccattatttttatattggccatgcatgtgtataagtggaagatagaacaatattaaaacaatattattgtgtttggtcctatttattactctctgctctcttcctgaagcttcttcatctttttgtttgacaagaagaggtagagaagaagatgtctcaatcaatctcctccagcacaaaggcagaagaagttgttagtgtagatgtgagccaagccaagactctcctccagtctgggcatcaatatcttgacgttaggtgagcttctgatctattctatcatatcaccatgcatgtaccagctgctgcggttgttaatgaaaaatccttgcacatggcaggactcaggacgagtttaggagaggccattgtgaggcagctaagatcgtcaacattccctacatgctcaacacacctcaaggtaaatcaaatatcaatcacctttaattagagatatcaaccagtacatgagttaaagccttgtgatctctactcttaggtagagtgaagaatcaagagttcttggagcaagtatcttctcttctaaacccagctgatgatatccttgtggtaactcttttcttcctcatcacacccacaagaattaaaatctgccggtgaaaacgatgataaaatctggaaaatgatattgatacaaacagggttgtcagagtggagccagatccttaaaagccacaactgaacttgttgctgcagtaagtgtataatagtccctagtttacatacataatttactcctacttgtgtgtttaatctcaaagaatcaattcatatatacataaaaaaatagggttacaagaaagtgagaaacgtgggaggtggctacttggcttgggtggatcacagctttcccatcaacacggaggaggaggagccatctgctaattaataatcttaagattctcttcttttcttaatcaaataatataactgcctgtgtgatgtagtaatcattttcaatttaaaattccagtttcttgtaatcaaaactttcgtgtaccaaattcaataaaagctgtgtttctctataagtgaaaaccaaaaaaaaaaagatgaacaagtaaaagtgtaaaaactaagtaacaagcctttgtttgtttcatcggtcaaaacgtttgggctttttgagtatacatacaaaaaggctttgggcttcagcctaagcccttatcttctctgttctcgcccggcgattctccgacttaattaattttccgaccgaacacttctctctctctctctctcgggtttctcatg

SEQ ID NO: 23204 - DNA, 3000 bp, Unknown; identical to SEQ ID NO: 1270
  misc_feature (1)..( 3000): 2750-1469P.txt file - cDNA_ID_2133115; gDNA_ID_1620378; Annot_ID_155232

SEQ ID NO: 23205 - DNA, 3003 bp, Unknown
  misc_feature (1)..( 3003): 2750-1469P.txt file - cDNA_ID_2133226; gDNA_ID_1620380; Annot_ID_155300
atttttccataagaatagaaaaaataattttggagggagtgatagtctgatagtattagataatttataatttatttaattaattttggataaacaaaatatatatatatatatacaagttaattttttgaataggaaaaaaaaaaacattgctgttaaaaattaatcaacgaagataacaattgaattgaaatatgctaatgctgattattgacttcatatttatatttaccttttctaaattctacagaaaaagaagtaaataaataatataatactaccacactaaaagataacgactagtttgatggaaatgtgagctgtctcactccttcacgcatcgttaagagcgtttaaacgtttataactgcgcacagtcattttgtataacacgtgtccggttaaaagtctacgtggcgtttaagtgacagcgacatctcatagaccattggtccgacgtggcattacgttgcgaatgggcctgaatagaataaaattatgcccaataaaaagtctctcgacctaactcttaaaagcccaataatttgatcaattcttatataagggcctgactggtttaaatacagcgggtgcggttacggttgcgcaagtttgcggaaacggccggttgcggttttaagcgttatcaagccttttaaacgactggttaagcgtttgataatgggtgcgttttcgggagttttatgaccggtaaaccagcaagtgtgatagtaattaaataaaaaaccaaaataaatataatatattactattaaaagaaagaaaaatacaatatattattatgataaattgataatattagaaaaattaaacatgcttaataattaaaaccataaataaaacattaaatttaaaataaataaattttgtaagaaaaagtttaatactttatgcatttggtacataccaaaaattgcatcaagtagtgtgataaactataaataacgttgaactcgcgggttttccggattgcctctatacatatgataaagtttcttcaagatatccaaacgatttttaacacatctccaactcaaatttttcccaaactggtcgttaatattcttaagaatattttctttttgaacatcacttagaaatctgattttgggatctttggaatcttccgttaaatattgattaggttttttttaataagaataagatatatagggtttgggtagaagacataattattttaattaattaaaaaaaaaaaataacctaactgctaccgcccgcaaccgcaaatgcttgcgggaatgagcttttgaaatctggcgattttgaacggtgtaaagcagtatctagcggtttctatgattgatgtcaatcgctaacaatcgctagcacccgcaaatacagcgtttgcgagtgacaaagggaaaaccaattaaaccctaagtaattgtctttgtctttgatattcctttcttctgacccaattaagacaaaaccctctacacacttttctctttcgaagacaaagatgaactgcattaataattcaacgagcccaaacaggcccaatggcccaatacggtccatcgactaaatatatcagaccctagttcccaagaaatgtccccgaggaagaagatgatgatgcgaaacatgaatgctcaggtaaaacatgaccagtaccgtgcaacaactttccccataatttgcttgtcgtgttgtgtagatgtcaagtgttttgctaaatctaagaaaacttgcagtgtgatacagagacatataatcaaatatgtagtcagcggtgttaaaaacagaatctgtcaaaccgtcttcttcaaatccacggaatgagaagcttgattaatgagatgctcccaaccatacccaaatattaatcagacattcattattgtctctagaggttaatgtctttgagtgtttttaggtgttcctagaacacaatttatgggaagatccagctgcatctccatctcctaatttggagtgaaagagcctagtctttcacaccaattttgagtttcaaatatatgtgcataaatgaatgaagatgcaaggtttggatttcgtttttatgactcttgtctaatcttacgtttgaggtaggtgagcaaagatgctatcacagcaaaaaatgctaaattactagattcaaattacgaatctaccctctgcatagctccgagagtgatgtgattccccttgaaagcatcaaagggttagtaaccttttctagagagtgccctttcgtcgtcagaaaaacgtaagcaaaaatgctacaaattaaaaagtgtctccaacatgtgcatattcacacacaagttggtgtcaacgctcagacaagaaaggcgtgtgttcattgttgaatcttcccatttcctcatccaaattccgacataactatcctagccgccatttgttctccacattacaaaaccctcagcagcttcaaaactcttccgatctctccctcacgctcgcaattctctcgtctccattttaatagtttttcttctcggaatcacaaatcttcggcttcttgttccttggtgagtttataatctatcttttgctctgcttcgatacttcaaagtctgttccttttgtctctctgagttcggtttttagttgtgttttatttcgacttctgttttagcgctttttctgaatctgatattgaactctttatcagaattaaggacccagatcatagttaggctcttcaattatatctgggttttgtgccaattgaagaaatcagtgaataatttttgtcaaattaaaatctgggtttggtcctacttgttgctccttgatgaatccttctcttgtagtaatcatatgatttactaactatagtttctgagtttaatatatgttacgatgatgttgatgatgttgctgttatgatgatgtggatgatttgatggtgttgatgttattaatgatgaggctaatgatggatacgaatcttgtacaggcgtgtgtgtgtgttgttgaatg

SEQ ID NO: 23206 - DNA, 3003 bp, Unknown
  misc_feature (1)..( 3003): 2750-1469P.txt file - cDNA_ID_2133240; gDNA_ID_1620380; Annot_ID_155305
cagtcctcttttcgatttatgctgtaggatttgtaagcataggttcatctaacctagttaggtagctttattttgtgtgtgtatatgagacatgagtaaatacatggaaattctgctctagggaacatctcattgtgtctcttctctggtttcttcttccttttctgcttcctactgttgtttttttactagataactctatatgttcttattccatcctttgagatgctcctctgtaaaacatctcttttatcttctgagcttcccatgtgcctaatttgttttctgaggatgttatgttcgtttacagtatgcaaagtttgtgaagccggcatttgatgacttcgtgctcccttcaaagaaatatgctgacgtgatcattcctcgaggaggtgataatcacgttgcagtcgatttgattacgcaacatatccacacaaaacttgggcagcatgatctctgcaaaatctacccaaatgtttatgttatccagtcaacatttcaggtattttctcactcttgctctctttgatacttgatttagatggtaagtgttatcgatggtctcactataggatcatgattgcagataagaggcatgcatacacttattcgggaaaaggacatatcaaagcatgactttgtgttttattcagatagactcattcgtctggtatatctctcccttatgtcttctctttcaacgtcactcacttttcaggctttcttattttaactaatatcagttcaatttcaggtcgtggagcatggtcttggtcatttgccattcactgagaaacaagtagttactccaacaggtatgagaagagaatgcatgagctgtaacaatactgtatacacttttttatataacttggtcatcagatgtccgtctccttcacgtcaatctagttagagttagcttattcaactcatttaaacttatcttttccacaccaggagctgtatataccggtgttgatttctgcaagaaactttgtggggtctcaattattagaaggtgagcctttgaaaggtattgtatttggttaagtttgatatgataagatgcttattcttccaactgttttacatcatgcaaggcataaatttacttgtttgcgattaaattatctctcctacgtggtttctgttttgtatgtttttcctagtggtgaaagcatggaaaatgcattacgcgcttgctgcaaaggaattaaaatagggaagattctcatccaccgtgatggcgataatggaaaacaggtcttcctattaatattttgctctgtttttaaaagtatcaagtataatctctttttataaacacgaattttgaagtttctcttgtcgtgataatcagcttatttatgagaagcttcctcacgacatatctgaacgccatgtcctgcttctagatcctgtcttagccacaggtactctgtctctctacgctgtatatttcgattttggtcctttttgatggatttttggttctcgaaattcatatctcgtgatattgcttcttcttgaaggtaactcggctaatcaagccattgaactactcatacagaaaggtgttcctgaagctcacattatattcctcaaccttatatcggtgagtgtaaaaagctatatatcgatctttcgctcttttgtgaatgtagaagctaaagatctcattatgtatctgcttctctatctctttgcttctctctttccctcgtcatgaccttgctttctgacaggcgccggagggaatccactgtgtctgcaaacgttttccagcattgaaaattgtgacgtctgaaatagaccaatgtctgaaccaagaattcagagttataccgggcttaggcgagtttggcgatcgttacttcggcaccgacgaggaagaccagtagccaccactcaacactgtgactggtttcaaaggaaaagcctaaatttatgactagagcgacagtagaggcacttgcatgtctttgtagtttgtgctaaagaatctttatcttattgtttatgaagctcctcttgcttacttgaattatttttgaaaaactacgttaattttctcattaaaaaaatgatcgggacaatgctagttttctaaaccggtggaaaaagacataaccaatccttttatacatgattttgacaatcgtacgaaaattccagttctctctaattttaatttctttatttacatgttgattaatatatatttaccatttttcttaaggatcttagggtttagggattatgacctaaacctaatgatagaatttaaccttagttggacccacgaatgatgggcctaagttaagcccaactataaattaatgtagcgtaaccgccacacgctcatctataaatacaccactcctatgcaagacctatagttttatttcagtcgactcttgaccttcaatttcctccgtctctaaatttccttttcttttggctctctctgcgatcgagttcgaaaccgttccctaatcgaagatctagattcaacatacgttttatctctcaggtttgcttcttcttcgactacgttttctccgcgattatgatgatgccttcttcttcctgctttcactttgggttgcgtttcttcatctcctcgattcgcgatcctcctattcgcatcgatacccagagatctagggtttccaccgatatggatatggataaatcttagggtttcaccgataaggattatggattcgagtttctcttctatgtacattgtcggagctacatcttctcttcttgttgttagtgttagggttttgaataggttttaggtgatgaattataggtttagagttctgaattagagatttatttggttttttctgtggacgtggtgctctatgatacctggattgaatttggggttacagacagaagaatgtgttgcttttgattctctagcgattggggaattcagaaactccttgcttctggacttgttacccttgtgaaaatttatgtatg

SEQ ID NO: 23207 - DNA, 3000 bp, Unknown; identical to SEQ ID NO: 1289
  misc_feature (1)..( 3000): 2750-1469P.txt file - cDNA_ID_2133244; gDNA_ID_1620380; Annot_ID_155306

SEQ ID NO: 23208 - DNA, 3003 bp, Unknown
  misc_feature (1)..( 3003): 2750-1469P.txt file - cDNA_ID_2133275; gDNA_ID_1620379; Annot_ID_155262
gcaatcttggttctgttttgggagtcctcgtggatgccgagcttcaggtttttagagaaagcctcatagaacttgttgtagtcctccttgttctcggcaatctcaaagaagagctcaagacacttcttcacaaggttcttgcggatgaccttgaggatcttgttctgctgcaatgtttctcttgagatgttgagaggaagatcttcagagtcaacgatacccttgacaaacccaaggtaatcagggatgatgtcttcacagttgtccatgatgaagacacgacggacatagagcttgatgttgttgggcttcttcttagtgtcaaagagatcgaaaggagctctcttgggaacaaagaggatagctttgaactcaagctgtccttcaacagagaaatgcttcacagccaaatgctcctcccaatcattgctcaaactcttgtagaaagcagcgtactcctccttgttgatctcctctggcttcctcatccagataggcttctgtttgttcaccaaatcccactcatgagtaacctccttaatcttcttctttttcttctcctccttttctttctcctcatcaatttcctcaaccttgccttcctcatccttcttctcttcctcctcttcatcatcagagatctccttctcaatggtcttctcaatccagagagagattgggtagctgatgaactcagagtgcttcttcaccaaatccttaagccttcgctcctcaatgtactccatctggtcttccttgaggtaaaggatcatctttgttcctctaccaagagcctcaccagaggtgtctctggtcaccgtgaaagatccaccggcctgagactcccacacatactgctcatcgtcgttgtgcttggtagtaacaacaaccttgtcagcaaccaagtaagcagagtagaaaccaacaccaaattgaccaatcatgctaacatcagctccagcagccaatgcctccatgaactccttggtaccagaccttgcaattgttccaaggttgttcaccaaatctgtacaatagaacaaacacgaatcagcaaacacaaatcaaacacatagataatggttttgaatgaaatcaagtacaacttgcttttgaatgaaatcaattacgtaccagccttggtcatcccaataccactatcgataatggtcaaggtgttgttagtcttgtccggaatgatatgaatgaaaagctcaggctgaccatcgagcttgctcttatccgtcaaggactcgaacctaatcttgtccaaagcctgtttcaccagaataaaaagctcaatcataagtaacaaaatacacacaacatatatacaatcaaaaactaagtaatctaacaaatttgaacatgaaaaggttccatcaattaacaaacgaaaatctcaaatcgaaaagaacactaaaccctaataaaacctaaatctacacatagatccgtcaaatcaatcgaaggagatacacaaacacattaagcttaaagataaacatagaaagacagagagggagagatcgtacatcggaggagttactgatgagttcacggaggaagatctccttgttggagtaaaaggtattgatgatgagggaaagcaactggttgatctcagcttggaaagcaaaggtctctgcgtccgccattatcgttgatcgggaaaaaaatctaagaattagggtttatgtgaatcaaaaagcaaattcttaagagaagcagagaagtattgatggtttgattaagggggaaaagtgtgtaatatataggggatgtggaaacagacgtcataatataatggaaattgtaaaatataaaaattgtcataatattttactttccttttttttggaacaagtgctacttactttttttttttttttttttgttaaatttttctattagctaaactaatcaataaaaacaatgtttttctccatatacaaaattcgattttgttatggatttgaatttacaagttcccattcattctagtttatctatgtttagatttttttagatcggtcctagttttgggttattttttgaaatcgataaagttaatcccttagtttcaagatatctcaaaattttatttcaaattttagttatgtatttaatttataacaacaagataaatagttgtgttaaaaaaaaaaaaaaagttttaatcaattctgaagttaaaaaaaaaaaatcaattttttctccccacaaaccccacgctttttagagaatatgtgtttctttttgttattgttttaatttatttattttacaactttcaatattattatttaattattgatttttttgaaactttattaaaagatacacataccaatctgtaaacaggaaaaaaaaagttgtaagcaaaaaataaaattattgctttgtttttaaaatagtaaattatcatcaataaaataaaatagtaaattacaaaattaacaaaaaaggaaactaaaacctgttacaaaaaagtagtaaattacacctgttctgcaaaataaaaagggagtagaattaaatctgactgttttttataaatagtaaattatcatcaaccaataaaataaaatagtaaattacaaaatttaaccaaaaaaaaaaagaagtaaactaaaacctgttacaaaaagtagtaaattacacctgttctccaaaataaaataaaagggaataaaattttaaaaaatttaataaagttttgtatttttctaccaaaaaatagttttgtattttgtaatttccatttaattatattgcagattatgtggacctgaaaagcaaattaacataaatcaaataggaaggatctagaaacccttataggttcccagtccccacaccactatatataataacatccttccccaaagtctcgtatcaatcaacacttctctgctctctaaagaaaattttgctctctttatctctcgatttgattcataaaccctagctcttagattttttttccgatcaacgagaatg

SEQ ID NO: 23209 - DNA, 3003 bp, Unknown
  misc_feature (1)..( 3003): 2750-1469P.txt file - cDNA_ID_2133326; gDNA_ID_1620379; Annot_ID_155275
aattgatgtaattcgggattagaattctgatcttgatcttattaatttcattcttcgttaataataaacaacattgcttgtatagtaacaaatttttgcaataaataaaatgccagattcagaactgcaaactttcaatgtatttagtgatactgtaagattattccaacttgatatactgacaatacatatttaggtacactaggcacataaactttttctaactcaacaaggaacaatcaagtggagttgtgtatcatgtttcccgattcagtgctctgttcctacgagctctcaaaaccaaatatccggaaaacacctgcaaagagatccaagttgttgtcattgttcattttctgctaccaatattagagttttgagttgttgctaacaatgaagtactaatacgcggtagtaccttcatcagtattatacttgggattcttgtcatcacctgcatatgcaagtaaattgtatttgggattccactcaacactgttcatggctgcccgacatggaatctgatgcaccgtccgcccggtttggacattagcctgtttggtagttagtggtcagatacgaggaactaatctcatattgaggaaactacattgaaattagcagtgtttaagtctgggcaatcacttacaatatcaatgaataaatcttcactggctgaagcaatatactctcccgaatagttgaagcttattgttctgactggccacctgtgagaaatagttataaattactaacatgtaacagaaattaaacctttttctactctatggaaaattcatgttgatactcactcaagtttggtaaatgttctcaaacaaagcatgtctgagatatcccaaaggcttactaaggaatccgcactcccgacagcaaaatatctgttaaggtaaagaggaagaattagatgcaaaagcaaaaagattatcattcgtgtctcagaggccagcccacaaatgtaaatatatattacctccctttaggatcaattgcaatacaataacacccggctgtgtgggctgtgagagtgtcaagtggtttaagagatggatatgaaagaacttcaacagtgcctgagcaggacaacatacaaagtaactttcagtaagatcattttctcaagttcaaaaacaaagaaatctttggtagggaatcgtgtgcaggaaagtacagaatttaaaatcctcaccaagtccagtagtcaagaagaaaaaatctccaggcatgttccaagcaatctcattaacctgttacaagaagacaaaagataagagaacattccatacggcaccagaaaattacttgacgattattacatgaacaaggaacttaggtgacatataaccgcatgagcttgaaacaggagatacggaagagccttataaaaaaaaagccattaataaagattaacatgagtctgagcttacgttacctcataattgaatttgcgcctgtgtagaggtttaaacttacggacatccagaattgtaagctcatcatcctacattggccagtaagagaaaggacaacgactatgaaaagggatctatcaagtaatccatagacagtaagaacaatgaaagtgtaaagatatggggctcgagacaataccctattaccaacagctacatgtgtcccgtcaggtttgtaggtgatgtttatattctctccactaagttctacctgctgtgtgcattttccacctgtagaactcgaagaagacatatctcagcaattgatagtaaaacatacaatagtagccacatatcaaaaacctgatcaaattcctctcttatggaatctggctaaataactaatttataattctaagaaacttagatccgatcctcatcaatcaatagtctccgcgatatgactcaaaagcaaaggccaagattgcgagaaatatttgtgaatgacacatagctaatccattagaaaatatacagatttctaaaccaagctccaggcatatttcaggagcaaaactaaacgattaaaagaatataacttactgcgagcatcccaaagacgaacgcttttatcaccagaggcagtagcaacaagatctgaatgtttgggatcccaacatagctgatccacactatcagtatgaccctttagctcaaggtccttagccttgctctgtatccacacaccacacaaacaaccaaattacaaaaactacataactcaaaaagtaacaatgacaaagataataatcgagttttaactcaatctacaatacttctccatatgtattcatcatcatcaaaaacacatagaagttcccatagctcaaaaaggtaaagaaattacatgaccgtgtggttcgatattccaaatgcgagccgtttgatcaacagaacccgaagcaagctttgttccattcgaattccaagctactgaatgtaccttcaatccaaaaattcccccagattcagcaaaaaactagggtttcgcaagttttattgagtacagaaaattagactggagatagaaaaaaaaaaccttcttcttatgaccttgatattctctgctatgtaagctcttgaaaggaatcgtcgtctcctccattttttaattctcaactcttcttcttcaaccttccttcgcggcctactgaatatcagagcttcgcttcctgaaacgcagcgtttagtcattccggtatagataaaccgaatcgaattttagtaaaccggatgtaaaaaaccttctagatggttaagagtcttcagagagaaactaacaagaagagcggtaaaattgggtaaaatatgaaacaaagaaaaaaggtgaaaaaaaaaacagctaagcaaacaacaagtaatcatttcacagtctctataaaatgacctcttaaatccaccgacgttatagagagacaacaacagctttggttctgcctccgccgcttcttcttcttcttctaatctccgacagatttactctgattctgttgtcttcgagatgatgatgatg

SEQ ID NO: 23210 - DNA, 3000 bp, Unknown
  misc_feature (1)..( 3000): 2750-1469P.txt file - cDNA_ID_2133367; gDNA_ID_1620381; Annot_ID_155317
ggtcggagagatctagatcaacttctggttttggttggtcaaaggaaaggatttctgggatgatggtggtcggaggaccgacgggactcacggtggagaaacggtggatgaggtttggtcggaggaaacggtttgccatttaaactcttaagaacgttttgttttctttcttttgttctgtttttgggtttctctttttatttttcacaagcgtttttgtgtgttggggtttgtgtgtatttgtgttattgctacatatatttataattttatacaatcaagctttatgtgtgtgtgtacatatgtttggtaataatctaatagatgtcaatatacgttactatatgtcttattaggataatatcatagtagaagtttaaatgttcttaaaattgatagaatccggaaaaaattatcaaaaattaggagagaatctttcaaaaaatgaaaattgcctaattttggtttgacgggagttatagaattttcaaacaaaataatgatggataagtcatttcagcttctcatttatttgttaatatatatatatatatggatttacatattaatggactgaaagaaaaatctcgtacatacaaacaaaaaaatatataatttattcaattaatgttttaaaaaattgattctatttaaataaaaatgtgtttgatcaaagttactgaaagtattaaaattgaaagtcttagttttaattattttatggcaaactatattagtctatcagaaattattatatttataatttatgaatctaattaatataatttttaatataatggtgagattcatgattttagtaataaatcagtttcttcaaattttaatttattaaacaaataaggtttaaatcatccaaaataaatttgggtctcttgaagtataaaaaaatattggaggtttaggggctggttaccattttaaatagataaactctaaacttttgataggcatattttgaagttatatagcttatcttcataatttgcataacaaatatcacgtggctttttgatgttgacttgacgtcaatactacgtggttttctaattttagttgcaatttatggtctcattaataggagatcataataataatccatatatagttcttgataggtaaattccgcattcgttatatcaaagaaaccgtaatgaaagttaatgcgataaataagattcggattgaagcatagtaaatcccaagagttactaaacgtgataattatatttgcagataaggatttaacaatgaaatggaatcaaaaatctaaaatgaaataaaactaattaatttggagtaaagagtaagagaagaatttcgccgtaattttctgacagaacatatttgtttcggaaaaacaaaaatctattaagaaagtcgagtcagagacaccaaggacgtgacctgtgtgaccatacgagatgtcattggatagatagaattatttaatggatatgattatttaatagaaagtaataaagtaagaattctgatgaagatttgtcttcgtgagtcggtggatggtgaatcggatgcaacattcagacctgaatttatgagaatctttgactttactcaattggaatcttgagacatgaatttagcaagattctctgcctaaacaacgtaaacaccactaaatattagtgacaataaaagataaggtacccaacaaaactatggactatggttcaattgttctttttttgtgaggagattaaaattcgtttgttatttttggctttggaattagaggggtattggttttgttgagtggacttgtcttttatttatggtggactagccaaaaattatttaattatcacaagtttaattggacgtttttgccaaattcagatatatctaataatgttttaaaaaaaacattatatttgtatatatgtttttgcttgtatgtttgatcaaaatcgaattgtattcatcaacattttctttttgataactttgacgtacgtttattcttcttcatttcctttcttcctaatgaaactgaaatgcttaatggtgttctacaactagacgttactaatattgaaaagtcaatatcatatgatatgataagattcatatcatatctatctttattttgtacaagattaattcgtttaacaagaaaataataacaagattatttcaacaatgcaggtaaaaaaatatatatatatatatagcaagacaagggatattttatttttatttgtttttggtggatggtaaggagacaaatgtttattcaacaaaaaaaaaaaggaactacaaagggacatcatatcattcggacataatgctaaaccacatgatttagtcacatttttatacctaaatacctattctctccgtttcatattaaagggataattttaacaaaaatatatgtagtgcacatgtatacatatatacggtataggaaacttgtgaaactcaacccctgacatacaaaaattgaaaatgtgtgtcaataaagttcatcctgatttgtgattatgcatcaaaagaaacataattagatattaatttgatcagatttggatattctataggtgtatacattttccggtgaaaacaaattttaataaatctataaagtagtaaactatcaaattaatttagtcacagtgtgtatactctaattgatgagtcttctcccttaattccagaaaaaaaaaaaaggaaattaagaggtttcgttgggcctaagcaactacagaaaattaaaactccttgtctttccttttttctaaacaccaaaacgcactacatatattcgatctatccaatgattctgtaacgcccgtgaaccagaaaattggttagggtttgtttttaaattatccggtttaattggttgggttaattagaaaccctagagtttgcctataaaagaaggaaactcgaaattagggctttagttagccacttttcgttttataaaggagaaaaagagagaaaaggagaatg

SEQ ID NO: 23211 - DNA, 3003 bp, Unknown
  misc_feature (1)..( 3003): 2750-1469P.txt file - cDNA_ID_2133371; gDNA_ID_1620381; Annot_ID_155318
ccaattttaatccaaatctaattctgtaaactggagaataacgataaaggatttggaaataactctaccaaatttcgttaccttttaccacgatttgatatgacgaaactgatttctcccaaaccctaacgattctgctcattctccttttctctctttttctcctttataaaacgaaaagtggctaactaaagccctaatttcgagtttccttcttttataggcaaactctagggtttctaattaacccaaccaattaaaccggataatttaaaaacaaaccctaaccaattttctggttcacgggcgttacagaatcattggatagatcgaatatatgtagtgcgttttggtgtttagaaaaaaggaaagacaaggagttttaattttctgtagttgcttaggcccaacgaaacctcttaatttccttttttttttttctggaattaagggagaagactcatcaattagagtatacacactgtgactaaattaatttgatagtttactactttatagatttattaaaatttgttttcaccggaaaatgtatacacctatagaatatccaaatctgatcaaattaatatctaattatgtttcttttgatgcataatcacaaatcaggatgaactttattgacacacattttcaatttttgtatgtcaggggttgagtttcacaagtttcctataccgtatatatgtatacatgtgcactacatatatttttgttaaaattatccctttaatatgaaacggagagaataggtatttaggtataaaaatgtgactaaatcatgtggtttagcattatgtccgaatgatatgatgtccctttgtagttcctttttttttttgttgaataaacatttgtctccttaccatccaccaaaaacaaataaaaataaaatatcccttgtcttgctatatatatatatatatttttttacctgcattgttgaaataatcttgttattattttcttgttaaacgaattaatcttgtacaaaataaagatagatatgatatgaatcttatcatatcatatgatattgacttttcaatattagtaacgtctagttgtagaacaccattaagcatttcagtttcattaggaagaaaggaaatgaagaagaataaacgtacgtcaaagttatcaaaaagaaaatgttgatgaatacaattcgattttgatcaaacatacaagcaaaaacatatatacaaatataatgttttttttaaaacattattagatatatctgaatttggcaaaaacgtccaattaaacttgtgataattaaataatttttggctagtccaccataaataaaagacaagtccactcaacaaaaccaatacccctctaattccaaagccaaaaataacaaacgaattttaatctcctcacaaaaaaagaacaattgaaccatagtccatagttttgttgggtaccttatcttttattgtcactaatatttagtggtgtttacgttgtttaggcagagaatcttgctaaattcatgtctcaagattccaattgagtaaagtcaaagattctcataaattcaggtctgaatgttgcatccgattcaccatccaccgactcacgaagacaaatcttcatcagaattcttactttattactttctattaaataatcatatccattaaataattctatctatccaatgacatctcgtatggtcacacaggtcacgtccttggtgtctctgactcgactttcttaatagatttttgtttttccgaaacaaatatgttctgtcagaaaattacggcgaaattcttctcttactctttactccaaattaattagttttatttcattttagatttttgattccatttcattgttaaatccttatctgcaaatataattatcacgtttagtaactcttgggatttactatgcttcaatccgaatcttatttatcgcattaactttcattacggtttctttgatataacgaatgcggaatttacctatcaagaactatatatggattattattatgatctcctattaatgagaccataaattgcaactaaaattagaaaaccacgtagtattgacgtcaagtcaacatcaaaaagccacgtgatatttgttatgcaaattatgaagataagctatataacttcaaaatatgcctatcaaaagtttagagtttatctatttaaaatggtaaccagcccctaaacctccaatatttttttatacttcaagagacccaaatttattttggatgatttaaaccttatttgtttaataaattaaaatttgaagaaactgatttattactaaaatcatgaatctcaccattatattaaaaattatattaattagattcataaattataaatataataatttctgatagactaatatagtttgccataaaataattaaaactaagactttcaattttaatactttcagtaactttgatcaaacacatttttatttaaatagaatcaattttttaaaacattaattgaataaattatatatttttttgtttgtatgtacgagatttttctttcagtccattaatatgtaaatccatatatatatatatattaacaaataaatgagaagctgaaatgacttatccatcattattttgtttgaaaattctataactcccgtcaaaccaaaattaggcaattttcattttttgaaagattctctcctaatttttgataattttttccggattctatcaattttaagaacatttaaacttctactatgatattatcctaataagacatatagtaacgtatattgacatctattagattattaccaaacatatgtacacacacacataaagcttgattgtataaaattataaatatatgtagcaataacacaaatacacacaaaccccaacacacaaaaacgcttgtgaaaaataaaaagagaaacccaaaaacagaacaaaagaaagaaaacaaaacgttcttaagagtttaaatg

SEQ ID NO: 23212 - DNA, 3003 bp, Unknown
  misc_feature (1)..( 3003): 2750-1469P.txt file - cDNA_ID_2133483; gDNA_ID_1620384; Annot_ID_155396
tcttatagaacattatatttagtaaagaataagatttcattactcaatgcactttattggccgtaacaattttagccaaaaatttgtgtatatggaaaaaaatcatatgataatattaatggatagtccatttatatccttgtaacatttcaagttcgttgactgtgagtcctcgacttgcttttaaatagattaactaaatgccacaataacataaaaaccattatcttagagaaaagtttaaaagaaaacgtgaaagtatggagaggataccttcacttgcatcccttgttagcttgcttatcatatttgccacaggtattataattttttgtacacctttcaattttcatgttaaatatatttttttaaaaggttattttcttctattatgtgaacaaaaactaaacaaaaaatctcaaagtctaaccttagtttttataatttagacgtccacatagaagattaatgttatgagaattaagaaatacatattacagatatatatattttttttcttaagtcttcttgtagctattttcttgaattccttgtacttaatttctatagagtgaatatattcttatatatctgttaagtttaataaagtatatatacaatgctgtagttgttaatcagacaagagcaagtatctgtaacgacagactaggcctttgcgatggttgcgatcaaagatgtaaggccaaacacgggccatcgtgcgaaagtaaatgtgacgggccggttggaatgttgctgtgcacgtgcacttacgagtgtggtccaacaaagctttgcaatggtgggcttggcaattgcggtgaaagttgtaatgaacaatgttgtgataggaattgtgcacaaagatacaatggtggacatggatattgtaacacccttgatgattttagtttgtgcttatgcaagtacccttgctaaaacaagttgacagaatttggaaaccaattagctttctttgtaactgtaactgcgataatatggtaataaatttccttttgataaaaacattacgtttatttgcatgtaaggtaagtgagataagatagagacattcatgacttgataatatttttaattttttttacaatctatattcttgatttatgcagttggtgaataattcttcggtgaaccgtgcctacggttttagaggcctacgacaatatttaagaatgtgaaattttagattatcaaacaaagagtaaaatgtacataaacttaaaatctgaaaaacaaatctttaaaaagcattaaaaatagaaaagcttctaataaatgagttaagtatcagtattggtatgaataaaacctttggaatattgatcacaagaaaaaataattgagtagttagaaagataatttctatcaaatgtggcttatgaatgaattatatttagtgtagcctaaggcatttgccttttttctataaggggaggctcggctatgcgcgggcggtgattaaggcgtcgggaatttagaactccggagggaagccccaataaaagtagctgaaatcttggactgtcattgtcatgagaattttccggaattgttagaaaattaaggaggggatgaacaaaaaatggaatagtataagagaatttaattcatgtaatatcaaatgttcggtaagtttggtatatgtatttgattttcagagtttatgtaaattttatagaaattattttcggagtaatgtcgattcattttccaatgatcttatcacttgtctcttcatacaagccaagatgagtcgacaacttggttttatccttctttcttttctagttttcttctatgtaaacgaaaacaaatttcacatgtaacgattttttctaatattaagaaataaatacgtttagaacgtctaaaatatttatacaccaaacattaaagatcaaaactattaaagaaaaactgttagaaacaacacaattccaaaagatttagatcaacatctttattctcatttttatcagcttcatcatgcctccaaatctgattagtccagaaacaggttatcaaaattaagttttctaagattagttctcaaaaaattatggttttttgtgtttacaaaaatttgtgttttatggacaatagatttcggaaattcgcaaacctagattttcacaatttatctatattattatcatagctaaaaagaagctccatgaatgtgtttacgcaaaatcaaaataatatcttataagagctatacacctcattatgaattttcaattttgtttaaccttactgtgtctgtacttattgagagtctttcttaaactataagtttaagagcatcaaagtttaaaccagaatatttctatcaacgtattgggagaaggagacattcgactaaagaatgatctaaaacaaaacaattttttttttcttccgctgcaaaatagaaaatgttttagctaaaaatacacaatttaaaatttgaatataaattttacattctttcaaaaaaaatatatccactttcaaaagttcaatcaatacagaaatcattataaaatattaaatttatacattatttgcataaaaaaacttgtaaatacttaattgttatgcaacaaaaaatttgttcaaggagtagtaacacacacctaatcaataatagaatttagagatttgtctactttatgtaacaaagataggttttattacacctaatgatatttagcatttgtccttatttggacaagttgtaattttttaactgactttcttatttattgttgtttgacttttatgtgtcggtcattctttatcagtttttccaaaaacaatatgattaaaaattacaagtagatcgagagactgttgcagattgctcttaaatgacttatctcgataaaatcattttttcagatacaacaaacaaagagaaaaagccctttcaatttctttttacagattgctttctaaatagctttgagaaattgatcttctctttatcatactcaaatg

SEQ ID NO: 23213 - DNA, 3000 bp, Unknown; identical to SEQ ID NO: 1321
  misc_feature (1)..( 3000): 2750-1469P.txt file - cDNA_ID_2133509; gDNA_ID_1620387; Annot_ID_155480

SEQ ID NO: 23214 - DNA, 3000 bp, Unknown; identical to SEQ ID NO: 1329
  misc_feature (1)..( 3000): 2750-1469P.txt file - cDNA_ID_2133515; gDNA_ID_1620387; Annot_ID_155482

SEQ ID NO: 23215 - DNA, 3000 bp, Unknown; identical to SEQ ID NO: 1330
  misc_feature (1)..( 3000): 2750-1469P.txt file - cDNA_ID_2133523; gDNA_ID_1620387; Annot_ID_155484

SEQ ID NO: 23216 - DNA, 3003 bp, Unknown
  misc_feature (1)..( 3003): 2750-1469P.txt file - cDNA_ID_2133537; gDNA_ID_1620387; Annot_ID_155487
gattatagaatccgttgtaattaccattctctagaattaatatttctttgtaaacactatatattcctctatacattttaagggtgattggattagacttttaaaacttacgaagtttttgaatgttttcaatgcttttttcaatcaatttattttgtctttcatatattttaaagcttttgaagtttcttttttattttttactcctgttttcatatatttttataagtggggtatatgtgaccttagaaataaataaataaaaagcttatactagttttcttcttttcttcttcccaatatttatataaactctcataacattcacaaataaattaatttttgaaaaattttaattgatttgtaaccgatttttttttgttcttttaagatccattttcccatatatttgatagttatttaaaatcgtaatttttatagtcacaatctttaccaagagtataaaatttatgcagttaaagtctttatagcaaaagtttctacagcgaaagttcttaccgtcaaaatctttacaacaacaattaacagtcgttatcaatcctcccctctattggtaatatacaattaattatcattctctagagagaatagccaaaaaaaactcaaagatagaagagaagagacatgatagaacatagagaaaagatggtggtcaagaagaaaaggaaagaaaagagacaaggagaggaaacatcggagaaaactaagagaaggaagctcgacgatcaaaaacttcaaaaaatagctaaaaaaaatagttaaaattttctattttaaaaactctttgcttttttcaggtttctcgaaatttgtatctgagagagtcccttacctacgcttttgagagagtctagttatttttttccattttaaacatttaggtgctatattcttacaccccacattcaagcattcgatttcaaaatccaatctacgttaagtaatattatatgtcagttcaaatccattaaaaactcaaatccaataacgtcctcttagcaacatttgtatgtgggttattcacataaagcgtctttattaacagatagaatatccttaaatattagtttgaaatactatggatattcttcatgtatctagaagaatcccataacatattgtatctagaagactttcaatatctttcacggtattagagcgcagctctttctaaatcgcttcttttctgattaaatctttttcttttctctttctcgtcctctattctcttcctgttttctccaaattctttcaatggccgacgcagtcaatccctctaacaagatctatggagtctctaacatcaagtctcacatctctgtgatttttgatattgaaaaaaaacaactaagatacgtggagagaactttttctcacccactgtctcagctttgacgttctcggacacatcgacgacactctcctcccagccgatgacaatgatctcgtgtggcagaaacgtgatgggattgtaaagctttggcttcatggtaccctcaccccaaagcagtttcaaggctcattcatttccggatcgacgtcacgtgatatctggttatagatttttgttaaataagccaaattattcagactgttaaatggtttgattaaaccgataatttttccgttagataacttaacaattcagcgatgtaacttatttagtaaaatcaacaaaaaaaattaggttgaattacattgattttgtttcttttatttaagaaggagtgaacccaagaattgttcttttaatatattattagtaattgaactgaaaatgttgaatttctaaacaataataagaaggagataatatacaataaaattagaaatttaattcaattgagatcaaaaagttcgtttacatctgagtttcctgctttttgatggatattttttcttatggttttgatccgatcaaaaaccttattatatttcatatgaatttgtaagttcattcggaccatcaatcctgttcacgaacaaatcaagtttgaccatcgatgacgactttcattccggcattagtccatggaattgttttcttttctttttaacaaaatcagtaattatattagttattattttaaaaatttagcacattatattgagatatcgaaacgctataaatcttttttggtcaacatttggaccacaactggccgacccattagccaattcactacaaattgtagggagcgggacttgatctctagtgtgatggtgcctgtcttcagtggacttatctctattaatcccgaaataaataaacctcataataaatttttttatgaaagcctaccatagttaatttatggcactctacgcgtgcttgattattttttgttttctttaggatatttcatatttcccatataatataaaaatattaaaaaaatcatcaaactaaattagttatggtttttttaactaattaccaaattagttatggctacacgaatgagttccacaaaaaatgtttggatttgtagcttaccagattatgttgtcggtttggttagagatagagcattgcatctaacctgtgttttttttgtggcttttcccattaaaaagaaaacgatatgtctcgagagagttgcctttaattaattcaattcctctgctttcatatacagtactacaaaagcctaaccacatgcatttcctatatattgcctcttcgagaacaaaatgttattcactccaaatacaaaggaaaacagaaacgtagccaaaaaaaaaaaaaaaagaagacaatgataaagtctatcttactatgtttcttcttccttttccctctccttttaaccctctttaagaagcttttaccttcgaaatggaagcttcctcccggacctacaggtcttccgatcatcggaaacttgcaccaagcttggaagattgcttcatagttcttttcacaagctctctttagaacatggaccagtgatgcttctccgtttcggggtcgtcccgatg

SEQ ID NO: 23217 - DNA, 3000 bp, Unknown; identical to SEQ ID NO: 1324
  misc_feature (1)..( 3000): 2750-1469P.txt file - cDNA_ID_2133561; gDNA_ID_1620387; Annot_ID_155494

SEQ ID NO: 23218 - DNA, 3000 bp, Unknown; identical to SEQ ID NO: 1326
  misc_feature (1)..( 3000): 2750-1469P.txt file - cDNA_ID_2133573; gDNA_ID_1620387; Annot_ID_155498

SEQ ID NO: 23219 - DNA, 3000 bp, Unknown
  misc_feature (1)..( 3000): 2750-1469P.txt file - cDNA_ID_2133577; gDNA_ID_1620387; Annot_ID_155500
atttgctgatgtactgattgatggactttctgacgaacttcctgaaagacttgctgaaggacttcctgaactactacacgtcgaaccaagcaaggaaagtgaatcatccatcaaccttggatcgtttatgttggagatttcaaaccctccaaatgaagaagaagcttgcaaaacatctttggccggaatatcaaaaggaatcaaagagaaattcaaaggaaataaactttcgttattcgacgtaattaaattagcattaattgctaaggagtattgcttgctcgaaatccttgatccaccatttaatccagagaatgcatctagagataaagctccatcaatgcccacgatttgttcctcatcgtcaccaccaatcacgctttctctattatatcgattgatttgtatttaacttagaatattttcttttaatgtagcttagtcatgtaagagctataaaaagctcatttgtttcattgtaaaggaccacgaaatttgaaagtaatagaaagagttttctctaaagcttaggctttgtttttgtttatttaagttaggtagattcctttacttagtaaacgtgtgaatcaatgtctcttgtgtggattccttgagacaaaggttcgtgatcttatcacaaaggctttcacacttttgagtggcgatcatcaatccaccatcaaaaccctgatttgatctcacacgagagaagcgaccgctagcgtgtcagatttccaccttcgaccatctttccttcacaagagagaagcgatcgccagcttgtgaagccaccatatctatccccgtgtgagactcaccccgagtcttgcattggagaaggttagtgccggttcgcaggagacatgattttttcaatgggtctcttcttggttggttatatttgaatctgggaatggtgaatgatgaggtcgggtattcatgggcaaccttgttctccattgtggtttggtggagttggaagtggcggtgtggctacgtttttggcgagattggtaaatgtagagatagagttcagtttgttaaggacttcgcttctcaagtaagtcaagctcacaaactgaatcgctatacgggcagatcgaatactcaaatggagagaatggtggcctggaaatgaccgaaagaagattggatgaagcttaacactgatggcgcttcacggggaaatccgggattggctacagtaggaggagttgtgcgtgatggtcaaggtcgttggtgcggtgggttcgccttgaatattggtgtctgttacgggctttatattgcttgggagaggcggtttaggcgagtggagttggaggttgattcagagttggtggtgggttttttaacgagggggattagtgatactcatcctttatcgttcctggtgcgattgtgccatggcttcttatcaagagactggttagtccatgttactcatgtttatagagaagctaaccgtcttgcggacgggttagcgaactatgcattttctttccctttatggtttcatttgttagatgttgctccaccctttgtggcgtcatttgtagaggatgatgactgagaaactgcgtttccaaagcatatccgaatttgatttttgttttttagtttcttaataaattgtggggagagcttttctccccgtgacctaccaaaaaaaaaaagatcataggaacaaagtaaagatatgtctctcaagtgtattttaccaagaacgtgagatcttttacgctaaggtagagtttgtggagatcaacaacacataaagaatcatatttggtacatgacaagctcaaatggaaagttgaaataaagtttgtatcaatagagacatgaatccagaagcttgtgccaaatatttgagaaaaaccaacaatccaaaagcttgtggtgtcataccaataactcaacaataacaaaaccataactgatccaacatgccttaaagactttgttggcgcaaatttgtttgggcagtggcgggagaatatgttttcatgtttcaagttttgcctcctataatgtttttcataatgattaatgtattattattatcacatttagtttatgtaaaataaaaatttagatataaagatataaaatatataaatgcgtactggtcattacagtgcacgatagcaagaagtagtactattagcaaattagcatcgtatttttatttatcgttaattttctcctaaattttcgatttccgatctccgggcaaaatctcgagtttttcgccggcaaattcattcgtgatgtgtgcatcacagagtgttgaatcagctttcacttcatcagaaaccctaattttagtgtagtatacttgctagatccataaatttctcgagtgttttagcttgatctgatcttagctccggaagatgaatttgcagcattgttaccatttctacgcaaaaacccagtaagatcgcttcttgtatctctatgtttttaagatgaatttgactgtttttgatttgtgggttatttttaggtttagaaattagcgaatcttaaagttaagagcttttaattcttatgttgaagttattagcttatatttgaggatgtacctgtaacaactgaaatttcgtcggaaaggagagatttttaagctgtctttgacttcaaagacgatgcttttagatacccaaatctacttgagttagtagtagagattgatgtttaggtagtatatgtttctgaaatggagcttggagaagtgggttttaagcttgagggtgatcttgcattcagagttgagcaaagatgtgatttttagtgagtgggttgggttcttgttataatgttgtgtgtttgagctctttggtgtattgggttatgttgtttagtgactgaagataataattttacgctggtggatgtttgcagataatggacaactttgtgagatttagcttgcgagaacggtcttagtttccttttgtagaactgttggtggtgaagagctgattttagatg

SEQ ID NO: 23220 - DNA, 3000 bp, Unknown; identical to SEQ ID NO: 1293
  misc_feature (1)..( 3000): 2750-1469P.txt file - cDNA_ID_2133614; gDNA_ID_1620382; Annot_ID_155340

SEQ ID NO: 23221 - DNA, 3003 bp, Unknown
  misc_feature (1)..( 3003): 2750-1469P.txt file - cDNA_ID_2133647; gDNA_ID_1620382; Annot_ID_155350
ccaataaagataactcaatttcataaaaagaaaaagacacgaacatgattaaacagttctgaaatcacaagaatcagatctcgagaatacctgattttataaaaattatgaattttctttttgagttcttacattttattcctattaaaagagtgatgaaacatgtgagaacgaataataaagtaattttattagcctattactggatttacacaacatattccacgtagacaacaaaccatgaaaagttacacgtgtcaacatctcattttaactccaccgtaaacaatcgaataacgaaaaatcaatcaaattatcgaaattaacaccgaaactataaaatgtaaaacataatgttttcaagatgtaaacaatgagatcctaagccaacacgacggcgtaaataatcgcggcgacaagtgaaccgacgacgaaagctttgttggttaaagcggcgttaggtggaggagcggaagcatcggaaggtgtcggggctagttcgccggggctaactccgggaccttccggtgcaggtggagaagcggtaggggcatcagacgacggagaaggagctgaagacggaggagaagaggtgggggcaggggagacggcaggtggtggagtggtggtcggagcgggagttgcggcgggtggtggagtggcaacgggaggaggagtgacggtggtggttggagaaggagctggagcttgagcgaggcatgaggtagtgaagagagcaacgatgaagaaagcttcgatgatcttcgaattcattttttccactctctctaaagatttgtttacttaagaaagatagagagtgaagcagagttgtttaggtgaggaatgaccacgatggaactatataaagcgagagagagagataacaataattataaattaagtagtatctaattaaatatcttgcggaggggatcataattattcgattattattagtataaataatgattagtagctaatattcaaatgaaggaataacattttagtagtcaaatagcagaaacgtttaagtgaaaaaaaatagcaaaaatatttgatcagtaacacacacatatcagtgattaacaacttgttttatcgtaaataagagaatacattttcaaaactaaacataattaagtgatagatcattttatcactataatgtagtcgcatatatgtatatatataattttgtaggatttttaggttaactcaatttttagctcttagttgtaaatttgtcattttttaatgatttggtaagtatagtagatgagaaatcgaagttgagaaccaattctatccgttgagtataaaatcatcaatggttttagaagaccggattggtttagctaaatcgaatcatgattgtcaataataattggagagagaaaacgtataatgaagtagtattgaatattgtatcatgtttgtcttactgtctaatcgatccacccaccgataataatagtatactttttctgatatagtaaatagtaacgatctctttgcccgtatacgatgaaccttaatgacaaaaatacagatctatcaagaaagaacgatgtcgttattatcgtatatcccatgtgcgtagcagacctatcgggataatttttgattactggttatggttttattgttgtcgttaccgttggatatttgctgtttttcgttttatttattttcttttgtccattactatctcttgtgtttgttgctagtagtaacaagagttggagatagctgtcagagaattttatatagttgaataataaatacaaatattataaccccaaataaaacgggtacatatacattacaacataacataacaacggaagaagacatttgatagcctgtaaaggtcattttacagtgaatccagaaggttcgtattaatcattaaattaaaatataatcggtatttgacaaaatgaactgaattatagttggcaattttatgaggcccatatgatgcgaaaccaaccgacgattatacactatacctacaatttttattgcactgactcgattgattaatccctaactaaaagttcaaaatatttgcatccaactttattttcattagtgtgaacatcaatataaagaattgagaagatcattacaggttgtttcagatgataacgacaagttcgttatatatgcactataacttgctttgttacatatgctataaagttcatttgcaatatatacgatttgattacatcagtgtgggattcctagaggatgaattaagtgttaaaaatgaatctatacatagtagtttgctttgaatccatatgaaaaaactgttgaggtttaatgtcgaaatttctttatctttggcttcggctgcagtcaaaattgccgaaagaccacctcgactccaaaccattttcttgataattgtaaaaaaaaaaaaaaaaaaaaacatgatgtcccatatgcgtgtctaataatatatatagccaagaagcatatatttatttaggggaagagaatgctaaagcatgagttttgtgctggctttatgttgttgtaactcttagagcaacatgtattcacttctaactgaactttacataatttaaagcatgatttggattatctaaaaaaaagttagattatgatgaatatacaagttttttttgttagtggaaaactctcatttcttcgagtaagcttctccatacataattttcattgtctatatatatattgatctatttgtaattgtaactcttgaaagtttggaaaatatttgtaataagagataaacaatgatatgggccgatatttgcgaaactgatttcaaaggattcttctttatgggcctatagagttttgggcctttctaccaaaactttcgcgacaagcgatatgttagggcacaaggacaattcgaaacctgagaagagagctagagcttgtcagatgttaggatactcctatccttgtttccaaacgggattacggttaacgacggcgatg

SEQ ID NO: 23222 - DNA, 3000 bp, Unknown; identical to SEQ ID NO: 1297
  misc_feature (1)..( 3000): 2750-1469P.txt file - cDNA_ID_2133672; gDNA_ID_1620382; Annot_ID_155359

SEQ ID NO: 23223 - DNA, 3003 bp, Unknown
  misc_feature (1)..( 3003): 2750-1469P.txt file - cDNA_ID_2133676; gDNA_ID_1620382; Annot_ID_155360
cttgtttatttgttgaaaatgtagaagaaactaaaaaaataaacacaatgatcatttcaaaattacggtgcaatgagtatctacagtagtctctgtatttattttacttttcgtatcagtagtctctgtatatattactaattttaatacgataaaaggatggtaccataagatgatgatcatgacaaaggtgcaatgaaaatcgaattttaattgattaaatgataatggcacacgcagatctgtgtggtgcatatgattttttttttttgttattaattcttttggaattttggaccgaccagatagcgtgacattgaaggtaaataattactcactcgtatttataccaagaaaaaaaaaattgattacaaaagttttggtgggtctactttatgaaagaagaaaaaagtgtgtgggagaaaaattgagctttagagggataacttctgaattctctaaaatctacatataattttacttaaaaaggcccaaagttattgtattatttttggaccttaaacagtctactacaatgaaagggccttatcttaattgttcaggcccaaatgattttaagcattgacactcaaaacaatatcttaaaggcaattaaaggaaatctcaaggcactaaatatttgtggaaaaaaagcttaaagtctatttaataaaacaaaatcagatgatgtatattgacattaattacaaaattaaatgaatttctaacccaaaaaaatggttagattcttggcgttatggtactatttactttacttgcgctttatataaactttggataaattcatgaataccgttgtttaataatttgttcgatgtgatattgtaacccgaactaacccaaaactttaactttatacaatttgtttatgtacgaaacactttaatagtatgattcaactcatcttctatacctttttcctaaactttaaaaacttttttttaatgtatgactaacttttttttccttgaaacacactatcaagttatcaacgtacagctaaataattgcttatttgaagcaaaaataatgatataaatactgaaaaagaaaagtagaagaatcatattcacacgccaacaaatcgtataatgctgcttcatctaaaattggtccttcgaaagtcacgtccatttagctctcacgttctacccgaatcaattttaaatccttaatttacagtcataacacatatctctgataacgttattttctggatatgtaagacgcagaatttcatttctattaggttaatttaccaaccggagtaatttataaatttgtgaaaatctcgcctaacacaaagtgaataataataaatcacttgatagatgtttagccaaacgtagatataagagtaatcttattgttatttttgatagtactataggacagatttattgatgagaaaattaaaaagtgaaaaaagtgggtgaaaagaagagagcagaaattaaaaaaaggacgagaagcgagaagagtgcatcttttgatggatattgaaaatcttaagtcaagctgtaatgggaagaaagaacacaacaagtgtcggtgcctctaagcaaattccacataattctaaagaaacaacataattattattttatttttttcgcaatatttttaacagaaattgtttttattccagccatgcgtatatataagctgtcttttcggaaaaaataaaaagctgtctttatctatcccaacggtccaaaaatttaataaaatagtattataaatgcactcgtaatacccaatgttttatttttcctgaggattaaagaggcaaatatactagcctttttgttttattaacagctagctaatgagcaaaatagctgtagatagatagcgccactaatctaatccaaggccattagcttatgttgtgtatgatgtgatacccccaagtctaaattagtgatggtgacgtataattaataatggtaattttgacgacgagtatggaacgtgttccgaatttttctctcaaataatgcgttttgattttgattatcaaaagattccaaaataaatacattgaagaattcgttctctaatcttctaaaccaacataataaacttcggaccactcgacgaccaaattttcagttatgcgtaattactatttaagtcaatcaattctgttatttaatgacattaccaaaaatcttaataatcctaggctatatgtaattatgtacgagtcacacataattaatatagatccgtgatgtatgtctctagacgttatatataaaccataacagcaaaataaattataacaacacatagggaaaagattttatgaccactaccaaatagaggcagtcatagataacaaataacaaatgaggcatcgaactttaaagcttaaagatttaataccgcatttgtatcgtcattaagtgcgataattctgtaattatgtaacgttgtcattcaggagtccggaaattaattaattaattaaactatccgttgtcgtgtcacgagaataaaaggttaaattcgccgtgtttttattaagaggagactaggtggggcccaattgagacagacagcaaatttaatgaacaggtgtccatgtgagacgcattcacacgctctctctctcaagtctctctttccattactactactataaaccgttctgggaacttgatcaacatttttaatcctaaaacttcttttgagtgtgttgaagaagaagaagattaaaattcactaaaaacccgagaaaagtggaagaagaaggaaggaagaagaagacaagagagcattctgattcatgtgactctggtttcgtttctttctgtgtctctgctgtgtcgttttctcggcatatttctgatctttcgttctcggttggtttttggtttctgggtattgattgattgattcaaaagtcttcaactttcctggaaactggatctgggtttatccgtttttactcgtctgagaagagaaaaaaggatg

SEQ ID NO: 23224 - DNA, 3003 bp, Unknown
  misc_feature (1)..( 3003): 2750-1469P.txt file - cDNA_ID_2133700; gDNA_ID_1620386; Annot_ID_155440
aaggacaaaactgtccatttagattccaccacgtgtcccgataacgtttccgtctgtatctctctcttccgtcttctactcttcttcttcttcttcttcttccactcacaatctatcgagctaaaacactgaagcagacattagcgttgagaaaaaaaaaaaagtaagaacgagagagagaaagccatgtctgcgaaaacaatcctatcatcagtagttttggtggttctcgtcgccgcatcagcagcggctaatatcggattcgatgagtcaaacccgatccgaatggtctccgatggtctccgggaggtagaagaatctgtttcccagatcttaggtcaatctcgtcacgttctctctttcgctcgcttcactcaccggtaagtctcgtcctttcaccacccgtgctttctccgttgacttttgatcttagcttttgatcatcgtttgttggtgatgaagatatggtaaaaagtatcagaacgtggaggagatgaagcttcgattctcgattttcaaggagaatcttgatttgatcagatccaccaacaagaaaggcttatcttacaaactcggtgttaatcgtaagtttttttttttatctttcttctcctgagtttgtacttaaggaagtaaacgtatgtataaaagacactgtgggaaaacgtggaaactaacttttgttctgtcttggaatcttccaagttaatatttttaaattttgatttttttctttcgttcacgtgattcaagattgttattgggactctagactttacagagtttatgagtctatgaactctgtgtgagagactagtttgtgtcaaaaacagtgttctgcttctttaagatttagctgtcctgagttgaagattggttctcgttcctacttccttgtagagttgtagggatctaatctttatttgtcctagaactgacactgcaatggtttgatgaataatgatttacctaaatattgctaattgtgtcttgaatctatacagaatttgctgatttgacatggcaagagtttcaaaggaccaagcttggtgctgctcagaactgctctgccactttaaagggcagccacaaggtcacagaagcagctcttcctgaaacagtaagtccaggactcaatcttgctgcactgaactatgtcaaccaccatcccgttctgtttttcagctctaagagaacgtgtttagctgcagacctttttaaaaatttggttctgagttctcaaattgtgtaactgcagaaagactggagagaagatggtatcgttagtccggtcaaagatcagggaggttgtggatcttgctggacattcaggtaaaagtaaaaccaatgattaagatactctctttaatttttggtgggatcttttgatgtcaaattgaaggtcgagattgtatgtcatatgattgttttttgtactgcagcacaactggagctcttgaggcagcttaccatcaggcatttggaaaaggaatttctctctctgagcaacagcttgtggattgtgctggagctttcaataactatggttgcaatggtggccttccttctcaagcctttgaatacatcaaatccaacggtggcctcgacacagagaaagcttatccttataccggtaaagatgaaacctgcaaattttcagctgaaaacgttggtgtacaagtcctcaactcagtcaacattactctggtaagcatcttttatggattttgaatttcacttgcatgagaatatacattctgtaatgatgattgaaacaacaacaacaacagggtgctgaagatgaactgaagcatgcggttggattggtacggccagtaagcatagcatttgaggttatacactcgttccggctttacaagagtggagtttacactgatagtcactgtggaagtactccaatggtgagactttcttctttaaactgttaaaaagactttcattggttcacataaaatcttcttaggaacttagcttagtgttcggtttccttaatgtggcaatataggatgtgaaccacgcggttttggccgttggttatggagttgaagacggtgtaccatattggcttattaagaactcatggggagcggattggggcgacaaaggttacttcaagatggagatggggaagaacatgtgtggtaagttctttaataattatgaaaccatcacaccattctcaaattctcacagttggtctttctctatctattgttgattcgttcttgaattgcaggtattgctacatgtgcatcataccccgttgtggcttgagatgatcagcgaatgtggttggtcaattatcaaattacgaaatgttcacgtatttattggattaagacattacgtaaaagttgggacttgggaatgcatatggtttatgcttgttgtaacataaaaaggtctgttaatatgtacaaaataaagccaaaactatagacgacaaatttataatattttcatgttaaatttatgaacataaattgatttagatcaaagtagtttcgttcttgatcctaagtcaatttgtctaacatatagcttttactttgaatcttgatccttgagtcattttgtataacatacagcttacaagttatgactttattttgttttggtaattggtattctaaacgaaaatgaaatctaataacgtgattaatagtggtcacatggatatctcataaatctctatccaattgtgtgattaagaacatgcaaaactgcaaataaagtataaaaaatcatttacacaaaacttcatctagtttttggacatcaaattcacaaaaagcagcatataacactacaataattgatttcacttttattttatttgtttgtttacctttctaagttcaaatataaattctatgattagtttattataattacaatttttattttttttactctgatttgaattttttacatggacacgaaagaagaagaagaccacatgttggttccgaataaaacatg

SEQ ID NO: 23225 - DNA, 3003 bp, Unknown
  misc_feature (1)..( 3003): 2750-1469P.txt file - cDNA_ID_2133710; gDNA_ID_1620386; Annot_ID_155445
gcctctcatctgctaaatcattcatatcaagtcttgtcaacttgttttttgaaccaacttgctcattaaagtaattcccacctaaacttctgtattaagcagacccttaaaaacagtgatgcaagatttaacatcactttcaccatttattacatggtaacaatgagacaaaggcatttacttttggaattgatgattattggaacaaatcttgcaatgatttgcatataacttgaataataccttttgatcaaatcttaacaatgaaatttggtctccaaaaagactaaaaactagcagtcaaaagtgttttgttgagatttatgcctataattagaatattatatgctagttggtatggttgagtgttacaagaatctacttgctacaaagtgacaatccaggagctgttcatagtacatagtaccaacattatacaagggactagttatggataagtcattgcttttgagacatagtaccaacatatgtaacatgggtcacaaaggactagttatggataagtaccaaaattttctccactatctatgttcatgaacatatgtagcatctgtgtatagatgcaaaatcaagagctcaaataaactacagagtatatacacacacaaaaaaacttatcaatgtgaattcttggaaatgaaggtaatgccaaatcattggagatgacgttaacaacatgacctcacttgggataataatcctgataatcatttgattgtagccacatagaaagcagcaaactaaatgacaattatgatttaagagcaaagatagtgacagtgtaaattaagtccactcttctttgaccttaaggtaataatatatatatggatgaggtgatactaatagagtgattacacatacaagtggtcttgcttcttctatggttttaaaactgcaaataaagatttgcttcgcaggagagatagcgccatcacctcttctaagaagttaactagtggtgacggtatctctcctacgtagcaatccttatatatgcatcttaatacggagagatcaaggtatttcagttgttcaataatcaccctctaacaaagatgcatcttaatattcataaactattctctttctacttacatagtaacaccataaaaacaatgaaactgctccgtagaggaccttggtttgagcctctagatcgtcttctcttacctaaaatgataatctgttccaagataggttcttgctatttgctcaaatatgttttggtcttttgaatgttagctcagcaaggagctcacatgattagcagcacatcctcagcctgaaagtttcaagaaaagctttatcaatttaagagttgtgtacgtttgcagaattctcacaagtttggtttgattctcacccacaagaaaaaaatgtcttttcttttactttcgatatgtttctttgcctttgacaagggacatataaaaatgttaagacgaaaaggttgacaaatctttgaaaactatccacatcatgaactcaagatatctcattccattagaagcaaaaaaaatatcaagtcaatgagaccagctcacgactactctagaatcttcattaagcagaacaaggaaaatctataggtctaattaaacctttttttaatatctcgggttaacaccaaatttggttcaaactcgacaagtcattgttcaaaacacagcatccaaaaagataaaaagccaaatcttatcaccagaagtccaccactaattggtatataatgtttttttttgtatgtagaaatagtgttgaagaaagagcttcatgctatttgatatctataatatctcatttcttgtaacaaatgaactccacacggaatgaagctttttacatatagaaagaacatataaatgtgtccaatatctaatttggtccacgtatcaatttgcaagatcacatgcttacgagacctcaaatatttggtggatatataagataatttcccacatgttttacgaaccatcccgtaatgagtatgaattatccggtctagcaatccattcgatagatttactagttgaaacttgaaagtagggttttgctcacttgtatcctttattcgtagtttaactataatgcacatatggaagaattgagccacaattctcaatgaatttagcgagggtgagaaatgtcaattcaatgtacattctatgtcaattcaatgaaaacaaatgaagaaaagagacatgaaatatgtttccaaattcttacttagaagaattagaatcaaataatacaatatctacatatgccatgagagacatatggaaaaccatgttttcggatgataaacttccaaattgatttgatatatactataaaccggcaaataaacaaattgaggttaaaatataacaaaccggtccggtctgatcgaacggctgatgtcataaaacgtggggaatattcgattaaaataacaaagactccgttacggtcgtaaataagtggtgtgagaaccgaaagtcaaaaacacgtcaatattggtgggggggacgaccgtgcacgtgaccacacaggaactaaacccggacgtattgcgcgaaaattaaaccggatttgataatcggcgactcgtccggcaacccttgttttgttttcgtctcggcggatcgatttttcttcgtctgggtttggttgtctttttattttcctcttccttggccaaagaaaatcttatcgtagctgtgaaaaccctagtttctaatcatctcaattctctcattaacctatcaatttcgatagggtttgatcaagtatccgatttcatggtttgtattttccgtttaatagtctttaaaggtcttgtcttttggaatttcaagggttttcgtttcagtaactccttcttttttttctgttaatttagatcggttgctgtatggagactaattgctggagtttaggttcgtgtgttttgaactgagcttttggttcttgtttgtgtctggtgttgaagacatg

SEQ ID NO: 23226 - DNA, 3000 bp, Unknown; identical to SEQ ID NO: 1314
  misc_feature (1)..( 3000): 2750-1469P.txt file - cDNA_ID_2133718; gDNA_ID_1620386; Annot_ID_155447

SEQ ID NO: 23227 - DNA, 3003 bp, Unknown
  misc_feature (1)..( 3003): 2750-1469P.txt file - cDNA_ID_2133747; gDNA_ID_1620386; Annot_ID_155458
agctggctcgggaccagcacttgtttctccaacagatacaatagtcttactactgcttgaagaagctccttgctcaatctctttcgtcatctttatgaaataactgtgcctgcaaaaaaaatgaaaccggaaagagtaaaaacagaccatatagatcattgctgcaaatatcaaaagatcggggaaaatgttaatcaattaccatcgagtgtctgcagtaagctcgggatgaaaagcagttgctaacaagtttccttgcttcacagcaacaatgacttttgtttcaggaagagcatcttcctgatttatccccaaaaaatgaaaccaacaagaagggattcatacatgtgctcacaaaagagtaatcgtttcatgaaaattagtgcaaaattaagcaaacctcttgaatttgtacggtggagcttgaatacaagaccttgtttgatgggacgggataatccgccaggacttcgacatcaggacctacatcaagaacagctggagcacgtatgaacactcccctgtatgtctctggcccaccttcttgagatgttagttgaggtactaagatatcagcttcaaaactttgaatctacacatcaaaaacaaattcgagaacaatctaagattttcacaacatcttatttgatactaagagtgaatgagaatccatatgaaattactcccattgattcatgaaaagaccgagttttatatatcagtacaccacaactcatgctaatataagcagtttctttttccacatattgcaagtcaagattgatttaaatatgtgtttacacattttcttaacatgaacccggaatcttggtaagagacataacctggctaccgaagaagttcctatgtacggtgcaatcaaggccaccaactaattcctgacctccctctttctgacctaaaatttcaacatttactcaagtttctaaattttccgcaacaggaagatgaattcaagtactcaccaactgctctgtctgccaagaatataagacctgcgcatgtcccccaaacaggtttccccatcttaacaaactcacgtagagccggaaacttcaaaagagcaacaaatgaaagaaaattagaacagagaagagacattttacactattcttcgtcctcaccactaaaactgtaaaaacaaccaaatctaaacaaggagtttggtaaagataaaagtaaatgatagctctccctttcctacacttatcacagcttccattaaagacagaaaatatcatccataagatcaacgagtagtttggtccacaatgtttaaaggtttcagatacaaaacattacttcatgtacttgaaggctaactaatcccaaagttccttcattttcaatctcaaagctaattactttcaacagtactaactgaattattcaggtataagagacgttttgactgaaattctggagaattttggtgaataacgccagattcgtgtcaaaacacacataaaaaaggaacctttaactagtttcttcaagtgggtcctcgcaaacaataactttagattctagagagagaggagcggaccaagttatgatactcggcgagtttggccatggtggtgctctcgccgccaggaatgataagagaagaaacggtgagaagctggtcagccttcctaatctcgacgccttggacaccgagccgccgcagagccgcgatgtgctcattgaaagaaccttgcaaagctaaaactccgacggtcattgcggcggcgacggtcaaagaaagagagtgtcagatattattaaacactaaaactttgtgaatggaattgggacactcacaaaagcctttttgtaacagccatcgacgattttgttttgtgtttctttctttgcccacgatttggatttctattcagatattttcttataataacatttttaaatataaagatatcacggtattaataactattgtgaacaaattcaattaaaaagccataaacaattatgctaacaaaacaaaaatatacacttattaagcttttatgtgattataattcaaattctctaggaaaaattgtaatctattttacaaaattttaaagatgatgatataatattatatatacacacaaaaaaaaacttatagtaaaggtaggttttcaaaaactcataatgtgtttttttttattagtagtaattttattgttttctaaccactgaatttagtttatagcatgttttgtcacattagctggtgatgatttaatataaaactactttttataaaagtaattgacaaaacaaaaaatataaaccccaaaaaaaaaaaaacagaagggggagagaatctcgatcaaaggcttcgaagctctctcttttttttttggtgtgtctaaatctctcacgcacgacgttgagagagctctttcctttgcgatcttgttgtcttcctctgctccgatcgaattcacaaccagctttaatgtatgattctcgctcttaccttcagtttatgttccgaatcttctcatgaaatttccattgcatccgatttcgaaattaggtttttttttttcaattttcaaaattttggtttgtgatttatgtgattttgaagccaccttcttgggggttcttaagtttgctgtagaattttattgttcttctctccgtctttgtttctttgcttagagttgactatttggattgaaaaagtttacacctttacgcctgaatcataatacccacaatgtgattgacttatctacacaagcttttgaatttgatgagaatttgaccttttcttttttcgcagaagcattgtagttcaacttgaatttattggcggttgttgaagctgtgtagctattaacaattggggctatgcattcaacgattttctgctcgtgaagaaggaatataacttatttataaggtttcagtcttagacatgtcgtgtttcgattgcagtggttatgatgtctcaagttgtcttattcatctcgctgaatg

SEQ ID NO: 23228 - DNA, 3000 bp, Unknown; identical to SEQ ID NO: 1311
  misc_feature (1)..( 3000): 2750-1469P.txt file - cDNA_ID_2133809; gDNA_ID_1620385; Annot_ID_155417

SEQ ID NO: 23229 - DNA, 3000 bp, Unknown; identical to SEQ ID NO: 1306
  misc_feature (1)..( 3000): 2750-1469P.txt file - cDNA_ID_2133826; gDNA_ID_1620385; Annot_ID_155421

SEQ ID NO: 23230 - DNA, 3003 bp, Unknown
  misc_feature (1)..( 3003): 2750-1469P.txt file - cDNA_ID_2133845; gDNA_ID_1620385; Annot_ID_155425
caacgacaagatcaagaaaagacaaagatttgtaagaaaatgggaagagctccatgctgcgacaaggcaaacgtgaagaaaggaccatggtcaccggaagaagatgtgaagctcaaggattacatcgacaaatatggcactggtggcaactggatcgcactgcctcagaaaattggtaagaattctgaaatgtttaaattctaatcccaaaagtaatcgcttataattttcaatttcgattgattagatcaagttttgttctgactttgagatttgtgtaaattatagggctgaagagatgtggtaagagttgcagactgagatggcttaattacttaagaccaaacatcaaacatggtggtttttctgaggaagaagatagaatcatcttgagtctctacattagcattggaagccggtcggtgatctatctctcttgatttctattaataataagttaattaacacctcttcattaaatatataaatttttttgttatgatttagaggtaatttctgttgaaatttcgacttgagattcttgtctttttaccttttgtctatgaatcttatgctgaaacacatgcaagcccatgtttcttcaagctatggtatctcacatagaatttagggtttatattgtctctttcttcttgttttggtgtctttgtaagaacctttatacatttatatcttttaatcttgaacttggttcgtgattctaaatacatagttttctaaaaaaaactttctattagttttaaccttaatgtgatatatttatgcaggtggtccataattgcagctcagcttcctggaaggactgacaatgatatcaagaattattggaacacaaaactgaagaagaaacttctaggaagacagaaacaaatgaatcgtcaagactccataaccgattctactgagaacaacctcagcaacaataacaacaataagagtcctcagaatctgagcaattcggcactggagaggctccagcttcacatgcagcttcagaatctacagagccctttctctagtttctacaacaaccctatcttgtggcccaagcttcatccattgctccagagcactacaactaatcaaaaccctaagcttgcatctcaagaaagcttccaccctttaggagttaacgttgatcatcagcacaacaataccaagctagctcagataaacaatggagcctcttctctctattcggagaacgtagagcaatcccaaaaccctgctcatgaatttcaacctaatttcggtttttcacaggaccttcgattagataatcataacatggactttatgaacagaggggtttctaaagaactgtttcaagtgggcaacgagtttgagctaacgaacggttcgagttggtggtcagaggaagtggaactagagaggaaaacgacgtcgtcgagttcttgggggtcagcttctgtgcttgatcagacaactgagggaatggttatgcttcaagattacgctcagatgagctaccacagtgtttaataagttatatcatgcatatatataaatgcgtaactatagggatggataatggattattgatggaatatgtattttattacggtcataagcttatagcatgttgatggtgaaaggggctttttcataatttgttttaaaatgtaacgagttgtggataataatgtaaatcgttaattctacttggttttatttcattttggaaaaaataggagacgtaaataaactttgatcgatttttatggtgaatatccacactgtacatacagagtttttattgatcagaattcttttctttaacaaaagaaaacaaaacgttttgatacattttgcaatttagtagctgttactggttacggacttacggtatcattgcccatttcaatattccgaatttccaaagtgtgagttgttaagaaaatcaagatttttatgcttcggtctaaattttgtttccagaaaaaacattgattagttactaaaattgagtttgacctagaaaatggggtctgttcgttttctatttctaaaatcatgggccttcctttttccatttctataggcccatctaaagatgcaactcgtggttgatactagatagtgacttggtatgacaaggaagaaaagtaagctaaaatttgattaatctctattatctatgtcctcaactagaaagtaaaatacttgtgtacatttgaccaaagcgtatagttttagcatataataaaaagccagaggagtattaattaatggtaatcatagattttgtaaattaaagcattagatagaaagtcctttcagggaacattttttggccggctggatttttatattcagtaatctcgaatcaaatatccgataattgctaattaatttttatccctgtaaaactaataaaattgaccaattctatccgcaataaatcaattcatggacgatcaccttttccttgtgccacttgatattaagaaaccaattaagatatcattcaacgccattgatctataaattttcatttcctcttatgaatattaattttattcattacaacttcttgtatgcatgagatgacaaacactttttatttctcaaaaataaacttctcagttatgttttgcgaggaacaaaacaaaattctgtttttaaagtgaatcggatagtttttctttataatcatattgaataattaggataaaatgttcatatagctaagcactcaatcaactatatgaatgatatttaagaagttaatatacacacatagagacaaaaatcatattaaaacccctaattgacaattatcaattaacctaccgtttaaccaaagggaaacataaaagagtggtaaccataatcgaacatggaagccacattgtagttgacatatcctaaaggtccaaattcattaattaattcatgaattcatcacttataaataatcactcaccaaagtcatttcccttcaccacccacaaagccatg

SEQ ID NO: 23231 - DNA, 3000 bp, Unknown; identical to SEQ ID NO: 6395
  misc_feature (1)..( 3000): 2750-1469P.txt file - cDNA_ID_2134026; gDNA_ID_1621091; Annot_ID_170707

SEQ ID NO: 23232 - DNA, 3000 bp, Unknown; identical to SEQ ID NO: 6383
  misc_feature (1)..( 3000): 2750-1469P.txt file - cDNA_ID_2134041; gDNA_ID_1621091; Annot_ID_170711

SEQ ID NO: 23233 - DNA, 3003 bp, Unknown
  misc_feature (1)..( 3003): 2750-1469P.txt file - cDNA_ID_2134056; gDNA_ID_1621091; Annot_ID_170721
gctaaagcaaaattcttgggacttctttacggaaagtggaaagacaaagtcattcactgtccaacaaaagacactcacatgtccaaaataagggagcgaatcatcaaatctttagaaatctgagactgtggtcacagttcacaccaccatgaaaggagcttaaagctaaaggtcaaaagaggattaattctttacattgagaaagagtcatataaggacaaaacagaacacaacctgaaactggaaacttaaaatcgtattaatatcaatcctaacaaaagtctatgatcatgttctctatgtttatattctcttgactattgctatttctctcatcctatatattttctaacaaccctaaaacattaacaaaagaagcaaaccagaagcaacagaaacagaccagactaagctcaagatatcaaaatgtgaaatcagatgatgggaggaggaagagtctcccacacatcaaacacattctcctcactgtgcaatgcaaacaacctatccccaccaatagagaaatcacaaatggagccgccatagcttcttttcaacctagaagtcaaaacccagtctgatccacaaaacacagagatggaatcattcatagacgagaagagctggccttcatgcaaagcaagtttggggtaacaaggctcatcaggcatcttgcttttcatcaacctgctcctagaactccacctcacactactccctcctccatccatcctcagatcaataaaccctagatcttcaaactcattcaccacacatatcgaattgctctcttccattgctatcgcgtctctcactctcttctcttccgccattgtaagaaatccgatatcagaccaagaccagaccatgttcttctctcggaaatccaacaagctaatataacagttatctttccttggaaacaaagtagctacaagaagacaattcttaccactcaaccattgcaacttatcagcatctcctaaagaccaaccaggactctcgtaaaagaaatctacttgctttccagtactttgatcccaaactccaatcccatactcattacttcttcctttacagctcgtaaagatcttagaatcaggactaaaactcaaagctccagcactataactcttaacctgattatcatgactaacctgaaacttatacctaagctcaccagaagatgagctaaacaatcccattcctccatctcctcttcctaatctctcacaagcagagagtacaatgttaccagaatcaatccaaccaacatcgttcactctctggtaatcaagattaatcgttggatgctcctcaagcatccaatcaaagacatggacgacactcccatgagctatgcagcatccaccatccggaccagctcttatcgccgttccgtctccaggagctatgccggtgacggaacgagataggtggagtctgttaccgtcgaaaggtccccactttgcggttcgtaagtggtctattaagccgtagaacattgcttctttgtgaaggagacgctccgggatattaggcgggatgtttaagtctcctgttcggagaagatcgagaagaacagcgaagcaatctggattcctatcgatgaagagatccccgggttgtgaaagattccaattttcgtcgaataatgctccgaagaaggaatcgcgacctgcgttagcgagcgttgtcgctgtcgtttcgaagattctgccaccaacgttgaatttgatcctgtcatttgataaacccattatttctgatttctgaaaataggtgaaatcaatgatttttatggattcgaaccaaaagcattaatgacaagacaaggaagccatgaacgctcgaactcggattgaaaatattcgaaattcgatcggattcgaagaaattgaatcctgggaaaggataacgaaatgaaatctgatttatgattaatcaaattgaatacgatgatctggactctggatatttttttaaaaaaagctgagattcccagaagagaaaataaaacgatctgtcttggtctcggacatttttccgttgctcgggcatttaaaacgtaagaaacccaactggaacatggtgggacctactagagacaatactcgtgttactaccgtcagatgcttttagatattgtcgtctatcctgcggtcgagatttcgtgtaatttcaaagctaataccgtgatccatgataacgtttctaaagcccatatagatagatatcatcccattaacatatccttttttttgtatgctgaaatggggccattagaagccctgaagaaaatgaagaatacaaacaatttcgttttttccattgaaatattttgctattttcgtgctgagtcttatcatacattaaagtacgtatatgtttttcctctttcagtcactattttggaagaacgcaaaacaaactccacttttcttgcagttgtttcctctataaagtaagtaatttaccactgtactaatcttttcggggtcagtcatgatctaaactagatggatcaacacaacaaaaaattacctttgatatatcaaaattcgtagaacattgaccatattcattatgctatttatcaccacatcacatgataataaacaaacaaacatcctagatagtcttaagataaattttacatagtaaactaaacggaacacgtcaatgatttgacgtgacgcaggggtgattaacggagaaataaacggagttggtttaactatctacagtcaaacaaagactgaaagacattaatgccccttctttctctttcttttttggtatctttttttctttcttcttttgcttttaaagcagagaaggcataataaaggaccaaaacgcagcgttttcttccggagatcagtcggtcggaaagcggctacctttttgtctgcctagagaatttgttcgtttctttcttttactctcttcagacaaaacccacgagatacagaaaaagaggacaagagagaatcgtccatg

SEQ ID NO: 23234 - DNA, 3000 bp, Unknown
  misc_feature (1)..( 3000): 2750-1469P.txt file - cDNA_ID_2134056; gDNA_ID_2926199; Annot_ID_201686
aaagcaaaattcttgggacttctttacggaaagtggaaagacaaagtcattcactgtccaacaaaagacactcacatgtccaaaataagggagcgaatcatcaaatctttagaaatctgagactgtggtcacagttcacaccaccatgaaaggagcttaaagctaaaggtcaaaagaggattaattctttacattgagaaagagtcatataaggacaaaacagaacacaacctgaaactggaaacttaaaatcgtattaatatcaatcctaacaaaagtctatgatcatgttctctatgtttatattctcttgactattgctatttctctcatcctatatattttctaacaaccctaaaacattaacaaaagaagcaaaccagaagcaacagaaacagaccagactaagctcaagatatcaaaatgtgaaatcagatgatgggaggaggaagagtctcccacacatcaaacacattctcctcactgtgcaatgcaaacaacctatccccaccaatagagaaatcacaaatggagccgccatagcttcttttcaacctagaagtcaaaacccagtctgatccacaaaacacagagatggaatcattcatagacgagaagagctggccttcatgcaaagcaagtttggggtaacaaggctcatcaggcatcttgcttttcatcaacctgctcctagaactccacctcacactactccctcctccatccatcctcagatcaataaaccctagatcttcaaactcattcaccacacatatcgaattgctctcttccattgctatcgcgtctctcactctcttctcttccgccattgtaagaaatccgatatcagaccaagaccagaccatgttcttctctcggaaatccaacaagctaatataacagttatctttccttggaaacaaagtagctacaagaagacaattcttaccactcaaccattgcaacttatcagcatctcctaaagaccaaccaggactctcgtaaaagaaatctacttgctttccagtactttgatcccaaactccaatcccatactcattacttcttcctttacagctcgtaaagatcttagaatcaggactaaaactcaaagctccagcactataactcttaacctgattatcatgactaacctgaaacttatacctaagctcaccagaagatgagctaaacaatcccattcctccatctcctcttcctaatctctcacaagcagagagtacaatgttaccagaatcaatccaaccaacatcgttcactctctggtaatcaagattaatcgttggatgctcctcaagcatccaatcaaagacatggacgacactcccatgagctatgcagcatccaccatccggaccagctcttatcgccgttccgtctccaggagctatgccggtgacggaacgagataggtggagtctgttaccgtcgaaaggtccccactttgcggttcgtaagtggtctattaagccgtagaacattgcttctttgtgaaggagacgctccgggatattaggcgggatgtttaagtctcctgttcggagaagatcgagaagaacagcgaagcaatctggattcctatcgatgaagagatccccgggttgtgaaagattccaattttcgtcgaataatgctccgaagaaggaatcgcgacctgcgttagcgagcgttgtcgctgtcgtttcgaagattctgccaccaacgttgaatttgatcctgtcatttgataaacccattatttctgatttctgaaaataggtgaaatcaatgatttttatggattcgaaccaaaagcattaatgacaagacaaggaagccatgaacgctcgaactcggattgaaaatattcgaaattcgatcggattcgaagaaattgaatcctgggaaaggataacgaaatgaaatctgatttatgattaatcaaattgaatacgatgatctggactctggatatttttttaaaaaaagctgagattcccagaagagaaaataaaacgatctgtcttggtctcggacatttttccgttgctcgggcatttaaaacgtaagaaacccaactggaacatggtgggacctactagagacaatactcgtgttactaccgtcagatgcttttagatattgtcgtctatcctgcggtcgagatttcgtgtaatttcaaagctaataccgtgatccatgataacgtttctaaagcccatatagatagatatcatcccattaacatatccttttttttgtatgctgaaatggggccattagaagccctgaagaaaatgaagaatacaaacaatttcgttttttccattgaaatattttgctattttcgtgctgagtcttatcatacattaaagtacgtatatgtttttcctctttcagtcactattttggaagaacgcaaaacaaactccacttttcttgcagttgtttcctctataaagtaagtaatttaccactgtactaatcttttcggggtcagtcatgatctaaactagatggatcaacacaacaaaaaattacctttgatatatcaaaattcgtagaacattgaccatattcattatgctatttatcaccacatcacatgataataaacaaacaaacatcctagatagtcttaagataaattttacatagtaaactaaacggaacacgtcaatgatttgacgtgacgcaggggtgattaacggagaaataaacggagttggtttaactatctacagtcaaacaaagactgaaagacattaatgccccttctttctctttcttttttggtatctttttttctttcttcttttgcttttaaagcagagaaggcataataaaggaccaaaacgcagcgttttcttccggagatcagtcggtcggaaagcggctacctttttgtctgcctagagaatttgttcgtttctttcttttactctcttcagacaaaacccacgagatacagaaaaagaggacaagagagaatcgtccatg

SEQ ID NO: 23235 - DNA, 3003 bp, Unknown
  misc_feature (1)..( 3003): 2750-1469P.txt file - cDNA_ID_2134074; gDNA_ID_1971789; Annot_ID_175535
ctgatagaatggagtatgcaggagtgctttgtctgcaagcaaagaacacaatggcggtgtgttaagtgtccaatggctgctcatgataaacattctccatggtcaaaagaaatacttcacttaaaagaccaaccaggaagagcagtttgttggaggcatccaactgattggcggctagacacaaaggttgattttttagtttaccgctttcataagatacttcttgaagcttcttacgatttgtactttcatagagttttactcacaggactgacaaaatctctgttgattgagcagcatgcagttgcacagagtgagattgaggtcagtgtttctttgccacgtgccaaatgtgactgtagtaaaggaaactaattcttacatagacttgccgctcgaaaatcaaaaagagggaagagatttgaaagctggatattttgtttttatcttacacaatttcaagagctaggcactgaatgtttatctactttcttattcaggaagtcttttgccagttgcctttgccatatgtggaagaggagtttaagattgacttagcatggaaagattctgttgtgaaggaagatccgccttcttatgtgcacattagacgcagtatcctttatagtttccacattcaatatttctgccttaaaagtacataattctcattttttcacaacattagtgtgtcttttccttgactgagttaagatatttacctcgttaagaaaaagcgtgataatgctaatgatggtgttgggtgcacaaattgtggccctaattgcgatagaagctgtgtttgcaggtatatttgttaattaaccaaacaaattttctctgttaacattcatttcgttttgaatagtttccgttttgaaaaatttctctcagggttcaatgcataagctgttcaaagggatgcagctgtcctgaaagttgtggaaacagaccattccgcaaagagaaaaagatcaaaattgttaaggtaaaactagtctctagtttatgattcttgcattacactcttcttgtgtttttttatcttgacatgtcatgttattggttttacagactgaacattgcggttggggagttgaggcagcagaatcaatcaacaaagaggacttcattgtcgaatacattggtgaaggtaaactatcttgatttggtctttgagccttatgtttgtggtggaaagcgacagagtttttagtgatttgttttcactctatccacagtgattagtgatgctcaatgtgagcaaaggctttgggatatgaaacacaaaggcatgaaagacttttacatgtgtgagattcaaaaagacttcacgattgatgctaccttcaaagggaacgcctctcggtttctgaaccacagttgcaacccaaactgtgtattggaaaagtggtaaagcatatattatttcatataaatatgtcgatgatgctcgagtaagagagcatgagtcagtttgattattttgttctaacaggcaagttgaaggtgagacccgtgtgggtgtctttgcagctcgtcaaatagaagcaggagagccacttacatatgactacaggtcaagttcttgaccatttgtttcttttatgtgcttataattagcctaagtaatctgagattctgatatattagcttctctctttgtgtaatggcagatttgtgcagtttggtcctgaagtaaagtgcaattgtggttctgaaaactgtcaaggttatcttgggacaaagaggaaagaaccaaactgtttggttgtatcttggggagcaaaacgcagaagattgtttcaccgacctatagcccgtaaaccgcagcaagattagctgcaaaatatctataaacaatgtgctttgatagtttgtctgttgtcgttatctagtaatctctgtggagatatagaaccaatcgtgcttgtaaccgaagcttaggcccacaattgtataactgctagctgaagccacgggatagaccggtcggttataccatacattctttcagttccattacaacacaattattatttaacccttgtcaaatttgaatctgatttaagaaaatacattcccttaaaaaaaactatctaaagatctcgcactatcatggcagaaaattcgacagaacaaattttttgatataaccaaacagaagaaaacaaattatataaagactacaatcatattacaaaatcgctatagcaatctaagtatcaagtttcatcatgtgactggtttcgctctgccttgagctcatcaggtgatcgagtttcagatcacgaccagttgattaagggtcggcctagtcccctttttttgtttttattacagaaaatacaaaagttacagagaatacaaggtcgggttgcagatcacgacgttacggatcatcgtggaatgtgggtagaaagactcataagactccatgaattcgatatgtacctcaatggtgcgaggatcaggtttcgggatacgtctttgttgttgttgaagtttctcgactttgttgtttgatgaaaatatgaaattaatgtattattgatagataagtaaacaacaaaatagtaaaacccaaagatgaaccaagtgacaaattgtgacaactacatggtagctatcctaattatcgaacataaatttttcatcaaaagtctttaacgaaccaagtgaatgacatgtttcaaagtcgaatactaattattgtactggtttaaaagatttgttccaaattgatatgatttaaaccagaagtctccgtatgaaacggagacttactcttcggcaagagaaggttttagtcaaaatccccattttttaaaaattctcaacaaaacgcctaaaaactgaaagtgcttattcctcttctccggcgaaccaaagatcaaacctttgcgagagaatttccctctttttcggcaacgagtatatccaatcagcaaggaattttatgatcgcttgataaattgaaactatttggagtgggtagtgatg

SEQ ID NO: 23236 - DNA, 3000 bp, Unknown; identical to SEQ ID NO: 6389
  misc_feature (1)..( 3000): 2750-1469P.txt file - cDNA_ID_2134074; gDNA_ID_1621091; Annot_ID_170730

SEQ ID NO: 23237 - DNA, 3003 bp, Unknown; identical to SEQ ID NO: 23235
  misc_feature (1)..( 3003): 2750-1469P.txt file - cDNA_ID_2134074; gDNA_ID_2926198; Annot_ID_201645

SEQ ID NO: 23238 - DNA, 3000 bp, Unknown; identical to SEQ ID NO: 8387
  misc_feature (1)..( 3000): 2750-1469P.txt file - cDNA_ID_2134078; gDNA_ID_1971789; Annot_ID_175533

SEQ ID NO: 23239 - DNA, 3003 bp, Unknown
  misc_feature (1)..( 3003): 2750-1469P.txt file - cDNA_ID_2134078; gDNA_ID_1621091; Annot_ID_170732
gcagccgcgaacagaacacgataagtcttcccccgggtacaccggcttatggcaaacaagacaatcaacctgacaccaaatcccatatagtcattatgtcaataaatctaataacttagtcactaattgacttgaagattcgaatgactttaaaagtaaactagtagtcaaacaatatctaaatgaatatgagatcttacacggacatcactaaagccaaaaaaaggtgatgaattcaattcacagatgcaatatacttcaaacaaacttcataactcaagatattatgtatatcctaaaatccaaatcccatgtagtctatatgtcaataaatctaaaaacttcacaagtcattaatttgacataacaaacaacataccattttcttggcaccaacaagaaaaggaaggaaacatgtcgactctgaaacaccagaagccactcttctcttgacccaatccttcacatgatcatccaagacaaaccctttcttgactctgtcagacggattctgtttccgggtaaaagcagtgactccattagcaattttaatgtccttgacctcttcctccggtggaatcattggtaaatgtttcccattgcattctccggctagattttccggggaattgatagatttggctaattcagggcctgaagccgccggaagaaaagaagggcaacaagtgagagcaacagatgcagacatagacatgtttcccagatctaacatcctaaactcgaaagtacaaaagatggaagagtaagaagaagaagacagttacgttttgtctttgttgggtaggcgaaaagcgaagagacatgaaaaaatatggagggaatttaaggcgggagatttgtcctaaaatattatacaaaaaggtccttgtattttaaatattgttttaattgcccccaaacattttttctgctagttaaatttctttaccaactaaaatcccccacattcatatctaccaataacagtgctacacgcaatgattaatgccggttcccaaaacggaactgaacaaatagctaaaattaatcaaatcatgatttgaaagtatatcgtattgatcagtgttcggtttgttagttataaacaagatatttcgttttcgtttttggatatgtttacatgtcattttaggttcgttatgtcacaacttaaatcaaattatatgctttctaggtatgttttaattaattactctcttttttttatcatacatctttacagactcacgaaaaatgatctatgatttcatctagtgaaagataaatggattaatcagtttgtataacatcttaatttcgtttttttttttcatttcgttagtgtctattgtctaaatttcgataattcagttttcatttgattactatactcaaacaaaatacctagcgtaaattgctttgttagaccatatttagcaacaaaatctaataaagtattgatctttgagtctaggtttccacagttcaccacgcaatactcacctttctttatacactttacaaagataatgagtaatcgttaaataatccaaagaatttactcatccatgtacacatagtttatacttaatcctcttagcaagaaattatggcgtctaagaatcgatttagatgaaaaacggaccaactaagcaaactagaatatatgttcacttcacgacaactttgtatataattatacacaaaacaatatacattcattttgtatgatatacaacaaatcttttgaaaatactacactcttttctttaatgtatttttaggctaatgttgaaatattcttgtatttatattatgaaatttgaattagaccggatcaaaccggatccacgttatcttgattttaaaatgaagaactccaaataaatctagattacaaactgattatcatttgctaaaaagatcctaaaggttatcatttgagattcagcaggcgaacaacaaaaattattactatattcgtacggttccattcgatttttgttcactcatttgttgttactacactttactactcaaaatttgttaccctcgtttagtccgattcgatggttcctcatcgttcattgcggtgaattactatgaaagtacaaattaaaaataatctgaaacattgatgataacaatgtagcaatgtagtcgtaacatgccaacatcgaattctgggccaactatattttgctttggtaagcgaaccattcattcagtttttaattattatatccaattgtttgacgcgttttaaataaatcaataacataatccatgttcataccaattaaatatagatatgtatgtacgtgttgtcttgtcttatgaatcaaccctccttggagaatcttatgccataaagccaataaaaagttacctactctttcaatttacctcgttcgtttaatctgttttgatcaacactccccatattatcaaatcatttaggaaacgtataaatgaaacgaaaatatatgttttagttactcaacaatgttattaagggtcaggcaacaaaaaaatcttgaggggtaaaaacaaagttctcgatttaataattatagactataggtttaaacagagacccacaaattctgcatttctcaccttccaactgtaactttaatatttgtttcaaattgacacggcgggtaaaaataatcaggtgtatcctccctcacactaaggcgaaactaacatactaataaggaagagacacgtgtaaaaaagaccggtcaaagacgctacgtagataaaagtcacgaagcttgctcgtttttaaaattcaaagaggtttcatctccgtataagtaggcgacgaagcataccacgaagatcgaaaaaaaacaaatcagattctcaaatactgaaaataaaaagaagaagagagaaatctacggtggtgggtgattcgccggagttcaatttcgtagctagatttctcctccttttccccccgacgagctgtgcgagagagggaggggaatcatg

SEQ ID NO: 23240 - DNA, 3000 bp, Unknown; identical to SEQ ID NO: 8387
  misc_feature (1)..( 3000): 2750-1469P.txt file - cDNA_ID_2134078; gDNA_ID_2926198; Annot_ID_201642

SEQ ID NO: 23241 - DNA, 3000 bp, Unknown; identical to SEQ ID NO: 6405
  misc_feature (1)..( 3000): 2750-1469P.txt file - cDNA_ID_2134086; gDNA_ID_1621091; Annot_ID_55526

SEQ ID NO: 23242 - DNA, 3003 bp, Unknown
  misc_feature (1)..( 3003): 2750-1469P.txt file - cDNA_ID_2134086; gDNA_ID_2926198; Annot_ID_141395
atgctgccaatatgttgtttgattcctaaaatggaatcttttttaggatttattcagttcttttcatagtaatgtggtatcgattagtctgcgtctaagatgaaggttcttactttgtctctctataggaccaggatgttcatctgttgcatatggtgaagcagaagagataggaccatttcacattaaggcagatgggaagactctttaccttaatcaatattcttggaaccaaggtaatgaagtaatatgtgctgtgtatgttggcaagagagctatgattcaaaaaaagcttaaaactttcgaacaacttttttgtttgcagctgcaaatattttgttccttgatgcacctgttggagttggttattcatactcaaacacctcgtctgatttgaagagcaatggtgataaaagaactggtaatgatttagctgcttaagctcatgtcttttagatcctcatgtttgctgggtggatttatagtttcagtgttatgaaattcacagccgaagattcactgaaatttctgctgaaatgggttgagcggtttccggaatacaaaggaagggacttttatatagtaggggagagctatgcaggtaaattcaaagctcatctcattttttaatccattcattttgaccataaatactcatgtgtttcttctggtttgttttaggacattacattcctcagctgagtgaagccattgtaaaacataaccaaggttctgacaaaaacagtataaatctgaagggttacatggtgagcctgtcctcttattgatccccctatgattcattttctaaaaggttataaaactctaaaacaatgttgatgaatgtgtggatgcaggtaggaaatgggctgatggacgatttccatgacaggcttggtcttttccaatatatttggtcgttgggttttatatctgaccaaacatacagcttactgcaacttcaatgcggtttcgaatcgtttattcactcctccaaacagtgtaacaagattctggagatagcggacaaagaaataggtaacatagaccaatacagtgtcttcaccccagcttgtgttgccaatgcttcccagtcaaatatgttgctaaagaaaagacctgtaagtggccttaaaacttctcttttcaatgttacactctttagtgtcctaatttctctgtttattttacttagatgactagccgcgtgagcgaacagtatgatccttgtacggagaaacacactacagtttatttcaatcttccagaggttcaaaaagccctccatgtcccaccaggacttgcaccatcaaaatgggatacttgcaggtaaaattgccttgcaatatcttagaaacttggttttggaggaaatgagcctatttaagtattgtaacaattctgatcccgacagctttggttatgcagtgatgtcgtgagtgaacactggaatgactctccttcctcggttctaaacatttaccacgagcttatagctgctgggcttcgtatctgggttttcaggtctctttctctaaatatatccactgaaagcactttaacgatatcttttcttcaagtgttttggcgttttggtggtaaaaagaaaaggttttgttctttggtaacagtggggacgcagatgccgttgtaccagtcacatcaacccggtacagtatcgatgcactaaaccttcgtcctttgagtgcctatggtccttggtacttagatggacaggtacaaaacaaaactcaagatgagaaaatgagaatccttttcttatgttataagaaaaacttataaacagtcatgatttgaaacaggtgggagggtggagtcagcagtatgctggtctgaactttgtgacagtgagaggtgcaggccatgaagttcctttgcacagaccgaagcaagctcttgcgctcttcaaggcttttatatctggaactccattgtccacacatgagaacagcatcagccgcgacatgtctgaactcgttagtgactcataatgagttctgatttgatgtaatgtgtgatttggattctcaatcaaaaactttccacataggccgttgaaataagaagagggaaagagaataaatcagtgttttaagtgatacgttcaatgcttcttcttcttctggttgtttgtttgtttggataaacatttgctgcttggaatctaataaaagaagtttctaccatttgtcagccatacgatccttgaataacaacaacatattcttgtgtaatgagaaagtgaagtctgatctgtgatgtataggactgggtattaatctggtaacggatataatactggggtagaaaatagaatttagactagtattgggggtctaaacgaaattatacagaagcattgggcttgacttggcccatgagacctaagcccatattttaaagaattaggggtttcttcttcctttgtctgttcaaattgaagaaacctgtttttttttttttttttctggaagtgaattgtcttgagttgaacattgaacttcaattggtcggaatctgcaatttctgaggtaaaggtttcatttttaacctttatttgtttgggttaagatgagatctacgacgttttgaatgaggattcggacggttgggtgtttcaggtttgggctcagtgtcttctctcgcgcgtccctcttcaccttcttatttctacctgtgagtctcacttttcttctctccggtctttagcattctattgaatagaagaattggcatatagctattagctattttcctcagatcgtgttttaggcgactttctgttctcgcttgcttaacattgtacttcagtgtcgaattcatatcctacacatgagtctacataaacattgtgctttatgcttgcttccttagttcctcagaaatccttggaaaatccgcagatttatcttcttcgctatctggaattgttttcttcgtaggtttcttctcgttcatgtgtttttccctattgggataatg

SEQ ID NO: 23243 - DNA, 3003 bp, Unknown; identical to SEQ ID NO: 20111
  misc_feature (1)..( 3003): 2750-1469P.txt file - cDNA_ID_2134143; gDNA_ID_1620708; Annot_ID_165360

SEQ ID NO: 23244 - DNA, 3003 bp, Unknown; identical to SEQ ID NO: 20111
  misc_feature (1)..( 3003): 2750-1469P.txt file - cDNA_ID_2134143; gDNA_ID_1620674; Annot_ID_164201

SEQ ID NO: 23245 - DNA, 3003 bp, Unknown; identical to SEQ ID NO: 20111
  misc_feature (1)..( 3003): 2750-1469P.txt file - cDNA_ID_2134143; gDNA_ID_2926210; Annot_ID_202548

SEQ ID NO: 23246 - DNA, 3003 bp, Unknown; identical to SEQ ID NO: 20099
  misc_feature (1)..( 3003): 2750-1469P.txt file - cDNA_ID_2134158; gDNA_ID_1620708; Annot_ID_165366

SEQ ID NO: 23247 - DNA, 3003 bp, Unknown; identical to SEQ ID NO: 20099
  misc_feature (1)..( 3003): 2750-1469P.txt file - cDNA_ID_2134158; gDNA_ID_1620674; Annot_ID_164207

SEQ ID NO: 23248 - DNA, 3003 bp, Unknown; identical to SEQ ID NO: 20099
  misc_feature (1)..( 3003): 2750-1469P.txt file - cDNA_ID_2134158; gDNA_ID_2926210; Annot_ID_202554

SEQ ID NO: 23249 - DNA, 3000 bp, Unknown
  misc_feature (1)..( 3000): 2750-1469P.txt file - cDNA_ID_2134173; gDNA_ID_1620708; Annot_ID_165381
tctcgctctgctttctgggaacaaactgcttccttcttcacttccaccaccatctcagctcctctgtaattagacgaaactatgaataaacatgacacagccatgtaaagttaacatctttaagcactaaaacctgagattttgtcccgaagaagaagaagaagaagcagaggaatcatcagcaaaatcagattcagagcaagtttttggtttcattggttgatccatttgcaacgttaaaatctctaactaaactccaagaaagataaagagagagccactgagaagaagtagaagttggttttcgtcttctcattcttcttctacgtgaatatataaaaatccggcgataatggtggtggacgccgacgaggcaaatcaataacttgtgctccccacgcgccaccattgaaaagatatcatatgctacggttagttacaaacttacgtattcacgtgtcaaccgtcgattctactgactttagtcttctaagatctcaaccgtccaatcttagagatacccaatttcccctaaaggaatgatctttgtcgaacgaactacagtgggaagaaggagaagatgaagatagtgacttacaacgttaatggccttaggcaacgagtttcgcagtttgattctcttctcaaacttctcgattcgttcgacgccgatatcatttgcttccaggttttactcgacttttgaaatttcaatccttttcttcggtttcgccgatgaatccatgataagagtattactctggttgaatctaggagacgaaactgagaaggcaagaattgacagcagatttggcgatagctgatgggtatgaatcgtttttctcgtgcactcgcactagtgagaaaggtcgtactggttattctggtaagcatcaagctttgccttcagtggctttagagtgaaatttgagaaaatgttaaaaagttggagtttttatgttattgaaatttttgcaggtgtagcaacgttttgcagggtgaagtcagcatcttcaagctgtgaaactgctttgcctgttactgcagaagaaggcatcactggtcttgtaaacagtaattcacgaggtgggaagagtgaaacgtctacagtagctgaaggtcttgaggaatatgagaaagaagagcttcttatgattgaccaagaaggacgatgtgttataactgatcacggccactttggtatgactcaaatccttttctttttttaatgtaacttcttttgtgtaaaaatgaatctttttgttacagtttgtatgtctttatgtgttttgtcagttgttttcaatgtttatgggccgcgagctgtagctgatgatgctgataggatcgagtttaagcatcggttctatggtgttttagaggtaagtttatcggtttctgaatgtatcgatgagatgcttcggcttctaatgatacttggattaaatgttttttagttttcttgtagagaagatgggagtgtcttctgcgtcaaggaaggagggtatttgttgttggggatctcaacattgctccttttgctatggatcgatgtgaagctgggcctgattttgagaaaaacgagtatgtaactgattctcatgctctgtttaaatcgctttgctttacttaataattttttctctactagatatctcattttcatgtcattaaaaaaatgcaggttcaggaaatggtttagatctctgctagttgaacgtggaggctcattctctgatgttttcagatcaaaacatcctgaaaggtgaaattttgtgataacctcttctgtttctattattgagggagacagtctttgaaatttttgtttatcattgattgcttctttctggatttctaacaggaaagatgcattcacatgttggtcctcaagtagtggagcagaacaatttaactacggttcgaggattgatcatatcttagttgctgggtcatgcttgcatcaggacgaagataagcaggggcatagttttcttgcttgccatgtcaaggaatgtgacatattaacagagtataagcgttttaagaatgaaaatatgccaacaaggtaagtctagatgatcaagaatgatcacatgtgtgtttcaatttaaaagaataagtacttgagatttccttttttcattttacttggatctcaaatttacagtgaatcaacttctgaacacactacaggtggaaaggtggattggttacaaaatttaagggatcagaccacgtacctgtattcattagttttgatgatttaccagacatcccggaacacagcacgccgccattagcgtcaagatatcttcccatgatttacggtttccaacaaactcttggtacaagaaaattcctatatattccgctgtcttgtattggttcatattctcaagttattcctgtctctatcgtttttttataatttgcttcacttgtttttttactgtaacagtatcggtatttaagaagaggcgggccaatgaagaagccaaagccattgaggtgtcatgttcatcatcaactcaaagtaatacttcatcaatttgtggggatatttctacaggaccactgagaaattgtggttcgatgggaatttcacttgagaaatcttgttcttttgagaacaaatccacttccggcgttacagaagcagaaacggtggcagcaacaggttccattgataaccttagtgatggaatacgtgcatcatcagttagagctttgaatatctctagagatggagacaggaaaaaagcaaggaaaatccaatcatctcagctttctctcaagtcctttttcactacaaactcaaaagtaaacaatgtcgaggatagttcttcttcctatgtttcctccagtcccagctcccaagtagaaagcatcacagaaccgaatgtttcaggcaaagaagacagtgaaccgactacttcaacacaggaacaggatcaaacaggttcttcagctaaacaaaaaaacgatgcagctttaatg

SEQ ID NO: 23250 - DNA, 3003 bp, Unknown
  misc_feature (1)..( 3003): 2750-1469P.txt file - cDNA_ID_2134228; gDNA_ID_1620651; Annot_ID_163476
tgttgtagacacttggtgcagttttgaagagataagtctctactgcattgcacaaaaccgtaaatgcgtgagatagacgtctcaagctttcgtatcccggctgcatagtacaaatatgaagcttggtctatcatacgaatcatcaaagcctcccatgtaatttccaaatccgtcaagttagcttgaaaatctctggtatagttatcactcctcagaatctccataccaagggaactataaaacgagcggtttgagtaacgtacaagacaaactgttctatcaattctccagactatagcttctgtctgattagtacaattctgcaacaatctagcatttgaaggatgatacaatcagaacaagagtgtgcatcagtacctgggacacacatccctagaccatatgctctgtttggatgttccccgatccatgtcgtgtaaaagccgtcgatagctgtgacattagaggaagagaagaaagcaggactcggcggtttaagtcgtaagtactattgggtgtgaagaaaccagatctttcaaggcatacctgtgcagagacatgactaaagcttatgaccacaaaccagaagattactaaaaacttgaccattttatttactctttccttttttgttttgatgtctgaaattaaaacctcaaatcttggaagatgtaatatttatacaggcgtttcaatttcaacctcttgtgctgtacaaaatttgactaatcgtcattgaattttctaacgtagacttttgatgatgagtcaatgtctagtttaggtgacttatgtcttatacgagcctgattcacattttttaccactttgtaccatatgaattggtatttttcctccaatgtggtaacaaatcttgttgaagcttcatcaaagcaaaacagcaaatgcatgattcttgaaagggtattaaattgaaacttttaaaatgtttaagcatattatgaaaagttaaaatattagtggggtggatttgtagttttttaaaacttggagaacagatacatcttactgtcattactgaggcaacatcgagtacattcaccggaaaatggatgccggagctgaaattgatgtggttcggccggtggaggcagattcggcggcggaaattagtccggaacaagaccacgaaggaagatcggagccttcgtcgttgaaccaaggggagattttaaaaacacttgctacggtggagaaggattcgcaggcaatcgcggagagcttttcgtctctctttgtttccctccgatcaactctttctgaggttagaagacgcttctgtgaatcgatttttgtttcttcggttacattgcctagaaaatttgacatttggggaaaactaaagtctagggttcaaaatccatcaattttgtgaatttctcttttcatgtcataaattaagaaactttaggagctagcagagctcaaattatgagatttcatcaataaatggaaaaccaatttcaatgtttatgttttgagctgtggaatgatcataatcttttgctgcattgaaaccattgctaagtttgttcaatgtcctatgactgtttgttttcatgaaaactgtttcttttccttgtgtgtgtgttgtttatgagacttccttgatggtgttttaggctactggtagctcggttgatcacatggcttgctttggagaggcagcgggacggcttcaggaaaatggtaataacactacctgttttgagcaatagattcagttttccatttatatatgagcaatcaacttgagccacctttctttgttctatgaatttttttagctctagatgcagccaccaaagggaaccggtacatcaactcttgcctcaggtactttcataacggtctcgttattactctacgtaatcgcatagtccagtgagtcaatgtccaaatatgttgcttattagtttaagacagagatatctcacactttgtttcatctgaagttttaataagattcctgagcttgacctctaactttcaagatgcgtttctcctgcgtctttttgcttccggtatgatttcttttttggttcaacatgtagattaaacgaggaaattaaaggcgttgagaatttggcggctcggttgtatccttatatgtgtgtcaacctgtttgtgtctgaatgttgaacacagacacacatgtctgctcaaagctttcattatcgtattttagacagaaatttgttctagaatccttaataaatcaatctgcagaaagcacctgaggaaaaacgtggatgttcttgacacggctgtaaacaagcttctccggcctccatgagaagtcgtcagtttttcacagacttggatcacttttttattttttctttcagactttggattacgtatttctcgtacataaagattttgattataaaactgatgttaaatttcaacattacatattttctagggtttctggtttaagaaaaacaaaacactctgttttttaaactgttttcggtaaaccgactcgaaaagggattatttgtaatttattattgtttgtataaataggatgccaaaaaattctaaacttacgtttcgctccctctctaagtccctctcgctctttggttcttcttctcccgcaagattgaatctttggtttctttggattggtttcgtaagtgttcgcaccgaatcatcaaccatttcaccgctgggtatgttttctacactcgctcaaaagttttgatagtatgaactgaattatgggttttggagaattagttgtttaattgtaaaatagaaaactttatgattctgcttccattgattttagctggtgggtttgtcaaaatttcaatcttttctttgatttgatgattaatatttcattgaaatcatcgttgtttcaggttagtaggagtttgctggttattaagactttagtctgaatccaggcctggctcttggggtttgctctgttgctagtgcacagggtccaaccctgtctgaatcatg

SEQ ID NO: 23251 - DNA, 3003 bp, Unknown; identical to SEQ ID NO: 23250
  misc_feature (1)..( 3003): 2750-1469P.txt file - cDNA_ID_2134228; gDNA_ID_1620631; Annot_ID_162674

SEQ ID NO: 23252 - DNA, 3003 bp, Unknown; identical to SEQ ID NO: 23250
  misc_feature (1)..( 3003): 2750-1469P.txt file - cDNA_ID_2134228; gDNA_ID_2926182; Annot_ID_200320

SEQ ID NO: 23253 - DNA, 3000 bp, Unknown; identical to SEQ ID NO: 3195
  misc_feature (1)..( 3000): 2750-1469P.txt file - cDNA_ID_2134230; gDNA_ID_1620631; Annot_ID_162675

SEQ ID NO: 23254 - DNA, 3000 bp, Unknown; identical to SEQ ID NO: 19234
  misc_feature (1)..( 3000): 2750-1469P.txt file - cDNA_ID_2134230; gDNA_ID_2926182; Annot_ID_200321

SEQ ID NO: 23255 - DNA, 3000 bp, Unknown; identical to SEQ ID NO: 1331
  misc_feature (1)..( 3000): 2750-1469P.txt file - cDNA_ID_2134315; gDNA_ID_1620388; Annot_ID_155512

SEQ ID NO: 23256 - DNA, 3000 bp, Unknown; identical to SEQ ID NO: 1342
  misc_feature (1)..( 3000): 2750-1469P.txt file - cDNA_ID_2134327; gDNA_ID_1620388; Annot_ID_155516

SEQ ID NO: 23257 - DNA, 3003 bp, Unknown
  misc_feature (1)..( 3003): 2750-1469P.txt file - cDNA_ID_2134333; gDNA_ID_1620388; Annot_ID_155518
atttgcaaagggaagaagactttcctattcaaaattcaaagccgactttttttttacctaaacagcaataatatctttttttctctgctccagggggaaattaaaaaagtggaaccttttcatctcctggagcgatcaatttctttttcatcatatcgctgactctcgtcttcgtcgtctttgatcgtatcgaggaattgggtttagttcgattcgatcatcagctatctcaatttttctggggattgttctaaaggtttgatgatcggattgcttttgttctatttgttctttttgattctcgtatatgattgattagagaatataggattagggtttgtgttccttaaaagttatctccttttggcagttaaagacttggtttttattctttgtcaagaaattcattccatggttgacgatgaagtcaaggttttggttttcttttgtgtttcttctgtatcaattgtatatgattagattgaagatgatttcatgtgatgaagttgattacaacggataataccgcttgtgaggttgtatcataatttgctaagaataagtatatatcttcccatttgtttcttgatgcaaacaggtttctagtgacttgtttaaagtggttggtattggataatgccttctctcatctcacagcaatggcaggagaggactagtggattcttttcttcatcaggtttgataatttctatgctaacctcatttcgtttctctctgtgagtgtttatggtggaaagcttactatggagttactgaattaggaacgaagcttagggaagcagggcagactgctggtagttttgtcggggaagttgctaaggatgcgaaagtgaatgttgcagatgttgcagaaagagttgggtcgttgtttaaaagccggtgggcaattcttcagcagcctgcaactagacatgccgtgcaagaacacctcataacagctgctgccacaaccgggacttttgtcaggaagggtataactgagacaaaggaaaaggtttctgttggaaagatcaaagtggaagaggtattctagacacatagcttctcgaagttactcgacaagaatgtatgtatctcgtttcattcttctaacttctgacagctaaattctttgtatccatgttttctctttaggcggccaaaaagactgcacaaaagagcaagaccattttgacggatatcgaaaggtggcaaaaggtatttgactattagagtctgaaatctgattgtatgccgttgatttgagtttggtctctaatatctattctttgtaattctgcagggagttgccagctcagatggtaagttgatcgcaatatatggagagattacagtttaaacgtttgttaatcgaaaattcaatggattctttgatgtggggatacttaattatattaccgttcttgagataactattagtgattgcgtgtctgaaatgctgtgactttctctgtatgacaaatgtttttggcactcagtgtttggtgttgcgattgagatcactgtccagcggcaggagtcaagcaggcctattcctctgatactagttaaatgcgcagattatctcatattaacaggtaataatgtttggaccaatggagcaataacacttttattgctcacaccttctcatatcgagttatcaatgtgatattttcctcttacccaggacttaattcaccgaacttgttcaaggccgaaggagatagaaagttgattcaacaattggtttctgcttacaatcaaggtagcaagatttcttttcgactcttatggctcatggagaaattgtcatttaattgaatcacttgtttggcagatcctagggcgtcaatacctgagggtgtgaatccagttgatgtcgctgcactcttgaaatactatcttgctagccttccgacaccactaactacttttgagctttataatgaaatcaaagatgcacggtcgagcatacacagaatgagacagtcactccagaagctttccaatgtgaattataatacattggagttcataacagcgctattgcttcgtgtgagccagaaatcacttcttaacaaagtgggaataagttgttataacactaatctctgattctagatacttaagatgatccttttttcaggaatcatataagttatctgaatattgggaatcatttgtttgcattttgcagatggattcgcatagcctagctatggaaatggctccagtgatcatgtggcgagaagacaacaggcctgaatcttatcgggaatactggagacgcccgtcaaggagtcctaagaaaagtaacgactttgaaactgctactccatgggacttgctctcaggtaaacacaaaaacacttggctcctatactctttgaagcacagtttcattacgatcattcttctctttcatggttaatggttataaacagatgaaggagaaggtccagatgcatcctcatcaatccctctagatgatatcgcacgagttgattttggagcggtcgaggttgtccagtgcctaattgaacaccacaatgcgattttcactgatgcagccgagactgtatggaggtgaaaccaccacagttaaccaatattgatctggttacaagaacatatgcattttgatctggatgatgattgactagtggtttcagtaaataagatgttgtttcatatttggttcttctgtaacaatttttagactttagaactctgatgattaaaagataagtttttcttataagaaaatcaagaattcggattgtttcccaatcatataaagcaacaaccggatgtgaccgcaattcgttaaaactcttatccaatcgggttatcgaaatcgaaatgaaaccaaaccgatttaaccgaaccgtattgactcatgagcagaccaattgaccttagagtcaaacagagcaaagcagagcagagcacagacatacaaatttccatttttgtagcttcttcgagctcacagccatg

SEQ ID NO: 23258 - DNA, 3003 bp, Unknown
  misc_feature (1)..( 3003): 2750-1469P.txt file - cDNA_ID_2134376; gDNA_ID_1620388; Annot_ID_155528
gcaaaataaataaataaaataaaatgaagttgaattgtctgaccgctatgactaaagaagcgaccactcatcaacgccatcggccatagctgttaattatttgttggatccacgaaggagcttacacatcaacttgccaaaatttacacttataattgcaatcaatacaaaggtttcgtcaatataattaaccacactatgctacatatcgtcgaaaattgaaactaatttatccggtaacattttgaagttgtagtttcatatagcctgcagatactgtggtttttgtttaattgcagtcttttgattcactctttgttcgtcgcaaacttgcaatacttatcagattttattttgcctgctaattatctctagttcatatctttcatttcacatattgtgtcgattttttcaaattgatatataatagttgagttccttttttcaaatttgtgtgtgtttacgaaagaagaaaagtaaacgaacgaggccaaaaaaatgtgaaattttttaatacatacaaaaaagatgtgaacaaaaaaagcgaagtaacttggcgtgaggtagagcaacttcactaacaaaggtgtcagttgcatgcatggacaggacaaatactctcttcagtcatgtgtcgtacacgtcgatctcaccactggacccactctttaatacacaatcagattacgttgtaacaaaatttctattactgccaaatgcatttctttggcacgaaagacaaagctcctatttatgccggtatagccgtcgtatccttcatgatcctcaccggtttaacctttgccggtacggccgtggctctaaccgttatgataccggttttggtggttcttagtccgattctcgtaccggcggtaatcacatcgagtttcttggcaacggggttcctagcttctggtagcctcggagcattggggatcgccctcctcatatggctctacaagtaattacttaagttaaagtaactaattaactcttctaatgctttgattgtaccaattgaaatttgttcatacatgcattgaccacatttttattttgtgtgttagttaacattatgtatgtgtgaatgacacttaggaaagaagagtattccagagctactttgcatgcacgaggaggtaggcctgatgggcctaacaagctggcagaaagtggcaagcaatcaggaggagataatccgttgaaggaagacaagccgccagaaagagataagctgccgagaaaagacaagccatccaaggaagacaatctgctgaaaggagataagccggtcgaggaggataaattgccggctgaggaagaaaaaccgccacaaaaagataaaccggcggagggacacaaaccgccacaaaaagataaaccggcggaaggagataaaccggtggaggaagacaaaccgccacaaaaagataaaccggcggaaggagataagcatgtggaagaagatatgcctttaggaggagttgagcatttgtcaatccctgagataccaaaggtactatattagtgatgttcaaattttttcgttaatgattttttcacatttagcaattgccgggaaaagaatttggattagcaagattaaacactgttctgctttaatattcccttcataaattaatggtaggttatggtggtggagcaaaacccaattgtccccaagtgttgcggcccaagtacttgtactaaaaggtgtcacccatttcgattcgccatggatgctaatgctactaaagcacgatctatttttatgaaagaataccaaaaagtcccccgtgtaggagcttttgcatataaatattttacatctcgtgacaaaaaatacgtaaaccattttcatatatgacatttgggacttgggtggttattattttaaagggtacgcttttaccttataaagagttcaaacgaaatttatcattttgaaggtattaaatactataagctaatgtgtttttgtttataaatatgctgctattaatgtactttagaaagcgtaaatttcagttatgaaaaaacacattaaacaggtggaatctctcaatttgtcagattaccatgtttttttattttattttaatatataaaaattgcaatcggaatcttagtcgagattaaataaaaatctaaaactcagaacctactagattttaatttttgatcaaactaatcatattttttaccaccgtagattttgtatgtgtcacacactgactgcaataaacaaataaacaaaaaaggtttccctaaataaggaaacgaggactttgttcctatattgatctaaatttccaagtatccaattagatctcaacgcgtttagattggatcgaattatatcacaaagttatttaaaaaaattatactctgaatttatcgcaaatatatataggagtatatatatgtaaaaactttggaagaaatagaaatatgggtaacttaggaaatatgagatattaactaatatggatgaagataaaagtaagtaaattccagttatattaagattaggattgatattgataaaaatatgggtaacttaggaaagaaaataaaaaaataaaatcgaatatacgatttaatatctctcctaaatatccgggatcaatatccagtacatgtttacctggaaaacaatctaacggctgattttccacgaatcctatcttaagaaaatgttaaccgtcgattatgatcctacgctgattctgctggatttttccttataatgacttgggtaaaaacttccaaataaaacaagataattaaggaaacgctttatctcttaaggaaaataaaaaaatgtaaaaacaccaaggacattcacaaataacagctcacgcatatccgcatatatatatatatatatatatatatatatatcattacacaagagagtttaaggtataaatacaattagcgagatcttgtgattctaattcttgtgataccgaaaacattggtggcgagagagagatg

SEQ ID NO: 23259 - DNA, 3000 bp, Unknown; identical to SEQ ID NO: 1334
  misc_feature (1)..( 3000): 2750-1469P.txt file - cDNA_ID_2134378; gDNA_ID_1620388; Annot_ID_155529

SEQ ID NO: 23260 - DNA, 3000 bp, Unknown; identical to SEQ ID NO: 1346
  misc_feature (1)..( 3000): 2750-1469P.txt file - cDNA_ID_2134423; gDNA_ID_1620389; Annot_ID_155550

SEQ ID NO: 23261 - DNA, 3003 bp, Unknown
  misc_feature (1)..( 3003): 2750-1469P.txt file - cDNA_ID_2134512; gDNA_ID_1620393; Annot_ID_155674
aacttatgaactttaacccatttgtttaataagtagcaaatagtccaacaattttatttagagtacattattataaagaaaatcacattacataacattaattaaaaatatatatttacgatacaattgtagacatataattctcccacaaatgatcaattaatgcattccgaagtgagaaatgagtttctttatccttaatttttctgaatcgagcgagataaaagttgtttttgcattttagtttaattggattaaaataaaagaaataatttgtttagaacaaaataaatactttgttattatttgaaggatcattttgtaaataagaaagttcaccttcaaaaaatgaagatgttaatagtataccttcaaatatgaagatacactgttcaattcttcattttgaagataaaaatgaagtaccattagagaagaattcttcatttttcacttcaaaatgaaggaaaaggtgaaaaatgaagcatcattggagatggtcttagctaggtcggctgattaattggctatcggcccgtccttcttcttgctacctaatatgtgacatattgtggctttttgttttactcctttaagtcatctagaatttgtttatatatcaaaagatatgcgaacagttatagatggattagtttgcttatactaaatatttttgtatagaacatcaaattgcatatgctttttattataaatataagtcttcctacacaatttcgctctctcaccaacaaaatggatgttgaaccggctggcctacttccttgcgagaagaaattcaatgcattttttacttacgttgtgttttgaaaagacatgatgattatgtaaataatgtttttgtttattacatatgtaaattaacatattttataatttgttttttaaaaatgtataaatggaaggccaattaaagtccttgagtatcaatacatgaaaaaattgctacatacatattttctgacaattttaacttttcctagaaatacataccaaatcacaaacccgagctcatttctattttatttgttcttcattttgaatgtacactgatgtttgtccccaaaaaaaatgtacactgataaaataatttaatagaatgattcaggatgtcaacgcgtcatcaaaagttcaagactactggaccaaatggtccaacaccaaccttatcgtaatttatctataggtgtgttttcaaatggataaaagattaaaagacatacatgatccagatagatgaaagcaaatgataagacttaatataaataataaagaatcgtactgattttttgtttgtaatgtgaaatagaatggctcgcaactcaaagtgtcagactctatctatgcaaaaaatgtcaaagacacgcagcttgtttatataccattcatattgccaaacttttggaccaaaatatttttattaagatcatataaacacaaagagccaacccactgtgatcggtgtgataaaatcccaactacttggagcaacatgtagtttacattattaagctgaaactctaaagatcatggaaatatatcaatcatatcactgtagggtaagtccaaaaatagaggtacgtacgaactacgaagacaacataacgttttagtttctaccaaactttattgactaagtacttttttttttaattgactaagtacttcatatagaagtgcaccgattattgcaaacccttattaatggacggcaaagaagagaaaatgacgacagcttccagcttcctaactcctaattgcatatatggactatggtaggtgtccttctcgtcagatcacatgtttgggaagattaatcattggataaacttaaaagaattgaattatgattagaagttatctgaacatttacttttgaaaataatatattacctaacaaactagtattattttggctaacgtcctatagattgtgtttcgaatagttttggaccttttggtaatagaaaaccaagtaaatgaagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttcaatg

SEQ ID NO: 23262 - DNA, 3000 bp, Unknown; identical to SEQ ID NO: 1369
  misc_feature (1)..( 3000): 2750-1469P.txt file - cDNA_ID_2134555; gDNA_ID_1620393; Annot_ID_155686

SEQ ID NO: 23263 - DNA, 3000 bp, Unknown; identical to SEQ ID NO: 1362
  misc_feature (1)..( 3000): 2750-1469P.txt file - cDNA_ID_2134579; gDNA_ID_1620392; Annot_ID_155635

SEQ ID NO: 23264 - DNA, 3000 bp, Unknown; identical to SEQ ID NO: 1353
  misc_feature (1)..( 3000): 2750-1469P.txt file - cDNA_ID_2134699; gDNA_ID_1620390; Annot_ID_155576

SEQ ID NO: 23265 - DNA, 3000 bp, Unknown; identical to SEQ ID NO: 1380
  misc_feature (1)..( 3000): 2750-1469P.txt file - cDNA_ID_2134760; gDNA_ID_1620394; Annot_ID_155698

SEQ ID NO: 23266 - DNA, 3003 bp, Unknown
  misc_feature (1)..( 3003): 2750-1469P.txt file - cDNA_ID_2134766; gDNA_ID_1620394; Annot_ID_155700
ttggagtataagagatttcattcgaccatactcatttgtccttatcttaaaatactttatttcgtttttgtcttcatccaagaatcaccatatcttattatccattttttttgggttcagctagcaagtagcatcccttcgatagactgaggagaaaaaataaacaattatctggctcttaccgaatctaagattttggccattttctcccctttttcttttgtgcaaaccattacaatatctatggatagatcttcatatttcacatgtatgatatatgaatgattccactgcaataagttatcaaactaagagacggcaatgtttttttttcttaattcatttcactgcaatgacgttattttattgttgttggtgagatatcccggctgcgagtttgaagactcttgtatagatgatttgaagacactaaaatatttcttctcatttcattaatttgataatattttaatagtgtgttaaaaataaaatatatatacagtatactccttctgttttataaagattgtcgctgtattttcaatgcacaattttgaataaaaatccatttttaatcctatttctttagtgtattaataagagagataattttgtttagtatattattaattaaggggtataatctaactttttaatagttttcttaatagtttttgtgaaaaatatagaatgatatttttttgtgaatcaaagaaaatataaatatatatttaagtattgtgaacctaaacccgactaattaatctcaagattcgggacgagacgattgataatattataagactgcaaaaactatccctcgaaagaagctattgataatatagtagaacatgaaatatatcatccctaacaaaaaaaaaagcttgaaactaacttcttgcgctaaccactatctcacaacacctttggtaatccttacagttttgttactgaaatgaaattatgtcctttaatctgaatttgatgttttaacacgatactaataacaattaacaaaactgagtggtggggacattctataaacttgtttgcaatcttagtttgaccaatataattgacatattttgtgcttgtatatatgtttgtattgtacaaggacttgccaaagcctatatgccaaggtcccaaaaccaaagcctaagacccatgctcgagcatgtcattccttgttttacttggagttggaacttaattcatacatattgtatgtatgtgtagtatgatctaatttgaaaaatatttttaataattcacgttacagaataatttaaatttttacaaagtaattgtataaagaaatttaaatagaaagtctgtttcattacaatattattttattgtagtatttaaaatgaaaaatacgataacatttggtagtatttaaaaaactggtcatcaagtttttaacatttcagaatagcgactcagctattataggaatgttgaatccataaaagtggtgccagtctgagcataacatagacggatgaagaaaatcggaacgtgataatatttttcttatatcttagaaaataagaaaagatatgtggtatgcgtttgtcaatataattagtaagagaaacctttatatcttaaaagcatactttgaagtttcctctatttcagaaactaatatttttctaagtaaataatagaattcgttttcctttaagacttgggcatgttacgttttttgaagatgttaacaagatatttttggatgcctcttatgataagaacatccactttgtatggctgattgagttttgcaactaatagtattctctttgaaaaaaaatatttctcattattatttttcaaaataatatatcatttttttttttttggtaagtatcaaatttcctatgatatgtattcattttgaatacatcaacttcttattattgtaagccaaaaatgtaaaatttgatcacctatatttaatcgacatattagtgatatttaataaattacttgcacccatatttttttttttgacatctttgaatcgataatatccgatctataaccaatctctataatacgggataatacggcttaatggaattgaactctgataggaaaggtgtaatcaaaatggagttaaccacttaactaaaactacatccctgaccatatttttatttatttaaaagtgttctctccattaaacaaaggagaaactcttatacagtggaccaacaatcgataagaaaaacgactgaaacaattaatacaacataaaaatcgtgagctaaatattgtttttgcaggaatatcatattacgaaactagtcgtaagaatatagcggtatcaacaacatattatatgtaaatttacatttagggataacataacgattatcgacgatattaacacaaaccaaaagactccaaattcaggtcatttgtatacattttctacaacaatattttcttagtttgatcaaaaaaatattcaacacttgtgtaaagtttagtaacaatgtgaaaacgaggcttaaattggattggataagagtaaacgataatgtttgggttgggccaagttgttaatagtggaagatatagccatatagggatggcccaatttagtttatgaacttatgacttcccaaaagttgcaaatctttctttagattggtccaatttattgatattatagaattacctcacaaaaagaatataatgttgactatacaataggataatattttattttatacatacattttgaacattatttctatatacacaattataatttgcactgaacaagaagaaacagaaaactagtactaactgacataattaaataaaagtgagccggatcgtaattaaactttaaaccgggaaatttgataaccgggaagatatccacgtcagcagcacgataacaccgccatcgctttccttaatttaccttttctctctcgacaaagatattgactaaaagtcaaacagtcgttaccggaatcaatg

SEQ ID NO: 23267 - DNA, 3000 bp, Unknown; identical to SEQ ID NO: 1373
  misc_feature (1)..( 3000): 2750-1469P.txt file - cDNA_ID_2134792; gDNA_ID_1620394; Annot_ID_155707

SEQ ID NO: 23268 - DNA, 3003 bp, Unknown
  misc_feature (1)..( 3003): 2750-1469P.txt file - cDNA_ID_2134823; gDNA_ID_1620390; Annot_ID_155578
aaaacaagaaaaagtcagatagatttcatattagtgtggggctaattcacactcaaaaattagtttaaggaaggaggattgccacaatactgtacatatatattgtccaaagaatattatttcttctaatgtgggataattctaatatctccatcaaaataaaaccggtcctgaaattgtaaagactatcggtttaattttttttagcacaattcaatattttagggttttgtgcagagatgtcctacacggagaccgagattagtaaaaagaatttacagtcaatactcaatagttaatggtattggtttgtactagattcgatattttgtgaatgaaaatcgaatataaaaaaactttaacttgccaaattttgcaactttactgtttactcaaaaaaagtgcacattaatactacgaaatcttaaataatacgtaatatgactcttaaacgtatatagttaacgttttcactgtcacatatattaaatttttacgaatttgatggtaacgaaaaacaattatatttcgtattatttttgattttgatgatcaatatacattttggaagtaaagagtaaagttagaaaaagtgacaagttaaatgtttattttttacaaaacccaatattttaattaagaaaacaagatataaacgatggtgggaggtttagtttaaacaccttacctaacgatacctttactttggaaaggtttctaagcgggacataccactagactaatgagagtatgagactatgtactgtacacaaatattgagctgcaaaaatacagtaatctattttgaaactgcaataccaaatttcctttacttaggtttagtagtgcatggctcgactttgaagaaaatacttacaaagggtaaaatatagcagtacaaaacaattgaaatacttactcgtccatgtatgttgcttgatatttttattatctttccattgtcgttttgttattattattgacattgcaaaaaaacagaaaacaaactcattctaatcgttgtccaatcagtatgtcattgaaacaaaccaaaaatgaattatttttttatttaccaatctttttaagttaatcgtcacgaaagaaggagatcaattattaaaggaaaaaatatatatatatatatatagaaggaagatcgatatcacgtggttacgttaggggtggacatgcgggtatgttggtcgggttcggataaaactcgatcgggtatggaatttttggatataaaagtttatgatttagggtaaatctaaattagcggtttatttttagtttagtccaatcatatttgggtatagatttcgaggtctttttttcagaaccgatacccaaattattgggtaaatactcgggttttttggtaaataccgggatttttaaataaaaactttggatttcgagtaaaatttggatattcgaataagatttttgagtattttcaagtctgagtcgaattcggttacaattttttgagtagaaaagtttaaagaaaaattctttcaaatgccttttccatgatgccccttttcaactctacccttttgttttatccattttcatttctaccctctttaaatttttaatgaccattttacctctatttgaaaataattttaggttaataaaatgaaatattaatattttctcgccaaaaaatttcccgccaaaaatttttcgaaaaaaaatttcccgccaaaatttttcgaaaaaatatttttcccatcaaaagtttttttggcaggaaatagatttacaagggattttaaaagggttttaaaagatttacaagggattttaaaagtgttttaaaatatttacaagagattttaaaagggttttaaaatatttacaagggattttaaaagatttacaagagattttaaaagggctttaaaagatttacaaatgattttaaaatatttacagggattttaatgaggtttaaaagatttacaaaggttttttaaagatttttaaaaggtttaaatttgttttaaaacggttttaaaatatttacaagggattttaaagggctttaaaagatttacaaaagtttttaaaatagttcaaagggtttaaaagtgttttaaaagatttgcaaggaggggtttaaaagatttctaagagatttttaaagagtttaaaagagttttaaaagatatacaagagtttttacaagatttttaaagaatttacaagaaaacccttgaaaaactcttgtaaatcttttaaaactcttttaaaatcccttgtaaatattttaaaacccttttaaaatttcttataaatcttttaaaacccttttaaaatctcttgtaaatcttttaaaacccttttaaaatctcttgtaactcttttaaaacccttttaaaatccctcgtaaatctatttccagcaaaaaaaaaatttacaatgatttttaaaagcatttttttggctcagaaaaaaattgttacgaaaaaaaaaattggcgggaaacttttttttttggccggaaaatagtttggcggaaaatttttttttggcggaaaaaataaaatttggcgggaaaatttcagttttcaattacatgttcctactagatgagggtgatttggtcattctgttcaggggaaagagtatttttaaaaatggacaaaataaaaaggtattgttgcaaaagggtagtaaaaaaggggtaattttgcaaatctctaaattcaaaatccaatatggtaaaatctaaaattttggattcgatatcaaatccaatttttcggatactcggttgcagttctttttcccagccctaacgtagcacgtgattcctctgctttggtattttacgtcacaaaggtaaaaacgcaaggaataaccaaaaatgatattttctgtttcttttttgtttaccaatcttttctaacggtaactaaaagaagcagattgattataaataatcaacctcatctacacaaaaaaatattgaatcggaaaaaaatg

SEQ ID NO: 23269 - DNA, 3003 bp, Unknown
  misc_feature (1)..( 3003): 2750-1469P.txt file - cDNA_ID_2134849; gDNA_ID_1620395; Annot_ID_155729
attctacaacacctgggatggtcgatagagaagtggaatgagctatacaaggaccttcctagcaggcagatcaaggtcgaagttccagatagaacagcggttgtgaccacaagcgaagaaaccgaggctctgagacctatggggattcaagatgctattaattctgaaatcaagaagtactcgcgtggcagagcttttataaggccatcgggtacagaagatgtggtgagagtatatgcagaggcttccactcaagaagatgctgattctttggctaattctgtggctcagctcgtcaaaagcttccttggttcaagctaaagaaccatctgaatttctgcaagagtatgttaatgggagatttttttaattttcttgttcacctcttagcttttacatcttttgtgtaacccgaatgacaagttttcttctcagcttcttttgatttacttcgtttctcttctagctcttctgcttctttctcctcaacgtaaacctgtaaatgctttactttcctgaaaagaatcagcaacgccattactcttttttattaatgaagctctaagaacagaatgtttcttctcctgaaattgtgtaagggaaagatagttgttaaggaatcagtagcagctactttatagtaagatcataacaatggtgtacttgaagaaacgttatgccgtaatctttggcttaagagggaacatagctcatgccttttgttttcctgtcctatctctaatcaacttggtctccgacagtgacttcacaacaaacctaccacagaatcttcttttacttacaactttcatgtgagatcctatttgtgggtatgataaaagaacaacttaaccagtgacagggacttgttgttatgttgttgagaaacttcaggtccccactttaagttgttattaaatccatttagaccaaagagattagagaataggatcatcactgaacatggagaagagagaaacttgctggcttttattattgacaatagcatatgtcatatctaaaaaacattgagaagacagtcccttgtgaattgcatatgaagtttgtagtttaatgtcccacacactccaataattatgtcatcaaaacaaatttcattaatgcatctttccaaatggtaaagacaaagccatgttctctgttttagtatgtccaacgcgtcaaaaccacaagtttcaatgattttttcagagaaatttcaactccttagttgatcttgctatatatatactcacataactcactctttcaatcatcaaccaacaacaagaaatccaataacttgaatcttttcatacatcttcagaagcttcaaaaagaattcaaacattttaaacaaaaaaacaatagatatggctttcgtgagaagtctattgggagcaaagaagattctaagccgctccaccggagcaggatctgcggcaccaaaagggtttcttgcggtgtacgtaggagagagccagaagaagagatatttggtgcctgtctcatatttaaaccagccttcatttcaagctcttctcagtaaatccgaagaagagtttggatttgatcatccgatgggaggcttaacgatcccttgtcccgaagataccttcatcaatgtgacttctcggctccaatgatgatgatccaacattttttccttcagttagaaatagacttattcattgtaaatagatgagccctttttcctctttcttcttgaaagagttgttctaaaagtgtagaaagtgaaatacaaaattgatgttatatacaaacttcatgtcaatacttttttgattgatcattgaaaaagaaagacaacaccaaattcaccaatcaaaaactactctaattatagtttcatgttgattaaatataaataagtggaacatctaacatccggatccgtggcgcaatggtagcgcgtctgactccagatcagaaggttgcgtgttcgattcacgtcgggttcaatcccccgaactttactccggaaataccttttttttgtaacttcttatttccatttttgctctcttcgcttatgcttcgtttcatccggtttaaccaggaggctactctggtttggtaatctaattactctaaaccgaaagtccttagtactggttcgaaatctgaaatctaaaccagttgactcacaaccagtgaaatcaacgatcaagggccaagcctatcttcaattcatactcgccagtttttgtgcctaaaggttttttcaaaggataaacaaaggcctaaataattttgctaccacttgaacattaattcgttctcaattatgtaatatttaatcatttatcttgttaattattcttaagtgattttacttaatactagcctagaaacaatttcaaactttcaaattcaatctcacgggaagcatagggtcacatctatatctagttaaagactaacatttaaaacaaaatttgaatataatagtaaccaaaaataggaaacgaaaattagcatagagattccaacttttgttacatttttattcctagatataaacatcatcacattttctttataaattacattgacacgtaacgctttaactatggtttagatgtggaatacatgcaggttacatcttccgcactatctcatacaatcaatgtatctgttctgagacttttagaaatgtgaatctgttttgtgtaagattaaaaagtaaataaaattatataatttaaagtaaaaattggctgtaaaccagtaacaatagttaattcttgagacttaaagagtaaatgaagttgttagtcgctgtcattgtagtaaatcaagttactaaaactggcaaactactttgctttttgcgtgtctttgaagtcacaaaacagagctcctctatttagtattattgggaagaaaacaaatagaaagagaattagtgagtcataaatcagagagcgagagaaaagtggtgagacatagagtgggaggttaacgaaagagagaacgatg

SEQ ID NO: 23270 - DNA, 3000 bp, Unknown; identical to SEQ ID NO: 1390
  misc_feature (1)..( 3000): 2750-1469P.txt file - cDNA_ID_2134853; gDNA_ID_1620395; Annot_ID_155730

SEQ ID NO: 23271 - DNA, 3003 bp, Unknown
  misc_feature (1)..( 3003): 2750-1469P.txt file - cDNA_ID_2134857; gDNA_ID_1620395; Annot_ID_155731
caaaagcaatcactgtagtttcatgtagttgtcatcaggtaccaagcattagttcttagattcgtgatgtgctttatcgatgttaaagagcgatgatctctttgcgatgttactgtgcaggagggcacaagcttagcaaatcaactggaaacgcaggctcgagagttggatgtggtaatgcttacaaggctaagatttctaaaaaacagaacaccgttttctcttattttctagtttccattgtgtgaagtaattcactcgaggctttgatgttgaaccaggtatcatcggacttcaatcatctgcggatgctaaactatagcttttgagatcaacggacagagccacactcagtttttcatcagtagatgtacattagagatcatcgtacgaagtgacattgtatattgacatcctgttactttttaagacatgagttataatgtaaaccagaacgtaatttccagttttcattgaaaatacatccttatagttttgatcaagagtcaaaccattgaagttaacaagatgtactgtaaaagaaaaacgaaatgaacacatactgacacagaagtagcccggattttgttttttctgatattgtaagcctccggtacagtatggtattggatacagggttcaatccagatatcttcccaggttgcagatgagcttcccaaatcttctccacattacatgatacaatcatcgactttgggcctatcctctcagccatgtgtttctgtaggaagagttgtcgcggagagaagcatcgtgtggcttgtattccatgacatatgcatgaggcaacttcaaatgccgcttgattgagtctctcaaacccatcactgcctgtttaaggaaaacattgcactgtgtaagtaccaatcaaaaggagagggagagagacagttcttcttgtgaacagttttctcacctgatggtcagaagcattgcgattccatacactaatgatgtcctcgttgaaacggacactcagtactgccccacatatgttatcagcatcatcaagctggtcgcctaccaacgcaagaagctgaagaaaacaaataaacggaagagtatttaacatgattctcagaccctaagtatgtaaaatggattataaataacattgacaaaagggtttcttttgaataaagtagaaaggtgtcaatactccaatagtagtgcccacaagaaaataaaactcaccagatcctcccagaagcgagcagatacaacttttgagaaacgtatgatccactttcctccattgcagttggcaccatcctaaaggtgatgaatttagctagtttagttggtttattgaagaagatacaactcttgagaaacttttgttgtataaaaggttccctctatatcgatgatccagataaaaacacaatacgaaaaatcaacacaggggaatacgtacctcccacaatggacgaatcccatccttaaagaaatgaagatctgttggactaggcaagagagaagaacgagcaaggtgacagtagcaggcccaaaatccttcaacctagtttataaaagccataactcagaaacgaacaagatagtatcgcaaacagcttcaacaatgaacttccagtagtatatttagacttaccgtgctgaattctaccatcttcttgatgttatcttcataagactggttccgaacccctggtgtgcgacgagtgtaccatatcgaaaacttgtactgcatcattaccaaaaatcctagagtcactgagccagtacttactcttaacaatgaaatcagttcctctaaatcaatctgccttgttctagctacaatcaataccaccaatacgaaaatcctataacatttgagctcacatacatctaaacaaattcgcaaaacctaatttgaaaacaaaaactccaacaaacaaagatttagaatccgaatcttccactactctagctataaaccgtcatatacaaagttcagaaatctttgacgaacgggaatcaaattttcagctaagatcagattcaaattgcaaatgaatcgatactaaggataaaggacaaacccgtaaaggatggtctccatccttgagctcacgagagcggcgttcctcggaaacagagtcggtaacatagtgtgacttgatgctgtccatgtttcccgagtccctgatctcatcgtctctcctatccaaaacctccatttttttctcgattagagcttcacgcgttcgtgctttcaaaagccctaaaattccaatcaggaagaagaaagaggaggagagaagaaaagaactgtattacttttccactcggtcaaatacataaaggtcaaattctggagaaaaaaaatagcatatgggccttattgggtctactaaatgggccttagtgattagttagttttaatatctcaatgattttcattcttttttacagtaaacaaaataagaaacagaaaattcaaaagtggacaaaatgtattaagtatagttgttggttattacataaactaatccaaccggaacaaaagagatatgtcttaaacacatacacatgcacctatcacggcaagattagtggtgtagtggagaaaattaaaaaaaaaaggaatgtgtgacgaatgcgatttgtcaaaaaagaaaattaaaaaaaagaatcgatttttggcgttctccatctgtaatgtaatgtttctgcaaaaacaagtgacaataaaaactttttcatggatctgagattttctccaaatctatatttgtgattgtttcgtgtagtttttctcttaaagttgtgttctttaagctctctcgtgctcaatcttacgtttccctttggtttgatttcgtgtttttgttattcgatttcacctttaacttttatctaatctcttgtttttgattttgtaaattgtaaaaagtttctggtgattctcttagcgaatttgggaaactttatctgtatttttctgtttcgccgtagatttaggatccttaattaatg

SEQ ID NO: 23272 - DNA, 3003 bp, Unknown
  misc_feature (1)..( 3003): 2750-1469P.txt file - cDNA_ID_2134870; gDNA_ID_1620395; Annot_ID_155736
ggttctaaacagctcgtgatttgtaaccctactttgaaacgattcttccctttacctgagcctcaaggcaccggtgacgaatacaacgtaggagggtttctgggatatgaaccgatagagggtaaatacaaagcattgtgcattgtcagaggatggaacactcaagttcttacattggaaattcaagaatcatggagagtaaccaaacctggctatacacattggcctactaaagatactggacgatgcattaatggagttatctactataaagctattatatttgatagggttccaaggcatgttatatttggctttgatctcagatatgaagagtttacacatattgagtttccgatgcgtaattatgaccgctttcttatggtatcttatgagggaaggttggctttgataagttccactagctctgttgttgaaatctggagtttggaggatgcagggaatcgaaaatggtcgtatgaacagtttcatttatgtcttcctcccaacacaagtctgaagggtgttattgatgctggtgagcttatttacacaggatttagtttgaatagatcgttctgtgttgtgtattttgatcctaagaaaaacaatatcagagaaaccaagtttcaaggaattgcggataaccagatttggcaacctgatagacttggatttgatcttgtgaatgacttttatgtattaccaaatcacattgagagtttcatctcgttttaagagatttcatctttttgcatggaatgacactatatatttctgaagtgttcttcagatctttttttgtatccactgattgattgatcccactggagatcccaatatgttttaatgatgatactacatattctagagacttaatagaaactttataaaactatacatggagagactgtaatatgtgtttttgagattgaacctacgattcctctgttctgtttctagcaatttccatgtgatccttttctcaaaaatagaaaagagacttttgtcctaaagttaaacaagtacagaagaagtacttgaaatcttcactcagacgattagagcttagagcatacgaagattagccttagttacttgcagtatgaattcaacattttgagacatggatctctgtaaaattgaccaatatagtggttttattatggtaccttatgagaaaagattagcctggatagccacaaattcattgatattggaggacttggctaaatttgggcgctattagtctattactaatgctagtgaatttattgtgtcatgaactttgatattattagcagttttaagagccctcaggacaataacatttggtaatgaatgtaataacatcccttacatattagtgttataacactatctagtttactctcaatttggatgtgagagaccaataatcataattcataacaactgattttgagaagggttctgttttgttttccaaagaatgacacatagctaattatatatgcaagtttatgattctctgatagattcttcttgttatgattatccgttcacattgaagggctttgtcataatttgatttttctttagtttgaatatatcgtaagtcctaaacatgcatgtcttattaaacaatgtgggctctgctctgaagactattgcctacatttatgctatctactcaatcccttaggagttatggcatttagtttccagctgatgatatgtagaacattcataagcgagctcaagattctacaatacgtgtataaaagatgaagcctaagctactactaggctgcatcggtcaaaacacacaagccttgtctttttgtttctttttcttacaaaaactttgtctcctacagtgacttcaccaccaacaccatcactgacaaacactaataatgaaagaccaaattcgtatcacagaaagataagactgaaaaatcaaaatgtttcaatagcattagcctccagaagaaataacaacagtcgttgtacttgtatcctagctaaaagcaaaatgtaattgatttattgcgaattaaactctatcttgttacaaactttaacaaaagttttaatattttgaattccgtacatgtaaatggaagcatattaattgggaaaacaaaagaaacatagtggataagattgtttacaagtcaacacacaccaatttagaaaaatcaaagaaatcccgatttgatgcgaacatgacgacgcaaccatatctctccaaatcaaaagattatgtgtgtcacattccccactaatttcacttatatctagcataagatgccatataatatacatgtagtatgtaacgttttgagaatgttcttattcggcgagattatttttctgacaatacatagcacaatgtttagttttcccaaactatataattggaaaattttccaatgacatctcaaatatgtcgacatatccaaccgtaattccgtaaataggaacaaaaacatccaaagaatttaagtctagttgatctcaaattttaggcaagttgcaaataaacacaagtatattttagttgaattatacaactaaactcaaaagtacatgttgttccagaaattaaacagatagacagttagttggtaaagatttaattagttgattcaaaaaagaaaaaaatttctcgagttatcttaaagtatgtttgtcttaacttatcaaaattatatctaaaacccacttaaaggcttaaaccatgattattgtgtcttgtctttttttgtaattaaattacttaatcagctccaccgtaatcagctggacctccactgaatcttacccaaacatatcgatcacgtgcctgtgtataaataaatacatacacacttaacaagttacaatcagactgacaccaatcttcctctttaacagtcgttttattacagcgttctgatcaaaactccagtgaaagttcaaagtacacagagagaaacaaaaaaagaagaagaagaagttgaagaagaagaagccatg

SEQ ID NO: 23273 - DNA, 3000 bp, Unknown; identical to SEQ ID NO: 1389
  misc_feature (1)..( 3000): 2750-1469P.txt file - cDNA_ID_2134876; gDNA_ID_1620395; Annot_ID_155738

SEQ ID NO: 23274 - DNA, 3000 bp, Unknown; identical to SEQ ID NO: 1382
  misc_feature (1)..( 3000): 2750-1469P.txt file - cDNA_ID_2134893; gDNA_ID_1620395; Annot_ID_155743

SEQ ID NO: 23275 - DNA, 3000 bp, Unknown; identical to SEQ ID NO: 1384
  misc_feature (1)..( 3000): 2750-1469P.txt file - cDNA_ID_2134913; gDNA_ID_2910745; Annot_ID_193739

SEQ ID NO: 23276 - DNA, 3000 bp, Unknown; identical to SEQ ID NO: 1384
  misc_feature (1)..( 3000): 2750-1469P.txt file - cDNA_ID_2134913; gDNA_ID_1620395; Annot_ID_155750

SEQ ID NO: 23277 - DNA, 3000 bp, Unknown; identical to SEQ ID NO: 1376
  misc_feature (1)..( 3000): 2750-1469P.txt file - cDNA_ID_2134940; gDNA_ID_1620394; Annot_ID_155712

SEQ ID NO: 23278 - DNA, 3003 bp, Unknown
  misc_feature (1)..( 3003): 2750-1469P.txt file - cDNA_ID_2134973; gDNA_ID_1620396; Annot_ID_155772
aatccggttggctcctcatgcgcagtatctcgccctttgcagagcccaagtcctcctcgagcttcttcactttcttctctagcacttccctttcttttcctagactcatcacgaggatatgtgcatcttccacattttccttagcttcttttgatgcattctttgcctctcctagtgatcgttgaagtacttctttctcgtcctccaagtttgaagcatgggtattcaccttctcaagctctcgtgacagtattgatgtgttcttgttcatctcatctaaagactttacagcttcttcgagatctgtttcaagggattttctcgcctccctttccatcaagatctgcttttccattcctttcacctctttgttcaacgacaaaacagtctttttctcctcttccaattccttgttactggtttcaactttcttgtaaatctccacaagttccttctggaggctctggttcttgacagaagactctttgagttcatgagttactccctcaagctcgtctttaactctcctccgaagatctttctccagtgcaagttcgctagcagaaatctcattcttttgtttttcagcatcgaggttcctttcatatctttccttagcttccttccattcttcgtgaactatagcaagctctgattctaactttgaacacaaagctcttgactcatcaagcatcgtttccaggtcagagacccgatctctagatgcctgcagtgttttctttgttccttcaagttcatgtctcaaattttttactgtagtcagttctatatccagcattctcttcgagtcttcgtacttctcagttaagtcagcaactttgtctttacttttattaacatcatctagcgcacgatccagattttcatttagctgctgaatctcctgctctttcctgctgatgagctctgcatctgcagctgcttgcgtctcagaagtcaatttcaaagcactataatcttttgaaatactatcaagcttctggatataactctctttctcagccactaaagttgttattcttgtgtttaactcctcaatcgcagagttcttcgagtccaattcactctgagttcttatgagttcttccttctgctgtttgatctctaacttcgcttcagcaagatctcggctagtttgagtgtaaatagagttgagttccttcaattctgcttccttttttgccaacgatgcattaaaacgttgagctttttcttcactatctttcagctccaaactaagcaagttgatccgatcttgtagtccttcaaccaaatcaagcttttctctgagctttgtttctagtgcctctttgtcttcgccagcctttgacagactattttccagactttcgatttgatctttaagcttctcacataatttcttctcgctacttagctcccggcctaattctgtcaccaagtcctttgcagaattcaactggttgatcaatgacaactgttcctcttttgccttttctacttcctttttccgctcttcctgctcatgctgcagttttgcctcgaaatctttctccttcaaaaccaatgctctttctctgtctttcaactggttctttagctgtatgccacggttatcggtagcttaagtcaaaaaggatcaaatccagcactagcaatatattcacaacctcagaaagttaaagaaacaaaagaagagaagctcgaactaaatgatataagctgctaagacaagaacattcacccacaaattgtaaagcaaaatctttaagtgctagtagcttacagattcgatggtttcctcagcagcttttgtatcttgccgagccagtgcataaagtgcaccaagaacgccagcactaaaaattccaagaccattcaggagagccagaaatggatttggggatgttccttcactaactactgcaacctaatccaccaaaccaatcctgattcagtaaaatctcaagcactactttaaacacattgattctcaattaaaaaaaaatcaaattgagaaggtctaagagagtcttacaacctcagtttctagatcaaccttcgatgtctttatctcattgcctcctggaattaaaaagcagaactggtcacaacaatgaaagaaagataaccaaaagcaacatttgaacaaatctcatctaagcaataaaaaaactcactttcatcagccaaagcgggtgatcgaagctgcaaaaagggaagaacagagatacccacaagaaggaaagccctccttttggcggaagcaacgtcatactcgtacccatcttcctggtttaaagaagccaatgttggtcgtcggcgcttgaacttggcgacattactcgaacacagaagcccaaactgagacgaagaaggagaagaagaagaagaagaagaaggagatgaaaggaatcgagagtgtagaggaacagaagggacgaagcaagagccccctatcaggaaacccatcttcgccgccaactacttaagagattggaaatgtgtggcaaatgaagcaatcctaaaatcactgacacaaagcagaccccaaaacccaaaaaaggaacttcctttgtgtactgacttgtgacctcggaaaatctcaaagaagaatgcttacacaaatctcagagttatatccttcgattactgaagaaaatatctacaaatcctacgaaattgggtatcaaagactgaaacttttttttgtttaggagggcaatggcatatctgcaattttggaatagttcggtgctttgtgtacataacttaccaatcaaaactcgccagcttagacttcccctgcttcgttatcctcaatctctgggttcgcctggtttaagaaaacacgtgaacctcacgtgcgtctgtctgaccctaaaatttctctctgtttttctcagccgttctgtctaaaaccaccgacggcgacttcaaatagacgtcggaatttgtcgccaccggagaattgttacatgtgaatcccgttttataaagatg

SEQ ID NO: 23279 - DNA, 3003 bp, Unknown
  misc_feature (1)..( 3003): 2750-1469P.txt file - cDNA_ID_2134991; gDNA_ID_1620396; Annot_ID_155776
aatgacctaacgttcttcacagtctctgcaatgttacctgttgcggttaaatctccttggatcctaatcatagcagcaccttctctgattctcctcaaagcttctcctgtatcacggcaaccacaaatgaacggagatcggaaattatgtttgttgatgaaatgatcatcatccgcaacagagataatctcgctctcgtcaatgtaatcaaccgcaagagattccaagatctgagcctcaacaaaatgaccaacgcgagctcgtgccatcacaggtacagacacagctcgttttacctctttgatgagaaccggatccggcatacgacgaacaccgccgcgagatcgaaccggatctgagacgattacagaacatgcgccggcggattcagcgagcttagcttggttaaccgaggaaacttcaacaatggcgccgccacgaagtacctgagctaatccgaccttaacagagaacggatggtttttcttcgcgtcggtaatggctgtgccgctgtagagagtaacagctccttgatcttgatccgtcatagcttgatccgccatttttaggttctgtgagtttttagtaacagagagcttttcgccggagaaacggtgtttgttagtaacacgatctgagacgagaacgagaaagctgcgttgaaggtgaggagaaatatagagagaacggagaagacgaagaagagtgtggtttggtctagaaacttctgagactgttcgtcactgagaaatggttagggtggaatcgcaaaacggcgtcgtatgcagaaaaaggaaactaagtgggcttccatgatgatgattgatgacccaagtagacggactttttctttatttttgtaagagccgttggatgtgaatagaacacgtggcgtaatcgtgtgtaattctcgtccaaagtattttgaaatgattgttttgatggacacgagtcaaagaagaaaacaaagcatgaaatatttacgaaataaagggagtggtacatctaacaactgtcttacttagtggcccaccatgttataaattgtcacgacactagacgacgtcgtttgtagtgctcctcacgtgtttcaggttgttggttctatacatttttacagttttgaagcaattaaataattgagtacgtaaatcttactcttcccaactgtcactaccactgaggatgtttaatcatataaagttctgaatcttgtatgatttgatattatattagatgagacaaaatcagtcggcaaaataaaaagatggaagaaaaaagttcttttttaaaccgtcatcaccgattcaccatatatggatgatggtaaaaatgactacaacggttttggattgtttggcagcttgggaaacaaaaagattgtaggaggatgtagtttactttcatctcttacgtaatgtgagtacgcgggcatgatccagagatttatacggtgcagttggttttatgacatatggtaaagaaaatttgtttaacatcaaaaaatgtggtgatcgtttactgatttgtcttctatcaaatcaggaagcaaggtctatgaagaagggctacgaaagtggtgaatacacacaacgtcaagcaactacggcaaaggatcgaagcattgtctaagagatttaattacgaaacttcaaactcaaagtaacacgtagttgtaaaaacgttttttttggattggtaaaattttacattcattttttttaaaatgtggtgatgttttgcatgtgggtgtagatttgaaaataccaacgatttgttgttgagttttagacacgagtaaataaatggtgggaaatcgattaaacacacatatgaagcgatgtatgaaaacgacatgcgaattttatataaacaaatatcagctcatattgacccatgcgatcccaaaatgaatggagaatgacgacgtctgatctgaccatatcatatgtatggaaaagaccatttatgttcaagcttcgaaataaacttgatgatatgatcttctctatgttttgatttggagttgttcgattgctcattgagagagataattaataaatatggtgacactttctctcttattcgtcttagtcatatcatatattcatatctcatgttgatttgttattttgctatccagggagaccacaacgaataacactcacaaacgacaaagggcgcgacacatttgcttttgcaaaattcaaacttgaaagctagaaaattaataatatatagtcctgctctataatagaatactataaaatagtaaaacaaagccactgaattcagacaatccaaattttaatgctatcatgatcactctaaaaaacaacttttacttatacaagcgtgagaataatttggtcaaaaaagttaccattacttttgaattcaaaaacgttaattatcgaggtttagctaatataacttaatttttagtgatattatcagatatagttgacgtatgtaaatttaacattgtagaagttcatattagtaaatgtaatccgtatgattttctaatgaatttaattgaattttagaaaaaaggtccaaactatttggataaatcgactacatggtattgatatgacaaaaaatctcatactaacaaaaatacataaattagtagtaaaataactctgtatagtaattagtaactataactatcatgtaatccaaaaaatcccataaaataaaataaaataaaataaaagcattaagtagaaaaggtccacaaatctgtgattaataattagaggaattaaaacgacatatagaaatcgagtttaagggagcgtcagagaacgaacagcgaccaattactctctctactctctgcgctttaatttgaacttgtggagagagaaaagggttagatacagagagatagcgaaagagaagaagaagaagaggtctatcgacagagcaaacttcgtcaagagatccgttaaaaggatccatttggagctccgattcgagctagagtcaataatg

SEQ ID NO: 23280 - DNA, 3003 bp, Unknown
  misc_feature (1)..( 3003): 2750-1469P.txt file - cDNA_ID_2135001; gDNA_ID_1620396; Annot_ID_155781
ttggtgcaagagaaacaatatgaagtattatcaaatgaaacttgtgagggatatgaagagaagattgaaggaaaccctcgagaaacttcaaataaaaatatatttcaagaggaatgatatggatgttgttaagaaatcgattatatcatggttttttctcaactctacaacacttgaaagagatggtttttataaaacacgaaagcatgtgaggatagaagttgatccaacttctgtgcttaacgaggtaagttcttaaatactaacaaagtttgtgaactaaatcaacagtttagttgattaaatttttttcttttgttttacctggttcaaaagcctaagagcatttcaatggagagagttctcattttgttataaattaaaagaatatttatgactctagacatttatggagagaggtttagtttttggtcataatggtcataatgtgttctcgtccctccactttttcctcataccttatggttcaaggccatatttgttttgataataaatgtttagtatgttaaaacgtttttatgactaacattttattaaacactattttctcttaattgaatttattagtagtttcctcacactttatgaatttattattagttttaattttaaattgtcttttaaaattcaatatcgtatatttacgttttttggtggagtagatcaaattagcatggatatacaagcaactctatgagatcacatttacaagcaactctctcaagatgtaattgaagtttgaaggacaatttaatgtatcaaaaactattaaataaaattagtttttactttaaaatagaccaaaaaattgtttggtgataagatttatattaagaaacttttattaataccatcattataaacaaaaattgatatgataataataataataataatcaaaactgctgaaaataggttgcaaaacgtggcttatatataaaacagttcccaaattgaatcgaatttaatagtttattattttttaaaagtgtgtataccctacaagatttggtatcaataaacattgttattatatgtttcaaaaaaattcttaatgtttcaaaaatttgtttaaccttctctaaggccgaagtaagttaacgatttgcaaccaggcccatttatgtcacatataatggcccataaattcacttcaatcctaaaaataaaaatctaaccttcataatgggcaaaataaattacgatcgtattcaggcccacaaatacaaacaaaggcccatgcttttaagtacaaccctagaattagaaaacgttgatataaataagctgtcataaaattgagcttcttcttctctgaagccgtatcctagggttttctttgcacactactcgctccaatggtgatctctcctcttcctctttcgtcgattgaccatgaaaaccatctctgatattattattgtggaactttttgagtattgcagggaaagggaacagggagtttcggtaagaggaggaacaagagtcacacactctgtgtgagatgtggtcgtcgtagtttccacatccagaagagtcgttgctcggcttgtgcttacccagctgctcgcaagaggacttgtaagaactctcttcattgttttaaaaaaacattctctgaagatgcgtttcattttctcgatctagatttgcttttgtgtgttaatattcattctccatgatcgtgcttgagtctgatatgcatttggaccaatttgtatattcgttctctaacagaagaagcttatctatgtagctcgattgacatgtctattagttttgtttattatagcttgaaatgtttaaactttatcagttctttaatgtctttgcttcaattgattggttggaatttgagggattatctatgttcatttctgtctctgagctcaattcttgtctctttggttaacagacaactggagtgtgaaggccatcaggaggaagactactggtaccggaaggatgaggtatctccgtaatgttcctcgtcggttcaagactggattcagagaaggtaatgtatcttagtcttaagtttgttttctcttccagtcgaaatgtggttttgatggcacatttcttgtctttacataggtactgaagccaagccaaggagcaaggcatcagcttcatcagcttaaagagccagttcgagtagtctctcaggaaggactaaagcttagcattttttgcattcaactagttgaagattacttttcatgtggatctcatacattatgttatgtgggttttgtttcttttgttattcacttataaagttttgaacttggtttaaatatcatcttacatttgcaaccttaacaagccttcttcataggtttcattagagtcctagttttgattgaatgatatctttgaagttcgcgtaaaccaacctcaaacaagcctttcaaattacattctttgaagtcctggttttgattgaaccaaatcgtagtctattgaacaacctaaaaaacattgatttcaattgaccactgaagctctttaacacaataaatagcatccctgggactgcgactataataaaagttaaaaaaatgttgtcaagggtataattggaactttcaaaatagtcggagaactaaaagtttggtcttaatcggaaaaacatagaaacaccgtttcctcctccgcttcttcgtctttccgtcgtccactgtctctctctctctctcgcgacgcagatttcgattcgtcgaatattttagctaatcctctctcttaatctctttgaacatttttccccaaattcgccgcagtgaatactttctcttcccgtaaatctccaaaaatcgagttttttttattacttctcaattgaatttgcttcttccgattgatctcttaattgattcgcttgtgggttggatttgaatcctctcttactttccaaaggtcataccttttcacagatctatctttgaaattgtgaagaagaagaagaagaagacgatg

SEQ ID NO: 23281 - DNA, 3000 bp, Unknown; identical to SEQ ID NO: 1409
  misc_feature (1)..( 3000): 2750-1469P.txt file - cDNA_ID_2135073; gDNA_ID_1620397; Annot_ID_155815

SEQ ID NO: 23282 - DNA, 3000 bp, Unknown; identical to SEQ ID NO: 1404
  misc_feature (1)..( 3000): 2750-1469P.txt file - cDNA_ID_2135111; gDNA_ID_1620397; Annot_ID_155826

SEQ ID NO: 23283 - DNA, 3000 bp, Unknown; identical to SEQ ID NO: 1406
  misc_feature (1)..( 3000): 2750-1469P.txt file - cDNA_ID_2135126; gDNA_ID_1620397; Annot_ID_155831

SEQ ID NO: 23284 - DNA, 3000 bp, Unknown
  misc_feature (1)..( 3000): 2750-1469P.txt file - cDNA_ID_2135200; gDNA_ID_1971878; Annot_ID_176775
ttcgtcaaccacaaacgcgtttcactcttcgttcacgtcggggaatttaaaaaaatctccttcgtaacaaaaaagagaaagatcaagaagattgtcgtgatggctgccggatccatggacggaatattccgcaacatctttgaaggttgcatctctagctgtgactcttccatccaacgacgtccataccacaagaactgcggttgtgcccttcacgagagatctcgcggtggaggttcagcgactccttgtcgtcatggaaggtctgaggtcgttatgttccctatccaacgatcttggagtgaaggaaacagtttggctctgcatcttgcctcatcttcttcttcctctaacctccagtcactttcgtcgtcttcgtctatttctacccttgcatcgttatcttcgaccgtgtctgatattgattctcccatttaaggcatgaactattattagttcccattcattaattttttgtcttttatttgtttgtttcgaagagagtcaaattatgtttggtgtgtgattggaaaggtttcatgagtttccttggatatcaaaggaaactaattcaaatgttgtaatataatggtcaattgtagggaggcttttctataaaatttgtacagaatcatgtatttgagcgtaattatagttttttttgtatgatgtaaatttatacataaaccgtttgtaacatcgagagatgaaatttggattggaatgcgagaaaaataattttattttaatttttgtaatatgatcttcaagctatttcttcttattttatgttcttcggttaccactgtcttcatattgttttgattatactacgctatcatttgcccaaatctcttgacattctaatgtagagttgttgagcgacttgctaagattgttttccaagaaaaaaaaaattgtgtattccatacgtctaagagaaaatatttgtttactatgtgacttaaaaaatatataaatttaattattttatagttatatttggtaatgactaatgacattcaatccgaatatctgatcattgacattcaatttgaattttggctcaaatagaggttagcagagataatccgtctactggattagctatactggaggagaatgtttttttttggttattgttctttcattgatcggtatttggagaaaaaatataatttttcaggatattgttcgaaagattaatataacgaaacatcaaatatgagtttgtcttcaacggagcctacttccctgcatacaaatatagaagcattaatttgggcgaagtaatgtctaacggccaagcagaagaatatagtttctttcgtcacgaacttttatgaactcataaaaatggtgacatggtgtacatgtcttcaccaaaagagtggcccatattttcgtcatatctcgaggaaatcgtaaagtgtaagtaaaaattttctcttgtttttctgtttcatttgtttcttatcgagttaatgctagaataggcacatgtacactagcataaaatgtccgcactaatccacaatttgatcatgcacgtaaatattgttttctcaggttgcctacctacttttgtttgttatatccttgataacattatcatgttctaacattttcaaccttgctactattgtaatatggtacaaaagaaattgaaatattttatgcatgagatgagacaaccaaaagaaaataaaaatggttaataaaatatgaaaagaattgttaacaaaaaaaaagtaaaccgcaataccttttttcgtctagtaaaatagtaaaactggagaattctctttctttttctctagtaaaccgtaatagtaaaatccgtcccaccatctaatccagtttggtaaaattaaacattttttttttgttctaataatatttttattaaaagaattataattcaaatcaatttaaaaagttttcttttgaaatggttatttaattttatagatttcatatattatatatattctaaacgtttttcgttaaatattctaaacattttagaaactttaaataactataatatttatctttaataaaatcctaagattttttctttttaaaagtaattaaaattgatggagatatattaaataaggaaatgctaataattaggaatattatttaaatgataataattaatgttaatgacattccttgtaaataagttccaacttgaggatttatttacaaaaatggttgcaaaaatatatatgtagataacatgtagataacatgtatttttatttcagttgtctttgatgtcagattgaataaccagtttgagtttttgtctcaagaacagtggttttgtaagatatttctttcataataaagaaacagtaaaaaagaaaaaccgcaatacttttcaaaaaacaaatatgaaaagaattaaataaagatagtaaactgaaagccttgtccctattgcattttgccatctccgtccgattggtgaggtgtgatggtgtttgtacttgtgtctctggttttagcatcctcttgattttctctctgtcggtttgctactggtttgacttcgatgtaaggtctatccaattttattggtgcttccgacgttcacattaggaaagtttggtgagagtttctgatccttttgctcatttttagtgcttaaatcttgtttttctcatagtttttgaccttcattagaattttgtctcttggtttgatttctttgatttaaattagttttcccatatctgttgggttttttcttccctcttttggattgagtttctggagacaatccattgatccaccgatttatatattttaacttgtatcctactttggtttttaataaaatttagaggacaacaaaaaaatagtaaactgcaagcccgacccagtaacctattaaggtccaaaacgacatcgtagaacatagcaagtaaaagaagaaaagatatagagatagagacaatgatatcatcatcatcatcatccaacatg

SEQ ID NO: 23285 - DNA, 3003 bp, Unknown; identical to SEQ ID NO: 17149
  misc_feature (1)..( 3003): 2750-1469P.txt file - cDNA_ID_2135200; gDNA_ID_1620837; Annot_ID_169925

SEQ ID NO: 23286 - DNA, 3003 bp, Unknown
  misc_feature (1)..( 3003): 2750-1469P.txt file - cDNA_ID_2135289; gDNA_ID_1620396; Annot_ID_155787
ttgaggagcaatcctctctttgtgaatggggcagcgaatgtctcaaagaacttgctctacaagtaacgaaagtagaagagaatctcttctcagaatagtgtttgattgaagtagaaaagtcaagttaggttatgagatgaagaaacctgaagaggattgtaaggagaaggagcatcagagccgtatacgtcccattgacctgttgtgttacccaaatcttctaagtcaaagtagacacttttgtctccatacttagccaccacaccattagccctattacacatgaacacaacaacctcaagctaatttaatcacaaacaagagatgaaattatcagaatttaatcctttttaagctaattaatcatcactatatctatcgtttaaaacacacttcagccagcaaaaatctattaatatattttgaatttatagtgtggttatagtggcattttgatcctaattaatgaataaatgaaaagttttagttaccggatggatttgggtttaaagctcaggcgggaaggcttgatggagagcttagctccggcgagtgagctgccgccgagtccttttatggcggcggatggtttcacagcggcgacggttgcaagagacgccatgagcttcgatcactattcttttgttgtgtgtggtgagtgggaattttgtgtaggaaataatagcctttggtcacaatgagtcgagttttgatcttcttctgacacgtggcaactgatttcctcccggggattttcttacgccacttggaaaatgccacgtggaatctagtaggataaggttatctcaaggttttaactaaaatatttcgtgtcttcttattttgttatagggccccttctttatgattttgttttggaaaaaaccccaatagttttttaggtttactaaaaactccagccagtggcaagttccctgaatcacgttatagatagatttgtgaatcaccaccacttttaatttgagctctgatcttaggagttaggtgtcgacaaaatatataaaaaaatcacaacataaatagttaattttaacccatccaaaaagaaaagttcgattaccgttgtgtctcatttggcttcgactagtgctaatatttacatatgtgaatgtagagaggaaaggcaatagtcatggccaggtgattccatctgtaacatattcacaatttaacataattggcagtgtagtgtgatttttaggataatccaacactaacaattacttgttatatataatcgatccacatattctatactgcgtaattcgttactatcattgacaccttaaatggacaaaatcacactaaaaggttttttgcaaaccatttttgaaagtctaaaaatagtttaaagtatctctagaatttgaaataaaataaaaattcgttttgcagtagttatttagaggttttgaatgatttttctataaaaagtaaattgaagtagtgaattttttttttttttttttttttgagcaacgttttgaagtagtgaatcaagattcattttgtaatgaatctcgtataaaaaagaggagaagtggggtcatcaaaacatgtttgagaggacaagattccacgagagtgtggggatctaattgacgacccctaagaaatgggagaggcaacaaagagagaagaaaatagacgtctttctaattggagtttgtcacgtgacggaatcttattggaatccacaaaccaaagtcactaggctctgtccttttccaacacatgaagagaaaatctcggagattccaaacttgtggagagaaagatgcgactggccaacaataaataaacatatttagacacaaaatcctgcggtaaataattaacaattgctaatgcctaatgcataggatcctgctaactgctagcaaatgcgtgtcgcagctactttacaacttctcttaaaaacatattactatattagaatcgaactatacattgggaatgagtataccactaatccactaacatttgtctaagctatttccaagaaagaggtttctatagactccgatgcatatgaggaaatgtttcggtgcatatgataggaaaaatcataaccgatacatttgagtaaagaaaaatattacgtaagatttactataaaaataggaaaattgtgatatacctgtcgagttggacccaaataatcgacaagatagactttacacataatattgagctatgtgtattgacgtatataatctatcttctaataacgtagattagcacaaaattgacgagataaacataaggaaaacgggaaaagaagagaagttgtttaaacaaaaagggaaattgcaagccaacttgaaacttttaatttatttagttcacaagttgtgagaaacagttatttctcccaaaccacattttatcaatataataagacaaataaaagaatgcataacaattaacaaccaatagttatcgctcccttcatgcatgttatagacctgacgtggaattcaacataaacagctaactgcaagttcccaagactactttgttttgtttcatttgagatagtatgtcatagcaaaaaaaattgcatattacaaaatgtagtgcagatttcttgaaattatgaaaagcattacagtttaataacgtttcatcttggtcgaatcaaatcaaagaaagaaaatggtaaaacaaatcccaaattggttaaatattaacctgaaaagggaaatgttgacaaaataactgaaaagtaaagaaaaatatacggaaagtatattcttccttcatatgaaaaaaaaaactaaacaaaacaaataaaatcagatggggtaattaaaaaatgtttttaaaaattaagaggtaaatcaataaataagaaaatgtgggtctctccttgctcgtaaaaggcctatataatgacctaatgcgactcttctttcttccatcattctcggtttaactgtgaaacacataaataaaacaaagagaaagagagagaatatg

SEQ ID NO: 23287 - DNA, 3000 bp, Unknown; identical to SEQ ID NO: 6052
  misc_feature (1)..( 3000): 2750-1469P.txt file - cDNA_ID_2135381; gDNA_ID_1620839; Annot_ID_170020

SEQ ID NO: 23288 - DNA, 3003 bp, Unknown; identical to SEQ ID NO: 20883
  misc_feature (1)..( 3003): 2750-1469P.txt file - cDNA_ID_2135400; gDNA_ID_1620839; Annot_ID_170028

SEQ ID NO: 23289 - DNA, 3000 bp, Unknown; identical to SEQ ID NO: 3957
  misc_feature (1)..( 3000): 2750-1469P.txt file - cDNA_ID_2135426; gDNA_ID_1620675; Annot_ID_164231

SEQ ID NO: 23290 - DNA, 3003 bp, Unknown
  misc_feature (1)..( 3003): 2750-1469P.txt file - cDNA_ID_2135426; gDNA_ID_2926203; Annot_ID_201975
ttgtactcttctttacctcgcaactttgtttttcagggacgagtctttgttatgtcaaggtctggctttgaatgatgacttgcagcgtgtcttaaccaattatgaagcaattgcttctggattacctggaacttcttctcagatcgagaagcccaagtccgagacaggaaaatcccttgttgatgttgatggtccacttattgatacaggggacagcagtaatcaggcgaacgggtacgttctaccaaacttgactgttatgcacccaagaatgttggataaaatcacctatttttggatatgggttaccgatcctagctgcaatcttgagctcgatatatggcttgcacgtccaaactattacaatctaggatgtgaaaacgaaaagttacttatgaatctgggagtaactttataatcattttaatataaacggtgttaatttgtctcttaaccaagtaagaactggggtttcaggccaagtgaccttgtaaaagttttttttttgtcttataacatagctattgatttatactgtccaacgttttcacagagctacatcgagctctggtaacggggttctaaatcagttggccctccctgcaccacctgtaactaatggttcagccaattccaaaatagacctcctcagtggcgatgatcttgcccttgttcctgttggacctcctcagccagcaagtccggttgcatcagatcaaaatgcactcgcccttatcgacatgttctcagataatactaataatccaagtcctgcaactgcaccaagtggcaatccagctcagaatattcctttgaatcctcaagggcaccaacaaccaaatagtcaagctggagaagctggattacaacaatccaatggatttgcgcctcaagtgggttattcgcagtttgagcagccatcatacgggcaaggagtctcttctccctggagcagtcagcctgcacagcaaccagtccagccatcttatggtaatatatataaacagtttttgtttttcacacatctggagattagattgcagtatgccaatgtttctctggttatggcaacaaggagaaagaatttccttcttttggattcagaagaatcagcttcaattgtgtctcatgtctaatcattaattgttctgtttttatggtaatcttgtaatataaagaaggtgcccaagacagtacggcatttccacctcccccatgggaagctcagctccaagactatagtccctctgcggagtcaggaagtccgttttctcctggaatgcatccaactcagactgccttcacacatgctcaaccagttaacaacaacaatccatatcctcaaattccccaaaccgggccaccagtcaacaataacagtccatatgctcaaatgccccaaacaggtcaagcagttgccaacatcagtccatatcctcaaattccacaaaacggcgtgtacatgccaaaccaaccaaatcaggctcttgggtcaggctatcaaccacagcaacaacagcagcagcagatgatgatggctcagtactatgcccaacagcaacagctacagcaacaacaacagcaacaggcgtatggaaaccagatgggaggatacggatatggctataatcaacagcaacaaggaagcagcccatatctggaccagcaaatgtacggtttatccatgagagaccagacatcgcatcaggtagcatcatcatcatctaccacatcttatctgcctccaatgaaacctaagaataaaccagaggacaagctatttggggatcttgtggacatctccaaattcaagcctacaaaaccgacttccggaagagctggtaccatgtgaaaattcctccatccattcatcatttaccagtattcatctcctctatcctcctcagctaactctctttcttctctttgttaagcttttttcatcattgattttattaccctcttgggagataacatagatatacatatgtgttatgttcttccttataatttaccgttggttatgggtttgtatatttcttgtagagaaaagaaaactggaaaatcttttgttgagaactcagcgatttggggtttgtctcgagattctattttaggacattttaatctctcatttgtattttcagaccttttatttgttatatccattggcaataaagtttgatatcaattggatgagagttatggttcttaaatttgccaaaaggacagtttatgttctttgtatatgattgcaaccctaattccatagtcaatggagacatcaaaatgtcaaactatgcttgcattatataatctctttcgactcaatgatgtcaattaccgaaaaagtagaaaggaaggatttgttttgtttgcgactgttgttagttcttatgttgctcgtcgtaaacaagaaaaacctgccattcgtttgggtttttgaaatctagtctaacagaaagaaacaagagacaaatgaagaagagtaaatctagtccattcatcatcatcagtcttttggatcgtgcatatattaatttgtataagagtctgtctaacaaaattgtcaatatgtccgagtggttaaggagattgactcgaaatcaattgggctttgcccgcgcaggttcgaatcctgctgttgacgtattctattttgttttcttttcagctctcttcagaatttttgtaaatattttaaaagggaaaaaaatctcaaaatacgatttcaattaaaattgtagagattctcctcacgtctgtttgtgaaatgttgtctctaataaatttccgtaaattactgaaaacaagacacgagaaattgttaatttaacaaaataaaaatacgttacgtttggggtttgccacgtaactacttaccgccacacgttctcgtccttttcttcttcctctctgcattcttcacagagtttgtcaccaccaacaccaaacacacaatttcacattcttttgcatatttcttcttcttcttccattatg

SEQ ID NO: 23291 - DNA, 3000 bp, Unknown; identical to SEQ ID NO: 3946
  misc_feature (1)..( 3000): 2750-1469P.txt file - cDNA_ID_2135462; gDNA_ID_1620675; Annot_ID_164243

SEQ ID NO: 23292 - DNA, 3003 bp, Unknown; identical to SEQ ID NO: 19560
  misc_feature (1)..( 3003): 2750-1469P.txt file - cDNA_ID_2135468; gDNA_ID_1620675; Annot_ID_164246

SEQ ID NO: 23293 - DNA, 3000 bp, Unknown; identical to SEQ ID NO: 19561
  misc_feature (1)..( 3000): 2750-1469P.txt file - cDNA_ID_2135468; gDNA_ID_2926202; Annot_ID_201942

SEQ ID NO: 23294 - DNA, 3000 bp, Unknown; identical to SEQ ID NO: 5168
  misc_feature (1)..( 3000): 2750-1469P.txt file - cDNA_ID_2135548; gDNA_ID_1620767; Annot_ID_167356

SEQ ID NO: 23295 - DNA, 3000 bp, Unknown; identical to SEQ ID NO: 5164
  misc_feature (1)..( 3000): 2750-1469P.txt file - cDNA_ID_2135573; gDNA_ID_1620767; Annot_ID_167368

SEQ ID NO: 23296 - DNA, 3003 bp, Unknown
  misc_feature (1)..( 3003): 2750-1469P.txt file - cDNA_ID_2135650; gDNA_ID_1620645; Annot_ID_163210
ctgctttttttaacaaaattgtgaaaatcatttgatcttttgtttatttatgtgatcagtttaatacactatatttattcagtcaaaacctgcatttttagtcttgttttttcaactgagtattgattaacaggaatggaaactgattatatattgaattgtaaatgcagcagcagaaacggagaggattgaaaggcatggagaatatggacaccgactccgagtaaattttttgttccttgtttcattttctttttgtatggtttacgatttctcttttgaggaaaacaaatatgaagatgcacgtgtggcttgcttgtgaagagcgtgcgaagtatgccaacagagaaccagcagagcgagctatcgatcgagaaattactctatttttattttaatatttactcttatttttccttcttttggtttttttttggggggttcctaaattctttttcttttgtttcgtgtacaaaaaaaaatggtggagatcccttcttcataaatcataattccccttttataattatgaagaaaataaaagttctctgtctctttgaagactctttattgcttaaaacctaaataaaattcgataagcaagaataataaagtaataatgaatcttataatccttaaagaagaataatcaatttaatgaaatatttctctgattacgtctaaacgttttgacttcgttatgttaggccggaccggtccggtctgatttgaaccggagagggtggttatgtggattttaatgtctttggccttttggttgaatcaatttttgaaaaaccctcgcttattctactaacccttttcttcctaacctatttgaaatacaattttacccttctcttttactttttttaattttttatttattttttactaccaaataatttattaaaatcaaccaatcatacgcattctctctcttatctcattaatcacttaaatctacaaaaaaaggctggacaactgaaaccaataggcacaactatgttgatggacttctacgaaaacatataattacatactgtttttttttttctttttgattttcaagttatagtcaaaaagacttcagtcatacgcattgcttataatggatactattaaatttttttgtcgtatttatacaaattaatatgttttgtattggtacaactaagtacaacccgcacaactaagatctattcactttgctagttttcagaatattataaaatatgaaaatttaaaacaaaactaagaaaacttaaataatgcatacacaatggtaatgaaattacataattagtttttgacaaaaatcatattttctaaattaatgaaactcttatcacaaaatctaacattcatacactaacaaccttatactttcatggttactttgtatattttaacaaaacaaattaaaaattttaaacacttgtatttagataaatataaatacaccgatacaaagtaatggtattttgatgggggaataccatatgttccacccataaaaattagttttgagttgataacaactagatttattatattctcgatattgtacaactatgagcaaaaatgtgcaaccgagtacaactgtacaactatgggcaatatatttttcagatatttatagatattttttaaatatttgtagataatttataataaaaattagctttatttttttgtgataaaaatgtttagttttttttttgtcatcaaaaatacttaattttatagttaaataaactatttttttccctttcaaacttttttttttcttctcaaaacactattgtttaataaaataaatactaacattcataattttttgtgttttgttttggatcaaaatacgttgatgtgtacattcatatttattttggagttttttttgacaaaaaatcttagattcatacataaactaagatacatagttttacatgagcgtaccagttgtacctaaacgcttagatgtattattttaaaacaaaaagacagccgaacaattgtatataaacccaaaaacccaacataattatatctaaaaatttagccacaattatacctaaaaccaaaaacacaacactacgtaataacttaaacaagacgccttcttcttctctttgtcattctccttctcaatttctttcttctcctccccttttcttctagtttttatcacaaactatctctaaggaacaaaattcaaattcattcgaatcccaattgtaatcctaaaaactaagtcataatggctattagaagaggcttttaaggaacaatttcgattttaaatcgataattaattcaaatttgaattgtaatcataaaaatccaaattataatcgaaatttcatccaaaatccatcattttcaaacaaaatcaaagagaaaaaagatcaaactatcaaatctaataaaaaataaaaccctaattaaacacaacaccatcaatcatcatatatagaatagagatggatttttggattgatagaaacaaatgaaaaggtaaaaaagatggatatttggattgatagaaagaatgaaaaggtaaaaaggagacgaaagattatatatggaatagagagaaaagagtaaagagaagaagaagaagaaacaaatcaaaaattttgtttttgttgaattgagagaaaaataaattgaagatgaaaaaaaattgatctgagaaattagatttttttttctgttgagaagaaaatatctaacattgttatggatttacatctaacatagagattgggttataaataagtgaaaaactctagttttacttgttttttactattattctgaattgaaatagataaataaacatatgttttttataagggggctaactagagaatgtttgaagctgagggggtggagtaagattaaaatactggttatgttacgttataaattaactcatcggctttaatttaaaccataatcttgtaagaaagaatcaaaaatctgaataaaccaatg

SEQ ID NO: 23297 - DNA, 3003 bp, Unknown; identical to SEQ ID NO: 23296
  misc_feature (1)..( 3003): 2750-1469P.txt file - cDNA_ID_2135650; gDNA_ID_2926175; Annot_ID_199809

SEQ ID NO: 23298 - DNA, 3003 bp, Unknown; identical to SEQ ID NO: 20873
  misc_feature (1)..( 3003): 2750-1469P.txt file - cDNA_ID_2135701; gDNA_ID_1620836; Annot_ID_169903

SEQ ID NO: 23299 - DNA, 1278 bp, Unknown; identical to SEQ ID NO: 7862
  misc_feature (1)..( 1278): 2750-1469P.txt file - cDNA_ID_2135794; gDNA_ID_1621169; Annot_ID_173911

SEQ ID NO: 23300 - DNA, 3000 bp, Unknown
  misc_feature (1)..( 3000): 2750-1469P.txt file - cDNA_ID_2135831; gDNA_ID_1621169; Annot_ID_173925
cattggtctttctaaaaagttaagatttctgagttctgaaccttggactgagaatggttaccacattttcctaagatttcaactacatggactctctctaagacttctgaaccctgaaatataaaagtaatagtagcttaccactttgatgttttgtgtagtagctacacttttctcaaagtgaacatcagagttaccagctaataacttctccaacctcagacgaattttaccttcatctttcctaactgtattcccacgaaagtaaagaagcgttgtacgagcctcaaaaggatctcccataccatcatcgccctcctcattcaaagactcaacaacatgtacataaggagaaactacgtctttacttaaacgtgccatgtctttagaataacgcccaaaatccacaacaatgagaatcgacgcattcacttgttgccttagaaatctgaaagcattaggatgtgtcatcggaatcacatgatctttacctcctgaacgattccaatacttcgaattctcaagaaactccattaactcaacctgatcacacaacatgaaacaataatggtggcgattcataaagattcaaaattggcaacaaagtcaacgaatttgacattacccatcatcccaaatcaccggaatttcaaaaatttcgattaaaatttgacaatagttagggtttatagttcataattcgatcgccagacgctgcaatggtggcgattcataaagattcaaactttgcaaaaaaagtcaacgaatttgccattacccatcacccaaaatcaccggaatttcaaaaatttccgatcaaaattatacctgtaatagccgatcaaattcagtatctggatcagtcatgttcttcccatgagtattaaaactcaacgaagagaaaaaaggaacataaaacacatccgccaaatccggatcaaaaaccctaattgcttcattctcatcctcaccaccgttaagaagagaagccataagccaatactcaacgctatgttgtcttttaatcccagaagtctgaggccaagaaggtaaattcttccctgtgataggctcaacatctgagctatgaggatccatcatcgcgatattaaactttcgtgggagatcgtacatgaagacacggagaggttttccagaggagctacaaggagaagaagctccattgggttgggattggaggaggtagaagtaaggtcttggatcgacggttcccatgtagattgagaatgaagcaacgaggaagatgaagaagacgattgtacatattgttttgccgtacatttcttcttcgagagagatgatacagagaagaagaagaagaaagtgagagatttagatccaacggtctctgttttgggttttttcgttgcttggtgattgtaatgagttttgatgaaatgaaacgtattgagtcattagacatttaatgatttatgatttaagaaagattctttcagttacaaacaaatttactgtagttgttttttctttttcttttacacacaacataggtgttgtaattcaagaaattgcacattcactttagaagttttaaaagattaggtaattgcacattacaatcaatatttttttgtaaaatgatcactatactataatagaagctaaggatgttgaacacacaaaggattcaaaaagtaaatgtttggttttccggttcgatgttgaaagactgagttatagaggtaatggttcgaattaccatttttgcaactcttgttcatcttatttgattgtggtcaattggaaaaaacgtttacgggtttcttttggttttcagttttgttaccaacaatttgatcattgagacattgacaatccgattttgttcacatgtttgaaaataacgagcgaatgggccgaaccctgctgactcagacttggtcaaagtttttctaagcaaatttcattcttgggccgagtctagggataaagctcatatctagcatttatgtataaccaaaacacataggtgcatatagactagacgagtgacagtccaggatacatacatatagatatcctgataatgatatccatccttgctttgtgaggatcggacaactatgaagaatggactaaaattgtgcttgcctcaaagaagaaatttggtttcctcgacgaccaacttgtaaaaccagaggaaaactctccccagctatgatgattgaaaatccattaattaatactctcttgatatcttggatcaagataactattggtccgagacttggctaatatctcacacaaatagttggtacgtgatgtgtgggaacatatcatcacgtaaagaaaggaaacgtagtttgctttatttaacatacatagacatagttatgttcacgacactttaatgtctacatgtttttttgcgtgttggattacatcccaaaacaaaaaaaaaacatttgtgtcaaatgtttttaattaaaacaacgtgtcatttccttttaaccaaattttcttccctagatatataccccaatacatggtagtagatcttttttttggttttttttttggttcaaaggtagtaaactaattaagccttgattttattcctcttattcttcttagactcgtatttagttcacgagttacgtacaaagtttgtttttttgtctaagcaagcggaaatattttgtaagattataccatctacttttgctgcatcgtatttaaaagtcagaaaaacaacaatgtcactttgataatgacatctgtccatagacatgcaaaattgattcaaatttatgaaatcacctttaaattgtctaagatattcaaattaaatgacttcaaactttaaatcaaaattttaccaaatctacacttcagaacaaaatgaatctgaataaaattagatttagggaaacgtaaagacttcattatggaataaatcgtgaggacttttaagtcattttgcatctcactctcacgccgtaacagtctctctctatg

SEQ ID NO: 23301 - DNA, 3000 bp, Unknown; identical to SEQ ID NO: 4757
  misc_feature (1)..( 3000): 2750-1469P.txt file - cDNA_ID_2135867; gDNA_ID_1620728; Annot_ID_165999

SEQ ID NO: 23302 - DNA, 3000 bp, Unknown; identical to SEQ ID NO: 4757
  misc_feature (1)..( 3000): 2750-1469P.txt file - cDNA_ID_2135867; gDNA_ID_2926173; Annot_ID_199670

SEQ ID NO: 23303 - DNA, 3003 bp, Unknown
  misc_feature (1)..( 3003): 2750-1469P.txt file - cDNA_ID_2135960; gDNA_ID_1620398; Annot_ID_155859
attccactgcataaatttaccatattgaggaaaatgtttcactttgtttaaagttattcggttcttgaaagatcacagaagatatctttacctggtcgaatgcaccagcttgagtagaacaaatccacgcgtttttgtttgttgttaggcggtatagaaggaaccgatactccctgaaccaagaacgagatacaatcttagggtgttgttattgtaactggttctttgcaatgcaaagtaagagcacaaaaaatgaatctattcttcatctcttttctatataacctgttcaaatcccaaaccaactgatttagaggtaagctggcaattcaattgcaattctatgcagaaaaactagcctgacatcgaagctaactcgagcttctttttactctttatcacatcaatgtaaaagagtccatttttgttactagtacacatacctttgtaacacagtaataagagtttccacaattccatatcctgcgaccgattacatactctctatcactgcagaagaacgggaactgcaacaccggaacatacatgaaaggaaagatcaatctaagaaccactcatcaaaatgttacaaaacaagtaaagtaactagagaggcagagagtaactaaccttgcgtatccatctaacaatcatggttccagtactgggacactcttcaacagtagtggaattagaaagcattgtatcccaagttggtctaaactcatcatcccagaaaaagtctcttaacatcacaggagttgcatcttcaaacacagttctacttctatactcagtaggaccattctaaaacaaaacacaaaagacccatcaagaacaaaaagaaacaaatctctctatctcaaacacacaagagcaagtaatatattaccttaggttctctcaaccaagcttggtatctcataccaggagtaaaacgatccatcatctgaatccaagcttgaccaccatctttcctctcaaccaattgcacaagatgtctcaaatctaactctgttacagtattaggcaatctctcctttgttttcttcactctacaaaaaatcaaaacacacaaaaattaacaaaccaaaacaaaacccttagctataactaaaccatcacaatcatcaaaattagctttaccttgaaaccaaatccaaatgttgttcagaagaatcatatgaagaagaagaagaatcaggagaaactgtttgtctctgttgtcttaaagccatagtccatgtatcacaaacaagagcctttaagcaaggagctgatccaaaacccttcaaaggagaagtaacaacagaactaggagaagaagatggtaaagacaaatcaaaagatcttggagcagaacattgtaatttgacttgtcgattattagaagaagaaacccatcttggtttccatgcccatccaataaccaacccaataacaaaagctaaccatcctgtgattagccctaatattatactctcaagcaaagccataactttgcagaggataagtaagagaaagggtacgcctttaaatatgttaagaagaaactaaaaaagaaacgatttttttatttggataaagatgaaaactttgaaggcggtgagaggaagaagacaaagaaagggacatgagtggtgagaagaagagagataaatctatggacttatggtaaaggggttattattcgtagacgctaagtagtagtagccattgatggagcttgaaagaccattgctttttagaggaggagaaacaaaaaaaaaaaatggtggacggagagtgtgaaacgacgaccaccgtccattaaggaccatttctaaattacggttgattaggaggaacacttcaaatcttgcagggtttatttttctttccccaaattaaattctgagttttattagtcctttgatttttaatatcgtaacgttattttatagccgcgtttttgatgtcacattttataaatgtgttaaatgtaaatattggttacaaacttttataacatgattgttttgacttttttttggaagacttgactatggaattttgctcactagcattaactcatctgtttgatgtattcaaagtttgaacatctatttactaggtctttcatcttcttaaaactaaaaatttctcacatttcttattacttctatcataatatttacgtatccaaaaaaacgatcagtcatgtcaaaattgtttgagttaagaattaaaagatcattttccaagtttgagttagtttatgaaaatcagaaaaatattttgtgttttaatcagtacaaaattgtatatttgtgctgctaaatatgttagagtaatgcaactatgtttgttttggacattaaacaaaaaaagaacaatattgcaaagacgaatttggaatcctttgaccttgccaaggccatagacacattaccacttgtgcaaggagcaaatgacgatttataataaattacaaacaaacttatcttaataaatttatcactaccttgaaggggcattgagaccatagcatgttacatgaggaaaagaaaacctttgtactgattaaaagaacacttaaagagttaatccattgtcacggctattgtcaccaccattaccattgccacgcatgatcgtctccatgactccattgttgccattaccacatcgtttccacaatcatggcaaatgcaatatagtggcaaaggtgaaagagatagacagatagtaatgttccgatactaggggtggcttaaataatttttctatcgtaatgttaagatgataggtactattgcatttttggtagatgaagggtaaattatataagattaaaagtttgaggattcttttgcaattttcccatattagaaacgaaacatgttctcttctcaggcccaataacattttttgttaaatctttgattattaaagttaacccatcttggaatcaaacacgaccgttaaaatcagaaaccttggttttggatatagccagccatg

SEQ ID NO: 23304 - DNA, 3000 bp, Unknown; identical to SEQ ID NO: 1413
  misc_feature (1)..( 3000): 2750-1469P.txt file - cDNA_ID_2135963; gDNA_ID_1620398; Annot_ID_155860

SEQ ID NO: 23305 - DNA, 3000 bp, Unknown; identical to SEQ ID NO: 7748
  misc_feature (1)..( 3000): 2750-1469P.txt file - cDNA_ID_2136000; gDNA_ID_1621160; Annot_ID_173670

SEQ ID NO: 23306 - DNA, 3003 bp, Unknown; identical to SEQ ID NO: 18633
  misc_feature (1)..( 3003): 2750-1469P.txt file - cDNA_ID_2136020; gDNA_ID_1621160; Annot_ID_173677

SEQ ID NO: 23307 - DNA, 3003 bp, Unknown
  misc_feature (1)..( 3003): 2750-1469P.txt file - cDNA_ID_2136086; gDNA_ID_1620399; Annot_ID_155875
gagtctttagtgattatttatacaacaaaaaccaagaccgttatatgatatatgattttaaataaatagaaagtgatcaaagagacgatggatcgtgattaagtttataagctgcagcgacggattcagcaacacctccaggaataatattattgaaaggagaatgattcagctcagcccgaatcactgcttctgcgtcttcacttgtcacttctctgtccctcgttactttcacatcaatctccgcgataacgtcgccgagatttgtcttctcattatcttttcctattttttggttacgagcaaccgccttacttgctacagcagttacaccaccttcactttctatatcgcctccgatagcccttgtttccacctcttttatggcagccacgtcggtggtttcaactggtttgtggccgacattcatggatgctgctttaagagcctccgttaatgtcgttgacctcccgataagtgcttccgctgcggtggaaatctcttctgttgggcctacaaactttttcaaaacgtttcacatcattcggtattatattgtggtcacaattgttcaaaaccagtatgtgtttttacgtttttcgttatttcatatttgcgttttacgttgcgttaacatgagaaagtgagactacaaaataaaaattcaacataaattttttttgaaagaagtatatcaaacaaaatattaatttcctttgtgttttcaacaccatgcagtgtacggatttaactttacacagccataataattaactacaaagttgggccaagttaatattcacaatctttcttcgtccaagccaactcttgatgatactcattttgaatgtaaaataatccactttaagcgtgtactagaagaaacatcctttcaaaatgatcaaatctaccgccactagtctaccactaccacacgcttgttagttggttattatgcattaaatataaacgtagtacaaagaaagaacccaaaatctatacctgtccaccggggctagactgagagacgctaaagtgctcctccacggagatgttggtgacactagcactatcttttgatgaacccatcgttttagacttcttctttctttgcttccatgttctttttctttccttagtttaaatacgaaaacggaatgtggcgataataacggttccgtacagtttcatttgacacgtaggcttttaacagtgtaacgtgtccatatttagctgcttgtgagacagtgacccttaaatgcatcggcgagactatgtattaaacatttagagtagcgtggtgagtttaagaaatattggaagaaaggacctttcataacccttttatgcaaatttccatatactattctttttttttaaggtatgttgatctcttttaacgacttgcatgtttttgacgtttgtcaaaactcaaaagtaataaaatggagttccatggttggattttgggatttaaatttgttctttaatgattatttatgcaacaaaatcttataggcttccaatgcctatataaggtggatcaaaaactgatctcggtaaaaaagacagtacaaaacttcggttcgaaacttcctactctaaaagaaaacaaaacaaaaaatacaaaaatcacgaccgttattatatacttattgtgataaatatgtaaattgcaattgatatcaaagagatacattgcatggattgcaattaagtttataagctgcagtgacggattcagcaacacctccaggaataatattattgaaaggagaatgattcagctcagcccgaatcactgcttctgcgtcttcacttgtcacttctctatctctcgttactttcacatcaatctccgcgataacgtcgccgagatttgtcttctcattatcttctcctattttttggttacgagcaaccgctttacttgctacagcggttacaccaccatcgctttctatatcacctcctatagccctagcttccacctcttttatggcagccaagtcggtggtttctaccggtttacggccgacatttatcgccgctgctttgagtgcttctgtcaatgtcgttgacctcccgactagcgcttcagccgccgtggaaatttgttctgttgtgcctgcatactgtttcaaaaggccgaacccgaacatcatacgatatcaacatggtcacgtaaaatatttcaagttaaaagtttttttacattttatcaccgcggtagaagttatacaattcctactatgagctagcaatcggtaaaacggtaaattaaagggaacaccaacaaaacggtacaaaatctttaccaatctatgttttaccgcacttgcttacttcttttaactgttctgttatcgtaaacgatttttcttttaatcgtggctaatttttcattttaacctattacctgaccacaagtagtagattgggagaggctaaagtgctcctctacagagatattgtgaaactagcaccatcttttgatgaacccatcgttttagagttctttgatcttctttctctgctttgcattatctaatacactttctgttttgtgtaaattgataaataagtaaacggaagtgccgacaaaaaaaaagaaaaaaaaaaaaaaaaacggaagatgacaatagtaacggttccgtaacaatttacatttgacacgtcggctttcaacagtccacgtgtacaatacttgtctacgtatgccgttatgcgaccgtgactcttcgatgcataagagagaccaattactttttgggcctcagaagcttcgtagagcccaaacattctaccaagctttgagacacgtgcatagtccgtgccagctgtttcttgttttagtatttccgggtcgggtttcacccgtatccggaaatcaaattcatcggagcgcttaatttgagtccacaattaaagtgagaattttcctgaagaagaagaacttttgctttttttctgggtttgcttttttgttgtgtcaatgaaatg

SEQ ID NO: 23308 - DNA, 3000 bp, Unknown; identical to SEQ ID NO: 1417
  misc_feature (1)..( 3000): 2750-1469P.txt file - cDNA_ID_2136112; gDNA_ID_1620399; Annot_ID_155883

SEQ ID NO: 23309 - DNA, 3000 bp, Unknown; identical to SEQ ID NO: 1416
  misc_feature (1)..( 3000): 2750-1469P.txt file - cDNA_ID_2136122; gDNA_ID_1620399; Annot_ID_155887

SEQ ID NO: 23310 - DNA, 3003 bp, Unknown
  misc_feature (1)..( 3003): 2750-1469P.txt file - cDNA_ID_2136144; gDNA_ID_1620401; Annot_ID_155953
ttgtggaccctcgacaacgttagaaaacatcttctgctagatgtttgatggcctttaatagctaagtgatttatagagaacgacatataatgggctttagtttgggccttttaaaagccatagtatgggcttatttgctttgtccaagttcagtattgggtttataaggaaactttttatcgtgaaaaatagagtaatttatattcacaagcagatttccatttcgagttattttatttaaaaaggctgtgattactgataagactgatattattgagtgaaggaagtggtgtgggattctaaaattgctttgaacgttttgaataatcctgtcataatgattatgacaacactagctttatcatgattaccacctcaatcaatgtttaattaaccagataataaacgaaaaaattaacgaataagaagatggcagtgtattaaaatccaagcattgacccatccgacccatgatcttctcggatttgtcggtatcattacatgctgctaaatagtcttctctaacgttgattttgtctagccacatcaagaaagaaaaaactatattcaaaagtttaaatgttagggaaaccatcacataacatgcatttttaccaaaaaaatagttttgaaaaatgaaatattagttgaagttgcagagattcgaattaaaaccgcgagcctcttgttaaaaaataaatccctcaacttcaaaactgtagtcataccataattctggcttgtgatctcaatagaaatagtatcaaagagtgacaataatgagtaatgacagaaaatgagtacaaaagtgttgaagaaaaaaaaaaaagtgttgaagaatattatttatcttgagctttaagtatatttataacacaagcgttgcagatttatgtttacgtggaatagaagaaaacttttttccctcaagatttttaattttttgcgtagaggaatatttgtttcttcttcttatatattgacaataatgtacatgctatttctaaccaagagaaatacagctagaagttaaaaataaacaaaatataccaacttgaaaaataagaatgaaaattattatttaggttttagattgaacctcttgattttgtatagtcactaatgtttctgcattattttgttagtaaaaggataagatattaaataatatgaggaaaagaaatggacatccccggcaaatgaaaatggaaaaaggtataataaagatgaaaaaaagacaatgataaagctattttggtttaaaacaaattaaaagaaaaaagcaaaacgctagagagcgtgtggttgaccccttcgttctacacttgtcgattaccatcaccattaccattaccattaatctcttaccattaataaacataaacacgcacaatgagagtcggtggatgaatagatcaatttatttttcttttgcataatttaaaaaaaaaaaactaaaacaatagaaagaataaaagacaaaaaaagaaagaaagaaagataaaagatagagatgtaacgttaagcccgttgtgtcactttattccaaagttgcatgtatgggttgggtcttcttctttttttcttccttttgtattcactactaaatatatttttaatagattcgctataaacttgatttatacttattacctatttcatgtaaaatatttcttcttgtctaccaaaattcgttgttagaatagtaaactaaatctttcaagttttaaatatcaagcagtatcaagcagagcagtacaatggagacactttcttatattaataatatacttgcttgtgacatagctaaaaacaaccgacacttttacattttgttttcaactcgagttattgtttgttagtattaaaaaacaaactttaaatagtcttttgaagtttggaattgttggcccatattatgttgtaggtaatatggaatcagccggtacactggaccacagaggattgtctttccgtctacagtctacagaatcagccggactagttttgtaacttttgtttaaaagagctatttattatttgtaatcttagtttttaagttttaactaaaagaatgaagaaaatgtagacaaaatcgaaaagtcgatggtggaggtatgtacgtgtctttttcctttgtccgtcttgaaaccaacgaaacaaaatcggaaattgtctacgttaaaggacaatcacattcttagttaattaatactccataccaagggacatttacgtctttaagcaccaaaaccatagtattggattggcgaaaatttccaaatttccaaagcaacaagaccatgagagtccatccataatcatttttattataaacttaatagtcaatttccatgaagctggacttgaatagttaggctgtctattcttcgtttttatgtcttttacgtgaacaactcgtaattctttatctgtttttctgaacatatgtttgttgtcgcacacgtataatacaattatacaaatacatttgtttttagtctaaaaccatctacattgggatattttataagagttttttacaattaaaaaaataaaaataataaaaatgaaagaaagaaagtgaataattaaattataatataatattaatattttttttgtttgaaaaactttgtgggtttctgtcctaaattatttttttaatcattttattaagtactggtaattactaattaacggatagtttaaaataagcagattaaacgatcccggaatgctgacgtcagcatcataaatctcagatctcgatacgaaacgaatttctcactgcagcagctattactttccctttttcaccttttttttcctttctttttctttcttttttccatttcttaattttttcttcccattgaagattactctacgatctgacgaacaaggcaaccaaaaaaagggcaaagaacagagagagagcaaaaagcagaagaagatgaatttagacgagaattgtaaaatagtttatcacgattcgccatg

SEQ ID NO: 23311 - DNA, 3003 bp, Unknown
  misc_feature (1)..( 3003): 2750-1469P.txt file - cDNA_ID_2136159; gDNA_ID_1620401; Annot_ID_155960
tacgaatcggcatggatctgacgttgtgtttgttacggagatccttggataacggcgagctcatgagaacgcgcctcacgcttgaaggagctgtgaagtgagccttcctgttcttccggcgagaagagctcacacgcggattgaacttcatcgccgctgaatttgtgaagaaattagggtttttttgtgctgaagaggtggagcgttgtgtgcatgagtttatatatgagatattaaaagttacttaaacgctgccgtttctcacagtgagaattagggttttgaaggtttctgggtcagatgggctttgataagttttatatgggctttcaaaccattaaaatggaccaatctaaccttgagaaatataatgggcttattagattgttgtcaacttctaagttaagtgttgtactcaattctaaaaccaaacgcattaaagagtttgtattctttttaattttgttctctccaaaacaatgtgttgggttcttgagaagactgactgttattgattattttttttgtataattaaaaaataaggctgcttgaaatagtaatggttacaatcttgaatatttggttatttggttacaatcttgaataaggctttttgtatatttggttacaatcttgaatataaaatatatctttcaatgaaaaaaaaaataaaaaaaatagtaatggttactgactaagttggagataaggaaatcatcaaatcataaaagatccatttaggttagaaataaatacacacttattgaatatcatttgataaggcttatctcaaactaataaaacaagaatcgagattcgagaatctcactaaacaaatagattaggtgaatccgacaaaagccaatgatgccgtcacgctcataaaactcggattccacaagcccaaaatagacaacatgttttattttattatttgtttaccgacttaaaatattaatttaagatcgttaaaaaacaaactctacaagtttttgatttcagagtccaccgttgagcctgttcaattaaatcgttgaatctcgcggtgcgttttactttgattctttcgaattttttttatatggatgttgccgcgatggcgagatgtgtgggaaggtgctacgtttcgccggcgttcggtgagtctgaatcgcaccggttatcggagcggcggtttctgaaattgtctagctccacgaattcggatcccgccggtagtaaaagtttgaagcttcgcgggaaaattcatcggagaatgagctacttccgtccgatcatggcaaaagatgaatccatttcatcgcggtccggtaataatcacgtaattccgttctggttcatctctaatcctagtttgggttcctatgattcgtttttaacatttgggttcctgagaccagaaatttccatagttttagcataaagtttggaccttagtagacagatcaatgatgtatatctgaatagatctaatctcagataatctaaccaggtgaaacgaagcaaatcaatggaaagcaaaagaacattgtctggcatgattgtcccgttactaaatccgacaggcaagaattaattaagcaaaagggatgtgtgatttggattactggcttaagtggttcaggtttggtcctttgtttctgaattgatctctaactacatcttgttatgtttctactggattctttcaaatattctcgtattttttcaggtaaaagtagtctggcatgtgctcttagtcgagctttgcacaatcgtggaaagctttcgtatatacttgatggtgacaatgttcgacatggtttaaacagcgatcttagtttcgaagcagatgatcgagctgaaaacattcgaagagttggtgaagtggctaaactgtttgcagattctggtattatctgtattgcaagtttaatatctccttaccggatagaacgagctgcctgccgtgcattattaccacaaggagatttcattgaggtttctccaagttcatgaatttgaatcccagtctcaacatcaatctgactttctcttggttctcttgataggtatttatggatgtgccactccatgtttgtgaagctagagatccaaagggcttatacaaacgtgcacgcgctggtaaaatcaaaggtaactttgctttttctctgcatctgttttcaacttaacccatgttctactgattttcattaattatataaccttcttgatctatccatttgattatatgtaaatatattgttccccaaaacatttcttctccaggttttacaggagtagatgatccatatgaagcgcctttggattgcgaggttcatataatatccaatttttgttatataagttggaatctagctcatctccgaacttgaatctaatgttgtgtttccgactactctttgcagattgtaatacaaaacagtagagacaaggggctttcttcttcatcttcatcttcatcttcaccttcatcttcgtcttcttctctgtgtgaaatggcagatattgttgtgtcgtacttggaccaaaatggatacctgaagaaacactccacaaaatcacgtaattgtatgtaaatgtaatattaatatcattgttgtaacgtttcttaaacctattttacctatggacgattaaattgtgaaaacataaatgtaattcacaatctgcaaagagttggtaagaaaaacttgtttgattgattgagagaatgagattattatatggccgccaagttggcgccaactctccggctttttaagtaatcgagcatttgggcctaaaaatatacggcccagtgttaacaaaacaggcctttttaatatccgggtcggactctattaaggccggatctggttctacggcggcgactcctcctcctgactataacaaaaacaaaacgcggtggggagggcggtagtatcagacagatcgaaaatcgcaacggttaagattccagctactgaaatctatcaacgtcgaagaagtgaacgatg

SEQ ID NO: 23312 - DNA, 3003 bp, Unknown
  misc_feature (1)..( 3003): 2750-1469P.txt file - cDNA_ID_2136173; gDNA_ID_1620401; Annot_ID_155964
ggagagtgattagagtaacgtatcttgagccgttttctctggatttttatttgactcagctcttcttttcactgggttatattttttttccagaaaaggttaaaagaagtgggaaaagatcaaagtatgttaaccgatttaagactatcatcaatcatgccgtgtgtcaaaacccgctaaaagcggaagagggtttcttttgtttagtcttgttcactcatacatagagtcccacatcgctaacaaaagaagcgtgaaagagaagaggagtagtataaaaaacgcggccatggatcgtaacaattcatacctttctcggccttttggctaagatcaagtgtagtatctgttcttatcagtataatatctgatatgtgggccatcggcccacacgatattaactctattttttaagggagaaagcccattatgatagcttgctatctgggctttcacgagtcgaccatgcgttgcactactgcacggtcttggctcaacccgccaactattcagtctaaaaaaattattaagtatctatagagataaaaaaaatcgaaaaaccaactaataatccacaaaggcaatatatttacggacctacataaacattgacggttcagatctgggcttaagaagcccataatcaaacacatcctaatgattctccattattgacccaaacagctcgtattagtacagtttccaatcagcgaatcattggtcagtggtcatcacgcgccttccaaacacattcttttgttttcttatcaaatctaaattctttcttccgaacttctctctgtcccatcgaatcttttttctgagtggctagttttttgttttttctttaataataactacaatacatagcaaagctccattattttcgctctgtcagacacagcttcagtttccctacaaaacgaattataatcagatctagaccgttaatctcacgacctacataaatatagacggttcagatttactgagccattttgtaactttaattcgccggctctcttgccgtgttttcgattttgacaaacgaaaaaaaaatcttcaatgagataacaataatatcagcagcggaacaaggattgagaaaaggaacctttcccttttaataagccgatatagatccttggaggagaatttgtagcagaccgatctctgtctgttgtctctgtttctacgaatctctgtgtttgtcggaaatcgtaaattatgggtttgtgggatgctcttctcaattggcttcgcaggtcagtttctatgtcttctacttcaaattttttgtctgggttcgtgggattttgatttggattgtttctcttggtattttgagttcaatgattggggaaatccaactatttccgccgaatttggttttgtttacaacaaaattagggattttagctaattttgattcctgatgtattaatgcatatacgatcacataagtctctggctaaagaaagcaacaactctctctctttttcagctattgattgatcatcaaatctaccctttagttttgattatcaagttttaagtttagacaatacaattgtgagattccatgttggatatagatggttaatcagtagatgaagattgtgagagcaagaacttagtttcccaaaaaaaagttgcttgcttcgcatttgcccgatatgcatagtctcacaatgccttattgcagcctcttcttcaagcaagaaatggagctttcattgataggacttcaaaatgcaggaaagacatcacttgttaacgttgttgcagtaagtagtatgcttccccaaaaatcgttccctctttttttctctaaatgactcgttgatggcttccttttgcatttccttgtccagaccggtggatacagtgaagacatgatccctacggtgtgttatactacttttaggtggcgaagtatttgcttgctcttggactaatcgtaaaaaggatgtttactctttcttaggttggtttcaacatgaggaaagtgacaaaaggaagtgtcacgatcaagctttgggatctcggtggtcaacctaggttccgcagcatgtgggaacgttactgccgttctgtttccgcgattgtgtaaatctctcttgaaattagttttcgtactatctttatttaggtttcagatgattaaaactctctgactctgattctgctttcaggtatgtagttgatgctgctgatcctgataacctcagtgtctcgaagagtgaactccatgatttgttgagcaagacgtcgcttaatggtatccctctcctagtccttgggaacaaaatcgacaagcctggagctttgtccaaagaagccctaaccgatgaaatgtaagcctaaaacctaaaacacgacaatggacttggcattttttactttgattctaataatgttttattttccattgtttgccacaggggtctcaagtcactgacagatagagaagtctgttgcttcatgatatcttgcaagaactctaccaacatcgatcaagtcattgattggcttgtaaagcactccaaatcatcgaattaaactttaccccaaaaggagagaagtcaactctctgcagttgtcgatctttcttgtgtttttggtcatttgatgatgatgatggtgattgtggaagaagacacagcttttttcttttatcctgtgaaaaacaagatttgtctatgttctctgtctgattctttatctgtctttcttctgcgtatgtggctgtgttctctgtatattagatttgattggtgttccctcttcttaaagccatgatgagatcacttccttcggggtcagctttttcaattttacgagttcattgcatgttttgaaagaacaacaaaatatgttgcgtttttcgtaattttgaaaaacttgaggccaaaaacggatattttcgaaaaaagcaacaagataaaataaaagatttttccttttactctcacttgcactatcctcctcttcgcaacaatg

SEQ ID NO: 23313 - DNA, 3000 bp, Unknown; identical to SEQ ID NO: 1433
  misc_feature (1)..( 3000): 2750-1469P.txt file - cDNA_ID_2136195; gDNA_ID_1620401; Annot_ID_155971

SEQ ID NO: 23314 - DNA, 3000 bp, Unknown; identical to SEQ ID NO: 1428
  misc_feature (1)..( 3000): 2750-1469P.txt file - cDNA_ID_2136223; gDNA_ID_1620400; Annot_ID_155904

SEQ ID NO: 23315 - DNA, 3000 bp, Unknown; identical to SEQ ID NO: 1419
  misc_feature (1)..( 3000): 2750-1469P.txt file - cDNA_ID_2136231; gDNA_ID_1620400; Annot_ID_155906

SEQ ID NO: 23316 - DNA, 3000 bp, Unknown
  misc_feature (1)..( 3000): 2750-1469P.txt file - cDNA_ID_2136286; gDNA_ID_1620400; Annot_ID_155921
ttctatctctgttactttctccccggtagtgtttagtatttataaaatagtcctagtagttgtacgattttcacaataacttccatatgtgcgagaagctcaaaaacaggcccaagggtatttataattgcaacccctttgaaaaacgtaaattgctttatcaccaataatgtttgataatttataaaataattcaaatagctgtaaggccttacaaataggcccaattgtttttatggcttgtaaactattccccatttttttttggtcgataactatgccccatttgaatacctatttttcttttccacaatttgaatacctattttacatttacatgtgacatcttcttattggatcatacagattacaggctgtgataaagaatggaggatcaactttacatatttttcttttcacaaacaccattttcgggaagacaaaaattccaatataaagaattccaatttcttactatcattgcaagaatgaagattttttagctagataacctaattttccatgactaattagctagatagcctaattccatgtgaaaggtttggttgtgattggtgagatgacaaaaaatatatataactataatgtaacggtaatgttaaactattgttaaaaatagtaaaaaactgtacatggaaaagatggattttatttaaaattttcataataaagctatagttaaaacttatgataaatgaaaatggagtattacaataatattcttcatagattgaaaaaatataaaaaaagataaagataaagttgaagggaattgttaagagttattcttgaaagtagaagaagcgtgtggattggacatgggcttaaagacacacaaattctttctacgaattttgttaatttttgttatatttccttcttcactattccgcttagagcacaacaccacgatgacgaccaaggccatggagagaggatttaaggtttgtctctctctctgctatttcttccctttttggtagaaatttgaaaaaaaatcaatgggaaaatgctgatgaaatgcgaaatatgctcaaacgtgaagctgattctgggttctcaatccatggcgagaaagaggattttggctgaaatgggatatgattacactatcgtggtatgttcaaattgtgattattattgttttgctatggatgttcataacataaattgagtttggctggggattatgttttttttaagactgcagacattgatgagaaagctattaggacagagaagcctgaagatttggttgtggctcttgctgaagccaaggtacataataatactctagggttttgtaatcttgattcaatgtcttttcaatttatgatgatggtaattgttttgactaggcaaatgagattatatcgaaattgggaggtgagagccagtttgcaaaagatcctcaaccaactcttttgattactgcagacactgtatgctttgatgcctcaacactttttgattagaatgttaactttttggtatctttagctgatgttatggtgatggagtttattaggttgttgtgtacaaaggtgttattagagaaaaaccaaccactaaagaagaagctcgtgaatttatcaaaggtttcgtacaagttaactatgtacatgtgttctatgatactataagccacttgtaaggctgatcatggttgtgtttaagcgttttgtttgtaatctacacaggctattccggttcacacggaggagttgtgggatctgttcttgttagaaacttgaaaactggagttaaaaaaggaggatgggacaaagctgaggtacgcagatataaacttttctttctgttttgtcaaattttcttgtggattgaacaatttgtggtgatgtgaatgttgtggtgatgcaggtttatttccatgagataccagaacaagtcattgacggtcttgtaaaacttctaaaaccactcttcttcttactatcgatctcttgaacttagtttgttttgacatataaagtttgtgtgttctattcaatcttcagattgatgatgcaataacttataaggttgctggaggtttaacactggagcatcccctcatttcaccctttatcgattctgtggttagttcccttaatacaaaaagctcgcgtctttgatctacacttgtttgattagttttgtttcagcatatcattaagatagatgttcaaagagatgtttatatgataacactccactaaaaagagttttgttgtaatgttattgtaggtgggaggggttgatacagtcatgggacttcctaaagaactcacagaaaaattcataaacgatgtgttgttgtagctcaagtccctttttgattatgtaggaatacttttgaatctctctaatcaatcatttattttgtaatttggtaaaacacagatttatcgtatcatgtttttaagtagtgatgatgttttcagatttcaaactctcataaagcaattgaaatgtgtcaaagtttttgcagtttaaacaagtttcagacaaatgtggatttttaatgtctgaattacgatttgggccaattcacaatgttaaaggcccatatattggcccaatgactaaggggtaaaactcgcagggttttggagagataccattgaggtttctcttgtccctgttcctcttctaaaacctaaccgccgtttaaaccaccttcggcaccgccattgatatactctactgttttcgtcaaatcgaaggaaccctaatttcgagggcactgaggaagctcaatcaatggctacggtaaaggattcggggtttgaagcccttgagaagcttaaggcaacagagccaccagtttttctagcgccaagttcaatatctgaggatgctcgctctgcatctcagtatctattcatgaagttgaagccgcataaccctaaatgtccatttgatcagctctcttctgatgggtttgatgcggagcagatttggcagcaaattgatatg

SEQ ID NO: 23317 - DNA, 3003 bp, Unknown
  misc_feature (1)..( 3003): 2750-1469P.txt file - cDNA_ID_2136298; gDNA_ID_1620400; Annot_ID_155924
ctccattttcatttatcataagttttaactatagctttattatgaaaattttaaataaaatccatcttttccatgtacagttttttactatttttaacaatagtttaacattaccgttacattatagttatatatattttttgtcatctcaccaatcacaaccaaacctttcacatggaattaggctatctagctaattagtcatggaaaattaggttatctagctaaaaaatcttcattcttgcaatgatagtaagaaattggaattctttatattggaatttttgtcttcccgaaaatggtgtttgtgaaaagaaaaatatgtaaagttgatcctccattctttatcacagcctgtaatctgtatgatccaataagaagatgtcacatgtaaatgtaaaataggtattcaaattgtggaaaagaaaaataggtattcaaatggggcatagttatcgaccaaaaaaaaatggggaatagtttacaagccataaaaacaattgggcctatttgtaaggccttacagctatttgaattattttataaattatcaaacattattggtgataaagcaatttacgtttttcaaaggggttgcaattataaatacccttgggcctgtttttgagcttctcgcacatatggaagttattgtgaaaatcgtacaactactaggactattttataaatactaaacactaccggggagaaagtaacagagatagaacaagtgacatagactctgagtgaaggagttgaaacgtgtatgaccagtggaagaaatgggacgcggtggtgatcggcgcccacgttgtgtatcacgaccatctctacgaacaaacatctcctcaaaacgatgtgttttgatgatgacaaggatgcagccagaggggaagaagttaacattcctgatggctcctctaagaagatggcctagaagaaagaatatgtcttcttcaagaaagctcgaaagctcttcgatattgacgttatacttgactctgatgttcctcaagaaggttccagaatcagcgttgtggtttaccgtttcgccacgaaacagccaaatcaaaatggtttgattgtttcgtgtgtgcagttgcaaaaatgtttgtcatgtctattcaagtctattcatggaaattataagcatttaagactattcagagtctacgtaaagtccaaaagaaaaaaatcaaacgaagcagcctctgaacaagggtaacttcctacccatagaattttagattcttaaatgaatgtttgcttcttttggagtttgtggtctaaactttcgttgaccgtttattgtatatcaaatggtttgtttaatttaagcgagctactagactagtagtttgtgatatagtgtatgtcaattaaggataaacacaaatgttacatttatgtgattgatattctgtttttttctaaaaattgacagaagcgttttagttgtgaacaaatttcaacgtatatgttaactaatgtttaatggtgtgaaagtttgaaatggacgagacgatgtgaggagaatatgaaaccacaattgtttagtctttcgtaactttataaagccaacattccatcaaatgatatttctcctaacacgagatcataaggaataagataaagcaaaagagatgaaggaaaaatgaatgacttccaaagttctcttcgcaaaagtctacgcttactttgattgtgtttcttttgttgtcttgtgctattagtagatggagtccaagatattgcatccatgcttaaaaagatcaagaatacaccacatgtttttgggggaaaagtatattaaagcccaaaagaatgttttggaataagtatatatatattttgatacgatttttgtttcataaatggaaagccaaaaaaatgaaactatcatactaagaagttacatattaatagacgtatcttacatcttcataaactcccaaaaaaccctaaacctaagtgaagaaaatgtgtactagtatgagatgatagatgaacatatttagataagcattaaaaacatgaaaggaaatgtttgtaacaatcaattccaaagaggggtctactacaaacatatataataaacacgagcaaccgtaatgtttgcttccacattcaaaatttcaaaaaggtcgaattattagtgtattgtttttgtttgtttggttttagactgtggatgaacaaatcaatgcattgataattgcacatacttttttcttttctcttgctactcactttacatctgtaaatattgcaataaatttcatatatatatatatatataaatttagaaaaacaccaattaatgtctccttgcagtccacatgggcttcctaaacgtcaaattttcccaattttcagaattaggtgaaacgttattatatctaaaaaacagtctagataatatgtctgccacttaaacaaaaagcagcttcctcttttgtttagttttgatgatttatcaaatgaatatcaataaaaaaaatacgaataaaatcaattaatatactttgtaatatcaattgaaacaatgcattacacattaaaaaagaaatagtaacacataaaaagaaacagtggaaagcagaaaacgagaggggtgtgtatatattactaaagaattagtttaaatgattaacaaatgagtgggatttttgcttctcccaaagcgtaatttatctgaaaatgtgtctcgtgttgagagtagttgagattcttgctgttctccaactaaacattaacttttattaaaattaaagaaaataaaaagatggatcaaaaacgagatcccctttttcgatatccgaataatgtttttctttgcttttaatgtgtctctttcttatgatttaggattccaattccttccctttccccttcttgttctctccatattctcctctttagaaagagatagagagagtcttgtttttttcctgtcttgagtgatatttttttcagagccctgagttgttgtctccattaatg

SEQ ID NO: 23318 - DNA, 3003 bp, Unknown
  misc_feature (1)..( 3003): 2750-1469P.txt file - cDNA_ID_2136302; gDNA_ID_1620400; Annot_ID_155925
gagactttatacgatgttgatttggtagagagaatcttaggccactttctcgacaccttggaacaatccaacaccgccatagtcgaagttgacggaaaatctccgtcgctgatgctcgtcgggaaattaatcgacggatttctcgcggagatcgcatcggacgctaatctcaaatcggataagttctacaatctagccatctcactcccagatcaagctcgtctctatgatgacggactttacagagccgtcgacgtatatctcaaggtataacaataaaattcaatgtgaagagaagatcggagaatttggatctgatttgttttgaaaatttcgttttcttcaataggcgcatccatgggtatcggaagcagagagagagaaaatatgcggcgtgatggattgtcagaaactgacgttggaagcgtgcacacacgccgcgcaaaacgagcggcttccgctacgagccgtcgtacaagttctcttcttcgagcagttacaactccggcacgcgatcgccgggacgttattagctgctcaatcgccgtctacgtcacagtcaacggagccaagaccgtcagcggcaataaggaatctaacgataacggaagaggacggtgatgaagcggaaggagaaagacaggtggacgctgggaaatggaagaagacggttagagagaatcaggtgcttcgcttggatatggatacgatgaggacgcgtgttcatcggttagagagagagtgctcgaacatgaagaaagtgatcgcgaagattgataaggaaggttcatcaccggcgacgacgactgatcggccgagaagttggtcgattaccaaaaaattcggatgtaaattcaagacacaggtctgcgattcacacgaagcaacgatggttgatcatagatcacgacggtcttgaattgttttcgattgattttactctttttagtacagaatcagaaagcatattgttgtgattcttggattttagtttttgttaatccttcgagattcttgctatgcgactgctctacacaaatgtgcatcgttttgagtcttgtactcgaattagtaaaaccagaaatgacatacggcacaaagcccatcgttaaacgtttcgaattgagcccttttctcgacttcctccgaatgggccgtaacaatgggcttcagttgcccttatctatcgtaaactgggcactgttttggagagaaattgtttcatatttgtggaatgtgcgccgttttaacgtaggaaaagagggacgaactactcgctgttcagaatcggtagtaggacttcatgtcgttttataaaggagagttcctaaaaacctaaaccctactttagttctactatataaatcaaccggctttggctgagaagaagccattagcacaatccgagtaccgaatcaaacctaagtctctgtaaatttcctcgttttccgtagatttagttctttgtcatcccatcttattagggttattcgtttaatttcgtttgaatcagttgatactctctgattttccaatatgtgtttgaatcggcatattaatctttgatcgactcgattttgtgtttttagaaaataatttagatttttttagagaaggaaaaatattctcagtgatgaagaaacaatagatgacgagtccgatgaaatccattcataaaatcgtggggacaaacgaggcatttgtctgagaggattatttttcttcgttttagcattctaaaatatctaggttttaggaacgtgtataaaggggatttctcagtgatgaaggaacaatagatgacgagtccgatgaaatccattcattaaatcatggggacaaacgaggcatttgtctgagaggaatcctttttgttcaattagttttgttttaattagacttagcaggaagaagaaaggcatgatgaggattgttttattgtcatctgattcttattgatgaatctatacctcctactcattctgagtgccttctcttgctcttaattttcagtcacagatatcattgcattagtagtcactaaattcggattcaattatattgactctagggaacactacatttcaagtgaatctacagatactctaataatataacacaatctgctaagaccaagtgataaaccaattgaactaacaaaaaaaataagtttatgaaatcataactatttcttgatattaaaaaataacagcaaagatgccaagttcatataacataaggccttcaaggagaaaccataacttgtaatttcaaactgtatactggaaagcagactgtgctcaatgtggttttggataattccctgcatcctagtcctgaagttgaagcaaaacctctagtattggcattcttacatatgatgagttaatttctgagagggacgtacattctgattcaggctctaaaggatcgattaagatttttaatttatcaggaccaaatcagaaaaaatttatatgatttctatctgtatacttagaacagcatccataaaagaaaaatgttgttgaagatcaattggacattggacaaaaacctagtgggccgggccttctttgcatctactacttgaaagccttaaaaaagaaaattaattgaaaattaaattttacatttaagtgttagcatccaaggcccattagctcagttggttagagcgtcgtgctaataacgcgaaggtcgcaggttcgaaacctgcatgggccacctttaatgtttttacaacataacaatttttgattattttatactattatacaggtcagcacccctgactgagacagtatccatatctccacttcagatttcgacacgtggcaacaaaaaaaaccagacactccgattcccacgaaacaaaccaatcaaaatcgttgccttatcccaatcttatctcagcccttttgattattactctttagtctttactttgctcacagctttggatcaccaaaaaaaaaactcaagagagactttgtggccatg

SEQ ID NO: 23319 - DNA, 3003 bp, Unknown
  misc_feature (1)..( 3003): 2750-1469P.txt file - cDNA_ID_2136457; gDNA_ID_1620404; Annot_ID_156059
acattcttctaatttgataattggctcaatatgaaatgcttaatgtatgtcaattttgggccgaaccaccataacattaacactgcttttcttttccaattctcttttggtaagaagtgggttaaattcatctacaaaatgataatgtataacatactctcctcacactgttttgataccaaaaaacatgaaaaaaacatgaaaaagctagcaatagcagagatgcagagtgtttaggtagctcaacatattcattgcggtatccttagataatgatatattactaaaagcaaaatgtttatcttattatatcaagtacagatttaaaagttagtacctcatgagatcatgacacatgacaagtctaacgataagatgtttgtctctgtcattaaagatttaactttatttgtactaggtgatcacccgcgctacgccgtggtttttttggattttttgtattgtttaacttaaatatataaaaaatttatttatctaatcattcactcatgcaataagcaattacttttagtattaaaaatattttttataacaaattctcaccaatgcatcatacacataattcataaacaacgtttgtcttaaaccaatttaatagaggatagtgttggattctagaaacttaagaatttgatggtggagctccttacgtattcctcaccctcaattatttattatataaatatcaatttaggagaatataaatatcaatttttaagagaataacttactcaaatcattaagtaatctacgactattatacactcatactttgagtttggattacaaaaaaaaaatcttcgagtatgagaaaactattataatggttttattgaaaaatcatgtaatattaaaataaatttagtaatagtacaattaaatatgtaaatagaataatatctaaaattaaataataaatatatcattaacctataaattaaaagttgaagagattacattaattatttaatagacacatgggaaatgctaaagtgatgatgtgtcaatcatatggagagagttggccaactttcatatatatgattctcttaaaaaaatagaaaacctaaaaaagtaaacaaatttacatatactaatttttatgtctatatatatataattatttttattaatcaaaaggaaaattaacaaatttgattttacatgttttattggtcaattaaataaatctagaatgtattaatttaaaacaaaatcattagtatgaataataaatcattaaataaagaccactaaagtttaaaataacaaaataatttgatgaaaacttgaatttttatcatttataaaatcttgatttttttattatttgatgaaaatgttaatataaaattttaatgttttatttataagtttgaagtcatttaatatgagtttgacattaggtaaacctaatctatgagattatagaatgtagcaaaactatcaatgtttcttttccaaaatattttgtggtttttctttttggttcattatgttttgttatttgtgaattattttaatatgaagtaattatattgattttatatgatatacatattattttgatataaaatttaacacttatccattaaaatagcatgggcataatcaaaatcgggactattacgatgaaaaagatagttaaattgtatgataaaataaaatgtgtaagattaaaattttgggttttagaaaattactaaacaaaatatagacaaagtatgttgactattatttaaaatttaaatatcatcaataagatatagttaaagtcattaagtgtatagcaaaatgaaaattctaagattaaaattcgattaaaattttttttactaaattaaatatttaaaaatagggattatcatttactatttacaattctaatatcatgggtaaaaattgataactttttttaaacccgcctatctaggtgggcctaacctagtttactaattactatatgattaacttattaccacttttacttcttcttttttggtcaaattactttattgttttttataaagtcaaattactctttgcattgtaaataatagtagtaactaaaatcttaaaacaaaatattcaacctttcccattattggaatggtaatgtcttcaacaccattgaccaacgttaaggaatgtcttttaatatttttggaacctaaatgctaatactgtataccacaatcacttatgagtattgaagttgagatagaggaggtacaaggagaccttatctgcagaagacaaaaagccatttttagcaaaactaaagaaagaaaaaagattgaaacacaaatatgcgccactcgtagtccacccctatctctttggcaaaagccacttcactctttttccctttttatatattaaaaataaagattcttaaggctcttcatattttgctttttgtcaactctttctttgccatctgttacaaacaccaaactctcctgattcatcagttttaagtcttcttcaagtcccaggtaacttcttcttaattgtttcctcttgtgttttgttaactttttttctagcattcttgatctgttgttcttgtcacttgttttgttttctggtaagagaatagaatcttgttgtaataaagttaaactctgtctttcagttgctaatctaagctttggttccagtagatcttagggtccacacattttactaattaatccactctctctactttttaaacatggatcatcacacctttttggtattataatggatctctttgtcttttgcttttaatttaatgtattttggttacttactaatcacctttttgcatagtgaattgggtttagtttaatcaccaatctggtcaagaatctgaatgattcagaccaaagtacaccagcaatctggatgattcagaccaaagtacaaaagtctttagattcttgatttggattttgattgacttttggtttttgatcagggatcatcaatccaatg

SEQ ID NO: 23320 - DNA, 3003 bp, Unknown
  misc_feature (1)..( 3003): 2750-1469P.txt file - cDNA_ID_2136567; gDNA_ID_1620406; Annot_ID_156123
tcggaagttgattctctttaagatgatattatttaggttgactgattgatttgaagtttaatctatccttatgattaggagttttatctagttcgatttgtcattttccttaccaattaacacaacacataaggatacataacataacaaaacgatgcgttttcttaacgggtgtgggattagtcgggtaaatcacaatagcggtataataaacgcggatttgtggttaatctcggtttaatgaccggttcaattggaaacatatttttaaggatgaacttacaatattaagaattatcaaagtttatggtagaaatttaagagacaaaaaaagtgggaggaaaagctgaaaatacaattagtttatggctataaaatcagccaagaacttaaaatttttttgttttaacacaaatttctcttcgacaagttctcatgatttttttcgaagaatacagagagctatgagaacgttatgttttacactgggttcagaaaagcccatccaaggcctgttatcataattggctaacaataaaaagatattccaaaaatggcgcgtgattcattcgcggatgcatataatgcgaaacaaaaacttcattcatgtttgaaagtttgaaaccaaaacaccgtttcttctgctttagagtgtagatcacaagattcaatcaaaacaattaccttaaaacattatttttagagaaaaacaaaaaatttattaaaaaatttatttataaaaaatcttaaaacctttaaatttatatataatatatgaaaaacatgttcaacttatagttataacattaaaacatacgaaccaaaacgaccggatactatatccgatttgttttcaatatatttaaatttaacacttaaaattaccataaaacatgttgacttatgacaccacaaaacttgtgaaatgttgaattttctaactagtttacatcaaaaataaaaatttaacacttaaaaaaaaaagatatcatttttaaaaaacatcaagtgctaaaaaattaattatgtgtaaaccatattaaacctaaaacacctattaatctattatggtttgaatgttatatatctaactagtttacacaaaaattaaaattttaacatataaaagaaaaagaaaaaatgataaaaccttttaaataaaaccaagtgctaaaactttaattatgtgtaaaccaaattaaacctacaacacctcttaggggtttggatgatgtgtctaattagtttacacaaaaattaaaaatttaacctttaaaaaaataaaaataaaaacctttttaaaaaaacaagtgctaaaactttaattatgtataaaccaaattaaacctaaaacacttcttaggggtttggatgatgtatctaattagtttacaccaaaattaaaattttaacacttgaacaaaaagacaaaacattataaaaaaaaccaagtgctaaaaatttaattatgtgtaaaccatattaaatttagaacacctcttaggagtttggaccatggttaaatggcgggatccaaaattcagatttcacaacatcatattaatttaatatttataaaactttaaaaaaaaaaaaaaaatcaaaaacaaaagagttaaaaactttttaacaaaagaaaataaaaagtaaatgttaaatataaagatgtgaaaacatgttggatttgtggaatcgctaatgaccatggttaaatggcgggatccaaaattcgtttagatttcacaacttcatattaacttagtatttataatacgttttaagaaaaaagagataaaatagaaagagttgaaaactttataaaaaaaaataaaaaaaatgctaaatatacatgaagatgtgaaaaacatgttggatttgtggaatcgctaatgaatgacctaaatgccgggatccaaaatctggttagatttcacaacgtcatattaattattaatttagtatttataatacgttaaaaaaaaaaagttgaaaatcttataagaaaaaaaataatctaaatatacatgaagatgaaatgtgaaaaacatgttggatttgtggaatcgctaatgaccacggttaaatggcgggatccaaaatccggttagaattcacaacgtcatattaatttagtatttatagaacctttaaaaaaaagaaaaaaaatagaaagagacgaaaaccattttcaacaaaagtttataaaaaaaaatgctaaacatacatgaagatgtgaaaacatgttggatttgtggaatcgctaatgaccacagttaaatggcgggatccaaaatccggttagatttcacaacgtcatattaatttagaatttatgatacctttaaattaagaaaataaaataaaaataaatgctaaatatacatgaagatgtgaaaaacatgttggatttatggaatcgctaataaccacggttaaatggcgggatccaaaatccggttagatttcacaacgtcatattaatttagtatttatataaaatacctttaaaaaaagaaaaaaaaaaagtttaaaaccttttaacaaaagaaaataaaaaataaatgctaaatatacatgaaaatgtgaaaaacatgttggattattggaatcgctaatgaccacggttaaatggcagaatccaaaatccggttagatttcacaacatcatattaatttagtatttatatagtacctttaaaaaaaaaaggaaaaaaaatgttgaaaaccttttaacaaaagaaaaaataaataaatgctaaatatacatgaagatgtgaaaaacatgttggattattggaatcgctaatgaccacggttaaatgacgagattcaaaatccggttagatttcacaacgtcatattaatttagtatttataatacctttaaaaatagaaaaaaagaaagaaaaaagttgaaaaccttttaacaaaataaaataaaaaataaatgctaaatatatatgaaaatgtaaaaaacatgttggattattggaatcgctaatg

SEQ ID NO: 23321 - DNA, 3000 bp, Unknown; identical to SEQ ID NO: 1467
  misc_feature (1)..( 3000): 2750-1469P.txt file - cDNA_ID_2136569; gDNA_ID_1620406; Annot_ID_156124

SEQ ID NO: 23322 - DNA, 3000 bp, Unknown; identical to SEQ ID NO: 1468
  misc_feature (1)..( 3000): 2750-1469P.txt file - cDNA_ID_2136573; gDNA_ID_1620406; Annot_ID_156125

SEQ ID NO: 23323 - DNA, 3000 bp, Unknown; identical to SEQ ID NO: 1471
  misc_feature (1)..( 3000): 2750-1469P.txt file - cDNA_ID_2136597; gDNA_ID_1620407; Annot_ID_156141

SEQ ID NO: 23324 - DNA, 3000 bp, Unknown; identical to SEQ ID NO: 1481
  misc_feature (1)..( 3000): 2750-1469P.txt file - cDNA_ID_2136607; gDNA_ID_1620407; Annot_ID_156146

SEQ ID NO: 23325 - DNA, 3003 bp, Unknown
  misc_feature (1)..( 3003): 2750-1469P.txt file - cDNA_ID_2136622; gDNA_ID_1620407; Annot_ID_156150
tacaacgaaatccaacaacttctacagatgattactaagaagacgcctcaagatccgagtaaagtgtcgtcacatattcgcgacggtatcaattctgatcccaaaacttggaaactttgtttgatttcctccttctcttatctcaaagtttttgtattttgcagatcttgacatggtgtttgtgttggaggaagttggacactcgtgcgacttgtgccagagagatcttgctaaggatccagaacggcctaatgcttccttgagtggcttacaagaggcgtgcgtgctgtcttgtggtcatgtctaccacttcaagtgtttgagaggaaccactcttgatattgataaccattctaaagatccttcttgcattttctgcattagctgttagctactccaactgaatcaacctacactatatcatcccatgtggattcaactttaggtacttctaccattcaatgtctactagatctacgagagatttaacagttttgtcttaacaatgccaatggagttacttacaaataccagagatttactctgaaatcaatcaattttctttttacatccctgaaaagtttaagtaactttacatatggaaaactagaaccacgccgcatggtagcttctaaagccagaagtgaatcattgcctgttcaagaaacaaaaaacatgtttatagttccaaatatcattcaggtatcccttactaagtagcaagaacattcattacctcttgaattgagttaaggactagatcctcttcgggattggacacaggtttagattgatgatgcagttctgatcttaagcttctcatctctgactgcattacattgagctgttctcgaatctcctttagcaaactcaaatgttctcccttgatgctcgtatctcttggcggcttactcacttttctatcgtaattactagtcaccatcttgcctctaacctgtgagattttttccatctattagtaacctgatcaaatgtcttaaacaaaagatttagttcactaaaaataatgacttacatttctttcttcggcttcctcttcttccgagatgattgtaagactttctttcgtcctaggaacctcgaagatgtcttgaacattcttcggagacagaatcggagtctctaaagaagcatcttttacagagaatctttcagggttcttcatcatctccataatcgaactaacatcactcttagctgactcaagtatagtattgctaacttgtgacaccaacgcatgtgaaattgactcacgcctaatcaaagggaatttagatgccttctgagtatctctagagtctgaaatctctctaacatgctcatctattctcctaatctgttcccaatacgcattcaagtcttcacgaggagatacagaactactctctacaagacctttcttctcctcaaagctttcaccattaacatcagacaaaagtaaacttctttcactagatatgccatcaaatggactctgcaacagaaaagacttatgctttaatctaacaatgtcttcaaaaccatgaaagtagaaagctttatatagccatggccatggaatcagttttttcagttataacaatattgaaaagctttaaattaccgaaagatttctcttcatcttcctcttttgattgccacgagagttttcaccggaaaagatgagagtttcagggaacttattctcaatcacagcaggatcagagcaaccaaggctgagtaatttacatctataagcctgaacctgaaactcaagagacgcaatctccatttccttctgataaatcagatcttcgaaaagcacaagagatgtctcagcatgacacattttctcctccgccattctcttgtactgactagcttccatctccaacgcagctttctcaccttgaagccgtagaatcatcgataaagcctcgcttgcagcagatgaagaagcttcacgttctgcgtcaagttcttgattgatcttttgaagaagctcttgttgtgcccacatcgtttctctgactcctgaggtttctccatttcctcctacccccaaactcatcgttctctccaccattttagatcaaaaatttcttgcttttggttgatctttgatcaatgtgtgatttgttctatgattagaagcaggagaagagagatcagatcgaggatggtttttgattgatgcggcggagggaagcggagaatttaggttgatctccgattaaatgtccaccggagaaatcagatcgacaaggaaagccttaaaagcgaccagatattctcggaagtcccaatcaatagtgggacatattaacgtgtatacgaccactttttgaattgggtaaattaaactatactttataaattataatcatatttgggttaattaaactatacctaattatataatccagccgacacatcgtatttaaagtacgattattttgtttacgttttaaatgatttttattatgtaaataattgtttaaagaattagactgaaaatttggcgggatgagccagacccttgcaatagtgcaacgcatgggagactcgggaaagcccagatagcaagctacctagatgggctttcccccttaaaaaattgagttaatatcgtgtgggccgatggcccacatatcagatattaaactgataagaacagatactacacttgatcttagccaaaaggccgagaaaggtatgagttgcttaatctagtggcctctttatttataatactacttatttctcacatctaaatatactaaatcagcagtcacttttccaataactgatgcatttagtgattgacacatcagcttattactatttttttattctttcattttcacgcaggatttttatgtgtcgtttttagttaactttgtttctttctcaaacgattttctctttcatccccacgatctccacatctccactttctctcttccaaaaactccatgactactgtgtaaaatctcaaagatg

SEQ ID NO: 23326 - DNA, 3003 bp, Unknown
  misc_feature (1)..( 3003): 2750-1469P.txt file - cDNA_ID_2136632; gDNA_ID_1620407; Annot_ID_156153
gatgagggattgagtgttgggacgatcggaggaggaacaaggtttgtagaagtagagagtgcccatgtgaagtctcacttgaatcaagtctaaattggaaagccatagattgtgtgtgggtgtttcttcagctggcttcacgatcgtagcttgcttcacccgaatcttcatttgatccacgatcactaaaaggcaatggctttaaagacagaacacgacttgattagcatgacctgatctgctgatcagtttaccggaaagtggagactgataaagaagaaaaagaatataaaaaggctctttttttttgtcgacaatataaaaatgctaccacctcaaaagaaataagagatgaaaaacaagaaatttgagcactagacgcaaccactccatgaattgttgagaatgggtacaatcataattcaaaagtgataaagagaaatctttacaaagacagatacctaaaaaccccatgataaactcaacttacaataacagcaaagctttacaaaaaagccacagcttattgtctttgatgaacaaagagagtgattggctcagtaaggaacaagaacacgaacggaaggtggaccagatctcatatcttcaagtaacagatcaagaagcgcctttgctataggaccttcttttcctgagtcagacagaaagaaacccatctttaatcagccaatctatccatcatgtaagtaattaaaagtgaggcttttaaaatgtttatatgataatcttacttaccttcaccaataaattcttcatcccattgaatcacaggtctgatcggaattccactaccaataagcatcatctcatctgctttctttccatcttcgactgtcacatccattactttcacagttttaagaatccccttgcttacaagctgttcagcgagtgtaagtgttctctttgctgtacatccgctcaaaacgttatcaaaccgcggcatcacaagctccttaccaccattaacaacaaacgccacattcatgttcgggccttctgcaataaacccatctttacacacccaaatacctgcataagctcctttggcctcagcttccatttgtgagagtacgttagggaggtagttaacacttttcaccgtggcaaactctggaggctttatggggatggacgaggtcactaccttgacacctattgggttaatggcgaagttcgtttttataacaatggcatagagagttggtttgagacattgagatggagataggaggaaatcccctggccctgcagagagccagtatcttagagatccatctctacatccagaaacgctcacggtttgaatgagaattcttttaatagtttctcgatcgaatggaagtgggatcttagccattgatgcagatcgcaagatacggtcaaggtgctgatccaattcataaaggtatctgcttattcgtaggacaacaagcgaagctcagatgattgagtaataagacaaattagaaaagggggctactatttaaagtgactaacccattgatgatcagggcagtgtcaaagactccatgaccacggtgaaccatgtgatcatccaatggaagaaccatcgctgctggatcggttgtaattccatcaacaacacttgagtacatggccaagaactgttgtcctcctcttgctagttttagcctctcaccaaccttttaaaccaaacatacttcactgatactcaatcaatcaacgcctctaaacataaacggataacaaacaaatgtcgcaatccttcattacgggctgcatctataatttcattgacaaaacacagaaatgtctggtggttgtgtcaataaacatctctagctaacaaattgtgaacagtttcaagagttaaagatatgattgataagtacagacataaaagagaaaccataattacctcatagctagataaaacaggaacattccacgactgagagcttgaatctgtggagaaacgaatgcagatttttgtcatcaattccagaacacttatggaatttaacgatcaacaaattgatctcttttttagggtaataagtgtacattaccctaaaaagattataataaatgcatcaccaatcacaatccagaagaaaaatcagaaaagagagaacacaaggtagaaatgtcgaaccagaacacatgagaatcgttcttcttcgtgtcaaccgacgcgggaatcgaaagccatgtcttaaaggacatggaacttgagagagagacctgagattccaagtgttaactgtaaactccagcgacaaacctgccatggggtttgggactcaaaagaatagagagagagagatcattcggaaatagcaacttgctttgcattattattatctcagtcgtgaactggaagaagacgaaaaaatatttgggcctaacttcaccacaaaaataaaataaagttattcggcccataagcccaatatgacttttcgcattgtattttaatattcaatcaatcaaaaataaaagcctaaaacaaaacaaaccctctctgtcttttagtgggttttgtacgacgcctaatcgatgttagtattatatctgtagccaaacaagccaccaaagtggtatttttcttcttccttccttaccttgtagggctctgagctcgagttataaaaaagccaactttgatttctttgccagtatttcatccttaatccattcttgtggtcactttttcgtccttaacccatctaggtaagtcgatttcattgtttgttatttgagtcagtaatttttgaaaatctttgcttttttttcttttcttttgaatatcaaaagaagaaaagatttgggggataactagatcatctctttagttaaattgactctttgaggtgtgtcaattgtcactgatagtctgattaatcttttattggcatcttagaacagattttgattctaaagtcttgtgaatcggcagcggaagaagagtgaattgttcatccttatcttgccatg

SEQ ID NO: 23327 - DNA, 3003 bp, Unknown
  misc_feature (1)..( 3003): 2750-1469P.txt file - cDNA_ID_2136636; gDNA_ID_1620407; Annot_ID_156154
gcaagtcgcttctctgagccagactctcgtgattggcgtagccgttctactcaacctccaccctctggggaggaaaggtcgtgggataatcttcgtgaagctaaagattccaggtatgttgaagcaagtcaatataatcgtcaagaccaacctaattcccagttttcaagggcaaacatatcatccaaccaaggggtaattgatcaatagatgaatgtttttccctcttcttagccctttacattctggcatgatttcttatttttcttacttatttgtatatcgtgtggaaccagggtggaccagctcctgtcctcgtcaaagccgaagttccttggtcagctagaagaggaaacctttctgaaaatgatcgtgttctgaagactgtgaaagggtaatgccgttgtgacagttattagttgtctagacttttgtataactttcctttactgccaacatgaaatctttaaaatagactatgcacacttacaaagatatacttttcttgtccaggatactgaacaagctaacccctgaaaagtatgaccttctcaagggccaacttattgaatctggcatcacatctgctgatatcctgaaggtgtatgctatgtctcaagcatagatgaagtcttgtttgaatcatctaggctgtttgtgtggctaacccgtgttcttttctttcatttgtagggtgtgattacccttatttttgacaaagctgtccttgagccgaccttttgccctatgtatgcaaaattgtgctctgatatcaacgaccagctgcccaccttcccacctgcagagcctggggataaggagattacatttaagagggttctactgaatatctgtcaagaggcatttgagggcgcttctcagttgagggaggagcttagacagatgagtgctccagatcaggaggctgagcggaatgacaaagaaaaattgttgaagctcaagactctaggaaatattcgtttgattggtgagcttttgaagcagaagatggtcccagaaaagattgttcatcacattgttcaggttaacacctataagcttacacattttcttagacttcttttattttggtatctagcattaacctttcttaatttgttctgtgcacaggagcttctgggggccgatgagaaagtttgtccagccgaggaaaatgtcgaagctatttgtcatttcttcaaaactattggcaaacaacttgacggaaacgtgaagtcaaaacggattaatgatgtatatttcaaacgcctacaggctctgtcaaagaatcctcagttggaactgcgtctgagattcatggttcagaatatcatcgacatgcgctccaatggctgggttccaaggcgggaagaggtattctaggttttacaaggttgagacttgtttcctgctccattgtgtagtgattctaatgttctatttacattactcgtgcagatgaaagcaagaactataaccgaaatacatactgaggcagagaagaatcttggtctccgaccaggtgccactgcaaatatgagaaggggtatggtttctagtggtgggcctgtgagccctggccctgtctaccctggtgggcgacctggtgcgggtggcttgatgcctggtatgcctgggacgcgaaggatgcctgggatgcccggagtggacaatgataactgggaggtaccccggacaagatcaatgtctagacgcgatgggccaggacctctacattctccagcagtgagcaagtcggcctcaatgaacacgaggctcttacctcaaggcagcagtggcattatgagtggcaagacaagcgcactgttgcagggaagtggttcagtgtcgcgtccagttaccgtgtcagcagaacggccagcacagtcagttgcacctctgaccgtaccagttccggtggagaaaccacagcctagtggtcccaagttgagcgaagaagtgctccaaagaaaaacaaagtcgcttctcgaggaatatttcaatgtccgactacttggtgaagctctgcagtgtgtagaggagcttggtttgccgtcatatcacccagagtttgtgaaggaagcaatatccctgtctcttgagaaaagcccgcctgtcgttgagccaattgctacactcttggagtatttgttatcaaagaaggtagtcgcacccaaggatcttgaaactgggttcttgctctacggtgctatgttggacgacattggaattgatcttcctaaggcaccaaacaattttggtgagattgtgggaaagctgattctggctggtggtgtggatttcaaattggttagagaaattatagggaagatggaagacgataggttccagaagatggtggtcgatgcagctgtacgcattgtggagtcaagcgagcaggggaagtccttgttggcctcacaggctgcagacatagaggcttgtcggaatctgtaaaaggaatcattacttgacgattttgctctctctgggtcttatgcttgtgcgatgaatgttgtgttgtaagcttgaaggaggaggagaaaaggattctcagaactcaaaaatagttttgctcttcgttgaagctttttcttatgacattattctcaccactcttctttgtgggcatgagtccatgtccttttttgtattcttctgtgacttgtctttttttgacctttgcatttttgttttacggtctcagttattatattcagttgattgttgttgagacttgagacccctataaactggtcggttcagataattacattggaaatgtttgatcatcgtcttcctattattcctatctgattctgagctaacattagttgagtaaatgattcattcgaccttaagctttatcaagtttgatcaatgggcctgagtgggctttgtaaagcgtcacaaaaactctcccgcgcaggacagagaatcattagttattatcctgaaaactaaaatacttttttttttttttttcaattttaaacaaaaatg

SEQ ID NO: 23328 - DNA, 3000 bp, Unknown; identical to SEQ ID NO: 1473
  misc_feature (1)..( 3000): 2750-1469P.txt file - cDNA_ID_2136648; gDNA_ID_1620407; Annot_ID_156157

SEQ ID NO: 23329 - DNA, 3003 bp, Unknown
  misc_feature (1)..( 3003): 2750-1469P.txt file - cDNA_ID_2136652; gDNA_ID_1620407; Annot_ID_156158
ctcctgcaccgaaacgctatcttcgtcatcgatgcgtctgtcacgttaggactgcttctaatggcaagaacctgtagattcgggcatctattgatatgtccaaaatcagactcgtagccatagaaaattccaaaatagaggatatcacaaactcaatcacgatcttgataagaaagatatttacctatcggctgcgtaagagagagcgtggtcgctgcaatggcggacgcggatcttagtgagaccaccttcgctccaatcaacgactgatcgtagcattaagtctaccttctgctcgaactcaggggaccacaagtgagtcgactcgggataggaatcgaaccatggctccagatcgaagatagaccagagatacggatctctgcaaacagttagccacgatttttggacgaacatcggaccggtccatagctcctgaatcgtaagccttgaaatgatgttgatgagtatctctggagccaatccgccccaatcagacccgtcttcttccataaagattcttgttttgttttcaaagatcggttctttgtgttcggtaataatgtagtttaaagttacacgaaacgtgtctctttagacacgtgtcaatgcatctgaccgttaattttgttccttgacttttggatcacttccataaatgtcgtttgctgacacatgtttcggtatagaaatgtcacgtttgcaataagccaccattggataaggtttttaagttttcaagtcacaattggatatgttgttcaatcaagataagtaaataagcaagctaactttgatgtgaagctatgttacaacaagatctatgaggaggaacaaaaggttccgtcttcttattttagactctgagagctgcgacaggatcttgccatgaaattttcctcttatttgatccgtttccgccattcctgcaagaagatggcttcacatctttctgctgcatctcaatgctactgatcattaatctcttacatgaattactttcttcaactctcgtgttctcttgattattgtccactgcctctgtttcttgctcttcttctccctatataaatcaatttatgagtaaagacatgtttggtttctaagtctcttcacaatctgattaagagtgaaaaatgtgcttacagatatctgatttagatcaaacaaaggaactcttctcttaggactggttttggtttcatcgtgagccttttccgagtggtttaagtcaggaagcgaaacatgcttagtttccgcctcacttttgttactaggagacacttccactcggatcttcttcccaccatttgatcttctgacctttttaatctcttgtggctggtcttgtctcaaatgtctgtatctccgtcgcagaaatctgttaaagaggttataaacgaacgatatattaacaagtgaggaaaacatcaaaggaaaggactaatgatatattttgtcaaggattgaaactgtctttacctgacttcagccattagtgttgcctttctttctcgcactgcctgtaacctttttctcatagcttcggtttcctagtgtatataatcaaccaacacacgttaacaaaagctcataaccaaatgatctcaaagatcagagtatcgagctgataatatgtacacaacaaggttttaaatcctaaaactatgtttaagagttaagactaatagagatttgcataactaactacacatagaaatcttaataagtaattaactttgttaaggaagcagaagcaattaaacttaaaagtttcttctttctattattttaaagaagaaagttgttcctttttccgggttttccgagtagctctgagcccagatcaatctttgagcaaataaaattacattctcagatccagagacaactaaaaccagacccagaaactgaaacttgatctaaaactcaagaaaagagagttcgtaccatatgcaattctccatagtcttgcataaggctatgatgcctaaacctgacctttggatcctcgaaatgattagagttcaagggagtgaaatctccgtgagttggattcatcagatgagtaaattacagaatcacacaaggagagaaagagagagatgaagagcaaaagatgaaaacagaggaaagagagaaatgagaaagaggaaggttctgggtttcgtgtagaagtctaatatcaatgtgaggagaagtcagagaaggacaaagaagcagaaaagaaggacacatcatgttgttgctgttgttgttgttgttgttgttgttgttgtgagaaggaaagaaaagaaaaaagaaaacaaaaattaaaataaaaggcaaaatttgcttttttggatgtgagtgtgttgggttgagacagcagtgatgaagatggaagcagacttatgcaggaaatgggtaatgacttgtggcactaagtaaattgtgtaatgggtcaaagaaaacacataaaagcaacttccttttttaataacattttatcaactagacaactttttttatattaatgggttagtttggttagagaaatcttgaagaaaccaaacctttctgttttgtttcttgtgttccattgtcgtctgtaaatattaagtttatcttcattcaactgggtccattgtatagagaccgatgagaatggaggttgaaatatatttttcagactttttaatataatccctcaagaaaagtcagatggtggaagagaaaaaaaaagattcgccttttagttattacttaaaaaaatacggattttgcagaaaactctgtcttgatttctggaaactggtgcaaggttttagttttcttctatataaaaaaaaaatcttcttattacgtcaattgttaaaagattgccatctcttcacatgcattccatttactctgttaccccaaaaaaaaataaagtttaaggcaatgactttttgcgttcacatcgatgattctagtgtgtttaatgcatcagttagtcagtgaccatcagctgatgcaatg

SEQ ID NO: 23330 - DNA, 3000 bp, Unknown
  misc_feature (1)..( 3000): 2750-1469P.txt file - cDNA_ID_2136706; gDNA_ID_1620406; Annot_ID_156114
taattttttttttccttttctgccagaagatatgagtttgtatcacacaaatcaacgatcaagtgagtacatgttgatagaactggactcatgcaatgccacgtgcatgtgattaaaggagatgcaaactttactgataggataattaacaaaatattataatatgaaaatcaaagcaaatttccattaaaaaattgtttagggacgttattagaacttagaagcaaagcaacctttggcccccatcagtagaccatatctgattatacgatagtataatattatgactatgatacatcatacatatatcatatatatatggacatatgtgattggtgattgagagacgttttgggtcattgtttgcgtcatacgactatgttacttaatcaggcattttaatattcttagaaatatttgtttcttaaagcttattaatatatcacgtcaaaatatatattgtgatatttgtatggcaaaaaataccaccaaatcatattaacatattttcagatctgattctttgttaaagaattcgagtgctttaagaattattcgagaagagattctccataaagaaaagaaagatcatcccaccaaattagaatagtaattagtatatcaaaaacagattaattattaaataagtcaagggatccatgcccctacggctctcggaaaggacttgataggaagtagatcccacatatccacttaggtgtaaaggtgtcatgctttaataagttggatttaacagtgaataattcagataaatatttgttttttaaaaacgaaatgatatcaagtactatatatatacttgttttccaatcgaaaattcgactcctaatagtcgacaaaacaaataaaagactccttaatcgcctcagcctttgacctgtccaaataaaagaagaaatcgactaagcattttggatcgtttttagacatatcgtacttaaaacatttactaatacacgatcattacacaagagtatatgttcggataattctgaaagatcgttttctctttttctaaagaaagcagaaaatatgagaaaattgactagaaaaggtgggctggaaaaagagaataaataaatttatagtacacttctactttttagaatattaatttcgaaatgttttcttgtttctgtcagctattaaattttcatgtatgagataagtgtacaccaaagacaacaaagagaaaagttttgcaggaaccaaaaagagaaagaagtgaaagtacaccaaaggaattggaaactatcacgatttaagattacttcattttcttctctacgtttagtttccttttcgatttatctttatcttttcttgtttttttgtatttacattggaattatttctatttctgtcagacattgtcaatgtcgcactactatgtttaaccccgatttagaaaataatatcacagactacttggttatttcagtattagaaaacaaagttatattttcgaaaataagatttcaaataaacaaaataaaaagatgtgatcaaaaccatcgatcaaatacagtttttccagaatgcttaaatttgaaataatgatgatatgtatatgatcaatgatcaatcgtcgaatgaatgtaaagattaattattatcatgaaatttacaataaactcgttatgttcatgaacgcgacgtaccaggcccatatcatgagaaaaatggaaaagtaactatgggtatagaattttcgttttttctcttcctcatatcaaggcccatatcatgaaactggatacaatagtatgtaattggccttggccttcatttttgggcttgaagcaacttaggctcggaccacaaacttacacaacattttttgacaaatctgaagaaaaaaatgtttgataatatctgaaatattataatacatttagaagttaaaaaatcttgaaaatataaattgtttgataatatctgaaatattataatatttagaattagaaaatactgaacccatggatttgtctaattgattaataattgtaaatataccaatctgtttaaatactaggaaatttcatttgacaaacctgtaagtaattttaaaataatgaatagtgatcagatttatacgtcaatgacacggaccttggagaccactttccacacaaaatccatattttttaacaaaccgacccagcccaccttctcacgaaaaccacctgtaccaacagattaggcacgattttaaaaaaccattaaccaaattttatattattaaagaagatatttaatttatagaaaactattgacccaaccttatccaaaaaccaataccacacgtcaaagccacactatatataccagttgcgttgaataacatctaacatagaaccaaagataaccgaacatcagaggtagataaaccggagataaccgattaaatggcggacatagcgattttggtggcggaggagtacgagaggaggatgaagcatacgacggtgggttcgagatcatcgccggtggaatttgattggtggaagataattccggcgaagatgactatagcttttgacaagatgaagattgagagtttgaagaagaattttgaagctaaatctgagtttgctttagccatctctcatggcttcttctctgcttgattccattttgttcatagctaatttcgtttcttaatttctgttttttttttttgctttttgggaagttttatgtaaatatatgtaaattaatctgtttattttatcaaccgttgaatcaatgacttggtcttctccggcgaatcactgttgagtaaaaaaagataaaaaaaaaaaacaaatctcagggactttgttgcatacgtggacaaacttctggggaagaattctaaaattttaaaacttcatcatcttaatactgtgttgagaaacttcggcgtaatttttgcaattcgacccttatattctggatttctcttttaaatcttttcattcaaaattatataaaatg

SEQ ID NO: 23331 - DNA, 3000 bp, Unknown; identical to SEQ ID NO: 7950
  misc_feature (1)..( 3000): 2750-1469P.txt file - cDNA_ID_2137036; gDNA_ID_1621175; Annot_ID_57322

SEQ ID NO: 23332 - DNA, 3000 bp, Unknown; identical to SEQ ID NO: 7943
  misc_feature (1)..( 3000): 2750-1469P.txt file - cDNA_ID_2137036; gDNA_ID_1621175; Annot_ID_174133

SEQ ID NO: 23333 - DNA, 3000 bp, Unknown; identical to SEQ ID NO: 5181
  misc_feature (1)..( 3000): 2750-1469P.txt file - cDNA_ID_2137078; gDNA_ID_1620768; Annot_ID_167392

SEQ ID NO: 23334 - DNA, 3000 bp, Unknown; identical to SEQ ID NO: 5187
  misc_feature (1)..( 3000): 2750-1469P.txt file - cDNA_ID_2137114; gDNA_ID_1620768; Annot_ID_167407

SEQ ID NO: 23335 - DNA, 3000 bp, Unknown; identical to SEQ ID NO: 5077
  misc_feature (1)..( 3000): 2750-1469P.txt file - cDNA_ID_2137210; gDNA_ID_1620761; Annot_ID_167140

SEQ ID NO: 23336 - DNA, 3003 bp, Unknown
  misc_feature (1)..( 3003): 2750-1469P.txt file - cDNA_ID_2137225; gDNA_ID_1620761; Annot_ID_167145
ggaagcaaatattggagagagccagcaagctcaagttaggttaaattctaattagagaaaaacacagtgtttatagtttagataagcttatcatctctaaaaacttgcattgcttagggaaaggcatgcattttctcacaccagatgctatctgaatgaattatggtcaatgttatggaatacttacagcttatcaaagaaaatatgataaatgacaacttagtgtatgttcatttttgcagagagctgacgaactacttgaggaagtgatactctcatggactcttaatcaactaagagaatgtgagactacagctcagaatttgtgcccgacgtacataaaaactcaagagtacgtcttctcaggaacgagaatatgctggaaatggctattggttctgtgttataaatcttcttccaaacttatgtgcatcatcgttcacaaaccttttctcataatgttgttgcagtataaaattatgtcaaggtccctatgaccctatactgataaaagcatgggaagaatgggatgcaaaacatgggtctgagaatgatcacccagattttccggagaaacaagtcagattcttttcactccattagattttaaggtctgtttatataggatgctaaatgatttgtagaagcaatattcattttctgtgtggtgtttgcttccagtgttatgtcatgtttgttctggaacatggtggcaaagaccttgaaagctttgttcttttgaactttgatgaagcaaggagcttactggttcaggtaagttgtagagtatagattctatttgctgttacagaaattatgtaaaaatgatattttttcttccggttaatggcatgtgtttcacatctaaggccaccgctggcctggctgttgctgaagctgcttttgagttcgagcacagggacctgcactggtaattttagtgtttgatttggtaagtttactacttattagttttctctcgcttgaacttcttattttcatttctcttttcaggggaaacattcttctcagtcgtaataactcggatactctgccttttattcttgagggaaaacaagtttgcatcaaaactttcggagtacagatatccataatcgactttactctttcaagaatcaatacaggtgggtttctgattctcaatactgcgacataatgtaaaccataaggtccaatctaacacttaaacagttaaactaccaataatcatggtgctaatgtgctcaggtgaaaagatactctttctggaccttacttctgatccataccttttcaaaggaccaaaaggagataaacaagtaaggaaaattaattaagttccttattatcccaagagttaagagaaatgtacatttattttaagttttaataacgttattatgcagtcggaaacttaccgaaaaatgaaggcggttactgaagattactgggaaggaaggtaagcgtaacttttccaagccttccttttagttttcatgccgctaatttggaaatttctgcagactagactagaatattaagccacaacattatctttctttctagaaagcatgagactgtgatatgagcattagtacgcaaccaaactgaagtgtgcctaaatgatttgatgattaatttaattgccatgttttgttttgttctttctaacaacagctttgctcgaacaaatgttctctggctaatttatctcgtggatatcttacttaccaagaagtcatttgtaagtttgcaagacacagataattattagttgcatcaactaagaacagcttattgatactcctttcgttcgtgtgtatatgttttaggaacggtcttcaaaacacgaaagagaactacgatcactaaagaagcgaatggagaagtatgaatcagctaaagaggctgtgtcagatcctttcttctcagatatgttgatggaccaaatatcatgaagaatataataaaccccgtaagtgattaaccagaagctctctctcttgtatatttgtttgcctagccacttaaatcaacagtactagctcttgcttcgtaatattatctaaggctccgttatctatataccaatcttgattttcatctcttcaaatgaatccaagaactgatatgttagtcttttcttgtatgtgacaatagtttaatggtagcttttatctatagaaatacttttgaaaccatgaattcttttaagaagaaagtatcaagatctaccaattccacatgggttgtccctacttgcatgaatagatcttcttatctcaagaacaaaagttgtcacatttttattcttgtaatgagggaagaacaatattcaaacgcgtagatgataaaaatgagagatttgctttaaaattaggccaataaactaatccatttaaacagctaacaaaagctttatgttgtctgcttttttgttttttcaaaatctttccgctttgttgatttctttaaatctttgtgggttttgctgagctaagcaaaagatcatccattgtattaattaatctcatgatcttaatctgcagcaccagtgtctcttctttccttttctcctttttggataagagaaataaaaataccaatttgcagcttctttcttgaaaactttggagagctttatgcatatgcttatgtctgaaacggatctgacaaaaatgggtttttctctttcttgttttttttctggctagcataaggtaaaagcttatatctttgcacacaaaaatataaagaacagatgagattagtcagaggccaaatccaaaagacttcatagcaaagtaaacatcttttgcctactttcttctttttttctcacttagtcacttgcatgtagagtacagtcagcatcttctctctttttctcccccaattctctcaagagaatctctaagcttttgttcttcttacaaatcatgtacttataataaacccaagaaagaagaagaagaaaaacaaaaccaatcccaagctgtgatg

SEQ ID NO: 23337 - DNA, 3000 bp, Unknown
  misc_feature (1)..( 3000): 2750-1469P.txt file - cDNA_ID_2137247; gDNA_ID_1620761; Annot_ID_167160
tttacggtccatggtttatcataatggcagaaactcaaacaaatattctatctagtttcatataatctccttcttttaaggtattagaggtaatgcatgattcgtgactatgttgcaagaagtcttggtttcaaacaattagctttggctcaactccatgaagaagcaaacatagttcttcgaacttaacagagatctattagctggccatatgaagtacacttagttttctgttagaagaagcacatggtgtgtgaagtaaaaaataagttatcatgttaattaagtaatcagttttattagacccatacgttaagagtctctcaagttgattattttatctgaaaagtcagataaattagcttacctgttttgaaagcttttagattagatcaacctcgacttcttacctgtctttagtcaactttgaacaaaaaataatatggattatacaagaagacgaatacatgagactatggagctcaaatgcacactgaagatcatcagttattgttccttttttattacagaagacaaatcaaagaagataaaaagatcttccctttagaaaaaaacagaactgtagtaatgaatataaaggaagggtgatgatcatttcttgggttggaacttggatttgatgtgtttaacagttcctggagaagtctgaaaggcttgagccaagatgttgtcaggaacaggaggagtagaaccaaacaaagtagcaccaagagattgagttccaggaagctgactattgaaagctgcaataacagaagcagggacatcaccattgttcttctggaaatggacaagtcctttggggaaagcaaagacatctcctttcttgagagattgagagattagcttattggcagtagtgagaaacccaacgtcaagtgttccttcgaggacgaaaacgacctcagtggcacgtgggtgggtgtgaggtgggtttaagcctcctggtgcgtagtcgatacgagagagggagacaccaagtgtgttgagtcctgggattgtcataacgttagctcctgtgactaaggcaccgaatgtgttgttggtaagacctggtttagctaatccttgtgagaagaaatcggctgatgtgactgtagctgcgtctttgcaagggaagccattgattttgattcctgcaaaaaagaaaaacaagaaagagattagaaattgaatctttttctaggaaaagagatgaaagtaaaggtttttgcaagtaccagagggaagatcagcgacgcagagatcttgaagcatgtcaggatctgcggaggaggagatgaagaaggagacggtggtgaggaggaggaggagagtaagagttggtgaagccattgggattgtggtagtggtggtggtgggactctctctaaacaagtagttgttgagagagaagagaattaatgaattatggtttataaagggaggagaattgaagaattgaagagagggtgacttttctcgttgagggaaaaagcaagcaacatgctgtttttctttcttgcacacatctgtctaagtgaaatgtcaaaggtcaacgaattactaaaacggatggatcagagctttgccaattgaaaatttatgtttacactagttttgcttttacacggtactgatattatttttatttaattattagtggcttataaaaaacaattatcaattattatcacctaataaagtatgtatcaggtaataaatgttgtcttatctgcataaactaattttacttgttggcttctgtattttgatcatcgtgagagaagaatcattatatattaacacgctcgttcatgcctcaccgttaatctgcaacgtccgcgtttcagggttagttcttctcacgcgaatcgtgaagcgcgtgaagctacgcgttgtctttaatgggttgggtttaggtgataatacccgataccgttggtttgggctttttagtgttaaaagcctcatctaatacgacgcgtaatgcattgaagacggaacaacaaatcgttttgaattctttattgcttccttcctatacggcatcgtgtgtttttttttgtttcgaggcaaatttttttttactagtgcatgatgtagagaaaatagaattggttaaatttattagtgaaaagattgattaaattttatttacaagtctttaaacggtaattgaaagcttaatcacaattattgaagacctttccacacttttttgtatgaaatctttgtctagtagctttttgaactcttgcaagcaaaatctgaaatttctttccacttttcaggaccattttttcaaaatgtttgaagattcctgagactttctgttctgcagattttggtgaaaagaaaattggaattatataatgaactctatacttctgactattatatgagtaatagtgtgaatttgaaattaataaaccctattaatataatcttgcaccacttaaataaaagcccaatcacaaaactgacttgttctaaaactagttttaaacctaacctattgatgaaatgaagtgacaacttcatgagtgtcaaatcatccttaaatatatacatgaaaatatacaacgaaagatacaaggtggcagtttcgtgaaaatcttaatttcttaacctaatgatcaatggagcgtaatggaggtttaggccccaaagttgtggtctatcagtcacattcttcagtacgatcttgtgatttacaaatggcaagatcatgaatcatgtccatgatgtatgtactttttctaattaaggaaagaaaatatcttaataaatctctcttatgactatgactggtctttaatgcaattctctctctctcactctctggtcttcaattataattgagtttctatataagaaaaacatatgcatactacaaaagaccaagacggatgctttattttcttggctgcgtatatactgacaactctagtacgtctccataatcatttcattcaaatttcattaagaggagaaatg

SEQ ID NO: 23338 - DNA, 3003 bp, Unknown
  misc_feature (1)..( 3003): 2750-1469P.txt file - cDNA_ID_2137255; gDNA_ID_1620761; Annot_ID_167164
tccgtattaaaaagaacatttaaaatctgttatcgtcactgtaataaacaatgtcaatggttacttatgtataagaagtagaagaagatgacggaaaacaatctttgtcactcttttgcaaggactgatcatcttcttcttcagtttgatgaaccaccggaggacatgaagaaagtttttcataataatcagtccctgcgactctgcaaagcatcctcgagatcaagttctaatccaacacgattccttatagacgcagctgcatgacaagacgacgtcattttaaataacctctccaattccttaaacctctcgcagtcaaacttatgactcttcaacaacttcctctgtctcgacaagaagagcctcttcatgaaatcctgatatgtcggatctctcgaagtcatcaagaaataagcataacccacaatgattccagtcgctgtagcgaagaaagtgattggttccatcacatcccatgagaattcccagaaagttaatctaaaaaagagtccaatttgaaccatcgaagtagctaaaccacaccaaagaatcttcctcacttgtctatgagccaaaacatcaatctcttctttcatgattctcaatttgttgaattcttccttgatttgatcttcctctggattctggtccaaaggcatcgctcttctaatcagatccaccacctgaacaaaacaaaaaagtccagatttttagagaaatcgagacaaaacagagtaaagtgagacaaaacagagtaaagttctgtttttgtgttctaattaagaccttgtctgggtgaagatagactttatcacgaaagatcaagacaacgccagcatcgtcaagaacacgagcaaagacatgagcttcatcgggagatctagcgatacccattccttgagaagcttctaaaagtgtagagtaagagacaacatctctatcagccacaccaacaagcttcttcttcatgtcttcaacattcacaagcctcattagcttcttcgcttccgctatagttatctctttcttcttctcctcttcatcctccgacggtgttttgacggtgacgcagcttcttaatccaccgtgaccaagccatgtcctttgcgaagaagctctaatggcattggacattgccgtacgccttatcaaacccattgaccacattatttgacccacgaatctgaagatcttagctctggatttggtgaaagcgaaattgaataaaagttaggttcacagatcaaacgattaaaagatatgagaatcggagaaagagatggaataatataacgcgcttaattatgattcttctgttattaatatcataagattacacgattaggaaaatcgaagaaaagaaaaaagaggacaagcacgaagccatttgctttttatctatcgaaaagtaaaaagattggtactagccaatggccattgttgacttggcatgaagaatggcttttacgaaaatctcaatcaataagttacaactttttgttaactcaaaaatccacattctaaatttgattttcttgataaagttgtatttattctatccaacaaccatcccgacaaaagaaacagtgaaaatgccgttgttgagacctatccttttcatcggagttgaaattgacgcggaatatatacggatttaggttactttattacccacatgacaaacaaacaacacgtaactgagtttaaaaagagaaaaacacgattagtttacgtaaactcttgtttagtttttcttgtcaaattgtttaggtggaattcctaattacaaatccatattctaggctactagcttgcattcactaatattcgttgtgaaaaactcatatgagcatatatagacatcaccatctttttgcactactatgaaaaacaaaaaacaagtctcattttgattgcatattagaaacgatctaaaacattttcgactaatatattgacatacctggaagtacctgctttcaacagtttgcttatatgataatgtgaatgaagaagacgaaggaaaataagttttagcctttctatccacggcttgagagtttttgcattcttttgaaacgaaagcaataacaactaattatgttctctcttgttttgccctttttctctccttgagaatagtagatttgatcgttatacgaccataagggccaaattctttatttaaacttttttttttggtaattaaaacccaatttcataggaaataaaaactagtacattttaggaccccagctaaatatgatgataattaatgtaaaaatacgacttgggaattcatatgtttttaatgctcgacttttgagctgactttgcaataggcttaccacttccgttaaaggataagtttatgaaattattaaaacataaccaaacaatgacatgacgagttgtatctaagaagagatgcaattaaaaaaacacttaatctaaactaatactacttagttagcctggccatactattattaaagatgttttaatcttatgcaatagtttttttttttgtcaaacaatcttatgtaatagtttaagtttgtcaatttgtcttattaaaacaggaggaactgcacaactctaccaaaaaaaaaaaaagtctcaaagactgtgccaaatcttgcctttatgactccaaagtgcacgtttattcagataaagtattcaaaaaacaaccaaatggaaatgagattagagagcgaggttcagagatgatgggcgactagttgcaaatacaaagtgttgtttaaatgaaaagtgattaattatttatatagatctttattggacccaatgctatcacctcatctcaattatcaagcccatgggttggtctcatcaaagcccaatcaaagcttcccaaacaaaaaggaattaagatgaacaaacaaaaaaaaacacttcggagcaaaagatctggccaccacaacacaacgatcgacgaatacaataggaaaatttgaaatctcgtcgatgaagatg

SEQ ID NO: 23339 - DNA, 3003 bp, Unknown; identical to SEQ ID NO: 20590
  misc_feature (1)..( 3003): 2750-1469P.txt file - cDNA_ID_2137262; gDNA_ID_1620761; Annot_ID_167166

SEQ ID NO: 23340 - DNA, 3000 bp, Unknown; identical to SEQ ID NO: 6100
  misc_feature (1)..( 3000): 2750-1469P.txt file - cDNA_ID_2137737; gDNA_ID_1620844; Annot_ID_170156

SEQ ID NO: 23341 - DNA, 3003 bp, Unknown; identical to SEQ ID NO: 20922
  misc_feature (1)..( 3003): 2750-1469P.txt file - cDNA_ID_2137737; gDNA_ID_2926205; Annot_ID_202162

SEQ ID NO: 23342 - DNA, 3003 bp, Unknown
  misc_feature (1)..( 3003): 2750-1469P.txt file - cDNA_ID_2137741; gDNA_ID_1620844; Annot_ID_170158
atggttcttgtgattgggaggtgtgacacccaaattagatttatcaaactcaatttatatatgtatgtaataattttacaataatccggataatatatcagaatttaaatctatataacaatcaccaaaataaattaaattacactgacaatatgaataaattcaaaaaagtacatactattgtactacaatctattgtcggcagtacataataaatcttaacgttagttctatgggattttgtgttttgtaaaagccaaaagaaccttacaagacttttgcaaataataatatggatacatttgaatctcaatcgttaaacaatttgtaagctttaattcaaaaaacaacagaaaagagtttaacaaaacaaaacatatgaaaggaaaaagagaaatggatttggatgtgaagaaaaaagtggaagaaacatattggctttgtactttaacaaaaagaaaaaaacatattggttttgcttccaaatagtgactgcgttttgcggtacgggaaaagtgcggtgcagttcaaatagtaacgaaaatacatagatatatatatatgtagagattttgatattgttacaacactgttgcgatgcgattttgggtatggtttcggttaccattcatagcctttgtagtagtggctatacaaatctaatcttgatcgttgtgttgctttaattaggaaatacaagggagggaagatataaaaatatatctaaaaggttatttgattgatatcgacatatgaaatttcgaagtatgaacacatgaaagagtgtttacacatttacatatgtatttttcaacacaactagaaaagtttacaagataagatgaatccaagtggatgaaattatctgtcacttgcatatacatacactcaaaatctgaaaagtcagaacttgtgaaatgattaaataaaataaagttcgacacaaaaaagggatgaatcatgtaggtgacgagagacaggtattactgttagtgatgcaatataatcaaagcttagattcaggcccatcctcatcatcatagcctgcggcaacaatcaagaaaacatgttttagattcaaatgcaattttttatttttattttattttcatttccgatgaacaaaaaaatacttaaaagcaactaacttagttacatgctaattttatattgtaaacattttttttatataattaatatgggattaaagaaaattttaaaatagacaaatctagtactcttgtctttgtgcgcaagatattaaggttttgaatggatattgtggttagtgctgactgatccgtcagcggttcaattcatattatttttggggcggacaataaaccgctacaaacttagtttaaagatggtctgcagttagtacacagcgcttttcttttattttcttgaattcgcactattacagagtatagttttgtgagtatagtttgtgaacgataaataaaaagcggtccgatatataaacggttttgtgcgcttggacatgtgtcaccattcaaagcctaagatcattaagtccatgacatgtagacatgtttttttctgcaatatacggcaaacatatttgcttgcgacattctaaacctttgttaagttttgcaccattagatacgataaactcaattctcttggaattaaaccatatatacatggtataaaaacctttagaagagacttctactatacattaagtttttttgtttttattattatagaaagtaatcatttgtgatggagagtgtatggacttgattagtttgggaaaattattcaaaatttcatttcatacaaaatgtggtttagaatttagaaaggtaatttgcaaagcactaaagcagctttaatatatctctttcatgaatttttaaaaaataaaaagatacgattttttttggggaaactaaaatctttgtttttctctcttatctctctttgtgtgtttcaattagtgagaaattagtaactctctttctcactctctctctctctctgtttcaactgtctgtgaatcaactgttcttgatctccagaaacctctacacaaacaaaaggtgcgttcttttgcgttgaaatggctcatatctcaaatcgtttgtttctctttgtgggtttcttgttgttaccatgtttaaggcaaactgtctgatctgctcagacatttagttgtttttcctcttcatcactctgcgctagttttgtttccgaattcttttgagacaatattggtttagtttcttcttactcgattcacactttacgacattggattcctataaagtgatttacttttctctaaaaacggcaactttgttgcttaagaatctctctgttcttcaggatttgcattaacgtctctcgtttcctgaaaggaattgatgatttacgccagtagaatttgaatattgtctatgtggcagatgtaaagaacaagttacaaagagatattcacaagaatccgtctggattcatgtgtgaatagaaatatgagcaaactctgttcttgatctttgtgctttcttttcataaggattcatgttttgtgattcttgtaggtcctactttgattaatttaatcacagggattagtaaacaagtctcagaacatagattaataagatccccaatggtgataaacaatctcaagacagtctttttggtaatacatacctttattctattgctaagatcacatgctagaatttggtctttactacttcttgaggtttatttatctctgtgatcttattgaaactgctgttaaactatctacttaatcatttgtctctattgcttttaggtcatagtccatcgttgaccaagatttgaatccaaggctttcccggagagtatatactagttaacaaaacactcataaaaagctctggcttgaccaaattttctacttaagcataacggtggagatctgtttttttgtgtgtggctatataacaaccttattgtctaggctgggattaaacaatg

SEQ ID NO: 23343 - DNA, 3000 bp, Unknown
  misc_feature (1)..( 3000): 2750-1469P.txt file - cDNA_ID_2137741; gDNA_ID_2926205; Annot_ID_202161
gttcttgtgattgggaggtgtgacacccaaattagatttatcaaactcaatttatatatgtatgtaataattttacaataatccggataatatatcagaatttaaatctatataacaatcaccaaaataaattaaattacactgacaatatgaataaattcaaaaaagtacatactattgtactacaatctattgtcggcagtacataataaatcttaacgttagttctatgggattttgtgttttgtaaaagccaaaagaaccttacaagacttttgcaaataataatatggatacatttgaatctcaatcgttaaacaatttgtaagctttaattcaaaaaacaacagaaaagagtttaacaaaacaaaacatatgaaaggaaaaagagaaatggatttggatgtgaagaaaaaagtggaagaaacatattggctttgtactttaacaaaaagaaaaaaacatattggttttgcttccaaatagtgactgcgttttgcggtacgggaaaagtgcggtgcagttcaaatagtaacgaaaatacatagatatatatatatgtagagattttgatattgttacaacactgttgcgatgcgattttgggtatggtttcggttaccattcatagcctttgtagtagtggctatacaaatctaatcttgatcgttgtgttgctttaattaggaaatacaagggagggaagatataaaaatatatctaaaaggttatttgattgatatcgacatatgaaatttcgaagtatgaacacatgaaagagtgtttacacatttacatatgtatttttcaacacaactagaaaagtttacaagataagatgaatccaagtggatgaaattatctgtcacttgcatatacatacactcaaaatctgaaaagtcagaacttgtgaaatgattaaataaaataaagttcgacacaaaaaagggatgaatcatgtaggtgacgagagacaggtattactgttagtgatgcaatataatcaaagcttagattcaggcccatcctcatcatcatagcctgcggcaacaatcaagaaaacatgttttagattcaaatgcaattttttatttttattttattttcatttccgatgaacaaaaaaatacttaaaagcaactaacttagttacatgctaattttatattgtaaacattttttttatataattaatatgggattaaagaaaattttaaaatagacaaatctagtactcttgtctttgtgcgcaagatattaaggttttgaatggatattgtggttagtgctgactgatccgtcagcggttcaattcatattatttttggggcggacaataaaccgctacaaacttagtttaaagatggtctgcagttagtacacagcgcttttcttttattttcttgaattcgcactattacagagtatagttttgtgagtatagtttgtgaacgataaataaaaagcggtccgatatataaacggttttgtgcgcttggacatgtgtcaccattcaaagcctaagatcattaagtccatgacatgtagacatgtttttttctgcaatatacggcaaacatatttgcttgcgacattctaaacctttgttaagttttgcaccattagatacgataaactcaattctcttggaattaaaccatatatacatggtataaaaacctttagaagagacttctactatacattaagtttttttgtttttattattatagaaagtaatcatttgtgatggagagtgtatggacttgattagtttgggaaaattattcaaaatttcatttcatacaaaatgtggtttagaatttagaaaggtaatttgcaaagcactaaagcagctttaatatatctctttcatgaatttttaaaaaataaaaagatacgattttttttggggaaactaaaatctttgtttttctctcttatctctctttgtgtgtttcaattagtgagaaattagtaactctctttctcactctctctctctctctgtttcaactgtctgtgaatcaactgttcttgatctccagaaacctctacacaaacaaaaggtgcgttcttttgcgttgaaatggctcatatctcaaatcgtttgtttctctttgtgggtttcttgttgttaccatgtttaaggcaaactgtctgatctgctcagacatttagttgtttttcctcttcatcactctgcgctagttttgtttccgaattcttttgagacaatattggtttagtttcttcttactcgattcacactttacgacattggattcctataaagtgatttacttttctctaaaaacggcaactttgttgcttaagaatctctctgttcttcaggatttgcattaacgtctctcgtttcctgaaaggaattgatgatttacgccagtagaatttgaatattgtctatgtggcagatgtaaagaacaagttacaaagagatattcacaagaatccgtctggattcatgtgtgaatagaaatatgagcaaactctgttcttgatctttgtgctttcttttcataaggattcatgttttgtgattcttgtaggtcctactttgattaatttaatcacagggattagtaaacaagtctcagaacatagattaataagatccccaatggtgataaacaatctcaagacagtctttttggtaatacatacctttattctattgctaagatcacatgctagaatttggtctttactacttcttgaggtttatttatctctgtgatcttattgaaactgctgttaaactatctacttaatcatttgtctctattgcttttaggtcatagtccatcgttgaccaagatttgaatccaaggctttcccggagagtatatactagttaacaaaacactcataaaaagctctggcttgaccaaattttctacttaagcataacggtggagatctgtttttttgtgtgtggctatataacaaccttattgtctaggctgggattaaacaatg

SEQ ID NO: 23344 - DNA, 3003 bp, Unknown
  misc_feature (1)..( 3003): 2750-1469P.txt file - cDNA_ID_2137800; gDNA_ID_1620408; Annot_ID_156185
gcattcaatattcatacatgcaaatccaacttaaccacaactaatttcataaaagaaaaaagaaaaaaaagtatatgttttcttctgttacttgttcgtcttgttaacttctaacctacaaatgtagctgctatctgtaaccagcacagttattttccttgattattttatcgtcttcaatttaataatttcggatcgaacttctaactacgactaaaggggatggatctgcgtccaagttggccatacgtgtatatattatacatagaataattcacagacctcatgatttttattttcattttggttataagtttaatatatagatgctatctgtaaccagcacagttaaaaagctcttcttaattaccatattaaacttatatttctgatatagctaggacgcattttcctaatagataattgctttttaaaagaatgtctttttgtaaagagtgtacagaaaagaaggtactaggtaggcggttttgtacatatgacattgacgaatcttttttttctaatgaaaatttattcttaacaatatttatttgatatcaacttgaaaataaatttataagcctttgtgaattctcacagcatatcacgaccacttgaaatttgttttttcttacattttttatatatatgatctcgcataagagagagaacctgtaacgttgttttattcttggtcaagtgtgtattagtggttatgtaaagactaaatagggtatagtcgtatagaattcgtaattgtatatgtgaactatactaatttaataagtgttagtttatatatgtatccatcttttgtcgaggattatatgtatctagtttgtacttacatttacaaaccagaatatttacaaacagtgaaaagtaactttataataaaacatgctcaattctttatatactagaacataaatcaatatatatatatgtagaaattaactaaattaatttcttttaaatgataataatacatttggatcaaaattataacaagctttaaaaatcatttaacattacatataatttggtttaagcaaatagtactgtagcatcatcataagtaatttaacgtagaaaaatgttgtaacatcaaatagtagttcagtgttggtctcttatgctagttctagaggtctttgggctcgtaagtcgtatctacaaagacatttaacaatttgatgagaaacaccttctacttgagccttaaacattatatattgtggtcatgctatgggatacagagaacactcgtcgatgagtggttaatagccttgaagacatcaaattcatcctttctagttgtatggtccctaaaaaatctccagatcagattaaaaataataataataataattgcatgccttagacttgatcggaatgagattgatgaaaaatttggagttctatacttcgaaggataatcacgcatttcataaaattagttgattatatgttcttcaattcaatcagagactccaactagatcgccattcgattaaggaccataatcaaatagtctctgatagagtctatgctggaattgaagtacatataatcaaccatagagatgagttggagatatacttacggagccttaggaagattgccaactctaaaaataaatataagttcctaaagtgggcatgtagtatgagaacgaagaccatatgaacatatgaggtaaaattcgggcggccatcaccaatcaatgttcaaattttcaaatgctcgagagatacgtcagtacctctcggaacaagctctcgtgttagggcagtaggtgctttagggctttgaaaagtggagtcatgggtgctaatgaatttgatatttcatccgccttacgttcacggaccacgaatgtatataccatcatatcattgtgagaaactatgccgcattatcaacgactttttggaagttgagatatatatccatcaatgaaacttattatggtttctattcaatgctacaagaattgactaattataatgccaaatacagtattgaagtcgcaaggatcatactacaaaatgtgtccataataataacgttttttttcgtaatccataataataacgtttataaattatagtgttagttgttaacatctaaccgtaaatacaaccaactttaacaaaattttttttactatatcggttaattgactcttgtataagttaatatatatccaatgaataacgccatagacttcaaaaattcaaacgtatatatttaaaatctgagaatatctcctcaagaacagtgttaacatctaatcgtagatacaaccaactctaaccaaaaaaatgacatatatcggttaattggctcttaagtaagttaatatccaatgaataacgccatagatttccataaatctgagatgatctctgcaagaacggaggtttttttttggtcaataagaagaacaagtttatgtactaaaatgttcctttagaaagaagtgaacaagttggagaccgtgcttgtaaaaccccttatacaatagtagactttctttcatttaagaaatttaaaaatgattccaaataaaataaaataaataataaactttgacattcatgtaaaattttacgtcgatattgtaaaacaattacatatttattagcaaatatctctcaacgtcaaaggcccggcaaacaattcctaatctccgcccgttacggtgcaacacacaaaatgataattgaattactatttttttataactatattacgttaaatgatttattaatataaaaaaacgtaatttaatgttccattaaacaactatataaaccaacttagcgaccacttaagcatttcccttactatttacgttctcttctttctcctccgacacactccaaaactcataaatctatctgatgcgaatttgactaactctttcgtaattcaggatcttactacaaatctttaactcaccaatcttcttcttattcaaagattagagagaaaatg

SEQ ID NO: 23345 - DNA, 3000 bp, Unknown; identical to SEQ ID NO: 1496
  misc_feature (1)..( 3000): 2750-1469P.txt file - cDNA_ID_2137810; gDNA_ID_1620408; Annot_ID_156187

SEQ ID NO: 23346 - DNA, 3003 bp, Unknown
  misc_feature (1)..( 3003): 2750-1469P.txt file - cDNA_ID_2137814; gDNA_ID_1620408; Annot_ID_156188
ccattgagaatttggtggattgaggtcaaaataatagcaaagagtttcacaaaagcattgatggtaaacttttgtattttgccattgtagttgtctttttttttttgtaagacgacactgcctaagatttttcttgacccctctcattctgcgcatagatcaccattgaggtcgctaagccgtactgtgtaatttgctttggctaactaattgaagttgagccaattatgaaaagaaaatgttaaatatcaccataacaatcatctgcagtctttacgcctaaaagccaaaagactagaaaaaaccctcccatagatggtttctttgtattatccagagaactcttgaagcaaaatcgttaaagaacggagaccggatcatagctcgtcatttccatatccctcatcatcttcatcccctccgtattcttcaccaccagctggtttttcatttaccgcaataagctctgtgtcaaagatcagtgttgcaccacctgaagtttgcaaggttgtttttagttataatgtcgaaatcccgtatttttttcacaaacatgaatacacattttaaaagcttattgatgaagcgtatttataccggggatagtaggtggagagccttgttctccatatccaagtttagcaggtatctttaacttcctcttctcacctacacacgctcctagcaaaccttgatcccaacctgcaacaaaaccgaaaattaccattgaaggaattaagaaaatgttaaaagaaaagagatactcaaaagccaaaagcaagtcactacctttgataacctgaccacttcctaatttaaactcaaacggatcacccctttcaaaactcgaatcgaatacagttccatcagtaagtttcccctgccacataacaacactaagttacacaacaacaaaaacaacaataaacatttcttcatgacaataatgaatcccaattttgttataagatctagcaaaaacttaccctatagtgcaccttgatcgtatcacctttgtgagcctgaacttcacatgtttttggcttaaactgcaaaaaaaagaaactctttattatctctgaatccaatcaagaaccctaagtatcttacaaatttgttgacaagatcacacttgtcaaatccaaaagactccaactaaaccaaatggtcaaaagacaaaccaaaacagaacacagcacaatcaaaaccagatccaaattcacattccagaaaacaacaatgaataaaccaatattatagctagaaacagtatacgagatcgttcatttcctgatcggaaaatataaaaattaccttgacaccgatctgcaattccgacacatctccggtcttcttggcaaaacctataaacagatccaattacaaggaattagattggaaacaaagagatcatgattttagcacattcaataatgagaaagaaagatgaatggagaaccttggagtgaaatgagagagaagaagatcaaaaagagagagtaacggagactcatcttgctcgccataatcgcttctcagttctcactcttcagttttttccttttcttcagtgtatagaggtaatcttattgggcctaggtaggcctgtggggttctgcatttttgtaaaagcccatcttttatctctacaagcaaagttgaaaatttcggtttaagagttttatcatttcactacgttagagtcttatatttctactagcaaagttgaaaatttcggtaagagttttcatttcatttcatttctttctaaatctactcaagagtgttcactatggtggttacaccggtatgcaaagagttatttaacgagcaagaagacaactacattatctcttaattatattagaatgtttcgcatgcatctaattgtagtttaagttgctgtaatgttttacaaataaaagttttattttataatttcacggtttaatatctttgtttaatatagaagaggaagcaaacaaagatgagaagctcacacaatctcatttgaagatttatgtcactatttaaagttatagaaaaaaacagttaatctctattattattatcatattctattctaattttttttctagtatgtcacatattatttaaaagatgagatgagtgtaatttttttttttttttaataataatatagactgcggtacaaatatctagtaacaaaaatatttatggttttttaaccattgtgattttatttagaatatcttataatattatgggacaaatgaagaatcttttaatttttaactaactaagctaaaattttaatttatatctcagaaaatgattcttcatatttttgaattcgaaaattctagcttgatgaaaaaccaaaagccatttcgactaaattcaaagaaaattacaaccaataagactttcatagtttaatgttacaattaatatccaaagaaatttattaaaatgaaaaagtttttaaggtgatccttgaagagtttttatattacccaaataaacgtcgctttactttactagtcaacttacaaaatcagcattaaccacacaaagcaataaacaaaaaagattttttaccatttgcttaccttatccaaatctgctcccactgactcttccttcaatcttctcctctgtaatctcttcacaatcccaaaaaatctcacaatcgttttttgcttatctctttcaatggacacctctctctcccaccacggatctctcccgtttcccccatcgcgccgcaatttcgttaaacaaaaccgcggcggcgattgcgtttttctcccctcgcgtcgtaagttccgatacgattcgttggtggtggtttccgctgcgtcttcgggacagagcatcgacgcgcctctagttccacggtcgcctcagggaaggtttctaagttccgtcttggtgaaaaaacggcagctctttcatttcgccgtcgctgatttgcttaaacagctcgctgatgataaggaagcttccttatctcgtatg

SEQ ID NO: 23347 - DNA, 3003 bp, Unknown
  misc_feature (1)..( 3003): 2750-1469P.txt file - cDNA_ID_2137818; gDNA_ID_1620408; Annot_ID_156189
tgtaaaattgcagaatccagaaatgtttgaatctttggttgaatccagaaattatgctaatcaatggtttattagtgttggttatcactatggaatggttgtttctgttttatgttctatgatctggcttttatatggagactgattaacgtatttgaatcgatgttttgcagaaggatagctcaacttaaggagagtgattgccaaattgcaattgaagacataatgtacatgttgatcttgtacaaattctcagagataagagtgcctcttgttccaaagcttcccagttgcatttacaacggaagactcgagatctcgccttcgaaagactgggaacttgagtcaatccatagctttgacgttcttgaactcatcaaagaacatagtaacgcagtcatcagtttaagagtgaattcgagtttgactgacgattgtgcgacaacggagatagataagaatcgtctcagtaaagtatacacagcttcggtcttatatggatactttttaaaatctgcttctcttagacaccaactcgaatgctcattatcacaacaccatggaagtttcactaagcaactgaggcattacatttctgagttcgatcccaagatattgcggagatgcgcaaaaccaaggtcacatgaagcaaaaagcctgatagaaaagcagagtttagctctttttggtcctgaggaaagcagcaaagagagcattgtgacatcgttttctagcctgaagaggttgcttcttgaggctgtggcgtttggtacgtttctatgggacacagaggagtatgtagatggcgcgtttaagctcaaggagaatgagaatgcagaggaagaaacaaatagcagtgtttgaagtatgtatgaaccagtttgctagaagaaaacttgaatatcttttttggtggacattgcatataatatatagattaaatcagggtcaatggctatatgaaattatttttgtctatagtttgagtaatcatatgtatagtgtataatggatgatttaatagagagattggttttgtcattttatatatccatcaatatattgcaacttcagaggaaaagaaaatagttaaaaaccacatttattctaggtgtctctcatatttgaccagtttctcatctctcatcaattttcacttgtggacgcatgttagttaattgaaaataaaaagacaaaatttatatgtaaatgcagtatactgtatactgaatatagtaattatgtttttagttactactccttatgtttcacaaaaagtatcattttacaatttttaacacaaattaaaaaaacatctaaaaatttcttttacctattgtaatacactttttatttttaattaataattgaaaaaacagaaataaaacagatatttgattttaaaaacggcatcgaaaacacaaaacaacaatctttgttaaacaaaacaaaaaaatcttaaaacgatattttttgtgaaacagatgaagtattttaaattaaaaattgtaaattaaagtttatagttttttttactatcatttataagaaaatatgtttgataaaacattaactactatgtaacataagtaaaaccgtaccctacaaaaaaaaaacataagtaaaagcgcatataaagatgctactatcttaactttaaaacatcacaaccaaaacgatcagcaaatacgttccatatttttttgttaaaatattaaaatttttaaagaaaatgaagacaatttttgtctttttaactcttgcagttttggtttcatcatgtaagttctcattcttgttcaattaaaaatatatatatatatatatatatatatatatattatagtttaaattttaatttaataagttttcaaaaaactatttttacgtgcatcaaatattatgataaaatctatttcagaaggaaaatctcagttttccggccctgcattaagccctaatattgatccagcagacgaacatattggacactctcccgaagacatgaaaattattttttgccaacaatgtgcatttcattgtattgagaaaaagaagaatatagctcattgtgaaaattctatttgtcgttgtacattggaagacattttgtaagacattatatttttagaataatataagaaataatcattgtgactgattttctacctttacagcctcctttcaatttttaataaaaattaataatatagaattgaaaatacattgagttatacatttttacatatatttaaacgactatatacactgaatctttataacaaagaaaaaaaaatcaaaattgtaatttttgtttgtatcttctatatgtattaagtgttacatgtgttatttataaaatgtttgtgaaggttatcacataaaatttactcatcatctcatggtttgcttttttagaagagaatttaattttagaaatagaatataaaatcataagtcatatatttctttttttgaatataaacaatccgaaaaaatacctagaaactatcttgtttgttttgattataaacaattatatatatatatatatatatatttatttagtctaaattttacgatgtttactaattgcataacaaccgttaaattagaggattgaatctatcaaaaatttaaagacaaaatattataataaaaagtttaattaaatgaggtattttttatcaataaaaaacaaagtaacaattaaacgtccaattaaaaatgaaatatttttttggttttttcctacgtcggtaactaataacgtcacaaagttgatggtatttgaaagaattagcggcaatttattccccccataaattttcatttgtgacctaaaattaactttccctttctctctccgtgcctcttcccattctctttcaatcttgtttgaatctccctcgattttcatttctctttcaatttcaaaattcgcacctcctcctccaaagttgttgaaatcagattttgttgaccggagagtagttatttatg

SEQ ID NO: 23348 - DNA, 3003 bp, Unknown
  misc_feature (1)..( 3003): 2750-1469P.txt file - cDNA_ID_2137843; gDNA_ID_1620408; Annot_ID_156195
taaggtggtccaaaattttgatataatgagaaacatcaagaacattgtatgggaagactgcaagtttttacatgtatcatcatttacacttctccgtttgtaaccacagacaataaggcaaacatgttcaaagcttccgaaaagcggataagagagatgagtggacatactccgataatgaccggtaagggtgaaacacaaccagataataatctagtgcttctaacaccttcatctccattcctaatatatcctttagttcatatttgttgtactcatcaggatctgcaaagatataagaaccgttgtcgtcgatatgtcaaaaaaaagcatattgaaggggaggtactctcatgatttgaaaaataaaaaaacagaagaagaagatattacacaatcttttgatgtaaaaaacaagattcctggcctgcactatgctttcttcagctttagatgccaggtacaagcacgtaagagcaacaagtcgaggctcaaactctaccatactctttctgagatagtatagtaacaaaaggaagatattagacaccaaaactgaaaactttcgtaacacagttaacgtttttgatagcagagatgcaacatagagagacactggcatgacaagaatttaactcatttcattcctcacatacacaaagatgcacattgatgtatacgatcatatcaaaaatacattgcatacctgatataaacccgtctcatatacgtaattgcagtagctacaaccctacataagtagaaaaaccaaggcgacgattcatatacaagtccaggttacaccagatattagagctagttaaatctacagaagcaaaacaaagtaatggaagtactgcaacagtagaatctctttgatatagcaaaaattggacccccaaattgtaaagaaccaacctttgcctcactttaatgtgctgagccaatttcataatatctgaaaacaacaataaatgaagaaacaaagagacataaactcaaaaaacttctctgatcaatctctaatcaaaccagtgcaacagagacaacaaatttgcttaagtaagcaggagaattcgaagaattaagaagaaaaaggatttcgtacgattagacatatggaacttgatgagcttaaaatcatcaattgagattccacgttctttatcgagatcatgaactacgtcgacttcttctggatccaaaagctgtttactgtttcgtacaaacgcaaaaacaaaacaaaaaaattcgagaaattgaaattagaagttgcttagaaggagaagaagaagtgaattttgatgggtaaagttttaaagaacatttactagtgagatgaattccagaaattggcagccattttttccggtagaccgtcgagtctttggtaaggaggagaagcttttttagctcataagttcaacatttttctgttatctgtcaaatctctttggttggtggtctcatgatctatcatatcgttgcttttttctgaaattaaatttaaggctcggcccattatcggcccaataggcaaacaaatgaaagtattaactctgatataacatgttcgttgttttttgaataacagaacatatagatgataaaaattgaaatcttataaatagctaagaagtgaccgaatatatcatttcgacgaggtataatcagtttcaaaaggattaaatttgagtttggtttttttcgtcatgattaaggctataaaaattctagctttatatcatcagccacaccgaatatttttctctcacaagtttttgtatcatgtattgttcaaacgcttgatcagtgattttcttctaaccataagtttgggtgttcataaaagaattttcagaagaacaccacacatttttcgtttgcctaatatacatgttcatttgttttattgagcccatactcctttatcaaaactaactttttttctttaaacatactaaattcaaactaaacttagactaatacatactcaaattaacaccctacatgtttctcacgttcaatatttggtacaagccaaataggtaaactacaatctaaaaacgcacgagaaaaaccgcatgacaaaggaataagccaaataagttgactacaatctaaaaaacgcacgagaagagtatcgattatcccgtgtctaaatttaattccggtttttcgctatcaaaacaattcaagaggagttattattctctaattcaccttatagaattctttgggattatgtgctaacccaagttaaaatctaatgtactcattaataaaaggtaagtaatattaaagttagtggagaataaaatctgttgaagaaaggtgaggaagtgcaacggaccatgtttgacacgtgagagtcaaaaaggcaataaaaaagtcgtcaacacacacactctctccccgtctatataaacatcttcttcacagtccccacaaagtcctcttccgttgccttttcgctttctccgtacacttggccttccttctagcgatcaaaccctaggtcccgccattgttggtcccagacttcaatcgaagctccaatttcactaatttcaggtgaatcttcttctactatttctcttccgtcagtttaatgtcacgatttcgccggaaaaatgtgatctacactgtttcggagtgaaatgtgaagtagatttcgttggtttcttagctagtttgtgcttttctcgaagttgtttctgtgtttatttcatgaaacgattttgggttgcttttgtgaagttgattttgttgttgcctcttagttcgttttcttgcttgttaagtgtttatcgagtcactatgtgtagttcatgaattacgttttctacggaaacgattttggaaagttgtgtgtgagatttagagattttctgttttttacatgattcttgggttgttctgtgatttacattgattctgagttttgacagtcttctatgaattacaggtgttgtttattctctggaagttggcgatacaatg

SEQ ID NO: 23349 - DNA, 12 bp, Unknown
  misc_feature (1)..( 12): 2750-1469P.txt file - cDNA_ID_2137892; gDNA_ID_1620409; Annot_ID_156209
aagcttgtgatg

SEQ ID NO: 23350 - DNA, 3003 bp, Unknown
  misc_feature (1)..( 3003): 2750-1469P.txt file - cDNA_ID_2137954; gDNA_ID_1620409; Annot_ID_156232
gcgccctggacagattcgtgtatatatatactcggggaaagcttgggtttctgatgatccagaggcgttcaaaagtgttttctttcttcttcttcttctggttgtctccatctttgtgttaaagatgtgaatatatgttttaggacagcttcatttttgttgaaagcttaaaaaacagggtcttttataatctctgtgattagtaccaaattgcagatttgcagaactacgtttttcttggtttgtcaggtaatgtgaaactgaataaaatgaatattatttgaatcaactgagattttacattatcttctagagttttgtgtttgagattcaaagaacactagactgagtatgaagattttgggtgagtaaaaacaatcagggtgataatttatcatacaatagttttggggtcaaaatggaataattctagagtatagagcccatgttgaaaagctcgaaaattctttccaattccagaagaaaaggttttgctgtttccctgtgagcgatcttcgatactcgtctgggcatggcgtttttgctcaacaacgcttcaatttcatctcatttacgctcgtcttcttcacaggtttggatcaaatcttgttaatcgattattgttggaattttgtttgatttttgtgacaattttttcccttacgaaatttttgaagaagacgggtgatgctttatcaatatcgcgtcgtggattccacattgagccaggaactcgagagaaagctgtaagttaatctctgtttctgttcgagtcctggatcattttggactcagtttttgtggaattttctgcatctattgtgatttgaagatactaattagggttcatgaaagaattggcttttatatagattccctgagactctcatgtgtgtccctagtaatgttcgttgtctgaatctatttgaaagagtaatttttatgagagttttgagttgttgttgatgcttatgctgttgttatatggcattttcttaaagctcttgatgagtttgtgtttgcttaaattgaaatcctgtgtagctcttggctgaagattctgctttgaagagattcaagtctcataagaaaagtgtgcacaaactgaagaggattggtgatgtgctcactgttgttgttgttgcaggtaaaaacactttagttcataacttttggtcgaagctaatcagattcttgttttgttagtggtctagaaacataatctggtatggttcaggaatcataatgaatctgagtaagagattgactaggctaggcacacttagatattttcaccttgcttcttgcaattaagaaagctgtagattgaatctcataggtttcatgtagagctgagcttattatgtcaaatcaaactaacaacgttcttctctgttgttcttggtaatatgaattatggattcacgacatactcgaaatctaaattgtgacttatctcgtgtcttgcttgtttttttgtcttaggatgttgctatgaaatctatgtcaaagctgtgatgaaaaaagaagctctggctgcagggaaaagctcatgagtgttcttgtctttgtatgcctttttgttttatcctttatacagtgtctctttctaataatctcacaataatgtttgtttactcaatgaaaatggcatctaataaagtagactaaaagaaaaagacattgtccagggaaaccaaactctggttttttctgacgttgtgtggaatctctgctttttcttctttttaaatattccttagcttttcacttatttgtactttgcttaaagatacactctccatttatagataactgcaacgattaatgtcttatccatggattaggtgactgtatttatgtgaaattgtgaatgatcaatcacacttaatggtttacactggacatgaaattgtttcgaaaggattagtagagcgagtgggccggttcggtgtagcctacctctatcttgggcctctctctaggcccaatttgggttcaaaccggttgagacgaggtctcaaaccgaaatctaactttacacccttaattttcaacctaattgtgactcaacaagaacatatccaccactgaccacttgttttccacaaatcatgcaaatttgattaatacctactgagtactgataaaaacaagtacaaagagctttcatgctcccttctgataacattggttcaccaaagatgtaatataaaaaatgttggaatattagttgaaccaccttggagaacgtataacaaagaagcccaacaaatcaagttacttttgcttgatttgcacacattcatgtttgaaagctacaattcatatgttctatattatctacatttatactcatagttgatatgttgtcgaaattctatcaatttatgatattgataggtttgcaatttcgtaaaagaaactctcacatctattttgactaacccacacgtttttaaaaataataaaactatgagtaattacacatcctaaagagcatttactcatcagtcaaaattagttgatcaatattgagtatgattcgtgaagtcatgcatgatacaacgtcgataatttttttggtaaaatgtaaaagaatacgtaatcaattttttctttggaatttttaatactttggaaattacaaatttttttgttgaaaataagatttcaggaagacgaggagtaatattcttcttagaccaacatcatgacatgttccctggcgtgattattttcgcgacacctgaagaaacggcatcgtttaggtcaaagtcatcatcatcattctctattttgcaatctcataaagacggttataaaaatcacagagacacacccacagacgataaaagctctaacggaccgaccaccgccaagtttttaattttacactaatgctactgccacctcttattccgccagatccaccaccgtctccgccgcatcactgattcctcaaccgtcaccggagataaatccttaagcaaatagaaaatg

SEQ ID NO: 23351 - DNA, 3000 bp, Unknown; identical to SEQ ID NO: 1510
  misc_feature (1)..( 3000): 2750-1469P.txt file - cDNA_ID_2137973; gDNA_ID_1620411; Annot_ID_156263

SEQ ID NO: 23352 - DNA, 3003 bp, Unknown
  misc_feature (1)..( 3003): 2750-1469P.txt file - cDNA_ID_2137985; gDNA_ID_1620411; Annot_ID_156266
agatggtgaagatattgtgcttgagtcagaagatacaatgagttgggcttcggcgccgcgatcaccgttaccggaagttatcatttcaagatctgtatccggttccatacccgaaaccaaaaacggaccacaaccactacggagaagcgtatcggaaactgcaagctacacatcagagatctccgacgtatcaacgatcgaacgatccacgtttgatttggtggagaagatgcattacgtcttcatccgcgtcgtgaaagctcggtctttaccaacctccgggagtccagtcacaaagatctcactctccggcacaatgattcaatcaaaaccggctagaaaaacctcttgcttcgagtgggatcaaacgttcgccttcctccgtgactcaccggatttatcttcctctccaattctggagatatccgtgtgggattcatcgacgggaatcgaaaccagccaattccttggtggaatttgcttcgacgtgtcagagattccgctccgagacccgccggatagtccattagcgccgcaatggtaccgtctcgaaggtggtggagctcacaacagtgatctaatgcttgccacgtggacaggaactcaagcagacgaatcattccccgacgcgtggaaaactgatacagccggaaacgtgaccgcacgagcgaaggtttacatgtcgtcgaagctgtggtatctacgcgctaccgtgatagaagcacaagacttgttaccgcctcagttaacggcgtttaaggaagcgtcatttcagttaaaagctcagttaggttcccaagttcagaaaaccaaatccgccgttactcgtaacggagctccgtcatggaacgaagatctactcttcgtagccgccgaacctttctccgatcagcttgttttcacgttggagtatcgaacatcgaaaggaccagtcaccgtcggaatggctcgcgtgccactcagcgcaatcgagagacgcgtcgacgatcgcttggttgcttcgagatggttaggattggaagatccaaacgacgagaagagaggaaacagatctagagttcacattaggctttgcttcgacggaggttatcacgtgatggacgaggcggcgcacgtgtgcagtgattaccgacctacggcgaggcagttatggaaaccagcggtgggaatcgtcgagctcggtataatcggttgcaaaaatctattaccgatgaagacggttaacggaaaaggatcaacggacgcgtacacggtggcgaaatacggttctaaatgggtccgtacccgaaccgtgtcggattctttagatccgaaatggaacgaacagtacacgtggaaagtatacgatccgtgtacggttttgactataggagtcttcgatagctggggagtatacgaagtcgacggtggaaaagaagccacgcgtcaagatctaagaattggaaaagtacgtatacgtatatcgacgctggagactggtaaagcgtatagaaatacgtatccgttactgatgttagttaacggcggcgttaaaaaattgggagagatagaattggccgttagattcgtgagaacagctccaccgttggatttcttacacgtgtatactcaaccgttattgcctttgatgcatcacattaaaccgttgagtttgtttcaagaagatatgttgaggaacactgcagtgaagatcttggccgcacatttgtcacgatctgagccgcctttaaggccggagatagtacggtatatgctcgacgccgatactcatactttcagtatgcgtaaagtcagagcaaattggcttcggatagtgaatgtagtcgccggaatggtcgacgtggtgcggtgggttgatgacacccgtttctggaagaatccgacatcaactttactagttcacgcacttgtcgtgatgctgatttggttcccggatcttatcgtaccgacattagcgttttacttgttcgtgattggtgcgtggaattataggttcaggtcacgtgctgctctaccacatttcgatccaagactctcgttagctgatgcagctgatagagacgagctcgacgaggagtttgacgtcgtaccgagcaaccgaccaccggagatggttcggttgaggtacgataagctacgaaacgtcggagctagagttcaaacgattcttggtgaagtggctgcgcaaggggagaagatgcaagctttggtgacgtggcgtgacccacgagcgactggtatattcgtggggctgtgtttctttgtggcgttggtgttgtatcttgtgccgacgaagatggtggctatggcgtcagggttttattacttccggcatcctattttccgtgatcggaaaccttctccggtgttaaatttcttccggcgactaccatcattatctgatcggctcatgtaatattgtttttttttttggaggggatgtatatatagtttgggtcgtttaaccttgttgggccttattgggttataatgggccactaaatggatttttatatgatttcctattataggtgctgtgtttgaccatgtctaaaacaaagaagtgtttggtatgacaaaattgatgaacctactttttgagcagagtggtaaatgtgcggaaataagcacacaaggaaatcgttgttggtgactaacaaaaggagttatccactgcccaagcattaccaactaccaccaaccaaactcaatttggaaatttcaaaggtccattagtcaaagcagcattaagtcattcagtaatcaacaaatatattcatatgaaacccaaaataaaataaaataaacacttttcaagaaaaaaataaaatactgagtactaaactggaaaccctttataagcaaaaagaccaaaagttaaaagttaattaagatttggtttaaggcgctttgctttattagagaggaaggaacgaaccatcatagaaatctctccttcgttcaagtttttctctactgtgttggttgagcaatcgagtgatg

SEQ ID NO: 23353 - DNA, 3000 bp, Unknown; identical to SEQ ID NO: 1512
  misc_feature (1)..( 3000): 2750-1469P.txt file - cDNA_ID_2137993; gDNA_ID_1620411; Annot_ID_156269

SEQ ID NO: 23354 - DNA, 3003 bp, Unknown
  misc_feature (1)..( 3003): 2750-1469P.txt file - cDNA_ID_2138062; gDNA_ID_1620410; Annot_ID_156257
ggaactggccgttttacttatcgttgtatcatatttgataagattttaattttctgggatttttttttggttttcattgatgtatctaataaatttatatatatattgattgggcatacaaaaacctcttgtcttcatgcttcttagattatgcgtttttcttttgatttaatcctttgttaatgtgtttctgtacgtatgactcattagtcatttagtagttatgaacaggttcagtgtagctaagctccgccgtgttagcacttaaataaacaatagtaaaatcaatttcttatgataccttaactatcttcggaaacatatgataatatcgaatataaacaactatttattccacatcaaaagcatgcactaggcgatttaaaactaatgatatactattatagcattagttaatttgtattaacgataaattaagataactcgaaagagtaatcttaggtttgttgatgataggcttgagatatgttagtggcgaattagaaaagattcagagggaattgtacggaaaacgagagagccgtgccgtcgcgtaaaaacagtgcaaagcaagaatagacgagcgatttgcgcagaggacccacgtgttagtgacgagtctcatgcgcgacatgtattccacgtggcttaagatgtgtcccacttcacgtgtcgtaacgtctatggctgacgtacttataatatcgaagtcggttcgtcgtttactctaacaccaatcgctcgtagacgatttcaaagatctatctagccgagagagaacgagtacggattctctgattgtgggccgttggatcaaagaaaactcactgctcgtattggtcgttggattggattggtgacactaggaatcaatggtgatgatggagaggggtccagattaggtaggtggtggtcattgtagggaaaacacttgagaggggagtaggtccattaggacatgtgcataagttataaaatctcatacaaatcatacacgggaaagtttggttgggcggttgggagagtttgggattgtctgtgggttggtgtatgactccaccatgttcccctaatcatttttccttttattatttcatgatttcttacttgtattttctgttttttttttcatcgatcgactcaattgtttgacaaattagctagaagtagttcatggacatttttattcaaatgcgggtttagtcctatatctataatgatggccctaagagtgataggtttgaacgttttaatagattttttcgatagcaagactctttacacttcgccatttttaacattttttctttggctattttgtagaatcttctagaactcttaaaatcttgtaggatggtttagagattctaaagaagtgcggaagaattcaaatgatcattagcacttttcagattctcctaaatcataaatcataattaacttcgtatcaaacacatttactttcaaagatcctaatctaagccatgttgatggaaccattgtgatggtgcgacttggtttcatgcatgttatgatgtaatacgttctcgacacgtgaattatgtctgaatgaccactggtcaaagtgttttttatgttgaatatgcgtatagaatttggggaaaactgttgaaaaatggttccaccaacaaaacctatttttaatctcacattgaaagccatacgtatcaatggacgtcgatatctaaatctaagctccaaagagccgatccgaaaccaacacatggctgaagtgatcacctgctaagatagaaaagattagtgtaggaatctctttagtaaatgtcgaagttgaagattaagtcaccatcagttgacaatgaactcagagaactccaagtatcatgagacaatgacaattaatgaagaaattgaaacttgaaagttggaacggttgacgtcggtgggattaatgtcacatatgtgtaacatggcaatagaaaatactaaaacttaaaatgaatattgaaaagaaagtctcaattagtacgtatgtaaattgttcaattgtgcattatcaagtttacattagctgaaatgacaactaaatgaaatggtgatgcgatcgtagaaaagataagttatagacaaatttagagatttaacatttgcaaagaatcacttttaacatacaaattttgtattgtggattatcaaggtaacattataattgattagctcaaacttgtatttaggtatagtaggttgctgagctgggattacaatgaaacagctgtattgaaagacttggtaagtggtccattcttagtctttgaatcgaaggcatggttcgatcggaactcgtcctaaccgtatttcgcattactatttgtatgtaacagagtctaatctctcttaacttaacaacacaaatcccataaaaatggatagaactagcaaaataaaaatcaaagaattttactgaagttactgaactttatgattgtaatgatcaacagtatcgtctttacacaaaaaaatatatgaagaagatgatacacaacacatttcattacaccatctgatccatctccatcttcaagtataaactcattcttatttagtttacaactattttttgtcttttgggaatcttataaattatttcggggtaattaacgtcaataaaataacttacacctaccgatataagactaaggtgaaaaagtatacgttaagaaaagtgaaaaactttaacaaaagaaaaaattcaaatcagaatcactaacccggtaaaaatgtaaaaccgtttcccggacccaaataaggacctggataacaacccagacccgaaattaagtcggatccggatctccttgatttattttttaacatttttgtctttcccctggaaatttgaaactctctcttctttttttgttcttcttctcattggttgatcgatacgcgctaaatttctagaaatctcagatccataaaattttccgaggagagattctctaatcagagaacctcacaatg

SEQ ID NO: 23355 - DNA, 3000 bp, Unknown; identical to SEQ ID NO: 1520
  misc_feature (1)..( 3000): 2750-1469P.txt file - cDNA_ID_2138093; gDNA_ID_1620413; Annot_ID_156315

SEQ ID NO: 23356 - DNA, 3003 bp, Unknown
  misc_feature (1)..( 3003): 2750-1469P.txt file - cDNA_ID_2138101; gDNA_ID_1620413; Annot_ID_156317
atcttagtataaacaacataaaacgtaactaacttagctatctttctacattttaacccctatgaacaagaggtgggttgaacctattaggctattacatgtgacccgctaaatagccaaatgtgggtaaccacctcaaatcactacaaggctcatgtcaaactctcattaccattaatatccgggaatcaagtttatcagaaaatgagattgtcttgcattcaaactaagaaaagaaaaagaaaaaaaagcaagaagcaatggagatgagtaacgcaatgaatgagtaatagctcaatgtctacataattggactcgtacatatgaactcaataaaataaagcaaatggacccgatttgagaccagtaatggttttgaaatcatatatttccaagcgtaccaaaatacacttacgattaaaacttgaattttttttggcaacaaacgaattatatttttgttagtattaattattgtattcaacgaattacatttgattggccgtatactctggaagtgtgtaagtataatattttctttggcttacaaagcaaaacaaaaatttgatggagagagtcaaacaaaaaaacaaaagaagtaggtcatatgtttatccattcatacgttggttggtaatcctaaaaaccaacaaacaatcatatatgtatacttgtccaattatgtaaactactccattgataatataattgttaattattgactcgacttatctactgattatgaaactaccaacaaatgaagaaagtaaagggagtgtgaaaacaagaatcttaaggtataacgaagatttgttccgcgtggaaaaggcattaaaagtgccacgtcactctctctttttattttatgattttcgtatctcttcttctacttgcttcccacgtttccatcaagtttccgtacatatcttcttgttatctgatccacgcgatctttcaacgcgtacttttcacgtatttgtgttgtcatgcctttgctgggattgtgttagatgctcattgctgacggtagtttttagagaacattctagaaagaaactatttttctaacaaaaccacgaactttgttttctagttattccactttctagaatacacctgaccaaattagaattctagaaatgaattttaaataaaccaaaacacctaaacgaaaagcaaaccataggtttttggttttaacatatttcaaattcataaaagtgaaaccaacctacaccatattaaccaatatttattagagtttttatatgttttatgatattgttcaaaacttcaaaagagatttattcatataacatacctataccataccaatgaatattaaaattatgaattagtatccttatattatatgaagtcaatcaaaaaacttagaagcatttcaaacggaatcaaaccattcatatatgaagtattattattatatctagaaggtgttgattttaaactattccgtataatatatctagaagacggctccgcgcgtggggaatgcatcaaactcagagagtttaatagctttttttggttgacgtcaactactcaaaagagtttagtttttgatgtgtatatatccaaataaaatatctttaaaaagaaaataataataataaatggtttcgagaaaacacgaggaagattctcatccaaccgaaacgactctttcgtttttagtagtctcttaagctacgcggtgtcgcaaatcgtgaccacataacccgttttttccttcttttaccccttatctttccacgtatttacgttaatacctacactcttcgctgccacttccttacccaccaagtcacaagggtatattcgtcactttccacacgtctttggtccacacaaactcggtatctatatatagttcccaaacggacacgaacacatcatcacaactactatcacaccaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttcatagagtgtaatcttttctttctgtaaaaatatattttacttgtagcattggagatttgttatgagattatcttacttagcatttagtgaataatctattagcctattttgccgacgtgaaaataccattttctatttaattttgattacttatcaactactattaagctgttattttcccccatcacgaataaaaacaacccaagaaatagatatttatttgaatttgaaacttacctataaatttagttgagctaatcaaaattaaattttaaagcatgatcagaagtggaattcttgagagtgttgtttgtgatctgtcaacatcttctgtccaaataaatggattcaaagaacatggttcaacaccatctcagtgtcacctttgcgcatg

SEQ ID NO: 23357 - DNA, 3003 bp, Unknown
  misc_feature (1)..( 3003): 2750-1469P.txt file - cDNA_ID_2138145; gDNA_ID_1620413; Annot_ID_156334
agctcaacctcaaacagctgagaagaatatagaagaaacacattaaacattattgactcagtcgacaaactaatggactgaagacaatgcaaagaaccttggggattgaaaataacactaaagcaaaatcgtaagatttgcaatacccatttatggaacagtagagagaatatatgtgatgcaaaggactggctccacagctgcaccatcaaatcaagtatatccttccccctctcagacactttcacatagtaatcagcaaggacatcgaaaaagcataacggaccatcagcatctgcttcatcagaagtaatcaaatcctcttctttgctaaggatcacatctgcttcaaattccagctcgaaaagttaaattccagtggtaaaaactgatttgaattcaaaaaaatggggacatgaaaagtgtaacctttggctcgatcgtctacttcgagagctatatcagcaaataagtcttgtaacaagttgcgtgtttgtgctggagagacaacagcctatacaaattccaaaatcaattttatagtctcaaattgaagatgacaaaatccagaaatctagccgtgaaaaaagctgaaaacaggtatataacatttgttgattgataaacattaatcagatttgctgcatgacattgatctcaatcggaaacggtagattcaaaatgaatcaaaaccaaaaaaaatcgaagaaaccatttcttaatcagaatttcgtggaattatctaatgcatgtgtctcgaattagagaaatcgtgttttctgggcaaaatcgaaacccgatcaatacaaatcgagaataacgaagaagaaaaagagcaaacccgtgtaagcttcttcttaatctcttgtgtaagagcttcaagataagcagacctccgtgaaaaagaggaagacggcgacgaaactttctccatttcaaaaaccactgatccaaaaaggaactaccacatgcgatcaacagcgtcgatctattatcgctagtatgagaaatcgagagaatgataatgattgcttcttcgttacgaattattttattcaatcaatcaatgaatggggtctcctctggatttaaaaattagtcgtaattaggcgtgaacttcttttctcttttgctactgtgaactccgataaagacacgagaggaaaaaacgaagatatagtttgtttcaaaacgacttcgttgcattctggatcagagagatgacgtgttggttggctgaagacacgtgtacctcttcaggcccctgtttatttttcttttaatctttttttttttctaaaagtaatcaacgtcgttgtggtagaatagtttcggaatgagattgattaatgtcgttttgtatcttttcagaatttgttatgcaatacgacaatttattcatatcaccttcttttagatctgtatccaattatagaaattggatgatttgattcatcaaattcaaagaacccttaagataccactatctcctttttaaaatggatcaagacctcattatccactaccactcgtggcaaaatgaaaactatataaaatcaacacaaaatggagggaaactaaaatttacgcgctaatgagtaaagttggttaaagcttctttactctcaacatttggacctgacgtcttgtcgtcgttatttatgggcttggtgatgttttattgggcttaaattttgtacattttagtgcaaataaatatttcgttctaaacaataataacgaatcgaaaagcccaagacatgttatactcgagagccaacagtcaagctgatttcaacgtatctcgtcacgccacgtagttgattaacagccgaagatcgccgctgataaagaactagattgacggctgacgagttaatacgtctgctctactgtcaaattcacaattcaaagcgaggtagaaaattagagtcagagtcataagagattatgagtaatcaaacgaactttcaccaaattgcgtgtttccattgttgagaatttagcaaatgaaaacacattacaaaagcgaaatagcaaaaaaaggaaatcaaatcttgctacatttactaaaatacctacattgaaattctcaaatctaatttccagaaacagatctccaaacacaaatctgaaaaaccctgattaaccgccgaatccgtagagagtccttccttgcctcttgagagcgtagacaacatccatggcggtcacagtcttcctcctagcgtgctcggtgtaagtgacagcatcacgaattacgttctcgagaaagatcttgaggacgccacgtgtctcctcgtagatgagaccactaatacgcttgactccacctctacgagccaatcttcgaatggcaggcttggtgattccttggatgttgtctctcagaaccttcctgtgacgcttggctcctcctttacccaagccttttcctccctttccacgaccagacattttctcgagagaattagatttctttttttcgctactgtgtgaagaagaattgcttttgattttcagatattgactggacgtgtttgtttatatataagagggcttttgttttcaaccatccgatttaataacccatctaacggctgttaagctcaatccttgtcaatactgatatgacatgatagccgtcgattgattttaatcaacggttattaattgtgatccgcatgataactacataagtgttcttcagagcttcgctttgtagttactagtttgcatgggctggcttactttttaatgggccggttatggatcgaaaccaaacttctcttattttcgaatacgcaggcgtttcggtaactgcctcatacgtcgtcggttgcatagtaaaataaatttatttctttttcttctctttttttttttttggtcgtatttatatttcttctcctaaaatcggtgaagtatctaaaaacccgttatttaatgcttaaaccctaatcggaaaatctctccgccactgttctctccgactcactaatg

SEQ ID NO: 23358 - DNA, 3003 bp, Unknown
  misc_feature (1)..( 3003): 2750-1469P.txt file - cDNA_ID_2138164; gDNA_ID_1620413; Annot_ID_156339
catacgcttttctaaagtttaccatttttaaatttcgaggttttttcctcctaaatcggataagtttaccattgttagtttagaactattttgttgttgttgttgttaaatgcttaattagaactaattaatctgattacattgttaataaaaagagatggtttcacctcgagcaagtgaaaccatagtgattaagacatatttgaaattaataattggtatgatcgtaagagaaatacttttttttttttcttattaagaaaattacgtaagaaatattttctttgggtgtacttatactctgcttttttctttttgacgttattgaagattggctaatctttggcacttaaggtaaagcatcttaattaatcatcattgatcccttctattcaaaggttaataaaaagaaagttgattatttatatacatatggcttagttctaatgtcgcagtaagattctttggttcctcctaaattatataattggtggatatatacaacacttcctgatataatataggacatggacatacatgatacatttgtacatgcataggcagaacaaatagtataatataatataacaataataatgatcgcgtggctggctaacataacactttctttttaattaacattatcatatggacacatcacacatgcatatatgtcttcacgtggaactcaaaagttttaagagaacttttgtaattatcaccatctttttatattcacctaaaaggtggctagttactgtccgtactaatgtccatatatattcgtataagatacgttctatatatgtatacatacgtgcatacattatagtactatatattgttggagccttaatcagaaatcaagggttggtgtaacaacaatatatgtacatgtgaaaattttaaataagaaaaaacatgtattaatacttcctccaatctaatcaaactcacgtacatgtatgtcttacgcgtatatgtgtgtgtataaagactacactttactacgtagtaattgatatatagtatcaatttaatatgtgtttataacatatatctatttttttaaacatatctatttaagtttaagtttaagtccaataatttcattttactagtaaagatcacaatgtcatttaccgcattcacttaataattgctgaattcacatagtgcctgtaaattaagactaattttaggtttcaaataatttttcttttttacataacttacgatcgatattttaaatggtattggtaagtttaaggtatatagatagtgtgtctaaactagagttcgttgaaattggtctgaggtataaatacctaaaaggttatatatgtttttagtttaatgtaattcgataaattttagtcgaaaccgttaagagatatcagaatttcgttttcaaataatatgggatataattacccgggattaaccgtacctgataaaatatagctctcgtacgtgtcacatgcctaatgcctagttaaacttaaaacgaatatctatatttactgttattgattgtgagttaccaactaaaatattgttaaaagacattgtaaaactacaaatggttcgaactgtatactaatgatgtaaactcgtgtttcatcgttatgtccgatatttttttcattcaaccattattcaatttcaagatttctttattgtctttttttctttctagaaagcctatatatttaattacccactttgcatattcagaggataagttgatacgtacttgttagcaacctgtctagatcatcttttgattgtagatttgactttaaatttctcacaattataaatatgaaaaataacaagcaaagaatttacaaatgtatataattatatacacgcattgatgaataaacatatttagaaaataatgtgttctaaggaaattttgtggcattttttaaaaaataattaaacaaataagaatagtgtaaagttgtttaaatatgtatgtataagtggcatgcctttgaggatacgaacttaaaagggagttaggtaacttgcttgggaaataaaatagccaaccttaatttgaggtttcctcaatgttcttatcaaaaagaataaaaatttcggaaattcccttcatggattttgatatctaaccctaatcgtgaccttctttgatagctacaatctccctctctttgcttattccccaagcaattttagcttacgaatgttttgactaactccacatcggtttatctcttaagttccccacctacaaatatacaaaaaaagaagtaaaataaaaataattattaacaaaccgatgaagtacttatcatttataaacatgcttatgaaatgtattttctaaaacataaccgctaaccagagaagtttcctagagttctgcttcagactcttttggtcgatcaagaagtctccaagagttgtttttgttgggtctaaacaaaacttggccagggaacaaatcaaactatattattaatcttctacatctggtcctaagttccttactatctcatgttaaaatttgaagtctaatatactcaaagctgtcaaagaagcagaacatggaagaggaactgtcatatctgagaaaccaaaattggcaatcttgcatttcatatttagaatctacgccatagtattgagatggaaacaaagagttttcgaagagggtcaaagagtttgacttatctttgacaccactcatacattagctgttcatataatctaacaactagtcaatatcaagtgtctccaaattacggagagtacttctctaccaattatctttttgtttttcataaacattttactaattgttttttctatatctcctgctcaagcaaacacctaactctcctttcctatatatacactaaaggttgaaaacaatgaatccacaatctacagcaaaacataagcgaggcagagtcttcagaaaacttacctgctctaaacaacgcctccgtgtccaagctcacttcaatg

SEQ ID NO: 23359 - DNA, 3003 bp, Unknown
  misc_feature (1)..( 3003): 2750-1469P.txt file - cDNA_ID_2138189; gDNA_ID_1620416; Annot_ID_156425
taaaattcttcagtcgtaatatagctaaattaatagtcacgtacaatgaaattgatcaaaaaatttgtggtaaactattttgactattagttgttatctaaatgtcaaaaagaaatgggtagttaggtaaaagtagtaagttatacatgagttataaatttctttgatcgtaataatatagctaaattaagaggcacgaaaatgaaattggatcaaactttcaaactatttgacgagtacatgtcaaatagagaaataattaatgagtgttagcatgttaggtgtgaaggtagtagtaagtagtaacacatcagttataaattttctttgtttaatctcttgcatgtaaagatcttattgcaacaacctcttattatcgatatgcttagaaaccataatgcaatacttcttttaacaaattatatacataccgcacaaaaagataatatcaaaacttttgtggttgtcttatagttatagctagcaatttatatttatgaacttaatatcatattcaatcattacaaacataatagtaaatagtccttaaagtatgtgctattttccattattccgtacttccatttccttaaattcccagatagaaaacgacaatagacaattaactagttttccgtagttaatagaggaataaaagttaatgagttatgcataagtcacttgctaatattgtaattgatttgatctgatttttaaaaattataagaccgacacaaatagaaagaaggtagctccaactgcggcctgcccataactttgtttacataaaagggattagtttttagttcacactatctttggtgacaaaatgtatatatttcttattatttgattatctatatttagaggaaggtttttgagttttggtggatttaagaactacacatatcggaactacttttatgagcctccttttacagattcatttaaagagagtgggcctcaaatttagtgcctttaatttcgttgttttcctgttgttatatgtttcatttgatttataaatttcgaataaaaaatagaaatatatttctaaaatatcacatttttaagtttcagttctaaaaataccatcactagtttgtttttccaatagtatcacaactttctttgtaagaaaatacttgtttacccaaaaataaaaatagatgaaaacacaatattttttaaaatataattattttggttcactatttccaatttaagaataattgtctattagtttttttggaaaatcaaaacgtatttattcttaaacatataaaagttaaaataaaataaaaattcattttaagaataatttatttttatttcatactgattaaaggatgtataattttttataatgttagttataaatttgtaacttatttgaaaatgtctcagttatctcatattgtaggcctgtactgctttcaaaagcccattaccaaagtatgggctgtccaattactactttggttttttttcaagtccatcttcttcacttcctaatacggactttcttctcctctccgctggattttgtctctcagtctactttatccgatcggcgccggcgagattcaaggtgatcttcttcacttcttctattgaacatactatcgaaaagacccaatcttcggattcattagttcccactgcgctttttctgattctatctcgatttgttcaatccgattccaacttttgtttcgattctgagtttttaataatgctagttctaaaccaaaatgagattatttgatgattctaatcaatctatagctcaagtaatagttattaacgaattgggttttaaaaattcgatttttgagtctttaacccgaatttatgtcactcttttgaaaatgtgttgatagggtaaagaagaagatgagtggtgaagttgttttagctgctagagtttatcgtgaccttctcaaagcagtggtgaaacatgttggtaaagaagatcacaagtctcatttcttagactttgttaagcaagaatttcgaaagaatgcaaactcagagaaaataaaccttgctcgaaattacacatatcttctcaatagcattcactctcacaaggttcagtcttttttatgatctcttaatcacattggcaatgcatttgtgtgtttagtctctcacatggataagttatctggttgttgcaggatctgctgttctcatacaacattgcggttgatagaactgaagaaatgaaacgagtgcttaataaatctgcagccagtgtagggcttcgtcttcctgaagtttacgagccttgatcatgcattcattcctctttgtctttccgggggatgagtcgttatgatttcttcatttctgtggacaggtctttggttaatttttgattatatgagatagtaaatgaagccagagagctcttttcctttaagcttttaagtattgacaaatccgagttgtgtgggttacaattttttgttagtgttgcaccacatttgttttaggatgtgttccatgaacatattcatgatcttgttatgtttgatggaaaccaccaaagtgagagaattcagaagcaattgcatattctgagatacaaagaagccagccaaagtaaatgaaaaaaatatttcttatgacttcattagcattatgatacgaggcataaaaaacctttcttgaaaacttaaaaactatttagaggaacttgttccgatcatgtctatatttggatgatgagtcaaaaatggtaaacaagatttatgaagagaaattagaaaccataagggttttatccaaaactcgataagccatccaccgctagtgtttatcactttatctggttcttgttttgtattttttctatttatttatttagtggagacatcgatgctgacactttcattttcttaatcattctttaaggctctggtagctttggcttttgatctaaaagctgagagtcaatagagagctttgtgctgagcatagcagagaagagttatg

SEQ ID NO: 23360 - DNA, 3000 bp, Unknown; identical to SEQ ID NO: 1550
  misc_feature (1)..( 3000): 2750-1469P.txt file - cDNA_ID_2138218; gDNA_ID_1620416; Annot_ID_156436

SEQ ID NO: 23361 - DNA, 3003 bp, Unknown
  misc_feature (1)..( 3003): 2750-1469P.txt file - cDNA_ID_2138237; gDNA_ID_1620416; Annot_ID_156441
ccgatgtgggacattgtccctaatacgccccctcgagatgatggctcttctagccattgatctcgatatgtttgggcatggatcggcgggccaagtattgggccgaaccgatgtggatcgggttgagtatgtgcggatcgggctctgataccataaaacatcataaaaatccaatacagagttttgataggaaacacacaaaaacataagacaagctcacataaaaaatctaccaaacatttcttcttccatggccattcctaagcgaaagagatccaagactcgaagacacatcctcaagcaaagcttcattcatggcatctcttagattcatctcatcagtagcatcatggaaacatccacgtgtcctagactcacttatcagtgttgcccaaatcgaaccacttagagccaaagttgtctcgttcccaatcacccataaacagtgtcttgctcgagtcagtgccacgttagctctttgacggttgttaagaaatccgacttttccattaccgttacttctaacggtggagatgatgataatgtcttcttctcctccttgaaaaccatctacggaccgaacattcaaagtgaattgctgacctgataaggaactgtacttatctccgattttctcttggattgctctcatctgtcctttgtaaggtgagaccactccgacactcaccttcatcctcctttcacatgaaactttgtaaagatttgatataatttcagaaatgacagcaacttcaaccatgtttttgggactatgtccatcaccaaactcttcttttccacgtccaacattgataaaagaaaatgagtcaaacatgtttcctttaagaaacctcttttgataaatactttctttaacattttcagcatctttgattctcccaccataaaactccttgttggggaaacgactaatagaaggatgcattcgatattgaacatcaagcaagtgtttgttgtgaccaagcaaaaccaatctctcaaacaagcttcttccgaatttcgccttttcacacatctcattatgaaccattgcaggcaattgaaactcatctcctattaaaatggcgtgacgcagtcccggaagttgcaatgcagcaactgattcacattccttaagctgagccgcctcatcaaccacaagcagttctacatttcctgtcctttccacgttcatttccgcagcacccgaggctgtgcagaggataatatccgcgttttgaagacaaaatttcctaatatcttcgttttctaacatgtctggaatctcaaaacgttttggaagtaagcgtagagccttgaggcaatcatcactgagtcttttgaagcaatcaaatctgaaatttccttcctcgaaatcaaccctagaagaattctccctcaagaaatatctgatacgctgaagagtttgacgagaagcaatcattttcttcacatcttcatatggaaggtaaaccttgggaagatgtgtatacaaatcaacgatgcatgtcttcacttcttcacttaagctattaaaattcttctgaacgaattctccaaaagtaggaatgttaacaacaacttcttccctttcatcttcttcattcattctttcaacttcttctaactcgtagacatgtctctcatactttccctcggggttttcaagaaactgtatcagtgactctaatctctgcatccatccagaaaatggtgaaaacagtttaccaagcttaccaatacgctcatcaagaaacacatcgagaagaacatgatcgttcttgttaatccccattctgtcccggtttccggataaaatgatattccctagcctgtaagtagcattttccgctgtcgagttttccttaaataaggataagagccttgatgtaacttgtacaatagctgtgtttgtaggagcacacacaactgtcttgcaccttagtttgagaagggcaaagagaagagtcgcgaccgtctttgttttgcctgttctaggaggtccccatatcagtttcacactgttcttatgggtacagtttcttgtctcaaggcagcccaagattgcatcctcttgggaagagttcaatttcgttgaacggattatatccaaaacaaggtcagatctcccatcattttcagaacaaaaacattgttctgtaccctcagtattagcctgaagcacactcttggttagagtcgatatgtcagcttcgttgtgcaaagcattccaaattcgagtgtttgttgttaaagtcattagaaaaacaccgaagctatagttctcaagaggtgatatcgatctagacaaatgaacagagattttaagattttaagatcacctctatagttctcaagaggtgatatcgatattagactgtgggcttccaacctaaaaccaattggcaataggtggagaggcgcatatcttatatataccacttaagatcctactcaacttccgatgtgggacattgtccctaatatcgagaactctgatcgcctgaaaccgagaatctgattctggactatggaaagttttgaaatttggccggaaaattgaaaccctaaattttttttgttttgagagagaaaacccctaaaaacccaagctctgtttggtgtatctctttcttgggaaacaagttcttttattgcattttttttccctatcctcgtattttccatacaaaatcaatgttaaattttaagtttcaattttgtccgcaaattagaaaacttggcaaagtaaccttcttagtgtaaaatttttagaatgccctcaaccaaattttaaagtgtttaaaaaaaaaaaattaaagtgtttaaaaaaaaaaaaaaaacacgaagagccaagtaaccttatccattcatacgcctcaaacagagacgacagcgtttgaagtagaagacaaaggacagtgcaagaatctcttatcaacatgagaaaaccatcaagcaaaaaaaagaaacacaaaagctatctccgaggttagagcaatg

SEQ ID NO: 23362 - DNA, 3000 bp, Unknown
  misc_feature (1)..( 3000): 2750-1469P.txt file - cDNA_ID_2138271; gDNA_ID_1620413; Annot_ID_156323
ggaaagtctcaaacagtagttagagttcccgatcgtgtccttttgaaagatcccaatatatttggtttcggtatatcttagttgatatgatcgtatttgcatatttctataccattgtttcaataggattaagattgacgtgtgttacttgattgaaccaaagcatacttccttcgagattatagattattgataacacaagattttagattcttgataactctttggattatgttttttcgacaacaacaaatctcatatttcgagcgatattagatatttcttaaacaataaatgacattatgtgagcattagaatttagaagcccgtatgctatgctggtatcaaaaggcttgcatttctacaaaatgactttcttcattaattgtcgacctttcatgctgattatttggtcttccttattagatatttttgtatcgctgactggttcaataatttattttactcaacttagtattgtgttgatttttatagaaaaacatagccaaaaccccaaaacatacaaaactacaaacaaataaaaatatatataatatgtgatgaatcatatttcaaaccataataggcgttactagatttttacccgcggtataccgcggagacaatttatattttaaaggtagtatatataaaagtttacaatttgtaactatctatgtaactatttataaaatatttttattttatagtttagaattgttattaagtaacaacctgccaaacccgtcccgctaacccgtcccgctaacccgtcccgtaaaaaaaattcatttattttattaatgttgatcttatttatcatatgtttatgaatcattgtctaaatattttgtaattttgtagtaattaaatgctatcaaatatctctgcggtttgatgattataattgaattgtaatagtcatgcagaaaaacaatatcaataatgataattttgtagtaattaaatgatattaaatattttgaaagttttattttattaaccaatcgtgtagttaatgtagagagattttaggaaaattgttaaatgtcaaatatttaattcgaagaattttcttctaattatcaaaaacaaatattaaaatccaatggcaaccattgtaaataagtcccaactacaagatttatttcataaaatggctgcaaaaatgtatatatagatattaaaaacaaacatagatatagtgtcaagaattccaagtccaaagaatattatggacacaagcccatctgtatttttcttagttgaaaacttggaatgcgtgattctctacatgacattgatatcaaatctcacaaaaaccaaacatatataattgatcaaacaagaaagtaaaatttgttttcaatctctaagataaatgaaccaaaaaaatcattatctcgaaaggcatttaggaatttctcaaaagagttactgtcttaagactctttgctatctcacatcaaagcgatatctcgtgaaaacgtttttataactctatcttcattgaaagggtaaacttttgttttctagtagtatactttagataagtatcaagtatgagacttaggattttaggtaatcatcttcagaaacagaaacagaaacagattaaggttagttataatgttcatgaacttcgtctcaaaattaacttcgtcttagtttttaagatgataactcttctaatccattttaaatcaaatctcactttatattcggcaacataaccaatccagttcaacacaaccaccattagtttgaaaaaatttcaactaaattagggttgatatatacttaaactcttaaattattatgattttttcaaactttgactatataattaaaccgaataatttgatttaatacttaattttgttatttttgttctataaaaccaaactaagtcatcataagagataaatgataagctctatgtaaagttcttcactgtctacaagaattatgtcatcttattctgactattatgtagaaacttttgttagttcatatccaaagtaaaacaaacttagtttaaattggatggttgattaccatttaccaatgttaacaacttaaaacttcaataacgtaacgagcatgtaaaactaaccaaccaaaatttaagaaaatgtatatattgattccacttttcacttatcaatctgattgatttattaagtgtaaattgcaaagtttaatctcatttttttttcaaattttttatttttcaagaccaaaccaaagtaattaattagatcataccaaaaagcgcaaaatggcgccgtttcgagaaaaaacccactccatatactcttatatttttccatataattctttcagaaaaaataaaagttcgaattaattgggtttgcataagttttgttgacattgttgtttaatgtaatgattgagtcaagtctataaactattaaactctagggtttaatatgtacaaattctcttaggctacttttgattaggactcccttgtgaatgtcaaaacataatgcgaccccaaaatatctttataagtataattgttaatcttttgattctaaaatattgttcattgttttccaattagggcttcaaagactcttgagaagcatcattaaacatttaaatgtcaatgactaactttacatttaacatataattaatctaccgaaaattagtgtaagttgcaagaaattatccaaaaacccaaaataaagcaagcgctaaacttttaaaatgctacaaaaaaactggcgccgtttcaaaaagcatacctctttttgattggttaatacatagtcacgcggatcgtgctttatttgaacatccaccgtcgatagactaaatccaacggataataatcctctcccttctttttttttcatttacctataaatatcacagagtacccttcaactttaaatcacaaatcttcaacttccgatactttcaatctctctaaactctcaatttcagtaatcgataaccgtagcaatg

SEQ ID NO: 23363 - DNA, 3000 bp, Unknown; identical to SEQ ID NO: 1555
  misc_feature (1)..( 3000): 2750-1469P.txt file - cDNA_ID_2138357; gDNA_ID_1620417; Annot_ID_156457

SEQ ID NO: 23364 - DNA, 3000 bp, Unknown; identical to SEQ ID NO: 1563
  misc_feature (1)..( 3000): 2750-1469P.txt file - cDNA_ID_2138361; gDNA_ID_1620417; Annot_ID_156458

SEQ ID NO: 23365 - DNA, 3000 bp, Unknown; identical to SEQ ID NO: 1560
  misc_feature (1)..( 3000): 2750-1469P.txt file - cDNA_ID_2138431; gDNA_ID_1620417; Annot_ID_156485

SEQ ID NO: 23366 - DNA, 1218 bp, Unknown; identical to SEQ ID NO: 1556
  misc_feature (1)..( 1218): 2750-1469P.txt file - cDNA_ID_2138435; gDNA_ID_1620417; Annot_ID_156486

SEQ ID NO: 23367 - DNA, 3003 bp, Unknown
  misc_feature (1)..( 3003): 2750-1469P.txt file - cDNA_ID_2138480; gDNA_ID_1620763; Annot_ID_167257
acactctattttccttttattattggtgtggtattgtaacactttttcttcttttataattggtgtctcgtgattttcatttcacacagttaataatactttcccacatttatctttaatgtcacacattgtgattaattctctagatgaacaacacaataaatgagctgtagagttatgggcaaaaaaataaataaattttggttggtgagataaacttattttgtaaaaatcacttgtttcctatttattttgaacgtgtgtttgtatatttttctctctctctcttcaacatccatcttcgaccatcaatgtcaatttctctcttatgctccctagaatttctgtcatacgcagcccttgggccattaccatctcgacaaacttcgttatcaatgataatttaccaaccttaacaaaatcaaacaaataattcaattaaggtgacatatattaaaaaactacaatgtctaaaaaaaggagaaaagaaaaaactacgatgtcaaagaaaaaataatagaaagaatggataaattacacttcatcaccgatgacaaaaaccagtaaattgattgtactagaaagatcttacgaaacactataaattaaaaagatcttacaaacaaactagagagaaaaaaaaatctctagatctaaaagcatctccaacagaccctcaaaccctcaaatttgaggggtttttaactctaactccaacaacccttcaaaccctcatggcactattcacaccctcaaaatatttctcttatttcattttagtctttgtactttatattccttacaaataattctattaaagtcaactatttcaaatatattcatataaatttaaataaatgaaaattatttaaatataaaaaacaaatacaacaataatagtacactgagcatttcaacacaaattaaaattaacattacaatgataaataaatacataaacacacaaaataaattaacacttgaaaaaattacattaaaacataactaataaaaaattaaattcgtaatgcaatattaatattcaggtaaatttgatcctgaacctccaagatcaccaaaatattgtccataaacatttgatggaatcggaggttgttgttgttcttgatttcttttttgtatgattcttgcttgttcagatcgtataaattcacatgtattactatcatcaatatcgcttaaacgtgttagcaatattttattttccttccctatttcttttagagctaatttttttgcttgattttgcatacgcaattgagccatctcataatccttgcttctagttgatgcactttctttcaaaaaatcaagagagacatctcataacaagaagcatgccgaaaagatgttgaacgtgcgtttggagtcttacaatcgaagtttgctatcatagcatgatcgtcatgttactggaacaaagaagtattgcatgatataatgacagcttgcattataatgcataacataataattgaggatgaacatgatatcaatgcactgattagagattcaagattgatgccaccgccaacagttgaaacggggttaaatgaacagacaagatttcaacaatttttatcttataatctacagataaaaaataaagagactaatttatcactttgaaatgcattgagtgatcatatatgggagcattttggaaatatttatatagagtaattttgtaattttataaatcattttatgtttttttttatgttttttttttaatttatatataatattatattattatatggagttttttttttaaatcttgtttggcataattgtttctataatatatgtgttatatttatttgtgaaagttttatcactataactgattattgttaaaaattgaggattataatgtaaatacttcaaaaaattaaaataaatttgtgggtataccattggagtaagtgaccctcaaatcttcattttgagggtgtgccccctttaaaatgagggccattgttggagatgttcaaagaagaagaaataaggtgagatggcatggggaaccatgactagagcaaccttcaagacactctattttctttttattattagtgtggtgctttttcttcttttataattggtgtctcgtatttttcatttcacacagttattagggacctcccacacttatctttaattgtcacaaactgtgattaattctttatatgaacaacacaataaatgagcggtgaagttatgaacgaaaaaaataaattttagttggtgaaataaatttattttataaaaatcacttgtttcctttttattttgaacgtgtgtttgtattttttctacttttctctcttattatttgagttacttaatataatataatttatctatttttatataataaattaatatttaatttttcttatattttaagatttatccgttgttttttttaagtaaataattatatataaaataaacgaaatatctaatattaagtaactaaaatggagaagaaaaagaaaaagagagagagagaaagcatgccaaagggagcgaaagagaaggatgaaattgagaggggcaaattcgtgttactaagtatattaccgtaaaacaaatgaaaatcgaaagaagtgtctctttttgcaaacaatgttggccaaagtttgttattaaggtgtactagttgggtcaaagagttgttatttgttcctttgggtcgacatagagtcgggtttagttttgttaattgaataattctaagcctcaaaaaaatcttaagaattaaactgtcttcttcttcggtcccagccaaaaatccagaagattcttaaatctcatttctgcggcgtaggtgaagtcttagcgataagctttgtttcttcttcttcttcttctttacccatggatttttaacgaacaagagaagagaagaaccaagttttcttcgaaaggattgaactttgtttctttctcttcagctacaacaaccaaaaaatg

SEQ ID NO: 23368 - DNA, 998 bp, Unknown; identical to SEQ ID NO: 7724
  misc_feature (1)..( 998): 2750-1469P.txt file - cDNA_ID_2138588; gDNA_ID_1621159; Annot_ID_173636

SEQ ID NO: 23369 - DNA, 3003 bp, Unknown; identical to SEQ ID NO: 18621
  misc_feature (1)..( 3003): 2750-1469P.txt file - cDNA_ID_2138612; gDNA_ID_1621159; Annot_ID_173658

SEQ ID NO: 23370 - DNA, 3000 bp, Unknown; identical to SEQ ID NO: 4384
  misc_feature (1)..( 3000): 2750-1469P.txt file - cDNA_ID_2138832; gDNA_ID_1620703; Annot_ID_165172

SEQ ID NO: 23371 - DNA, 3000 bp, Unknown; identical to SEQ ID NO: 4384
  misc_feature (1)..( 3000): 2750-1469P.txt file - cDNA_ID_2138832; gDNA_ID_2926174; Annot_ID_199745

SEQ ID NO: 23372 - DNA, 3003 bp, Unknown
  misc_feature (1)..( 3003): 2750-1469P.txt file - cDNA_ID_2138881; gDNA_ID_2926146; Annot_ID_197735
ttttcaatatgtatatgaattactatcttcacaattttttacaaaaagctaccactctctctatttttctgcaatcactcgttttatttgttttattttttcttacagtttctctttccatcctcttataattttgtctaaacaatatgtgccataccttctaaacttttcatatgctccatatttcttcttcgaaaatctcttacttttcttgttagtataagcattttttaagctcgtcaagatgtactctgttttgttttctgttattctaagaaaatgttttaccttctaaactggtacttaactctatcacttttctcttttgatgcagtttagatccttttcaccttcacgctttccagactgaaagacctcaatttatatcttcgagaatttgattcaaattgatacgattaaaaacaccactatcaaaccacgtcattgttacgtttctttaagttatattaaaaaatgttggattagttgtataaaattctagaaaaattctttctaatgcccttttcattatgcccctttttaactttaccctttttttagccattttcatttttaccctctttagccattatgaccattttacccctatttgaaaattgttttaggttaacaaaataaaatattaatatttttcgcctaaaatatccaaaataaatttcccgccaaaaaaattcgaaaaaaattaccgccaaaaagttttttgtcaaaactagttttctcgcaaaaaaaatattttttggcgggaaatagatttacaagggattttaaaagggtttaaaaagatttacaagaaattttaaaagagttttaaaagatttacaagggattttaaaagggttttaaaatatttacaaggattttaaaagagttttttaaaagatttacaagggattttaaagtgctttaaaagatttacaaagcttttttaaagatttttaaagggttaaaaattgttttaaaaaggttttaaaatatttacaagggattttaaaagagttttaaaagatttacaaggtattttaaaagggttttaaaatatttacaagggattttaaagggctttaaaagatttacaaaggttttttaaagatttttaaatggtttaaaagtgttttaaaagatttacaaggtattttaaaaggatttcaaaagatttacaagagatttttaaagatgtacaagtgtttttaaaagatatttaaagaatttacaagaagaccctttaaaaactcttgtaaatattttaaaatcttttaaaatctcttataaatctcttaaaatacttttaaaatctcttgtaaattttttaaaacccttttaaaatcccttgtaaatattttaaaacccttttaaaatctcttgaaaatatattttttcccaaaacaattttacaaggatttgcataatcatttttttggcgggatttttctttttggtgggaaaaaagtttgccagaaaatttttttggcgagaaaaataaatttttggtgcaaaaatttggtgggaaaatttcagtttctaattacatgttcctattagatgaggataatttggtcattctgttcaagggaaatggtatttttaaaaaaggacaacataaaaagatattgttgcaaaagggtagtaaaaaaagagtagttttgcaaatctcccaaaattctgtaagggtttaggtttaatattatttaattataattatattgcttccttttttataagtttaaatttaatatttgttattttcgttttttattttaaattttaaaatggaaagtaattattatttttaaaaatgttaattaattagatgttaaatatgttaattattgatgtgacagcttccgattagttgttttaaaaaatgttaaataattaaatgctaaatatgttaattattgatgtggcagctttcgattggtcgttctaaatcctatgtggacggctttagaagcaaatagcctcaacttttatatagtatagattttcagtttttggtgttcaatttttcgatcaccggttttgatgagattgaaaaactctgtgggaattttttatggccgggcaacccgaacaccacacgagttgtaaaagtgctttcaaattattttatttattttataaacatttaaatcttaaaaataatatatgagaattaaaattaataaataaaattttaaccataaattaaaaacgaaagtaacaaaaaaaatttaaaaaatgaagtaatttttttttaagattgtaatattttttttaataggatggttttttattctttactttttttcaccagcgaccattttattaagttaggagaactaatccggagtcgatgtacttacatgaaaaagaaaaaaaacttcgtgttcttatattttttgttaggcaatcaacacagacattgttacaacagagaataactctaatataaaataaagacaaaaaatttcaaaagcttttttaaaatattgtaattcttcaaaagcttttaaaatgttgtaattctacaaagcagctcaactaaataaaagttgcattttgcagacatacgaagtcgctaatttttcacatatcggaattggaccgagaaggtggaaactacgcgcctccatcgagagtggtgtaaaccataatctattacataaaaaaaaagataacaaaagagacgttaaagcaatgtttctctgttacgcgctgacgcatctctaacctttttaggttctgtactatctttatcttttagtcaagtgttagaaaagtatcttaatcagacggttagggttctttattattactagccgcaatttttttattgaaacaaataaataaaaaaataacccaagaacaacaacaatctggtctgctgatgtattaattaaagaaaaaaataaaacagagcaagaaacaaaaaaaaaaatgtaaagaaagagaaaaaaagctttcgtagtgtctattgaaaccagagaaaagccaaaggggatg

SEQ ID NO: 23373 - DNA, 3003 bp, Unknown; identical to SEQ ID NO: 23372
  misc_feature (1)..( 3003): 2750-1469P.txt file - cDNA_ID_2138881; gDNA_ID_2926146; Annot_ID_139100

SEQ ID NO: 23374 - DNA, 3000 bp, Unknown; identical to SEQ ID NO: 6110
  misc_feature (1)..( 3000): 2750-1469P.txt file - cDNA_ID_2138881; gDNA_ID_1620845; Annot_ID_170177

SEQ ID NO: 23375 - DNA, 3003 bp, Unknown
  misc_feature (1)..( 3003): 2750-1469P.txt file - cDNA_ID_2138885; gDNA_ID_2926146; Annot_ID_197733
atatcttacgtattagttataaggatagctcctcaaacatctttcaaattacttgttttcttatcataaatttcgaaaaacttagatatatttaatctgcatattcatttagtttatttcataataaacgtctaatttttaggtaaggaatatgtgtagcatgtttggattttatgatcactttagccactaagtggatctcaaaattaaaaagaatatattgaattaaaaagatatagaaagaatgatggttcaagttctgactaattatactctcatattttagttgttatgttgaattaattactaattatgtattagttattttatgaagtctaggtggcaagctctcatgtgctgatgtgtcaagttgtgggagagagttaaccttctttcatatatatgattaaaacatcaaccactagatttttatatgattgtgatgccccttaaaactttgatatatttagcgccttggatttatagatcacatgtaactggattctgaaagctaaagtcgtgagtttttgtgtagaatttttataaaaaacaactttaagaactttaccccacacacaagctttagaaatcattacaacgcttgattagtgttgttgtagtcaacatatgtcattatatgattaagtataagaactagatatgcaacgagattcagaaagttaagtcgtatatgtatttgtgtagaagctccaaaaaaacttctataacatcacccccatccacaaagctaagtaatcatacaacaattcaatcattaagcatcaattcaatccatatcatatatatttatgcataagtctacacttagctaatatctcatctagaagctaacatttaggcaaccaaatcaatcaaaaactctagatctacaaacgaaagaaaataaacaacaatcaatcttgtttagatgagttccatgaactacatgtaaccacatgaaacacataaccctaattcacattggtctggatgaacgagaaatcgctacccttgaccaacccgatctcgatctgcctaagctttctctgactcgtactaatgatggatataagcttcagaccaaaaaaaaattagaaaaatattctaaaaatattctaaaaataataaaagactaagggcgggtaacacataccgattatccgactaacttgactcttagctatccgactaatgataccgaccaccacagtttctctgacgaagcttaacgacctaattagtttgcttatacgtttaagttataataaaatgatgcatgaaaaacagtattgtttgtataaaaatcaaataatataaaaaatcatataaaagacaaaaaaaaaaatagactaagaatatcaaaaacttacaccttattacaaactgtacacaatcaatcataattttataactaaaaaacaacaaaaagtattatatacaacaaattcatcggtttatacaaaaagaacaaattattaatcttgcagtatatattgaattatacgtcttttaaataaaagtattataaaaaagaaaaataacaaaatgatatttagttttacaggatgggttatatggtaggacagattttgggtcgaaattagtttgagactgtataccatgggtaaattcttaaaattaacaatcaaaatacaatttatacaatcttaaacactagacaaaacaactataatttaaaattttgattataaaagatcgacccccagtgtatccacaatcaaacataagtttataccaattaaattaaaatacaacaatatcataagtttataacaaaaaagatatatatatatcatccggtgtacctttggtcaaatcctgttattatgtaagtaagctaaacttttgatattattaatttgtcttaaacgtcatactcaaacacgacgattacacttaaatcccccattaatctttgatattaatatatatatatatatatatatatatatatatatatataattacatattgttatttacgttattatttgttttacgattatatttattttgggtttttatgcaaataaaagggtactacccatatttaagttccaaaattgaaaaatattatcaattaattgaaatttgccactattttgcaaatcacaattatacaatatgtcaagctctattaataattttttttttttcagtcgaatacggataaagaatttagaaaatattttaatatattaacaaaaataatcaatagaattaagattaatagtttaatatattgaaatttccgttataggaaaaggaattctcaccttttttatataattttttttaacttatgcatatatttttttctgatagagttatacagcttttcttatatttatctttaaatatattaataaatttagatttgagacatgatgatatcgtgatcacatgagttagcaacttgtaaaattcaacttataataagatggtcacattaaataaaaacacatgtatgattagaaatttccattttacaacctaaattatatgtctcttttataacaataataataatgcgtctgttaaaaaaaaaagcgtcttttacattttataacccttggtcttctctaacttgctaaattgagtgctaaaacaatattcgagaagcattcttgtactcaccaaaatcttcacatttcttttgtttacaaataaacgtactaacaattcaacctggaaatgttctgaaagaccattagctaaacccaaaaatatatgcacgaacatagatcattactttggtagttacaacttacaacttagtagcataataatttaataaagtactactggttacaactttaaaaaggaaaaggacatcttttactttattaggacagctttttgagttgtaaatttagagcccaacattggattcctcttctttgaccattcctctctacctgaataacccgttaatctctctctgtccctttcttcttcttttttcaagaacaataaaaaaatg

SEQ ID NO: 23376 - DNA, 3000 bp, Unknown; identical to SEQ ID NO: 6104
  misc_feature (1)..( 3000): 2750-1469P.txt file - cDNA_ID_2138885; gDNA_ID_1620845; Annot_ID_170179

SEQ ID NO: 23377 - DNA, 3003 bp, Unknown
  misc_feature (1)..( 3003): 2750-1469P.txt file - cDNA_ID_2138885; gDNA_ID_1620778; Annot_ID_167845
ttacgtattagttataaggatagctcctcaaacatctttcaaattacttgttttcttatcataaatttcgaaaaacttagatatatttaatctgcatattcatttagtttatttcataataaacgtctaatttttaggtaaggaatatgtgtagcatgtttggattttatgatcactttagccactaagtggatctcaaaattaaaaagaatatattgaattaaaaagatatagaaagaatgatggttcaagttctgactaattatactctcatattttagttgttatgttgaattaattactaattatgtattagttattttatgaagtctaggtggcaagctctcatgtgctgatgtgtcaagttgtgggagagagttaaccttctttcatatatatgattaaaacatcaaccactagatttttatatgattgtgatgccccttaaaactttgatatatttagcgccttggatttatagatcacatgtaactggattctgaaagctaaagtcgtgagtttttgtgtagaatttttataaaaaacaactttaagaactttaccccacacacaagctttagaaatcattacaacgcttgattagtgttgttgtagtcaacatatgtcattatatgattaagtataagaactagatatgcaacgagattcagaaagttaagtcgtatatgtatttgtgtagaagctccaaaaaaacttctataacatcacccccatccacaaagctaagtaatcatacaacaattcaatcattaagcatcaattcaatccatatcatatatatttatgcataagtctacacttagctaatatctcatctagaagctaacatttaggcaaccaaatcaatcaaaaactctagatctacaaacgaaagaaaataaacaacaatcaatcttgtttagatgagttccatgaactacatgtaaccacatgaaacacataaccctaattcacattggtctggatgaacgagaaatcgctacccttgaccaacccgatctcgatctgcctaagctttctctgactcgtactaatgatggatataagcttcagaccaaaaaaaaattagaaaaatattctaaaaatattctaaaaataataaaagactaagggcgggtaacacataccgattatccgactaacttgactcttagctatccgactaatgataccgaccaccacagtttctctgacgaagcttaacgacctaattagtttgcttatacgtttaagttataataaaatgatgcatgaaaaacagtattgtttgtataaaaatcaaataatataaaaaatcatataaaagacaaaaaaaaaaatagactaagaatatcaaaaacttacaccttattacaaactgtacacaatcaatcataattttataactaaaaaacaacaaaaagtattatatacaacaaattcatcggtttatacaaaaagaacaaattattaatcttgcagtatatattgaattatacgtcttttaaataaaagtattataaaaaagaaaaataacaaaatgatatttagttttacaggatgggttatatggtaggacagattttgggtcgaaattagtttgagactgtataccatgggtaaattcttaaaattaacaatcaaaatacaatttatacaatcttaaacactagacaaaacaactataatttaaaattttgattataaaagatcgacccccagtgtatccacaatcaaacataagtttataccaattaaattaaaatacaacaatatcataagtttataacaaaaaagatatatatatatcatccggtgtacctttggtcaaatcctgttattatgtaagtaagctaaacttttgatattattaatttgtcttaaacgtcatactcaaacacgacgattacacttaaatcccccattaatctttgatattaatatatatatatatatatatatatatatatatatatatatataattacatattgttatttacgttattatttgttttacgattatatttattttgggtttttatgcaaataaaagggtactacccatatttaagttccaaaattgaaaaatattatcaattaattgaaatttgccactattttgcaaatcacaattatacaatatgtcaagctctattaataatttttttttttttcagtcgaatacggataaagaatttagaaaatattttaatatattaacaaaaataatcaatagaattaagattaatagtttaatatattgaaatttccgttataggaaaaggaattctcaccttttttatataattttttttaacttatgcatatatttttttctgatagagttatacagcttttcttatatttatctttaaatatattaataaatttagatttgagacatgatgatatcgtgatcacatgagttagcaacttgtaaaattcaacttataataagatggtcacattaaataaaaacacatgtatgattagaaatttccattttacaacctaaattatatgtctcttttataacaataataataatgcgtctgttaaaaaaaaaagcgtcttttacattttataacccttggtcttctctaacttgctaaattgagtgctaaaacaatattcgagaagcattcttgtactcaccaaaatcttcacatttcttttgtttacaaataaacgtactaacaattcaacctggaaatgttctgaaagaccattagctaaacccaaaaatatatgcacgaacatagatcattactttggtagttacaacttacaacttagtagcataataatttaataaagtactactggttacaactttaaaaaggaaaaggacatcttttactttattaggacagctttttgagttgtaaatttagagcccaacattggattcctcttctttgaccattcctctctacctgaataacccgttaatctctctctgtccctttcttcttcttttttcaagaacaataaaaaaatg

SEQ ID NO: 23378 - DNA, 3000 bp, Unknown; identical to SEQ ID NO: 6109
  misc_feature (1)..( 3000): 2750-1469P.txt file - cDNA_ID_2138897; gDNA_ID_1620845; Annot_ID_170182

SEQ ID NO: 23379 - DNA, 3000 bp, Unknown
  misc_feature (1)..( 3000): 2750-1469P.txt file - cDNA_ID_2138909; gDNA_ID_2926146; Annot_ID_139096
ggagatgagatggcagtgaagaccatcaacaaacagaacatcttgaagatctaaagaagagcctaactgaacactgccttgttttgtagcggttgtaaaacgtccatcaggaagtttaatcaaaacaggaggcatatcacaaacattacggagaaatgcaagagaaccagtcatatgatttgtggctccagaatcaattatccaagattcaagaaaatacttaccagactgatgatcatttaaggtagatttccgttcctcaagaatcgtttgtaaaattttccattgtgaatcattcagcccactaagtcctatgcgatcatctgatgtcaatggagaagtgagcgatgaattcgtaacaacattggcagccattccagaagaagcgacatgattaatagaagatccacgaccatgactctgttttcctttgaacgaacttaaaccaccacgtgaagaagatgcagtgtttttaagacgcaatttttcttcgagccaaggaggatacccgattaatttgaaacattgttcggcgagatgaccaacacggccacaattactacagactctgttttctgaagaatctcgaggtcgtgaagtagtttggaccgcgaagctaacaccgtcaaccctctcgttatgtaagcgactcaaggatttggattcttcgtcttgtgtcaaagcattgtaagcttcctcgagagaaggtagtggcactcgagagagaagagccgacttgacagctccgtacacagattcatcaagtcccataagaaactgatgcaatttgtcttcttcacgttcttttctgacgtcgtccatggttttagcttgttggtaatccgccaagctacaccacagttgagagagacagccgtagtaagtttcaatggccactcctttttgacgacaggttgctaactctgttttgagtcgctgaacatgttgtccattcttgacaccaaagcgtttctgaatgtgtgtccagagctcatgagaatcgtcgagatgagacatagatgtggaaacagtttcatcgatggtgagcttcatccatgaaaccacaagagcattgttggcagtccaatcttcgaaatcgggatctgtctcaactggttgtggaatagatccatcagcaaacccaaatttctttctagcttttaacgccaaacgaagatttgtggcccattcgtcgtagttgggtccacgaagcaacggtttggagatgagagttccgggattatcaccggatgtgagatcatatggcgagattgtacgccttgtttcagtcctagctggtgtggtggagctagcgagagccaattcagtactcatgatgaacggagagtttgatgcaagtattaagtagagaagttagaaggaataagaaagcgatctcttatagcggaaggagagatcacagaatcgatcacaaaaaccttttagtagttaggtattgtgctctgataccatgtcaagaatcaatcgaggttgtgaaaagaagattcttattgattacggcaagaggcaatgcctttatatacacgataagtttagacctagttaatctatacaatataaatgggctaaggccacacagcccaacatatattgctcataaacaaacttttcaattgaggcaagtctcaacatgttttgatcaaatcgacgcttttctaaaccactttgttttctctttttgcatcgtgaaccttccttgatttggaccaaacttggaatataagagataacatattgtttacagtttccgtctacaagattcagtttttctaagtatccatcctctccgacgatgctaataaatgttttgagacaattagagtcggggtcaaggtttctaccgaaacccatgaagactttcttctcttcgtctacgaagaaactatgtgatatctttatcttaggtctcgtatcaattctaaataacttgctccacgacaccgtttcggcatcaatcttagtcgtaatccatatctccaactcagataacgctgaaataaagctgcaagcttctcttctttaacacaagataaagtcacatctacagcgctgcacggtagagggagaagcggcccgaatctctctcttgtaaaatcaaaacagataatgtgatctttgtgaccctgtgacctcctttctttagcacaccagtaagtgtttcccttaatagaaacgccactggaagaacaatgtacaccccagtgtggagtgacatcaagagttgtctataaacccgagtcaaaatcatagatttcataccaaaaagattgtgtttcgggtgtattgtagaaataatctagaaacctcaggaacttaaaggtacgacaagattccttatcttcgtatccaagagcataactaaacctatcaaatccattcggaggttgagaatatcggaggttgatccaccttgtatgcccccaatacggattccaaaccaaaaccctagtaacgtcgtctttcaagatgcataacaacaaaccctcaaagtggaaaatattagatatactcacttgattgtgaatgaaaagttgacctttaacctctatagatggatcaaagtcgacgacaccgctcattaaacaaagtttgtgaggcatcatcatgatcatcatagtctctccatctcttgttggtgttgtcactttaccaatgtgcatcttcgtaaaaccctcacttttggataaattgttccaagttttgcaagttaatctcaccgctttcatagatttcaaaggaaccctagaaatgatctcctcgatcaaatcccttggaagattgtagatcatcgtcgtcattgtttcaactttcacaacgaatgatttcttgcagcttagggaaaggaaaaaggtatacacgacgacaaattataaccctaaataaatttgggccactagtgggctttcagaatctaattgggcttaagcagacccaatttgtatctggcgcgaggttttagtttctgcggaggaggagatg

SEQ ID NO: 23380 - DNA, 3003 bp, Unknown; identical to SEQ ID NO: 19525
  misc_feature (1)..( 3003): 2750-1469P.txt file - cDNA_ID_2138953; gDNA_ID_1620671; Annot_ID_164104

SEQ ID NO: 23381 - DNA, 3000 bp, Unknown; identical to SEQ ID NO: 19526
  misc_feature (1)..( 3000): 2750-1469P.txt file - cDNA_ID_2138953; gDNA_ID_2926200; Annot_ID_201802

SEQ ID NO: 23382 - DNA, 3000 bp, Unknown; identical to SEQ ID NO: 19521
  misc_feature (1)..( 3000): 2750-1469P.txt file - cDNA_ID_2138981; gDNA_ID_1620671; Annot_ID_164117

SEQ ID NO: 23383 - DNA, 3000 bp, Unknown; identical to SEQ ID NO: 3884
  misc_feature (1)..( 3000): 2750-1469P.txt file - cDNA_ID_2138993; gDNA_ID_1620671; Annot_ID_164121

SEQ ID NO: 23384 - DNA, 3003 bp, Unknown; identical to SEQ ID NO: 19520
  misc_feature (1)..( 3003): 2750-1469P.txt file - cDNA_ID_2138993; gDNA_ID_2926200; Annot_ID_201785

SEQ ID NO: 23385 - DNA, 1470 bp, Unknown; identical to SEQ ID NO: 7509
  misc_feature (1)..( 1470): 2750-1469P.txt file - cDNA_ID_2139018; gDNA_ID_1621149; Annot_ID_173157

SEQ ID NO: 23386 - DNA, 3003 bp, Unknown
  misc_feature (1)..( 3003): 2750-1469P.txt file - cDNA_ID_2139018; gDNA_ID_1620785; Annot_ID_168122
taaaatatgataaaatggtttcattaatcaagtgatactggttaagtggttcttacttaaggaagaattgcttcttatgtcgccaaagaggcaaagatcaattcttcttaaacgtgtgatttacaaaatcattttatttgatcaatcgaaatggtgttatatttttacgctcattaaaaaaccatgtgagtggactattcaatagctaaatttactatatacagagatttttcgggtggtagaaacccccgattacacctgatttcattggcttatatggccttgtgccgatatagtagtggacatactctaaagtcttgaaaaatgcaccaaaaagctaatactttgttaacatgggctaaacattttgcctagcatatatgatccggcccatttattaatatgtatctacatctttaagaagtaacgaatttgtagtagcaaagaatgaatggaatcgatattgttcagtgaccatgaaattctcatatattgccataagcccataccttttttttattatttatactttttacggtcgaagaaaaagagaatagtagcaggattcctactgcaggcaatgataataaacttatagaaattttgaacagcgaaaagaaaacgacttgagattcaatatcaatcgttggtgctgtccaattggcaatgaagtaaaatttatgaacattgaatttttttaatttacctattaagcttcgatcgtattcaacctaagaatattacattttataaaatttaacagtaaaaatatctaatttaagagataattattaaaaattatataaaaaagtgactgactttttaatctaattttaatttattaggagaaaatctactttgaaaattattatatatatatatatatatattgtgaggtagaattttttatttcttaaaaaggtttactattttaactgaacattgtgtaaacgatgaacatcataactcgattgtgtccaattcatatctaatagttaaatgaatcaacgactcatatatcacggagcaaaacgcgcatgcagaaaaatccaccaagcgaacaatttggaaagcgatatttctgatgaatcgttgatttccccaatattacgaactttcctgaaatctttcctagccgtcgaatatgaaccaaatttattacctgacctataaacacacacatatgcaggcaaatggacacatgtgttctatgaatcagtgttggtgaagagagagcttgtcgtgtaatgagagttgcatgtgttcaacaactttgtgtatgttttgtaattttcctcttgtgatattttctacggtgagaattccatttgcaaggttacatcaatgggtgaagcctgtacgtccaacatgtgaccagaccttcttttatatcaacggtccaaattaacattacattaacatacacaaatatattatatatttaatactattgttcctgttcttctttttattgtcgttacctcgttagcatcaatgacgaatgaaaatgacaaacgatacattgtgttgttcgaattcgtgttattgttgccaaaacgatgtgataataatggaactatgttcattgtattggcgttgcccgctggtttacaacgatctatttcatcgatgaattttggtaattaacgatataaaattttcaatactaaaagacacacctttttcaacatttctttttataacttatgatgttcccattccattatattatagctcaacttacaaactaacttgtcacatgtaaattactcattgactcgtgacaactattgacggcaatattatcaaactcgtggttggaaatattttaagtccacaaaggaggagaaaataaaattcttgaatattgaaaattcttatacctctatgatataaaagaaaataaaatcaaagagaagtaccacaaaaacaaatttttagtatttaaaaatgccattactttggaaaaggtcccaaaatatcacaaaatctaggcttaggaagggtctctaaacgtttattaagaattactaagcccaaaacttgaaaactcctaaaactctttcttcaaatttagactaatcatttttaattctctccaaaatattagtaacccttgtaaagcctaaacattttagtaaattttatgatttttggtggtaattttggaaaataaagcataaaatgtggtattccgaggactgaccaaatttcaaaaattcaaataaatgattaatatcctaaatcaatcattattttttataattgtttttgagaaacttatattaatactattttcaggcattttcttataaattaccctatggttttagtaggcaacaaaaagatgaacgtctcagatttttttgaattcaatttaatcttaacaaaagcgataaatatcaagaagataattgggtacgtgtattgtgtactatttcaaaattgatatttgcttccataacgtaacgtaacgtaagacccaaagattaacacttggtttcttcatggtcgtagattattaaaagtttataactaatgacgacaaagtttaaacgaaaaacaatattttctcaattttcactagttttttttttttattccagaaaattattagtatacaaccaactatttttacgattataaacttttatttgatgatattcataatttagaaaaaccttaaacggatcttaatgtcaatatcatcagctcatgcaccgcctctcggatatgttgacaaaattaccccatacaatataaaccaccaaaccataaccacaaagggtatattcgtatattataaaaatatctgaatagtcgaacttgtcgttacactcaaaaacgaaatctttccctcctctgttctcaatctttctataaattctcttcttcttcttcttccattttcccaacaacacaaagtctctctctctctgataaaatcttaaaacccacctcgagatcatagtcttcatcaattagccataaaaaagcacaatg

SEQ ID NO: 23387 - DNA, 3003 bp, Unknown
  misc_feature (1)..( 3003): 2750-1469P.txt file - cDNA_ID_2139022; gDNA_ID_1621149; Annot_ID_173159
cctcgccatacgggaactgtagccaggggaattcagaaaccgaacctttcatagccgcacataacatgatccttgcacacgcaaaagcggttaacatatacaagaccaaatatcaggtaataaaactcatacatcaaattaagacctggtttcgtgagttatcgatataaatataatgtttttgcagaaagaacaaaagggaagcattggcattgtggtacaaacatcatggtttgaacccattagtgattccaatgcggataaagaagctgctgagagagctcaatcattttactctaattggtatgttatattactatatatgttgagatcatatttgtagatatgaagtatagtacttcacccacatatggaatatatattgttttatctatttgtattctaacatgtactaggattctagatcccgttatatatgggaaatatccaaaagaaatggtagatattcttggaccagccttgccacaattttcgagcaatgaagtgaagaacttagagaagtcgagggcagatttcgttggtattaatcactatacaagttacttcattcaagattgtttgacctctgcttgtaatactggacatggagcttttaaggccgaaggatatgctctcaagttagaccggaaaggcaatgttactataggagaacttgtaagtacattcattcagtttcttatattcaatattttacgactatattcaaatgttttagtaaattttattgtttattgaccatgtttctattgttagaccgatgtaaattggcagcatattgatcccacaggattccacaagatgctgaattatttaaaagataggtacccaaacatgccaatgttcataactgaaaacggtacaagacctcaaatttgatcaatgatcgagtcatcaaccatatttgaaattatcatgaaaaattattattaatggcttgaaggttttggagacttgcaaaaacctgaaacaacggataaagaacttctaaatgatacaaaaaggatccaatacatgagtggatacttagaagctttacaagcagcaatgaggtaaataatttatgtaaatttatgcagaaatccaattcttaaaatcatgcattcaaatagtctttaaaccaatttttatctaatgaaaatttactaattctatataagttgtgaattgttttggtagggatggagcaaatgtgaagggttattttgtgtggtcactattagacaattttgagtggttgttcggatacaaggttcggtttggtctattccatgtggatctaacaactcttaaaaggtcaccgaaacaatcagcttcatggtacaaaaattatatcgaagaacacgtgaatcgaagagatatcgtagataattattaaacacatttatttttaattcgtattcactgccaaagaaagtcaaaaattacaaaagcatttaaaattgatacttatcattgttgttgattgttgaatgattaaatttgtcttttcctcctaaaagtgaatgtttaatgtgttacatgattatttgtctaatcttgcacaataattctattagcttaagatgttgaagaacacgtgagaagagaatttaggttttttttttggtcaaaggaagaatagtaattcgtattcctaagtaaagaaagtcaaactaggaaagaatttatgtaacttcgttaaatgaatgattaatggttttctttaccttaaagtgaatgtttaatcagtgttacgcgccatacggaagtaattgtctaatcttgcacaatcattcaacacgttttcaaagaaaactttttttgttctctatgatgataatagtgttaaatcaaaagtagtacaaaagtaaactaaacttattttagattaaaaatcaccgaaaaaactaaacacgcgttagaaagcatttgacatcacctccaaatttaatttcacgcaagcaagcgtttctaagatatggattctaaacgctatatcactgttttttgtaagataaattcttcttaattttttcaataaaaaaatttaaaattaaaaataaaatcataaactaactgataatgaccaaaggaaccataaacacctagaaaattatatttctgtgttttctatctgcggtttaacgtcagtaacatctaggaaagttattttacgaaagtgaacttggtttttgtttgattgaaatatgtttcagactttcagaagaaaaaaaaagatacttatttaaaatatgttaagattttagttcacttcaaattatgtaaacatgctgatttttttttttttttttttttttttttttgcaatcatccttcaatattgtctgcgaaacagtcaagtttcaagtacgattcacaacatttttcaaaaaatttattcattcatttcactcccaaaactttttaatttacaaaactacccgtacacgtatattggttgaatagaaattttttgaatatttattatattttgagttacatatagactatgatttaatcaaatacacaatgagtcgttaaacaatctaaagaaaaagacacacgaacaaactgataacatagataacatataagcaaaataggtcggaatcaacaattacatatataaatggttgcgtggttaatgatttcatttggtattttcacgacaagatcgtttctaggtacatagaagtcaacttcgttgccatataaactgtataacacttagtcatacaatctggtttatttatcaagttcaaaaatttaatttaatcaaaatatttgtttgcgaaattttcaatcgagaattaaaaaattaaaaaaagttgcgtggttgagttaatcgtttggtctccatcgctgatatcttcaatttctctgaattaatcttcacatagctgtataaagacctagaaaagaaaacagatatactagtaaccaaacttagaatcaagaaagaaaaaaacagctatagagttgaataagaagaagaagaagatg

SEQ ID NO: 23388 - DNA, 3003 bp, Unknown
  misc_feature (1)..( 3003): 2750-1469P.txt file - cDNA_ID_2139034; gDNA_ID_1621149; Annot_ID_173163
tcattttatctacttaacatttttgaagtgcataattgctctttttttaatttataaaatttttgacccgggtctttctttatacttcatacatattagtctaatttaataaaatcaaatcctttactaatttagatttttgagatctttgggttttctttttctaattaatgtaaaattaacaaaccatttaccaagaaacatttgttggttcaaaagttttaggaaacaatgagatgattatgtcaaatcatcattatttataaacttaaatatatttgtttcctaaataataagaaaaaatattaattctatatttaatcccacaaaatgaattaggaatatgtattaactaaaagattttttatccttattttctatagcatctacataacatatctttaaattataaaaaaatcacataaatattttcgggattcagatttcaataattaggatgtgaacaggttttctaaaaatatcgttcgaatatattgaagataaaaaaaatacaaataggaaatataataatttaaaagatacaaaatatttataaagaaattttgttttaaaaaaaacaaatttcaatgaattcaatataaaatcttcaatacgaatccgatattgattcttaaataaaaatattaatataatatacaatttttcttattagactgaaattttaaattgactcgaagtatcttaaataataatattattaaaaatagaaaataaataatttgatttttagttatcacgggacggattatacggtggaacgggtttagatgagacatgacaaaatattatcccgtggtgtggtctatcaccagtcaaattctataagataaaataatatatattaaacttactaatatcataattacgactcactaaaaaccgtacacaaccttatcgagaattattaatcaacacaaacaacaacaaattctttatcttataaaaaaaaaaatatatatatttaacccgcggtataccgcgggtcatatcttagtacgttataaactttatactacgggtgaaatcctagattgatattaatacaaattatatactatgggagaaattaacaatcaaatacaattataaaatcttaaacactaaataaaataaacaatattatttaaacaaatataaaattaaaatttcaaatttttagtttaaaaaatatagttttgtgatgtaccatacatttaaattaaacaaaataaaaacatatatttattgatcaacttaaaaataaatatttaattttttaataaaattataggcatgcagtataccgcggattaatatctagtttaaaaacttaaaaatattataaattaaaatttaataatcatattgaaacgaatgacgacgttttgtaactcccataagattatcgagttaccaaaactcaggcgagagagagagatcagaaacggaagagaagaataattcagtgaagaatgagactactctctcctctgatcatcactcattgatcagatttgcatttttgagtctccatttctgaatcatccaatccgatcgacgttctccggtattgatttcgttgatcgggtttttgttaagtttttaatatcgatagctccgattccttaaccaaaccagtacgtaccatacacgagagagactagcacatcactagctcagctcacattacaccatacgagagagactagcacatcactagctcagctctcaagtctctcatgcgagactcgcacaattcaacaacaacaacataaagcataatccctctaaattgatctctttccttatttatactagaacggagtttgttagagatatttttatatcttcttcaagcaagcttccttctcacgtgcctcttcacttgcacatgtcttcttttgctttgtctcccattcacatgatacaccaatcgtatcagttttcagtcatacaatcctttgtcagcaaacacactttgttagccgatccaaaataaccaattcggtttgaagttcaccgattttcgttccacctctacacggttttttgtagtgaaaaatcgtcgagaaaattatgaaaattgagagcatcgtctcgtgggagagttcaactagatctttatatttacttatgctctttttattgtaaaaaataattgattatatacttcttcattatatacatattttgatttacactgtttcactaattgtagtttccatggtatgaaatcacttttagaaatttgaattatttctatgttttttttttttggggtaggagatgggatcgaacccccacttttattaataactaaaaaaacaatcacacccgaacattcagagagcccgcatacccatttacatactcaagaacaatcgacataacactatccaaagtagaattaaacaaatgaaaatctaagggtaaagtgtaaatatatagctaactcattcgcaagacgattagcctttctatacgcatatgaaatccgtactacccattcctttgaaaaaaagttatttatctatgtccaaagaaaaccaaccaccatctctaagccaatctccagctcgaagtgtatgataccgcgatccagctatatgtgagccataatatgctccccatagttccatggtatcacttttagaaatttcatttatttctgtcatacatattttcccagatgtaatgcatatttttttttttctttttggatattcgaattattcacctttcaagcgaacgacgacgtttggtagcgtcacattgattattatcaagtattcaagttactccaaaacttccaggcgagagagatcagaaaacggaagaaaaggtgatgagagagttagtctcttctgatcatcacttcttcatcttcaaccattgatcggatcacattttgtttatcgaattcaatcgaagattaccgattttgattcgaaattctcctgttttgatttcaccctccagcggtgatcggagaatttcgccatg

SEQ ID NO: 23389 - DNA, 3003 bp, Unknown; identical to SEQ ID NO: 18505
  misc_feature (1)..( 3003): 2750-1469P.txt file - cDNA_ID_2139072; gDNA_ID_1621149; Annot_ID_173185

SEQ ID NO: 23390 - DNA, 3003 bp, Unknown; identical to SEQ ID NO: 17573
  misc_feature (1)..( 3003): 2750-1469P.txt file - cDNA_ID_2139126; gDNA_ID_2926130; Annot_ID_196859

SEQ ID NO: 23391 - DNA, 3003 bp, Unknown
  misc_feature (1)..( 3003): 2750-1469P.txt file - cDNA_ID_2139232; gDNA_ID_1620682; Annot_ID_164518
tgaggtttacaaggtatactataatatcttcaagtacaccctaggttaagtacttcgtattgattctttgattggataacgagatgatgctgattaaaaagttaaacggatagggtacattttcaaatgggaaagaagttgcggtgaagagattgtcgaaaaattcaagacaaggcgaagcggagttcaagaccgaggttgttgtagttgccaagcttcaacacagaaatttggttaggcttcttggattttcattacaaggagaggaaagaattttggtctacgagtatatgcctaacaaaagccttgattgcttactatttggtctgttgcatttcaatgattctttgaccattaatcttgaaacttggggttgctaatctcaagatttaactgtaatccatggatttgcacagaccctacaaagcaaattcagctggactggatgcagcgatacaatatcattggaggaattgctcgggggattctatatcttcatcaagattcacggctcacaatcatacaccgtgaccttaaagcaagtaacattctcctagatgcggatataaatccgaaaattgcagattttggaatggctaggatctttggattggaccaaacccaagataacacaagcagaatagttggtacctagtaagtcttccacttaacatctcataacttataatatgttgaacattttacattgccaacatatacactaaagttttgttgtggattccagcggttacatggctcctgaatatgcgatgcatggccaattctcaatgaaatctgatgtctatagcttcggagtgttagttcttgagattataagtggtaggaagaatagcagcttcggcgagtcagacggtgcacaagacttgctcacacatgtaagttttaagacaatcaatatatacctctcttacattacattaagtaatgttagctagaactgattgcttgattggtattcaaggcttggaggctttggactaacaaaaaagcattagacctcgtggatccacttatagcagagaattgccagaatagtgaagtggttcgatgcatccatatcggtcttttatgtgttcaagaagatcctgcaaagcgtccggcaatatcaaccgttttcatgatgctcactagtaatactgtgaccttaccagtgcctcggcaaccagggtttttcattcaatgtagagccgtaaaggacccgcttgattcagatcagtctaccacgaccaagtcttttccagcgtctattgatgatgaatcgatcacagatttatatccgcgctaaatatgaccttaaacttcatgcttgtaatcaagcttacgcaaatgtttacatatttgtagaattgtggatgtgatcaaccctaataattttttagttttgatttggtttgttaaaaccatatgtattttgttttgattttttaataatgaataattagtctagtctcaacatcaccaccgattgaaaaaaatgagagagggagagaacacttggaatgttggcattacagtttggttcattttaaaaatttgggcaatccaaaagctataactttggagttcatttcagcgtctaagagccaagaggatatatacctgctttgaagtcacaatgtatggttatgatcttgaatcattctagaatcgctttagcaatacctccaatgatcttgtaccatttgatttggaaacagagactaaacagagtacagtgggaaggtgatttacatgatttgtaatgtggtgaagtaaatgaaatgtgaactatctatcacgtcaaaagtttttttttttttttttcttgttgtaaagtaaactaataactaatacaatattttgaaagacaaagtcatctacacgaggaatttaaatgttagactaataaaacatgtggaagagataaccagagaaaatagaattacaaaattccaggttttgacgtctatcaatctatttccgagaaaaataaaaaatattgggtttgaatattatttaataagttgatgactattctgcttggcgccgaaactttgggtcaataagacagcaccgttagacttccttaccatacaagtaacaaacggaacagttattaagttaaaacagtcatttcgcaaccctagttgattcagtttgtagccttatttagaatcagcaccaatcaacgcgctcagtggaaggttcgcctacaaagaaataggctttgatttttagagtctttttttttggaaacaaggaactttacaaatatgcctagacttatatcactcacatctcttttcataccttctgcactttttcctataaattatttttcaattttttttatataaaatattttcatacatctagatggatccttcacaacttttgagattattttgttattgttttatggattttgatattcttcataaaatttaagttttattaattttcatgatttttaaactccattaaaaattgtgttattcaaaggcttaagtttcattaaaatatatattgtttgtaaaattttattcataaaacaaaaaaaaaaaactgtggatatcctttacaatattaaaattattctataactacaatactctctacaatcttaaaaatctctcatttcttgaaagttgaaaccaaactcccatattatttaagaggtggagaaacaatgattaagtttttgggttttgctcaacaaatgtttttttggatcaatgatccaaagattccaaacactaaactcaacgtcttcttccaataacttttacttttgttgttaataaaaatgacataaaaaagattaatcgtatacagtacattgagtttgattgacgactgactttaaagtcgtaacaaaccaccgtatatttcacgttaatcaaataatcagcactagtcagagagagaatataatttgtcagtttataaatggaagctgcataatgtgaaactcaaatcaaggaactcaaagaaaaaaccatg

SEQ ID NO: 23392 - DNA, 3003 bp, Unknown
  misc_feature (1)..( 3003): 2750-1469P.txt file - cDNA_ID_2139439; gDNA_ID_2926183; Annot_ID_140644
tagatgattagaacaaatccaataaacccatacatttaccaagaaaatattaaaacataagatacatgacaaagtcatatatgcaacatgaaatataagataaagaaaacaaactcttagatcattttgcagacaacgttatacgacgaataatcaaacaaacgaaaaatgattctccaagaacatgttaaatttcatgttcatcagaagatcataattagtagtaagtaggttcagacgtgtagaagaaaggaccagcccagtaaagcttgaagctcttgtcttgaagaatacggtacgtgctcaatggctgtcctctaacacctttgttcacatcggtcggaaaatcgcaatcagcgagtggagatttgtaaaggtaagttttgcatttggtcactgtccttcctgcacgaagctgcgaagggaatatcgtggcgatgaagtaacctttagcatcagttttgctgctcaatatcgatattggaactaactcattcccatatgcatcgaccttcacacacgcaattcttgccgttgcacctgtcgcaaacaaacaacaatacgatattcgtttggttagaccttactatgctctaattttctcctaccattagaccaattcgtcttggtatatataattaaagaagttatgttaccttgaattgggtaagttttgccaccggacttgcacttgatgatcccttcaacggcgatgggaatcaattttccggtctccgggtcagcttcattgccgtaataagcaactgaagatatgattagagatgagaagacgatgagagaagctgcaaatgagaggcgtgagaaagccattttttttttttgcttgctttgtttatatgttgcttaagcaagtgaagttttttgaaaactaactattgggttttatagattaattgcgttgaaaaagaaggttaattttctaattaaattatttggtttagtgtacattaactaataagaaaacgagcaacttgtaatagtaaaaccaaacaaaacttgaaataagaacaacgtgtatgcacggtagacaatagtgttattgtcccgacgtgagtcgcattatagtgtgtggattaccaattccaaagacggttctaacattatggatggacaagcatatcagttttaacttttaaaagttcggatgtctctaacaaataagggcctgactggtttaaacgcagcggatgcggttgcggttgcgggagtttgcggaaacaggcggttgcggtttcaagcgttatcaagtgttttgaacgactggttgagcgtttgataatgagtgcgtttgcgggagttttatgattggtaaaccagcgggtgcgatagtaattaaataaaaaataaccaaaataaatataatatattactagtaaaagaaaaaaatacaatatattattatgataaattgataatattagaaaaattaaacatgcttaataattaaaaccataaataaaacattaaattcaaaaataaataaattttgtaagaaaaagcttagtactttatgcatttggtacatcaccaaaaattgcatcaagtagtgtaataaactgtaaataacgttgaactcgtgggttttccggattgcctctatacatatgataaagttctaacaagaaacgggtcatctcgtctgaccaaataattttctaatcgagaaaacaaatcaaaacatgtattcaatcaaaaaactcaaaaaaatacaaaataaataaaatgacgatgccataaaatactcagagaattacactagctaatgaatggatgaaaggatagatcatacttacgtttgattcttgattttgattttgattttcgttagtttgggtagatgccataattgagagaatagggtttcaatatattgattaggattttctgataagaataagatatatagggtttgggtggaagacataattattttagttaattaaaaaaaaaaattaacctaaccgctaccgcccgcaaccgcaaacgcttgcgggaaggaacttttaaaatatggcgatttcgagcggtccaaagcggtatctaacggtttttatgattggtgtcaaacgctaacaactgctaccacccgcaaacgcagcgtttgcgggtgacagagggagaaccaatcaagctctaagactaatcggaccaatttagcaacttgtgtgcttcgatgtgttggactgggctagattgggcccaaatagcctgttttaacattcccaaagatccaaacaattccttcttctttcttccgaacaattcaatgtagatccgagcgaatctcctaaattactaaaatgcacaattgtgctcagcttaccaaaaaggcccaaaagaccaaaacatattctgattttttctctttagatacaataaaagtaatttatatagattagaggcccaataaggttcacgtaggcccaaacatattaaaagtaactcagaagagatccatcaaaattttgattcacacatctgtttaggaattaaaaatattatttgatcggttattcattccttttcatgaaatcatgcaaaaaatcaaaaatcatttttttctctagaaactacgtggcgagaaagcagagcaccagttgtcttcttgctctgattatctcgttgaaaccgctttcaaagcagagcaaaagagacgacaccggagcctccactgctttacttttcctttaaactgtgactgctttcatttatataataaaatacatacactctcagagtcacatgtactctcctctaacataaacacgtcacttgtagcgaaaacagtatcaagaaaaagagaagatcaaacacgtcttcttttctctctctctctttgtcgcctaaaattccagaatcactctgctttttacccttttaatcaatgatttttccttttagtagcaatcgttggtgattcgaaaaaccaaacttttctcggactaggattctagggttttagtgatcatctgaatattcatg

SEQ ID NO: 23393 - DNA, 3003 bp, Unknown; identical to SEQ ID NO: 23392
  misc_feature (1)..( 3003): 2750-1469P.txt file - cDNA_ID_2139439; gDNA_ID_2926183; Annot_ID_200399

SEQ ID NO: 23394 - DNA, 3000 bp, Unknown; identical to SEQ ID NO: 21185
  misc_feature (1)..( 3000): 2750-1469P.txt file - cDNA_ID_2139458; gDNA_ID_1621182; Annot_ID_174320

SEQ ID NO: 23395 - DNA, 3003 bp, Unknown; identical to SEQ ID NO: 17583
  misc_feature (1)..( 3003): 2750-1469P.txt file - cDNA_ID_2139462; gDNA_ID_1621182; Annot_ID_174321

SEQ ID NO: 23396 - DNA, 3000 bp, Unknown; identical to SEQ ID NO: 6258
  misc_feature (1)..( 3000): 2750-1469P.txt file - cDNA_ID_2139462; gDNA_ID_1621085; Annot_ID_170512

SEQ ID NO: 23397 - DNA, 3003 bp, Unknown
  misc_feature (1)..( 3003): 2750-1469P.txt file - cDNA_ID_2139509; gDNA_ID_2926131; Annot_ID_196950
ggtggggttagtcggcctagctgttatttccggtgggatctttatccgtactacagagcttttgacaatgttgtaagagttcctgctcctcctcctcaagcttcttctactattatcgattacgggagagacgagaaaagttttcaaggaagcaacatagcaattattgtggtcccttcagtcatcaatctcatcatatttgtggttctaatattctcttggaagagaaagcagtcacacaccataatcaatggtaaagtcttttaaaataagcaacatatatattccttatcttactaagagtttggttttaaacttgacatgttttatttgatgacgtgcagatgtttttgattcaaataatggtcaatctatgttacgttttgatcttcgaatgattgtaactgcaaccaataacttctctcttgaaaataagcttggccaaggtggatttggatctgtctacaaggtaaagaaactagtaagaagagtcctaacaaaatcttaagatgggtcagtgatctttaattatagcatgagaattcgttttcagggaatattaccaagcgggcaagagatagcggtaaagagattaagaaaaggttcaggacaaggaggtatggagttcaagaacgaggtcttactcttgacaagactccaacataggaatctggttaagcttcttgggttttgtaatgaaaaagatgaagagattcttgtctacgagtttgtccccaattcaagccttgaccacttcatattcggtgagccttcgcgagacgagactttgcatctttgcatgttacactacttttagaaaacaagaaaaaaaaactgtttctttgagatgtgcagatgaagaaaaacgccgagttctgacatgggatgtgaggtatacaatcatagaaggagttgcaagagggcttctttatctccatgaagattctcagttgaggattatacacagagatttgaaggcaagcaatatccttttagacgcggagatgaaccctaaggttgcagattttgggatggcaaggctgttcgatatggacgagactcgaggacagacaagcagagtagttggaacatagtaagtaagctctgtttttatttttaaagattctttgatcagcatcactattaatatgatttggttaatgcagtggatatatggctccagaatacgcgacatacggacaattctcgacaaaatctgatgtttatagctttggtgtcatgcttctagagatgataagtggtaaaagcaacaaaaagttggaaaaagaagaagaggaagaagaagaagagcttccagcttttgtaagcttatcacttatgtcgatcatctttactcttcttcttcatcttcttatcgaaattttaaaaattatttgcaggtgtggaagaggtggattgaaggaagatttgcagagatcattgatcctttggctgctccgagtaacaatatctcaataaacgaagtaatgaagctcattcacataggtttgttgtgtgttcaagaggatatttccaaaagacctagcattaattcaatcctcttttggcttgagagacacgctactatcacaatgcctgtgcccacgcctgttgcttatcttacgcgaccatcgttatcacttggtcattaatgaaccgtcaatcatgtatgttttatacctatttgtctctctctgtacaatgaatgacaaatgttgagaaaagagatgccgtgtaatgtaagcaaacttatgtttgatttgtgctaaacttatttatattaaatgaatatttgatatagccagcgttttggataatgttggaaattggactgaaacggaggaacgcatagatgaaattaaagtccaatttctatgaaagttcacacgagcagaaacaaaaactttgatctaatgtaagaggaaatgcgtgcggtaggggttgcgtagtcataaagaaaggacattgaacaaaggcacatttttaaacttatatgtaagagcatcatgggctcttaaccatatttagaatttaaatattgcacaatcaaaatacccctcatgagtttttatttttgacaactccaatggtagaagttctaatgaggctcttaaaatttaaatttttgaaatttatatgtgtttgtgtaacaccccgatttcaggaatatggtggtgcatacggtgaaatttaaaataattgatttgaccatttatattaccaaaatgcatttatcttttcgatcaaagatgttgaaaatgctcaagtaaataacatttgacattatattttacttttttcatgtttacaataaagcttcgttttgtatgatctgaaatataaaattttctctatatttataaccaatttactatagactaaatatttttaaattacaaataccgaatgactaatccataaaactgtgatggacaccatatataaagctatattggacgattgtgggtgttgttcattaaattgatgatttccactatgtcaaacctttcctccaaatttaagaatgacaaactatccaaaattattttcaaagatttttgaaagactcactacgagtttctcagaaattaacaattgttacaattttcacttcttttttcttcctgaattgtcacattctttatacagtatatgagtatgactcgtagaccaagcaaaggaagacttttttggtcatgcatgcgaccaaaaacaagtacttacataaccatattgaaaggacaatattttcaatacttctagagaagaaaaaaacccttagttcatacgaagtgattaagaaatgtttaccctttctctacggctatttgaatttgaatggccatctttgaagtcaaccattactcaaattttttcatgtgtactcaaccaaaacccattctctctcatgtcacctaattatacacatatataaacatttattacctcattaacaaaaaaaaaaacaatgaacaaaaccctaaactccattgcttaacaatg

SEQ ID NO: 23398 - DNA, 2463 bp, Unknown; identical to SEQ ID NO: 6122
  misc_feature (1)..( 2463): 2750-1469P.txt file - cDNA_ID_2139509; gDNA_ID_1620846; Annot_ID_170196

SEQ ID NO: 23399 - DNA, 3003 bp, Unknown; identical to SEQ ID NO: 23397
  misc_feature (1)..( 3003): 2750-1469P.txt file - cDNA_ID_2139509; gDNA_ID_1620847; Annot_ID_170247

SEQ ID NO: 23400 - DNA, 3003 bp, Unknown
  misc_feature (1)..( 3003): 2750-1469P.txt file - cDNA_ID_2139551; gDNA_ID_1620846; Annot_ID_170213
tcatctcccgcatcatttttatttctgtcaaaggattggaggtgcataattatgaataaacggatataaacttcactatgcattatgttgaaaatctaaatattccttatgcaaagttacacgacaaacatatttattaaaatttaatttaaaatgtaagatagttattttacctttactagattcttctttctttttgttcctatacatctattgaaagtaaaaaaataaaaaataattcagtacttgccatcttagatagtatatgttttgtagataagttttatacactatataattataaagacctggagatgacttttgacatgtgatattgtgaggtctctcacacccataagactcaaaattctcttaggagttgcacctgcaaatttaaggagaacaataatatcgactatagtgaattaatctaaaaaaggatataaagagaacattaatcatggaaaggtcttaaaaggaaaaaaaagattgttgatttcaatgacaatttttttttctttgaatttatttcagaagaatcgtcttgttatagttttgcgatatggaaagaaaaccgcttactctcttcgccaccgagtttttcaataacttgaataaaacggatatcaagatcgtcggtccagtgcattcgcggattgtctgacctaatgtaagatctaaccatcggatcttgcattttttttatctctcgtaaaatttttagtttgataatattgagagtgtgcaccaattatttatagaaaaattatatggaaaagaatattaatatttatttcccaaaaataacctaagaaacaaatatttagagctagtaaatgttattgttgtcacgtgtaatttatcatttaaatatttctgtaaaaaggatatataaaatcgcattttaagaaatatttattttcttgacagctccatgtgttcttttctctaataataatatttataataaattttaaaataaaaagttaatactactagatttgtttcaattttattctaagaataattctatctatgcttgatatttatataaataaacaaagaacaatccaaaactaatttatggcataaagccttaatgcttattattatcattttgaaccaaatgatataaataacttaaaaacatcccaaacaaatatgaattatatatgtcattatattaatataaattagttgtagacgatagaaataatatattcttattagattaaaaaattctgaaatttagtttttataaatgattatgctatataagtagttttcatttattttttttctgatttctcaagtaattactcgatacaagttagtataaacgcagtcgatccagaaggaccaaagatactctaaggatttccaagactcatttttagctagcgcgaaaaggttgtttgtttggattttcagattgtaaataaaaattgcaaataatttaaagatcaacttatgaattaaagacattgtgctatagggtatttcagatatcaatgaataatgaaaacattagacaaggaattcaaccatgaagcatcgggcttgaacatgaacacaaatttagactaagtctctcttaagacattaatcattatatttaactatgcaactactaaactcttgtttttaattttctagtcaaatccgtattagaattaggttcattcggttcacaatgcattctaacataaactctcattggttagaaatacattgctcaatttacatttgttcagacagtctatcaaacatttttgatgcatagaaaaatctagaatctaaaacagagtgttcgatctttttctagcattaagaacaagtgaatcaaagaacttaaggattaaaaactcaagaaaacaatcaaaccatcaattcattgaatctcctacttagaaccctaaaacccaactaaaggactatttactcatagcaaaaggaataacacaaagagatgaagaagacataatagattactaaacaataaaagaaaagggattagaaatattttccaaagtatcaaagaggatgaatctctagaatcccaataggggaataaaaaattaggtctcaaaaaccctgctctataaaatgaaaaataaaactgcttaaggaagaccgaaactgggcatcaggtagttgcctgatgagatttgcgtgatgtcattccccaaaagatttttaggcaagaaaacgaaactgggcacaagtagttgcatgataaaatttgcatgatgtcattttccaacagagttgtcttgaatcaccaatttttcatttcttctccgaactcttggttttgatacaaaaacgcctccaactccatcattgcttcctaaaacctgtaaagactcaatcaaggactggaagactctaaaaacatactttgactctataaaataatgatttaagaaagaaaacaaagactcaaaaccgataaaaataaaacatatcattttcatcgaaattataagtagttttcatatacagggaaatctttaaaaattaatacttcaatttatagtgattattgatttaaaaaataatacttcaattaatttatagagacggaggttattttaattacttcataaattaataatcactatacaataatacttcataatttataggattttcaaaaatattattatcttatcttctcattgaattatgttaaacattgcaatcttttgctaacatttatgcatcccatgaagggtggcatacattttagcaaaagattgcaatgtgaaggtagttggcatacattttagcaagagattgtaatgtgaaggtagtttgagctcaagtatatatatgtcatgtcattcatgtcttcactagattggactttaatggactcgtttcttaacagaaaaagtagacatacgatgtgtctgcgttacaaacatgtccatgaagacagttttctgatgatgtagacccacaagagcaacattccttataagcccgtgatcgggcatg

SEQ ID NO: 23401 - DNA, 3000 bp, Unknown; identical to SEQ ID NO: 7553
  misc_feature (1)..( 3000): 2750-1469P.txt file - cDNA_ID_2139660; gDNA_ID_1621152; Annot_ID_173288

SEQ ID NO: 23402 - DNA, 3000 bp, Unknown; identical to SEQ ID NO: 5421
  misc_feature (1)..( 3000): 2750-1469P.txt file - cDNA_ID_2139660; gDNA_ID_1620787; Annot_ID_168171

SEQ ID NO: 23403 - DNA, 3003 bp, Unknown; identical to SEQ ID NO: 18535
  misc_feature (1)..( 3003): 2750-1469P.txt file - cDNA_ID_2139674; gDNA_ID_1621152; Annot_ID_173293

SEQ ID NO: 23404 - DNA, 3003 bp, Unknown
  misc_feature (1)..( 3003): 2750-1469P.txt file - cDNA_ID_2139674; gDNA_ID_1620787; Annot_ID_168175
gagccttttaggcagagatgggtactaaggtgcagatgagcacggcttatcatccacagagagatgggcaatctgagaggactattcagacgcttgaggatatgttgcggatgtgtgtcttggattggggaggtcgttgggcggatcactttagtctggtagagtttgcttataacaatagctatcagatgagtattgggatgactccttttgagacgttgtacgggaggccatgcaggacaccgttatgctggacccaagtgggggagaggagcatatatggtgcagattatgttcaagagaccttagagaggatccgggttcttaagctgaacatgaaggaagctcaggatcgaaagcggagttatgctgacaagaggaggagagagcttgagtttgaggttggggacagagtgtatcttaagatggccatgttgcgaggtccgaacagatctatctcagagactaagttgagtcctaggtacatgggtccgttcaggattgttgagagggtgggaccagtggcatacaggttagagttgcttgatgttatgcgtgcgtttcacaaggtctttcatttgtcgatgctgaggaagtgtcttcacaaggatgatgaggtgttggctaagattccagaggatcttcagcccaacatgactttggagacgagaccagtgagggttctcgagaggaggatcaaggaacttcggcggaagaagattcctttgatcaaagtcctgtgggactgcgatggtgtgacagaggagacttgggagccagaggcgaggatgaaggcaaggttcaagacgtggttcgagaagcaggttgctgcatgagtttgcctttccttggtttccagtttcagtgttgttgagtttttgagcttttgagttgttgttcttatttctcttttatttgtattttcgtttggagttgtaacgatcataacagttgatgattaataagatgagtattttttcttggatttgacttgagttgtcttatttaagattgtgttgtgcggtttccaaaaatgaaaagtttcctagaaaggacttgtctatttttggaaagtttgagtaaacaacctaagagatccgtgtgtttacgagatggccgggagttggtcataaggatattctcgagggatatgatggatggtgagacatagaggtgtcttacgcgaatccatgagagagtctggagatatgctcggaagcgtttaatattgttgctcgagggacatgaaggtcccaacgactcgtgaggagcggggtatgctcctgaggtaccggtaactcgagggacatggtgtatttagagaacgaggggtacggtggcttcgggtgacgatccgagagcacgctttagggtgacgacccgagagcgagttttgtggtattattttcgccaagtgtcgtaactcgatgactttgtggctgagagtgagccgacacaactcagggtttgactttgagtggggaagataatatgtgtgatacccgagataccgtagccgaggcctgagagtgacggtttatgctcgaagattgcagtctgagagtggagagtgagttgtgagcaacaatgactagtaaatcgtgagtatattgactggatagagagacctagagggggtctggttgaagggagtgcagactgtagtgatggttgcacggagttcctcggagtggaagggtgaagctagattcgaggacgaatctatgttagtgggggagaattgtaacgcccgtgaactggaaaatcggttagggtttgtttttaaatcatccggtttaattggttatgttaattggaaaccctagagtgtgcctataaaagaaggaaactcgaaattagggctttagttagccacttttcgttttataaaggagaaaaagagagttatttccaagtcctttatagttattctccagtttacagaattggatttggattaaaattggttgagttattcgcagtttcgtgagacacgttttctcagacgcgaattaggaccagcggagattgaaactgagatcgtggtctcgtcttttttccgatcggcacgagattttgtgggcatctttgtgacgtctgcagataggattttaccggagcgattgaatagttaacggttagcttatattttagggtttcgtttttgagactgcttgtttctggtttttcctgtccagtttgcttcaaggttgcttttggttgtggacttgttgtaggacgtttctgaactgtttcagacgcaaggagagtctctcctgggtttaattggtattagaatcaatttgttaaggtgagtgcgtgaccatgaatttatctgagcgattgagttgtgtgatgatatataggtgtggtgaatatgttttgggtgaattgttcaatgactggtttgtttgtattgtattcgtgattatatttttttatttgcttttgtgtatagctcgtagatgggagaatcgcctcactaagtatttatgataatacttaagcatcttattgtgttgttgatgcagtaaaaataaagtgtgattgtggaatcatggcaaggaagagaggatgatgtaggaactcgtttgttttatgttttgtgtttttggttattggaacccggttaggattgtctgttatttttggttttgttgatcgaattatttatttatttataaaatagtatttctgatttgcggtttaattattatgttattggttgatttaattaaatatttaattatatatatatatatatatttttttttttaaatgggtctggttgtttcacaaagatatctgagtcatatttggggaatgctgacattaatactttcgataacaaaaagaaaatacactcattaaacagaacaaacctcagaaacagaatttaattaaaaacccacaaaatgaatctaagatagtttgctttacaattcaaaaacccgtctctgtgattcaaaatccctaaatccagagatcgaactctcgatcatg

SEQ ID NO: 23405 - DNA, 3003 bp, Unknown; identical to SEQ ID NO: 18533
  misc_feature (1)..( 3003): 2750-1469P.txt file - cDNA_ID_2139702; gDNA_ID_1621152; Annot_ID_173302

SEQ ID NO: 23406 - DNA, 3000 bp, Unknown; identical to SEQ ID NO: 7562
  misc_feature (1)..( 3000): 2750-1469P.txt file - cDNA_ID_2139712; gDNA_ID_1621152; Annot_ID_173307

SEQ ID NO: 23407 - DNA, 3000 bp, Unknown; identical to SEQ ID NO: 7564
  misc_feature (1)..( 3000): 2750-1469P.txt file - cDNA_ID_2139718; gDNA_ID_1621152; Annot_ID_173310

SEQ ID NO: 23408 - DNA, 3003 bp, Unknown
  misc_feature (1)..( 3003): 2750-1469P.txt file - cDNA_ID_2139824; gDNA_ID_1621178; Annot_ID_174210
gtctttgaatttttttccaataaacaaagaatcagcatcacttagaccagttgaaaacgcagaactagaatactgttgatcaaaaatactagatgtttcagatacacacgcctgaataatcctagaggttaacctcggctgccaaaataaaaagcttaccttaaacatcaatctatctttaataatgattttacaaggatttttaaaaggggtttaaaaacgttaataatgattttacaagattttttaaaaggattagtacctgagtagtagatgtagaatgagaagcaaaatgatttgaagtcgtctaagcctgtaataaacacaatcactgacttaataatgattttacaaggatttttaaaaggggtttaaaaacgttaataatgaatttacaaggatttttaaaaggggtttaaaaacgttaataatgattttacaaggatttttaaaacgattagtacatgagcagtagggagagaatgagaaacaaaaggatttgaagtagtctcagcctgtaataagcacaatcactgacttaataatgattttacaaggatttttaaaattataacacaagaaggttattgaaaaatctgctcaactgtcacagaaatttgctctacagtcaaacataactgaagcaatcctccactctgtgagaatttgtgcataaaagttgcaagctgtctatcgtttctaatataaagaggatgagattgtatggttgtagatgtggagactaacttgtaactaagcttcaaagaattggttgaactatctatttgaaaatcctctacaagaatatccaccaacgcgtgataggtaatgtgctcatcaatgaccattaaagaagctcccaattcaatgtctaattcaaattcccaagtcatattgtttgtcaacttccacaagccacaaacaggatacaattctagcattataacctgataagataaataacaacaatatcaacacccataaaaacactgtcactacagagagaagcatggtttacaaatcgttttaaagcgtaagtaagtagcatagaataatttacaagggattttaaaagctttgaaaagtggttaacatggtttacaaatcgttttaaagcgtaagtaagtagcatagaatcatttacaagggattttaaaagctttgaaaagtggttaacatggtttacaaatcgttttaaagcgtaagtaagtagcataaaataatttacaagggatttaaaaagctttgaaaagtggttaacatggtttacaaatcgttttaaagcgtaagtggcatagatctatcacgaaagcatatgtaaaagaggtaaacactaaatcagaaccaaaatctattacgaaatagtataacgaattcacataagcaaatctatcacgaaacagtataacgaattcaaaaggtattaacgaatttacaaggattttataaacaaattcaatcatcaaatctcaaacaaaattcaaattcgaagctgaagcaaatgtcaaactgtcgattgaatcaggattcaaataacgaattcacataatcaacaacaaaaatcgaataaatcaattcgaaatcgaagatttaagctaacattataaaatcaaaccggggaaacgcaagagattcgacggcgacacacagctctacttccgacggcgaagatgggttttcacggcgagtaaactcactatttccgacggcatgggattcaacggcattcacaatttccgatggaggaagaagagagagagtgaagaaatgaattaggtctgtgggtagctcattaaaggtaatttggagagaaaagtattagaaagggtagaaatgaaaatgggaaaaagggtagagttgcaaaagggcattgagaaaagggcattacagtgaattattcttaaaaataagtatataactgtttgtttagcaagctaacatatataataacgtggtaaatttacatattatatgttaaataaatgtttatctacttaaaattatgaataaatatttttatttatatatatatcaacaaaataaaatacatcatgttacataattaacatgataacgattataacaacattttacatagaataataacatgctaacatactaaatatcgaaataatatttgtctcaacacggtaagataatcgatatatgaataataacatggtaacatactaaaaatcaaaataatatttgtcttaacacggtaagataatcgatatatggataatatttatttgaacgtactaatgttttagttaaggtactaatgtttcatccaactttttatttttagtttaattaatttaggggtataagtgtcataaaattaaaacagtagaagacaacaatgttttttttttgtcagttaattatcagttcttctgggtatagataatcatattacccaaaactataacattagttacttttattccaaatatatatgaattactaaataagtctagtatatttggatttataattttaagggtttgttacactatgaggcactttcggagaaacttaattcactttagacactttaaaaactagaggcactttgccttgcttttggagtgaaataagacatatatacccccactaattcgtttgagatatttctacaaaccggtttatggtttcgtttggtattggtctaaaatatacggttattatggtcggtttagaaaaaacagtttgggcgtgacgacgatcgtcggatttcagtaaattaaacggccgagattaatcattgtaacttcccttgcttttcgactttattcaaactgaaacacgagatccattgaaacacataagattctgggtttcaatcatcgatctttggccaactgtcgtgtccaaggaggtacgattgtagaaaactgatatcatgatattaaaacgaaatttcgtgcattctatttgttacgggaatcagaatataaccaaatttatttttttcgtttatctgtacagggatcgatg

SEQ ID NO: 23409 - DNA, 3003 bp, Unknown
  misc_feature (1)..( 3003): 2750-1469P.txt file - cDNA_ID_2139877; gDNA_ID_2926129; Annot_ID_196829
cagtgaaacaatttgatgggagagaaaaaagaagaacaaaaaatcaaataattatattttagcactaatttctcatgccggtaaaccttaaagtaatcaaagtaatcaatcttggtatataaatgtttgtgccatacataatcaaagttatcaatcttgtaccccaatttatggttgtaaaaactcttataacatgctaaaatcttatcatacagaactaaaagctcctaacattaggagattgaagcaaatgaataattgaagagagaatcagaaaatgtaaagtgtggaaagacgagagagattctacgagcaccacatattcgtattattattctaccatcgtttcaagacatgaaagaaagcaaaaaaacaaaagagaaaaaaacaaaaaaaatcagacaatatattggaggaccctagaaaacaatataccaccaaaacaacgactcttgaaataaggtttatataaaataagttactaactcaaactcaggagatcatgatatttatataaaataaagttttgaaagttacttaagatacggttttgaaaattactcactaacaagatcataatatgtgacaagtctaacaataagatgtttatatgtgtcattaaagacttaatatttttattctcttaaaaaaatagaaaacctaaaaaactaaacaaatttacatatactaatttttatgtctatatacatatatataattatttttattaatcaaaaagaaaattaacgaatttgattttacatgtgttattggtcaattaaataaatctaacatctactctattatttgagacgtacgttaagtgattctcggttaaaaaaatttttacctttaaatcatatgtttaaaatgttaatgtcatgaaaaagtttaccttttactaagaatcacttaagttacgttataatcttggccattcgattgaattgtttgtgaccgtccgatctctcgccttcacttaaaaaacacgtggatccttatgacccgggtttacaattattgggtcatacgttataatcttggccattcgattgaattaattgtagccattaatgttttttgaataaattctatagcaagatttttggagagagaatttttatttatttccaattaatatattcccttattcaatactattcataattacgtgggtttaaaattggaaaactaattatactcatatatcaacaatatttattatattctaagagatcattaatccaatcaatatttataaaacatttcataatcaaagctgctttatttatagatataacattataaatatcgaattaatatgtttgaattcgaaattgggttaaatattctaaatttatttaaataactggaaaaataattttaactaaacttttttttatgtttgataattaaaatagaaaaaatatttttaaacatttaaaaataaaattaattacatttttggtttatattaatttttgttaattaaattaatcgaattcctttttcagcaactgaatcatattaatttaaaatatccaatgcgtatattcctttcttaaatttgaatatatcacttctccataattataggtaatcaaatatttagttggatattcatttttgaattaacataaagtttccgaacaatttccataattaaataactacttataagataattgctaaacattctcctataattatgggattcatcataatcattaaacttgacttccacgatttaatattttatgcatattttaaacctaaaaatttatatcttataaatattgtacgtcccatttcaagaacttactcagcagttcctatcttcttttactctctcgtttcttttttattctagcagaagaaaacgagaccatgaagaaattaaaactgaggttgtggatcgacgagaccatggagaaaacaatatatcgaggtatcctctcacactctctgtttttctctatttttttcatgtttttctcacatctgttttttaaaatatttatgcaggtaatgtgggagattaaaatgtagacgcacacatgattttgttaaagtatgtcttgctttctaattatttatcttttatgcaaagtaatatgttaagctttttttacctctctatatatttataagatgagtaattctgattgaattttttttattgggattacggtctttttcctgttaatttgcagaaacatgatgatgatttataatttgactactatcttccaatgaacaacaaaattataaggtatgcaataattttcttaaatctgatcgatagattctctttcactaatatattgagattgtgtaaatatttttgactgtagtttagattttaatatattggtattgttaattaaattaattgaattttaatataagtttaattttgataaaatttatttttgtcttattaatttgtcaaatttgataattaatatatgtattaataaaatacactaaaccccaacacaccatgtatataagtacatatactaaatatacaattatatattcaaagggatacatcaattttgtaatacattcaatagtatccatgtttaaatatgagaatatttaatgaaaacaccaaaaattaggagaataggagaatagggcttagagagattaggagaatagggcttagagagattgattatttgatgaaatgttaatataaaatttgaatgttttatttttaaattttaagtcatttaatgtgaatttggtattatgtaaaactaatttatgagctgactatagtaaaaaaaaaaaaatgtgttcgccctaattattctctcccaagcacggaaaccaaggagccgcttcccttagaaatatgagcttctttctccgacgttcctcttctggtatcttccttgtctgatcggtgctagctgctaaggcgagatctctcaggcggacctcttttttggcggcgttgctgtttttcggtgagactttccacatgagatg

SEQ ID NO: 23410 - DNA, 3000 bp, Unknown; identical to SEQ ID NO: 7977
  misc_feature (1)..( 3000): 2750-1469P.txt file - cDNA_ID_2139877; gDNA_ID_1621178; Annot_ID_174225

SEQ ID NO: 23411 - DNA, 3003 bp, Unknown; identical to SEQ ID NO: 17627
  misc_feature (1)..( 3003): 2750-1469P.txt file - cDNA_ID_2140070; gDNA_ID_1621193; Annot_ID_174625

SEQ ID NO: 23412 - DNA, 3003 bp, Unknown; identical to SEQ ID NO: 17625
  misc_feature (1)..( 3003): 2750-1469P.txt file - cDNA_ID_2140103; gDNA_ID_1621193; Annot_ID_174642

SEQ ID NO: 23413 - DNA, 3000 bp, Unknown; identical to SEQ ID NO: 8098
  misc_feature (1)..( 3000): 2750-1469P.txt file - cDNA_ID_2140111; gDNA_ID_1621193; Annot_ID_174645

SEQ ID NO: 23414 - DNA, 2393 bp, Unknown; identical to SEQ ID NO: 8091
  misc_feature (1)..( 2393): 2750-1469P.txt file - cDNA_ID_2140236; gDNA_ID_1621193; Annot_ID_57503

SEQ ID NO: 23415 - DNA, 2393 bp, Unknown; identical to SEQ ID NO: 8091
  misc_feature (1)..( 2393): 2750-1469P.txt file - cDNA_ID_2140236; gDNA_ID_1621193; Annot_ID_174622

SEQ ID NO: 23416 - DNA, 3003 bp, Unknown
  misc_feature (1)..( 3003): 2750-1469P.txt file - cDNA_ID_2140446; gDNA_ID_1620778; Annot_ID_167829
actttgcatcatcatcatcatcatcatcaaaaaaaacttttcatcatcaattactaaacaaactatatggaaacaacttaatctcaatagcagcataaaaagggtaacaagttgttccaaattcaagtcaaacgaatgaaatgcgtaaagtattacgcatcattaggttcaatttgctaaatgtgagttcaagttcttagctttctctacttcttagatttcatatatcaaaattcaaacaacattgcgtcatcatcatcaacaaacaacttttaatcatcaattactaaacaagtatacataggaaacaacttaaatgaccaaaatagagttcaagtccttagctttttctacttgttagattccacatatcaaaattcaaacaacattgcatcaagaaacaactttttttcaatcattgattactaaataagtgttgatgaaaacagattggattgaaaaatgaaacctttacgagtgtggaaaccaggaggtttacagttttttcccttgtaaaagtctctgggagctcgtttgggagagagaatatcaagcgaagaagctctctttcttcggaatgttcttccaatcccgaataacaaccctaatgtcatcttccaaaatctatcaaatctggtaaacaaaatatgttgtagaatcgataaaaatggaaactttcgaatgtatcaaatgttgaagaagaaatgtcagagatttgtagaagaaaggtcagagaaagggtttaggggttcttttaggtgaaaaggcccaaaactaaataaagcccattttcatacattcacttatttgtttataattctccaaattacctttaaggggatgtattcaaattagaatttaaagtgatttgagttttcttgagttttaaatgatttaattgatcttagggaagtttatatgatttttgtaaaatccattcaaatctcactttaaaccatgggatttggatttctgtatttttaactaaagaaatcctctcaaattctccaaaataattaaaattcaaatccacaaattgttttcaataacagtaaattttcaggtggattttgaaatcattagttcaataacactgaatttcatgagttttttaaaattcatgtttgaataacatatgatttataaattctacaaaagtctcttaaaatttcacttgcaatacacctcagattttacgatcacttgtgatttcagatatgctttagaaatgtgaattctagtatgcttagacttgctcaaatatgcttagatctgcttaggttttacttgttgtgaacttgtaaattatactttagtttcatcggaattgttgtgtactcgtaaatttaattttaaattatgttttaaaaatgtgaactctaatattttctcatgttgattttatatatgcttagatctgcttagactcgagtagtatataccaaattgtgatttgcttagacttgcttaatttataaattgtgatttcactcctacaatattttttttttgtcggtacaaagaaggtagttgaacaaacttgttctcaaaacaaaagtagtttccagaaaggctagtatagtttcagaaagacttatgctcaaaacataagtcaagtactattacaaacgtctagtttccgatacgaactaactctgtgagaatctctgcagttgatggcataagaagagggtctacagaggtcatcaaaattcctttgacagcgtacaccttttgatccattttgaacacacattggaccactttgccataccctccacgacctaggctaccttcctctataaaatcgtcatgataccttgaaggcggtggacgaatagactttgttgaagcgagtccaaccatccaagataaaagggattaggctttgccgactcgaacctgaacacaaaaatactcgaatattttaatcgaaaatctaaattttacccgaaccccaaaattttacgcgaaaattcgggtatcgcttctaaaatagggcctaaaaatctatatccgaaccgacctaaacctgattagacccgaaccgaaatcgaaccgatattttaaatttatccttttagatcctaaacttttttacccaaaggacctgtacccgatcgagttttatctgaacccgacccgcttactcgaatgtccacctctacgagtgagacatgaaaccctctcttccactccgagtctttcctctcaattgaatccgagataaaccggtttaatctccaaaccaatcccatattcttgtaccaaatgttggtttgcttcttcgtacaagaagatattttccgggaaaatgacaaacagagaaaatctccagaaaacaatgaaagctatacacaaaaactcgcgcttccgttcacgtggcaatcacttccaatgaacgattctccttcgtttctcccaaagtcccatcacaatcaaaaaccttctctccgagaatctcactcactacaaagagtaagattcgattcaaaaacaaactccgatcgttgaagcaacgaagatatgcttacttcaccttcttcttcttctacatatgatccattctcttccaatttctctccgtcgctcactaatgccttctctagtagcttcaccattcccatggggttagtcaatttcactctatcttcctcttcgaaatttgagttctgattctgaatttgtttggtattcgtagattgaaattgagtaggagagtcaccagagctcggatcttctctcgtaaggcacgtcttcttcgtaatccctaatctcgttcatgttcttaagtttacattccaaaaaccgaattagacgatcttcattgtttcatcgtaggtagattaaggatcgttcaacacttaaggtcacttgtcgtcgcgcacacgaacgtgtggttgaggtaaatctcttggtttagttttttgctctttagcggattttgaattgtgtgataagtgcttcttctgtgtaattttctaggaagaagcatctacaatg

SEQ ID NO: 23417 - DNA, 3003 bp, Unknown
  misc_feature (1)..( 3003): 2750-1469P.txt file - cDNA_ID_2140457; gDNA_ID_2926146; Annot_ID_197731
gttgtaaatgggtgtttcgtctaaaatacaaatctgacggcacacttgaacgacacaaagcacgtttggttgttcttggtaacaatcaaaccgaaggtcttgattacacagaaacttttgctccggttgcgaaaatggtcacagtccgcgcttttcttcagcaagttgtttcacttgactgggaggttcatcaaatggatgttcacaacgcgtttctccatggtgatcttgacgaagaggtatacatgcaatttcctccgagatttcgtactggtgacaagacaaaagtatgtcgtttacgcaaatctttgtatggtctcaaacaagctcctcgttgttggttcgcaaagctcacatcggcattgaagaactacggttttattcaagatatttcagattactctttgtttatctttcacaaaaacggagttcgacttcatgttttagtatacgtggacgatttgatcatcacgggtactactattgctgtgattacagagtttaaacattacttaagctcttgtttctatatgaaggatcttggaattttgcggtacttcttgggaattgaggttgctcggagtcctgaaggtatctacttatgccaacgaaagtacgcacttgacattatcacagaaacgggtctccttggtgttaaaccggcttcttttccattggaacaaaatcataagcttgcttttgccactggtgaaacaatagacgacccacttcgataccgtcgtctagttgggcgcattatttatcttgcgactacgaggcctgaattatcatatgttattcatattctctcacagttcatgcataatcctaaaccggctcattgggaagctgctcttcgcgtcgtcagatatctaaagtctagtcctggtcaaggtattctcctacgtgctaatacacctttggttctctctgcctggtgcgattcagactttggagcatgtcctcattcagatcgatctctcaccggttggtttattcagttgggtggctctcctttatcttggaagacacagaaacaaaatgttatttcccgctcttctgccaaagctgaatacagggctatggcagaaacagtgagtgaaatcatatggatccgtgaattacttcccgctctcggtattccgtgtactgctcctaccacactccattcagatagtttatcagccataagtcttgctgctaatcctgtctatcatgctcgcactaaacatgtgcgtcgagacgtccatttcattcgcgatgagctcgtcaatggcactatcgctactaagcacgtctcaaccacttctcagctagcggacattctcactaaagccttaggacgaaaagagtttgcagactttcttgccaagcttggtatctgcaatctccatataccagcttgaggaggggtgttgggctgtgtggccttagcccatttatattgtataaattaactaggtctaaacttatcgtgtatataaaggcattgcctcttgccgtaatcaataagaatcttcttttcacaacctcgattgattcttgacaatatatataactaggaggaggcgtaaaaggagaaaacaggtaattttttgctcttgtacctttgatatttttactgaaagtgaagcttatggtgattacacttgtggtctacaggagcagaacattgagagtgggtcgagtattggaaacgcttcaagatgttcttggaaccatatgggacttcttgcattgtgatgcctaataaagaaccatatgatgatgttgttcgtattgttgggtttctcttttactttctgttgtctcttttgtagaataaataatgttttgggtaatgaatgatttaacttgcttgtgaccaaaaaaataaaataaaaatgttgttttgttacgagtcatttcgattgcagatacaatgtaacagtcttcacacattgaacaaaacaaaacctaagttaaacaaataactgtttctttaagtctttaaccatgaatctggcctttattagtaaatagtaatagtggttattgtaacatgagcaacatacgtcatactagccaaccaatgtctctcttcttaaactcatcgaactaaagagaggtcaaatcctcatacttactcggcctcgatgtgaattcacgttataataagaaacaaggaaaacacaaactaatcattttcttagtcctaggtgttcggttttaaaatttagtatcattcaagtattttgaaatcttcattttggtttggatccggttcttttgtttttaaaatttagtatcaatttggttatttttccttggatattttgattatttttgattattttcggatatttttttgttatttttgagtattttactttttctatttttattttaaaatttttgattttttgatcaataaataattaatattttgggtatttttggttaccaaaaatatttcagttcggtaccaattataatttttttttgttatataataatatagtatacatccaattatttttaaatttttgattttgttcgattctttttgcttcggttccaattcagtagcttcgattcagtttaattgcctagacctacattttctattagaactgacacaaaaacaaaattggcgtcgcttataaggtctacaatatatggttggcctctggcccaatagtaagcccatatattaaccgacgtcggtttatagccccgataaacacaaacaatatagataagatagtttcttctacttcaaaaaatggatgctttcagaaatttccagaaattacgggtccaattgagaaaaacgcgtatcgtcgtcttcttcatcaaaagcgaacaatttcgaaaacaaacctaacgaacaaaaatcaaatcttctctctgttaaaatctcaccgactagagaaaagctttgttttttccaattaaagttacattttttgtttgaacaaatcactttctgtgatctacatttgtgtggtcgtgaaatcaatg

SEQ ID NO: 23418 - DNA, 3003 bp, Unknown; identical to SEQ ID NO: 23417
  misc_feature (1)..( 3003): 2750-1469P.txt file - cDNA_ID_2140457; gDNA_ID_2926146; Annot_ID_139097

SEQ ID NO: 23419 - DNA, 3003 bp, Unknown; identical to SEQ ID NO: 23417
  misc_feature (1)..( 3003): 2750-1469P.txt file - cDNA_ID_2140457; gDNA_ID_1620778; Annot_ID_167843

SEQ ID NO: 23420 - DNA, 3003 bp, Unknown
  misc_feature (1)..( 3003): 2750-1469P.txt file - cDNA_ID_2140539; gDNA_ID_1620687; Annot_ID_164664
tagactcgaggacaatagtccgtgacagtctctctggtctcaccgagctttacagatgtttaagtgaagatctcttcaagtcttcttctgaaactcaacaagcccttcttaatggtgatggtttgatggaagagcttcttgaagtatcactgaaatacttagaggtttgtggaggagctaaggacgcagcttcgaggatcaagaagattgttgtcgagcttcagtctgctttgagaaggagcaagaaaggaggtgagtttagcctcgagagtgacgtggatgcttatgtggcgtctaggaaagagatcaagcaggagatcaagaagtatatggtaatgtcgaaagagacagatgcgtctttggagagtgtttggtgtgatggcgatgatcaagagatgagtgctttagttagagtgatgcaagagacgagtgtaatgacttgtttcgtcttacgctcggtcttctcgttcttgtcgtcgcctaaagggttaaagactaagaatcatcatcaccacaaaggttgggggattgttatgaagcttgtgaagaaaggaatagaacatcatcaccaggagaaaagagattacgagacgggattttcttgtctcgtgcttgaagctatggaatctgagcttgggaagctcgttgtgatgatgacaagggaagatcaagaagaagagaaaaagattagtgaagaagtatctgagagggttcaatgtgcattggttagatccgaaggtgtagaggcagccatggaagagcttgaagagggacttgaaggattgttcaaggtaatgatacaagctagagtctctcttcttaacatcctctccacttaaaatggatcagattcgaatttcttggtctggattggaaataagttagttgctacttgaccagtcgattggttttaaaatcttggtttggtttttgtttgtttgttcttgtatgttgtgagagagagtttaaacatgcgtccatgttttagaggatgtgtgtttgttgtaagtgtgtaacccgttcaggtgtgaaaaactcttgtaaagttttatgtacgtaagcatctttattgcacaaataaaagaggtgtcttttaacaatattttaaaaaatttaaacaacaaaatattaatagttaaatatgaaaggtctttaattttaagacatctttttcaaaaatgtttccacaaagacacttaagacacagtgtctaaaatttaaggacacacaaacattataatgttatatacttttatatatattaattttattcgtgggaagaccctctctaatgatgtgggatggagatgacctaaatatctattattttaccacgtagaacgataaatttaaggagagaaagacgaaatgcaaaagcactaactttaatgtttagaataggataaattactgaatagtattattttttcgtaagaaaagcaatttagctatatagcatagcgttgaagtaaataattaatcaaatgtcacaattttctcaaaatgaaaaaccaaaaagaaatgggctaaaattaaagaggcaaaagtaatcatattaaaatgtcatccaaaaattacataaacaaacaaaatcatccattgatatcgagaatgtcatgaattttgctggtagacttttgacaaacctttcttagaattgataatgacaggaacttttgttaaatgacccaacttaacattttattttcttattttccttagaaaattagtcgataaatctttcactttcttttgaaataatgaaccattaaaaatagaattcagtggctaaaaatgggattgagagtgagcgccacatacggtggcagtacttcgaaagaatttatttgtcttagtttgattcacacaattctcacttaagtaggaaaccatattaaacactagtacttttacaatttagttggaggcgttaggacaaacgcaataacagcctgtaccaaaacataattctttgcattttggcgtacaaaaactaagctcattttgcttaatcgatagtggagcttcatgatgcacagatgcttcactagtggttagagattgaagattaggacaaacgcaataacaacttgtagcaaaacataactctttgcattctggcgtacaaaaaccaactccattttgtttaaccaatattgaagctttaagattcagagaagttttttcagataagagacgtttcgcctcagcaatctgaactgtcacggataccatcactacaagatataaatgtagtaaacattagtaacacaatacaattctttataaccatatcattatactacaaaaacattaattttaccagtaaaagctaaaaggatgatgaaagcagacttggatgaaaattttcccatcgtcgtagaaagattatgtttcttcttgataacttttttagacttactagaaagagttggtgaagaaaacgatgtgatatagacaatgttgtataacgttttttataggacagagaaagtgtactaatttaggaagattaatatcaaattgttgctttgtggtgaaaattaaaatgatatcgataatgagataagataagatcaaatctcctaatatggtcgacaatccaattgacaattgttacctaataagatttctactattaatgagaagatcttcaaattattcgctgtattgataaaagtttttaaaaagttagtttgactcaaaagaagcccattaccaaagcccatctaagcccattatgtaatcaatcaacaagccacggtgttgcttaggatgctgctcgttgggtttttggcaacgtgtgtaagatacaacggctatattttgacatggtccaagtccagctatcataagtcggtgtgttcttgtgggacctctaaaagagcgttactttcctaatttcagcggaccgttacatacacactcgcacacactagccttcgtcttcttctacatctctttcttcttctgtgtcagagacgctgtggtgaaaagaaaatg

SEQ ID NO: 23421 - DNA, 3003 bp, Unknown; identical to SEQ ID NO: 23420
  misc_feature (1)..( 3003): 2750-1469P.txt file - cDNA_ID_2140539; gDNA_ID_2926209; Annot_ID_202504

SEQ ID NO: 23422 - DNA, 2872 bp, Unknown
  misc_feature (1)..( 2872): 2750-1469P.txt file - cDNA_ID_2140539; gDNA_ID_2926210; Annot_ID_202531
gagcttcttgaagtatcactgaaatacttagaggtttgtggaggagctaaggacgcagcttcgaggatcaagaagattgttgtcgagcttcagtctgctttgagaaggagcaagaaaggaggtgagtttagcctcgagagtgacgtggatgcttatgtggcgtctaggaaagagatcaagcaggagatcaagaagtatatggtaatgtcgaaagagacagatgcgtctttggagagtgtttggtgtgatggcgatgatcaagagatgagtgctttagttagagtgatgcaagagacgagtgtaatgacttgtttcgtcttacgctcggtcttctcgttcttgtcgtcgcctaaagggttaaagactaagaatcatcatcaccacaaaggttgggggattgttatgaagcttgtgaagaaaggaatagaacatcatcaccaggagaaaagagattacgagacgggattttcttgtctcgtgcttgaagctatggaatctgagcttgggaagctcgttgtgatgatgacaagggaagatcaagaagaagagaaaaagattagtgaagaagtatctgagagggttcaatgtgcattggttagatccgaaggtgtagaggcagccatggaagagcttgaagagggacttgaaggattgttcaaggtaatgatacaagctagagtctctcttcttaacatcctctccacttaaaatggatcagattcgaatttcttggtctggattggaaataagttagttgctacttgaccagtcgattggttttaaaatcttggtttggtttttgtttgtttgttcttgtatgttgtgagagagagtttaaacatgcgtccatgttttagaggatgtgtgtttgttgtaagtgtgtaacccgttcaggtgtgaaaaactcttgtaaagttttatgtacgtaagcatctttattgcacaaataaaagaggtgtcttttaacaatattttaaaaaatttaaacaacaaaatattaatagttaaatatgaaaggtctttaattttaagacatctttttcaaaaatgtttccacaaagacacttaagacacagtgtctaaaatttaaggacacacaaacattataatgttatatacttttatatatattaattttattcgtgggaagaccctctctaatgatgtgggatggagatgacctaaatatctattattttaccacgtagaacgataaatttaaggagagaaagacgaaatgcaaaagcactaactttaatgtttagaataggataaattactgaatagtattattttttcgtaagaaaagcaatttagctatatagcatagcgttgaagtaaataattaatcaaatgtcacaattttctcaaaatgaaaaaccaaaaagaaatgggctaaaattaaagaggcaaaagtaatcatattaaaatgtcatccaaaaattacataaacaaacaaaatcatccattgatatcgagaatgtcatgaattttgctggtagacttttgacaaacctttcttagaattgataatgacaggaacttttgttaaatgacccaacttaacattttattttcttattttccttagaaaattagtcgataaatctttcactttcttttgaaataatgaaccattaaaaatagaattcagtggctaaaaatgggattgagagtgagcgccacatacggtggcagtacttcgaaagaatttatttgtcttagtttgattcacacaattctcacttaagtaggaaaccatattaaacactagtacttttacaatttagttggaggcgttaggacaaacgcaataacagcctgtaccaaaacataattctttgcattttggcgtacaaaaactaagctcattttgcttaatcgatagtggagcttcatgatgcacagatgcttcactagtggttagagattgaagattaggacaaacgcaataacaacttgtagcaaaacataactctttgcattctggcgtacaaaaaccaactccattttgtttaaccaatattgaagctttaagattcagagaagttttttcagataagagacgtttcgcctcagcaatctgaactgtcacggataccatcactacaagatataaatgtagtaaacattagtaacacaatacaattctttataaccatatcattatactacaaaaacattaattttaccagtaaaagctaaaaggatgatgaaagcagacttggatgaaaattttcccatcgtcgtagaaagattatgtttcttcttgataacttttttagacttactagaaagagttggtgaagaaaacgatgtgatatagacaatgttgtataacgttttttataggacagagaaagtgtactaatttaggaagattaatatcaaattgttgctttgtggtgaaaattaaaatgatatcgataatgagataagataagatcaaatctcctaatatggtcgacaatccaattgacaattgttacctaataagatttctactattaatgagaagatcttcaaattattcgctgtattgataaaagtttttaaaaagttagtttgactcaaaagaagcccattaccaaagcccatctaagcccattatgtaatcaatcaacaagccacggtgttgcttaggatgctgctcgttgggtttttggcaacgtgtgtaagatacaacggctatattttgacatggtccaagtccagctatcataagtcggtgtgttcttgtgggacctctaaaagagcgttactttcctaatttcagcggaccgttacatacacactcgcacacactagccttcgtcttcttctacatctctttcttcttctgtgtcagagacgctgtggtgaaaagaaaatg

SEQ ID NO: 23423 - DNA, 52 bp, Unknown; identical to SEQ ID NO: 4163
  misc_feature (1)..( 52): 2750-1469P.txt file - cDNA_ID_2140554; gDNA_ID_1620687; Annot_ID_164669

SEQ ID NO: 23424 - DNA, 3000 bp, Unknown; identical to SEQ ID NO: 3913
  misc_feature (1)..( 3000): 2750-1469P.txt file - cDNA_ID_2140554; gDNA_ID_1620674; Annot_ID_164187

SEQ ID NO: 23425 - DNA, 3000 bp, Unknown; identical to SEQ ID NO: 19740
  misc_feature (1)..( 3000): 2750-1469P.txt file - cDNA_ID_2140554; gDNA_ID_2926210; Annot_ID_202536

SEQ ID NO: 23426 - DNA, 1265 bp, Unknown; identical to SEQ ID NO: 4783
  misc_feature (1)..( 1265): 2750-1469P.txt file - cDNA_ID_2140779; gDNA_ID_1620732; Annot_ID_166134

SEQ ID NO: 23427 - DNA, 3000 bp, Unknown; identical to SEQ ID NO: 3326
  misc_feature (1)..( 3000): 2750-1469P.txt file - cDNA_ID_2140779; gDNA_ID_1620640; Annot_ID_163015

SEQ ID NO: 23428 - DNA, 3003 bp, Unknown; identical to SEQ ID NO: 20388
  misc_feature (1)..( 3003): 2750-1469P.txt file - cDNA_ID_2140787; gDNA_ID_1620732; Annot_ID_166112

SEQ ID NO: 23429 - DNA, 3003 bp, Unknown; identical to SEQ ID NO: 20388
  misc_feature (1)..( 3003): 2750-1469P.txt file - cDNA_ID_2140787; gDNA_ID_2926177; Annot_ID_199959

SEQ ID NO: 23430 - DNA, 3000 bp, Unknown; identical to SEQ ID NO: 5315
  misc_feature (1)..( 3000): 2750-1469P.txt file - cDNA_ID_2140923; gDNA_ID_1620779; Annot_ID_167853

SEQ ID NO: 23431 - DNA, 3000 bp, Unknown; identical to SEQ ID NO: 5320
  misc_feature (1)..( 3000): 2750-1469P.txt file - cDNA_ID_2140933; gDNA_ID_1620779; Annot_ID_167856

SEQ ID NO: 23432 - DNA, 3000 bp, Unknown; identical to SEQ ID NO: 5321
  misc_feature (1)..( 3000): 2750-1469P.txt file - cDNA_ID_2140937; gDNA_ID_1620779; Annot_ID_167859

SEQ ID NO: 23433 - DNA, 3000 bp, Unknown; identical to SEQ ID NO: 5323
  misc_feature (1)..( 3000): 2750-1469P.txt file - cDNA_ID_2140943; gDNA_ID_1620779; Annot_ID_167861

SEQ ID NO: 23434 - DNA, 2465 bp, Unknown; identical to SEQ ID NO: 1580
  misc_feature (1)..( 2465): 2750-1469P.txt file - cDNA_ID_2141151; gDNA_ID_1620420; Annot_ID_156561

SEQ ID NO: 23435 - DNA, 3003 bp, Unknown
  misc_feature (1)..( 3003): 2750-1469P.txt file - cDNA_ID_2141155; gDNA_ID_1620420; Annot_ID_156562
acagaacacaaatagacaaaaaaaagcactaactgtatatcttgatttagtttttgtgaatctaaagagaaccataccattctacaacacagacagaaaatttcacttaacctaatcactttgaaccatcatctaagttggttaagcttgtttgttattatagttgaaaaatccattcacagtagctagagttgtttttgttagtgatgactataatggtaaactttttctccctcaatctatacgaagagtgagaattctcttattccctccatacacatatatacacaacctttctgtaaactaagtttgggtttgcctttacttattttggcagaggatcggagagatccccgagactgtggagatggagcgtggtgatctctacgttacaagattgtataaagagcaatcgaatctggccaaattgacttttgtgtagtgaatttttatattgtacgagcttcctaatgtcttgatagaaacttttactctgtagatcgtgcattatcgaattttgttgttgttgtcatctgtgtttctattaataatgccattaaaagatataagaaggaactaaataagtttgcgaaaaaaaaaaaatccccacaaactatgctcaaaattgaaagataaataagtatattaatttgaggttttcaatgtatataaatctgattaactcatatgattattcatttaatagatttactagatcataacccgtgctatacagcacgagcattaatattttgtataaattaaattgtatactttgtttgaattacataaaaaatagtatagtataaaagtgatgccataatatttttcaatgttttactatttacatataatgctgcattagattgactttgtttaaaaatgttattgttataataaatacaacatatgtagttttaagtaaatgtgtaaaatttgtatagaagttattttggtaagaaacatgtttcctttgtattagaggatctaatttttggcctaatttagaattagtttttgtatagtattttggttatatttgtggacctaattggggcctatattagattatctttaatagggctgacgaaaaaacggacccgataaccaacccaatactcgaaccaaaaaatcgggttagggcgggttaaaattttaggaaatttccttattgggtagagttttagtaaacccgtggatatccgattggaccggaaattacccgttatctaaaaagagtattcaaaaacccaaacattaatttaatatccaaaatattaattatatgatattattttatttgattttaaatatatagtaaactgcgagttgtatatgttttcttgatattatttatattgtttagtgtttaaaattatacacttgtattttgattgttaattttagagtttcacctgtagtataccatcttatattaatatcgatttaaacccgtcaattctaggattttccagcttgtattaaaaattgaatcacatcatacacataaaaaaatctaatatgttattaattattgttgtatataagattataaattcttaaaataatatgcatgaaattgaatataaatatttaaattatgacccagtacttagtaataaatttttttaaatctatttttgacccgttataatatttttttatgtattgaacagtttatattcgtttttaaaagtttaaattatggcatatgcgaaaaaactctaattatttttttataacgatgatattattttttcgcaaaaatagaatcatataaagatgagaggtgaactataataattaataaaaaattaatatgataatttagatattaaatctaatttgttgattttaattggttaattttttggaaattaataatgtatttcattttttaatgaaatttaattaattaaattagtatttgactttttaatttttaaagagatgaattactttactctttaaattttatttctaatggcatacatatgtaattacttacaaaaagtaaggttacatttaaaatgtacttcccaaataatatagtaggatcatggtaaaatgttagttctcgaaagaaaaaatattgttataaatcataaacctaacgagctaactaaaatagcggcatcctaccaatttgagatttttcgtatatatattaaaattatccatttgataaacacttcatgataaagtattagttttgaaaataaaaatattgttcttgttataagaaaaaacacacacataaaagtattattggaggatctcattgttaagttgttaaccctcaacatttcgtctaaaaatcagacttttttctatcaaaaaaatatctatactttgtagtcaaataaaaatcttaatcaaaataatactcgtatactttgactgttgactgatggaaagatattagaatataaacattagagatagaaacaaatctgtaaaaatcttaaaattaggattatttatacggaatattccccaaaagataaaatcattgaatcataaaaagccatttatggtagccctaaatattcaggcgcggctttttttcttatttcgttttcattttaaaaaagtttttagcgccgtttattgccgcgcgtcgttttcgctcctcgtctcgtctccttttattattaccccctctctctctctcccactcttcctctcaaatcacacatcactgctttcttcaacctctctatctctcagaccaattagggtttcgcaatcttccagtagatttcgcttctcaacgtaagtttttctctataatctgtgtcgatttcagtctaactacagtgattgttaaaccctagactcggaaattttcctgggctttgttattatttgcgtcggtttagtcaatgcgatgtagtgaacgcttcgattacatagatttgtgtgaaaattttatagtccaattgcgttatagtgatgattttgttggtaattttgattttgaaactagggattttgaaaatg

SEQ ID NO: 23436 - DNA, 3000 bp, Unknown
  misc_feature (1)..( 3000): 2750-1469P.txt file - cDNA_ID_2141163; gDNA_ID_1620420; Annot_ID_156564
ttgtgattttgtctccgcatggttactttggccaagccaatgtcttgggtctgcctgatactggtggacaggtatacagtatttagttggaaacttccatatcttagaacttggtgatcctctgttgattcaacttacaatctactgttctgacttgcaggttgtctacattcttgatcaagtacgtgcattggaaaatgagatgctccttaggatacagaagcaaggactggaagttattccaaagattctcattgtatatttgcttgctcactatcatctacttcgttcttcatgtttgaaagtatttgttattcgagttccaataaaattttatgcttctatgctggcttatataggtaacaagactgctacccgaagcaaagggaacaacgtgcaaccagaggttagaaagagttagtggtacagaacacgcacacattctgcgaataccatttaggactgaaaagggaattcttcgcaagtggatctcaaggtttgatgtctggccatacctggagacttttgcagaggttagcattaattagtagctagagttctatgtaacttctgcagattattcttgcttcttcacttagatgtggttagcttaaagttacggtgaattaaagaatatacttgttcgtatcacataggacaatctgcttcagctgtgtatgcatgccctatgtattggctaacactttacttctatcaatgtgactaggatgcatcaaatgaaatttctgcggagttgcagggtgtaccaaatctcatcattggcaactacagtgatggaaatctcgttgcttctttgttagctagtaagctaggtgtgatacaggttgacgggttttatgctctctgtaatattaaattcttttttgttgtcttttgttctgatctctcctttaccatttcggatgcagtgtaatattgctcatgctttagagaaaaccaagtaccccgagtctgacatttactggagaaaccatgaagataagtatcacttttcaagtcagttcactgcagatctaattgccatgaataatgccgatttcatcatcaccagcacataccaagagattgcgggaaggtaaaaattcatccgctattcaaaggcatgttattgcctctggaattgtggtttgatgccaacagaaactattttgcttttgtcacagcaagaacaatgttgggcaatacgagagccacacagctttcactatgcctggtctttaccgagttgttcatggaattgatgtctttgatcctaagtttaatatagtctctccaggagctgatatgaccatatactttccatattctgacaaggaaagaagactcactgcccttcatgagtcaattgaagaactcctctttagtgccgaacagaatgatgagcatgtgtaagtcctcttacaacaattctgatttagcaattaaaaaaacaatctcagacaaccacataatattaagattggtttgcatgtctcaatcttcttgtgttgatgcagtggtttactgagcgaccaatcgaagccaatcatcttctctatggcaagacttgacagggtgaaaaacttgactgggctagttgaatgctatgccaagaatagcaagcttagagagcttgcaaatcttgttatagtcggtggctacatcgatgagaatcagtccagggatagagaggaaatggctgagatacaaaagatgcacagcctgattgagcagtatgatttacacggtgagtttaggtggatagctgctcaaatgaaccgtgctcgaaatggtgagctttaccgttatatcgcagacacaaaaggtgtttttgttcaggtaacatgagataaattcccttgtatttggattttttttttgttgagtcagcagaccatctaatctctctttttccaccacagcctgctttctatgaagcatttgggcttacggttgtggaatcaatgacttgtgcactcccaacgtttgctacctgtcatggtggacccgcagagattatcgaaaacggagtttctgggttccacattgacccatatcatccagaccaggttgcagctaccttggtcagcttctttgagacctgtaacaccaatccaaatcattgggttaaaatctctgaaggagggctcaagcgaatctatgaaaggttggcccattctccttgacaggcttaacaatacaacttgtatcgcttcaacaagatgatggcttaataaggatttttgcatgtataggtacacatggaagaagtactcagagagactgcttaccctggctggagtctatgcattctggaaacatgtgtctaagctcgaaaggagagaaacacgacgttacctagagatgttttactcattgaaatttcgtgatttggttagtgtaacccactgttattcttttgatgtctacatctactttacttacattattcttttcttcggtttgcaggccaattcaatcccgctggcaacagatgagaactgatcatgacagggtaggattttatttcctgcactttctttagatcttttgtttgtgttatcttgaataaaaattgttgggttttgtttccttcagtggtttgattttggacttatttgtgttaatgttgttttggctgttctcttaatatcaataacaaataaatttactggttggtatctaagatctaacaatagttactatttttagaggtaaagacaccaaccttgttatattggtcagagagctaaaaccttgacttgttgggaaaacaaaactctaatgacagaaaatctgacatgatgccttataattcacagcctcatgttctacataaatcctaacaatagcactttgtttcttcattatattttgttaagtccactcttctctctcatatcttctaaccaaaacagagtcacaaggggctcttaagcccttccaactaaattcttttcttttgttctcttgaaactgaatccaccagacaaaaaaatg

SEQ ID NO: 23437 - DNA, 3003 bp, Unknown
  misc_feature (1)..( 3003): 2750-1469P.txt file - cDNA_ID_2141175; gDNA_ID_1620420; Annot_ID_156567
tacacaaaaactttgctcgcaggatttacttactggccattaacgagctcttccttaaaccgaagatattcagaaacagttaaatgatctacgctcagctcatacacattcacacggacatattccctaacaccaggtctgggacgtatagccaaagcaacaaatggaggcaaaactatggcttcctgaatgcgaaaacttgagtttattaacaaatcaagatatatgaacacaacgtagccataaaatgatactcggatcctatatgttcacctctgcagactgcagaactttcatgaatggacttttgttaagatcttctaatgttccatcaactttcacagtcttaaggaactcatcaatcagctggtgggactgcaatatcccctttccctgggctacatatctaataaagataacaaccaaaaccattacccatgacttgagaccaatcacaacacacatgcatttataagcaaggctcagggagagagagcgagagggttaagaagaaacctggagaaaagagagaggagctcattgcgttgagcagagatagcgtcataaacccattcacgcatagtctcgaacctaccagtcggcatgattttttctcagaggcaaaaacacaaacacttacaaggcaaacccagaagacccaaaaggagaggaatttgtttaagaaaccaatccagcttatgtatacgagatcaaagaaagacgccatttttaaattcactgtagcttgatgagaagtggcgaagaaagaacgacacttggctgcagagataacaaaaaccatgggcgagtttcttcaacgtcaccaccagagcactttaatcctcacttagagcgtatcgcccgtagtggtgggcctccggtgatagccacgttcaaatcggagatcgcttgctctgaattttacgctatagttcgttaacacatatgaataagagtagaagaagacccgccaaaaatggatcagtttctttgtttgttttttaagcttctccactttcattaaatgatgtgtgaaagagtttgtttatcttaaagtaaaaactctgaaatcgaattaacgagaaaaattacatttggttgatacaaagattgtttattgactgatacacctattacaaaataaaactctcttaacagttaactcaacatataaaccacaaaattaaatcagaattctttagtcgaaaagactaaactttgttgccagcagctaaggtccatacacgcaagttaccactctcgtctccactgaataacaatccttgaggaccaattgtgagtgtggcgatcgtgtgcgtagagaacatccttcctctttcttgaaaagatggtaggtcgaaaatgccaacggttccgttttggtaagagcagaatattatcggtttggcttctgcatcatgcataccagaaagagcatgaacactactctgttcttgtctgcgagtttgaacaactttcaagattccgttttcagaataagcccaaacttttatggtcccatccaaggaagacgatatcaaacatttatcccaacataagagtgaagtgacagtgccggtatgttgcttcagggtcattatacattgcagggtgttgagatcccacatcttgattgttttatcgacagaaccagagtatagcatttgacctccaacagcaaaacaagtgacttcaccactatgtccctcaagagatgtcaagtatttgaatggatcagactcagagtctgtagtagctttccagactaagatactaccagaacttgttccagcaaaaagcattccgtttgcaatagtcattgcattcacctgaccaaccacccctgctgcttgaagatgcaaatcttgactggtttgaacgttaaaagcctttatagcgtttggcaagccaaggaaaacccaagggccttcactgattagagaccctgcttctgcgtcaaggttgatggaatgtacacactgaccagaattgcagtcccaaactcgcaatgtaccatcaatactgactgaaaagagtttatctgaaccctcagggagagcgatcccctttagttccttattgtgcccttcaagagaagctaccatggccaatccagggaaacaagaccaagagtgtaagaactggcactgctcacccctcttgcactttccatctttccaatacttacatacccattttctgagactagaagatctcattggcccacaagcagcattcttcctcgccaaacctaaaactggtggtttcggtgacacatcattggtccttggcatattattgccctcgggtgatttgtactcttttgacgtccaaaccagactccttgaaaacttatttggacggtcgtaagggacataaggtcttcttctcgtaactatatctgttgcgaaatcttgctgtctcgcaacaactccgtgtgagtagtatctccttggcgctttgtaatccatactgagagagagatcaaacgtatgtagaggaatctagatcttcgattagggttaacgatttctccaactcgttcggagagagccaacaaaaaaaggaaattttgagacggagtaaagaacatgtaaagagtagaatgatctggggctgcagaggaatggtgtatatatagatgagcgtggcggttacgctataataatttctattgggcttaactttaggcccatcattcgtgggtccaattaatgttcaattctatcattaggttaggtcattaattataccctaaaatctctgtactagtagaaaaaaagaggtctttattctgtatactaattactaattagagctaaatcaggatgagtccatcgcaacttgtctaattactgttagccaagaccaccctagagtcaatatcatatgttaacaatgatgtaaaccttttagtattgaaggccaaagtagtaattaatccattgactaacttcttttaaaccttgagacagtgaaatactaactcattcaacaaaaatg

SEQ ID NO: 23438 - DNA, 3003 bp, Unknown
  misc_feature (1)..( 3003): 2750-1469P.txt file - cDNA_ID_2141183; gDNA_ID_1620420; Annot_ID_156569
ttgttctctgacagtttttttttttgtttggttacaaataaagatgccagtaagtgtaagtgtctttttataagtttagttctgaagtctcttgtctttcttttactctcttgtccgaaattgcttgattctcgattttgacgaagcttgaaaaacaaacccagttcgttaatggtttctgggtcttcgtcatttcactggatccgttagaaaaatgattcctttttgttatctattgattcccgatctgaatttgaagctcttagtatgtttttattcaggtggcactagttttgctgttgacattgagcagtgtgattctgattaatgggagaagttacggcgtcggaaacatatgcgatcgtggtcggagaccgagcgagagaccacacagtgtcaaaatcactgattttggtgctgtgggagatgggaaaacgttgaacacacttgcgtttcaaaatgctgtcttttatctaaagtctttcgctgataaaggtggtgctcagctttatgttcctccgggacggtggctcaccggaagtttcaacctcaccagtcatctcactctctttctcgagaaagacgccgtcatacttgcctcacaggtctgtgtgtgtgtctctctctctctctctttgtctaaagtcttgatcattctaaagagtaaagatcagagtttgcagcttaactgtttcatagacttctgattagcttcagagaatcctgtttttgaattgatgtgtagaaacccaaatttggttcagtagttaggcattgtggcttaggatgacctctggctccaattgctagcaagattggggattataaaaggatatatctcattgcgctggttttcagttaaatcaatatatatatctaccaatgttccatggttctgcattgttatcagtcagaacatttgtgtatttgtttctcattttgtcttttatttgttgttcttacctcaaccgtgtgaaggatccatcgcattggcaagtcacggatgccttaccgtcatatgggcggggtattgatctaccagggaagagatacatgagtttgataaacggtgacatgctacatgatgtagtagtaacaggttatatacatattttgttccattcatttcattttgtttgctaatgctaaataaaaactcactgttgtataccatattcattggcttaggtgataacggtaccatagatgggcaaggccttgtttggtgggatcggtttaattctcattctttagagtacagtcgccctcaccttgtcgagtttgtctctgccgaaaatgtcattgtatcaaatcttacattcttgaacgctccggcttatactatccattcagtttattgtcggtaaaaatagtttgaaaattccctcttattattatacctcctttggttttgaaatcatttggtaacctcttgactcgttttgcagcaatttatacattcatagagtaacggctaatacttgtccagaatctccttataccatcggtattgtcccaggttagttgttattatccagatatatgtgtaatttgaaacaatttgttgcagcactaaaatctcaaactgttatttttttcagattcttctgaaaatgtgtgtatccaagaatctagtatcaacatggggtatgatgccatttctcttaaaagtggttgtgatgaatacggtttatcgtatgcaagacctactgctaatgtccagataagaaatgtttaccttagagcagcttctggttcctccatttcctttggtagtgaaatgtctggtggtatatctgatgttgaggtcagtgatgctcacatacacaactcgttatccgggattgcctttagaacaacaaatggaagaggtggttatattaaggagattgatatttccaacatccatatggttaatgttggtactgcatttctagccaacggtagcttcggtactcatccggattctggtttcgatgaaaatgcttacccgcttgtgagtcacatcaggttacatgacattgttggagaaaacataagcactgctggatatttctttggaacgaaagagtctcctttcacttcgattttgttatcgaatatctctctgtcgattaaaaactcggcttcccctgctgattcttggcaatgctcatatgttgacgggtcttcggaattcgtagtccctgaaccgtgccttgagctgaagagttttgatagttactatggtagagctgaggccttatgaaaccaaacttcattaggaatgatgattcatatttgtttaagagagagcaaatggttctgattcttttcttttccccaaaaataaaccacagtgtgtagaattattacctgttccttgttggtgttgttgtccctgttatttgcagcttgtgagattaatatatcttgtacaggttcatttcttcattcatgtgtaaccaaagaaattttgtattagcccagtaaccagatattaatttttttaaatatttgggcctcgttaaaaagcccagcccaataacaaagagctgcttcgtaaaaagagacgtcacgaaaccattcgcttaccaaaccacacagagacacatctcttcattttccaaccatcttcttcttttcgccacacccgtaaatatttactttttctcactatgttcaacttattattattaaattaactaatttagtgtatgccactagaattatttttatataaaatatttttcatcaccttcctgattagataataatataatcaaaaattcacccatttccttcatcttccccaatctctctaaaaccctagaaactcacttcctcagtttctccaactctgtacttcgtatcatcaagcgaaaccctaaaagaagcaatctttagtctcttctcttctttattttttctggggagaaagaaatttcacttttttttatccgatttctgcttcatctgggttttggatttttgcgatcgattttgagaaattagcaaacaatg

SEQ ID NO: 23439 - DNA, 3000 bp, Unknown; identical to SEQ ID NO: 1584
  misc_feature (1)..( 3000): 2750-1469P.txt file - cDNA_ID_2141187; gDNA_ID_1620420; Annot_ID_156570

SEQ ID NO: 23440 - DNA, 3000 bp, Unknown
  misc_feature (1)..( 3000): 2750-1469P.txt file - cDNA_ID_2141341; gDNA_ID_1620423; Annot_ID_156648
gtgggaagaaaatccaaaattttggaattcctagggctagattgagttctaacgaaagttataatcagttctcagaaaaagaagaattggttataaaggatgattcgatgttcaagaacaataaaccgccgaaatacggaaaccttgtaaccatcctcagcctcgacggcggcggagtccgaggaatcattgggggagtcatccttgctaatcttgaaaaacatcttcaggttatacataaaacctttcactagtgcagcgaatatttgttttcagtttttttacatttacatattataattatagatgtttgttttgattgaatccccaacattttgtattttgatcaaaactcttttctagaaagtaagggttatcatctaaatttcatatgcgcatctatatatatgctagcggatctactcgattatttgtaagatatatagtagtaattgaacatatatatcattgtgtaaacgagtttgacgtgtgagattcttgtttcaataggaaattgataatgacgaaagcgtgaggctagccgattattttgacgtgatagccggaaccagcaccggtggcctcatgacggccatgttgactgcgccgaacgattccggccggccactttatgctgccaaagacattgtcccgttttacttagaagaatctcctaaaatattttatgggtaaagaaagtagtagtcatagttgttttttatgaaaattcttaagtatacataatttatagattgatatatatatattagggtctaaaatatagaaacacacaattatgaattcgtatgtttcgtttaacgaaaaggattaaatgatatgtaaaaagaactaattactaaaggttttgtttttaaaaatcaagttgtcattagatgtggagatgattagtgaattacttatgaatatagaattctttgtttcctgaaaaaatgtagatcgaaatggtgggatccgtctgctttatgggcactgtttcgtccaaagtacaacggagagtatctgcatacaagattgggagagattcttggagagacaaaacttgaccagacactcacaaatgttgtcatacctaccttcgacatcaagaaacttcaacccaccatcttctcctcataccatgttcttctccaccccgctgttcttaaaccataattaacgtagcattttaaccactctaacatactaacacgctctgtattcttttgttacgtgttgttgaaggcatcagttgaccctagtttgaacgccaagttatcagacatatgcattggcacatcagctgctccattttacttacctccttataaatttcccgaaaacgataagatgagaacgtttaacctcatagacggtggtgttaccgctaatgacccggtaatacacaatcttcgtaccattttctcattactccttcttgtatgatcatcaactaattgtcttgtatgttttgtgtttggttgttcatagactctggtaggcatgacagctatgtctagaaagtctataatcaaacatcctgatatggatgggttcaagccgttagaatacgaaaagtatatcgtgatatctatagggacaggatcggcgaaaagggaggagtactacagtgcagtagaggctgcaaaatggggattcgaaaattgggcgtacaactggaagcataaaacaactccgatattagacattatctttgaatcaagccgagacatggttcagtaccacacctcggttctgtttcaagccctagagtccgaggataactatctaagaatcgacgtaagaagctatacttaaaacattttaatgtgttatctatcattaactagatgagattattgatatgtgcaagtttatctcaggcagatacattgaaaaaagatgaagtctttatggatgactccgagacgttgaacttagagaatttaaagaatattggagagaaattactggacacaaatgtcatgcgtatgaacctcgacacttatacatatgaacctattcctaaaaccgtcaacaatgatcaagaactcaaaaggtgattcaaattttcaaatctttttgatggtttcttggatatcaatcaatctcatcgtttgaatatcttgtccatgtaggtttgcgaaaattctctcggatgaaaagaaattaaggaacaagacatttaagaccatgattgatgattcgtcaaactcctaaaagatcgataacaaaaatgaatgacagatcgatgataacccgtgtgtttttcttcagttgtgtgaaaaaatctacttgcacttttaacccaacaaaaacaaaatcaagaaaacaagaaaagaaaagaaaaacaaaacatttcgtatatattgtgttgtggggattgctcggcgaactctctttacgccttttttattttttgtcttctggaattgtttttgaaaacgtgaaaaataataaaagatacttccctacgggacaaagccaactatatatcgacgttattcattgcgcaagagtagatctaaattaacgaaaacacatggagaaaacaaataaaaaatgctattaccgcaaattaggaaaaaatgaaaggctagagtttcagacctattagtcattggacttacttgccagttggccagatcatatagatgagaacaccatctcatgaatgtatattatatgccattagttgtgatgaactaaaacatggttgctttataaattagaattcgtttcagtatatacatattatatatagtaagttgtggatgacttgaatacgatacgataagtcttatttacgtttatattattactatattcgggtggcttttatgactttatattctgattaaaataacttgggaagtcaactttgattaatcttcagaatctacgaagtttataaataccatgtttgtcattgtggagaagaacccaatacaaaactcaaatcacaaaaatctacaaatcaatacatttattcaagaaaagatg

SEQ ID NO: 23441 - DNA, 3003 bp, Unknown
  misc_feature (1)..( 3003): 2750-1469P.txt file - cDNA_ID_2141351; gDNA_ID_1620423; Annot_ID_156650
gttcaacgtctcggagtcatccataaagacttcatcttttttcaatgtatctgcctgagataaacttgcacatatcaataatctcatctagttaatgatagataacacattaaaatgttttaagtatagcttcttacgtcgattcttagatagttatcctcggactctagggcttgaaacagaaccgaggtgtggtactgaaccatgtctcggcttgattcaaagataatgtctaatatcggagttgttttatgcttccagttgtacgcccaattttcgaatccccattttgcagcctctactgcactgtagtactcctcccttttcgccgatcctgtccctatagatatcacgatatacttttcgtattctaacggcttgaacccatccatatcaggatgtttgattatagactttctagacatagctgtcatgcctaccagagtctatgaacaaccaaacacaaaacatacaagacaattagttgatgatcatacaagaaggagtaatgagaaaatggtacgaagattgtgtattaccgggtcattagcggtaacaccaccgtctatgaggttaaacgttctcatcttatcgttttcgggaaatttataaggaggtaagtaaaatggagcagctgatgtgccaatgcatatgtctgataacttggcgttcaaactagggtcaactgatgccttcaacaacacgtaacaaaagaatacagagcgtgttagtatgttagagtggttaaaatgctacgttaattatggtttaagaacagcggggtggagaagaacatggtatgaggagaagatggtgggttgaagtttcttgatgtcgaaggtaggtatgacaacatttgtgagtgtctggtcaagttttgtctctccaagaatctctcccaatcttgtatgcagatactctccgttgtactttggacgaaacagtgcccataaagcagacggatcccaccatttcgatctacattttttcaggaaacaaagaattctatattcataagtaattcactaatcatctccacatctaatgacaacttgatttttaaaaacaaaacctttagtaattagttctttttacatatcatttaatccttttcgttaaacgaaacatacgaattcataattgtgtgtttctatattttagaccctaatatatatatatcaatctataaattatgtatacttaagaattttcataaaaaacaactatgactactactttctttacccataaaatattttaggagattcttctaagtaaaacgggacaatgtctttggcagcataaagtggccggccggaatcgttcggcgcagtcaacatggccgtcatgaggccaccggtgctggttccggctatcacgtcaaaataatcggctagcctcacgctttcgtcattatcaatttcctattgaaacaagaatctcacacgtcaaactcgtttacacaatgatatatatgttcaattactactatatatcttacaaataatcgagtagatccgctagcatatatatagatgcgcatatgaaatttagatgataacccttactttctagaaaagagttttgatcaaaatacaaaatgttggggattcaatcaaaacaaacatctataattataatatgtaaatgtaaaaaaactgaaaacaaatattcgctgcactagtgaaaggttttatgtataacctgaagatgtttttcaagattagcaaggatgactcccccaatgattcctcggactccgccgccgtcgaggctgaggatggttacaaggtttccgtatttcggcggtttattgttcttgaacatcgaatcatcctttataaccaattcttctttttctgagaactgattataactttcgttagaactcaatctagccctaggaattccaaaattttggattttcttcccactgaaattgttaatagtggctaattttgaaacacagtgaaaagcatttgatcgatgatatcgaccaacaaagcgagtcatcaaccactggaccatacttagttaatgactcgtttttcttttgagttgtaaaagtttaaatctaaaaattggtttagaaaccaaaaaaaaaagaagaagatcaatgcaataattctatacattttcgtcttatatacacatgtgtgtgtatattataaaaatgcacaactaaatgagtgggagattcgaaacgacaaattttgggatcgataagactctttcttaatacattcgtgctaaccgtgattttagtttggaccttttctttgttattaattattataataaccttggaacaactagttcttgagacgaagtcgagatataaatctatattttaaaataaaagattactttaatgtttatctaaatcttttgaagaatctattgaaaatgacatatcattatagtatgactaatttcaaatggtggatgcaaaattgcaaatacatgtagaaaaatttgcagacgagttatatgacttataaagctagtgtatcatattttttagtttataaaaacagcatatgatacttttatgaaagatatgttttttcttaaaacaatcaggaacaaaatattttgtatgtaggctctatgcaataagtaagatatgattaacaattgatccaacgaattgggcttttcagatgatgaaacgggcctctatgaaataaatgatggatttttttccttctaactctctaatgatacaaaatacaaagattccaaaacatataaactttaattcattttttttataaaaatagtagtattttacatatgagatgagatcagaatcaatagagtacaacaaaacactctgtcagattcccacttagttttgaggattccccaaaaaacaaatttggacaatgataacgctcaaaatttaattaataagtttccccaaagtataattaccaaattatgaatgaatagtattgctctctcagaatcaaaacactgaaggagaaaaaaataaaaatg

SEQ ID NO: 23442 - DNA, 1810 bp, Unknown; identical to SEQ ID NO: 1605
  misc_feature (1)..( 1810): 2750-1469P.txt file - cDNA_ID_2141382; gDNA_ID_1620423; Annot_ID_156658

SEQ ID NO: 23443 - DNA, 3000 bp, Unknown; identical to SEQ ID NO: 1595
  misc_feature (1)..( 3000): 2750-1469P.txt file - cDNA_ID_2141433; gDNA_ID_1620422; Annot_ID_156629

SEQ ID NO: 23444 - DNA, 3003 bp, Unknown; identical to SEQ ID NO: 20979
  misc_feature (1)..( 3003): 2750-1469P.txt file - cDNA_ID_2141433; gDNA_ID_1620863; Annot_ID_170390

SEQ ID NO: 23445 - DNA, 3003 bp, Unknown
  misc_feature (1)..( 3003): 2750-1469P.txt file - cDNA_ID_2141464; gDNA_ID_1620424; Annot_ID_156666
aatggtacattgtttcgattcgcttcttaggaatggaaacggttgcacaagaagaaattcatagagactttcaagaaaatcatggaatgtaagaagaaacctcagggacagggaaatgatgatattagccatgtcctacgcgaagatcaataggataagactccatcgtcttggatggacttgtgtttgagtatgttctatatataaccacctttgttaaattatcaacaacaaaaaaccttcgtttttaaaaatctaaaataaataaaacgtagagagtgttgtattgatgtaagatttttgtttttgtataaatttaaaatttatttaacaaaaaaacggttttacaataaatacatcgttactgaaacaagtataaactgaataaaagagctaacgacaacaagtgctaaaccaatatcgtagtccgccttcgtagataggtgaacttgaagtaactaaaataaactaaaatacttaaccgattccgcatattcttatcgaccattttggcaagagagagggctggaatggatgactcgccatgccttcttccatttctctctttctaaagagctgaaacacatatctgaaaacaaacatatgaatttgcgtcaaggccgaatttgtagatagatcaaaatatcatgtggattatattattatatatatgttatacttgcaagtatttagagatttttgcatcttacttagcttgtgtgtgtttggtctatttgaagtatttgcagaaattctatcccacaattttgtttgtccgcctctatccaaaactgatatgcgttcaattattctgataaaaatttagatacatacgcaattaatcatgagtatttaaatccttaaaggttccaccatctaaatgactaaaaccaattagtaatcaataccaattgggttagtgggttttgggaaaatttaaagttttgtactcaagttggtgtgtctaattatttattatttactttatgaattagcataattaagcaaagaacaaagaatattttggtcaaatatataaaaagattaacatccatctgaaaaatcttttacctatagtttttgcaacttgaatatttacctcaatagataaaaactagagttatttttttttttttttgtcggcaaaaaactagagttatttatcaaagccaagttagcaaaataatctactatgatgacaaaaatttgtaactaaagaacataattccacgtcgttcaccgtttcgtgttcctacgtgttattcttttttttggtcacgttataaaacctcaaaaagctctagaggatcagagaaaataacataaccaatcccaagaagaaaaaaaaaacagagtagagattgataaaaaaaaaatgagtagctccgattctcctcagcttcacaatatcttcgtctatggtagctttcaagagcctgacatcatccatgtcatgcttaatcgtattcctgagattgtctctgcaacacttcctggcttgtacgttacctctctctctcgatcttgatcttgatctcgaatgataattctctctgttttttagatctaaggtttaatgccgattttgggttgttttcagtaagagatttaggcttaaaggacgtttgtatccatgtattatcccctctgagaatggagaagttcatggaaaggtttgatttcttgagatcattctttgtgtgttgatcttgattcttgaataattttagattttgagaatttttttggtgaattgtttggtggtccaggtactaatgggattgactaatgatgaacttgagaatgtagattgggttgaaggaaacgaatatgaaagagtgtttgttgaagttgtaagaaaagtaagtttcaagatttattgattgcatcttcaaaaacactttttagtggtcttgatgaggttatgagaatatatatgcaggacaattctgagaagatgagagtggaaacatatccatggatcaacaagaatgatcctgatattggtggagaatgggatttcgaggttcgatgatttaaccatttttgttttgttttgttagctctttatgaatgatgaagtggtgcattggtttgattcgcgtgtttttgttaggaatggaaacgattacacatgaagacattcatagaggcgttcacggagatcatggaaaggaagaggaatccacaaggaaagggtagagatgatttcagcaatgtactcaaagaagaagatcccgcgaatgctccatcgtcttgaatggatttgtgtcgagtatgttctatatatcacctttgtgtctaaactccatattaaataaaaaaagctggagagtctagctaggttattgtggagactaatgacaagaatgtttttgtcatgttgtattgtaagatttgagttatatatcatgtggattgtattattgtgttatacaagagtctttaagagattttggcatcttacttgtggcgtctattgaattaagcgtgtatggattaagtgactgaaaagagaatttgtagtaccgaccatgggataagggttttgaaatatcctcaatggttaaagaagcatactataaacattggaaaggtatgtaacatcttttggttacacaagaaagataaggttcttgaagacttggtatgtaataagaagttaagaaccaagtaagaagtgaaggagagacgaaaatggagaaattcacagagtacttgcaaattttataccttttacataatttacaaatattacactctcccaaagagtaaagaaaaattaagtgagagaggacttaaaggcccaaatataaagcccattaggcctatatttaatataaccaatctggaccgttgaatatttattaagcccacataaatcgtgtccgttgattagaagagcccaagagaactctagggttttgtcttataagcttgatctcgcattaggtctttgcgcctcttgccatcttttgtcactcatcttcacaggaaacaatg

SEQ ID NO: 23446 - DNA, 3003 bp, Unknown
  misc_feature (1)..( 3003): 2750-1469P.txt file - cDNA_ID_2141474; gDNA_ID_1620424; Annot_ID_156671
gatatattatttatcaaaattttaaaaatttaactataacaaaaaaatgaagctatattgcatattatttttgatttcatacaattattttgcatttttttagagatagatgataaatttgtaaaaattgacgtctttgaaagttatttttgcacaaaattccttttataaagaaaaagaaaaaaatttgttttgagacaactcttaagattaccttacaatacattgatatttaaaaacaaatttatatgaatctctagtagctatcaccctagttacattggctaatggatttctcataatagttttggatcctctaataatctctagttttggatcctctaataatctctagtatatgaaggacggaatttcgatcattgctctcaacttgttcatcaaaatctagcaaaattgacattttccgtcgaatatcacccatataaacttaaccatagtggaaacctaaaaattcacccccaacttttacaagaaagtgatctttctcattccttcatttgaaaggtttgaccttaacgtttttgttgtagtcgaaggagtatctttcacaacattgctgatcttagaacaaatgtaacccattattaccataagacttattttttctttttcagttttgacttgtgcctttatgtttaagacactagtagccacatttattacgctttttcaccgcaaaatttaacacgcactctctttgtcgatcccacaaactccatctacctaaccatggttaaaaatcatcaaaccttggttcccttgattaaaatatccctaaatccaagtctctttattatttcatttaaaatcataaatttagtttaatacaattgtcctttttcaaaatattatttctttatttgcttcagcaacagtcgtcatagtcatcatatcattttcttcttttcctcctctaaacgaatattaccaataaaaaatcaagtggaaaatatgtaatattaaaaaatctccaacagcttaagaagttagaacctttttacttatctttatttcttcttcttcttcatttttctattcacattctctgaaactcataccatattttcaaagctcttaacccaaaaaccctaagtcttttttttcttcaaattattggttatattaatgttttaagctatgatggatatgactcctacaataacaacaacaacaacaccaactcctaaatcacccgaacccgaatccgaaactccgacccggatccaaccggcgaaacccatttcctttagcaacggcatcatcaaacgccaccaccaccaccaccatcctctcctctttacttacaaagaatgtctcaaaaaccacgcggcggctttaggtggtcacgctctcgacggttgcggcgaattcatgccgtctccgtcgtcaatctcctccgatccaacttctctcaaatgtgctgcttgtggctgccaccgtaatttccaccgccgtgatccagataacaacaacgactcttcccaaatccctcctcctccttccaccgccgtagagtatcaacctcaccaccgtcatcatccaccaccaccaccacctcctccaccaccacgtagtcctaactcagcttctcctccaccaatctcttcctcttacatgctcttatctctctccggtactaataacaacaacaacaacttagcttctttctccgatcttaacttctccgccggaaacaaccaccaccaccaccaccaacatactcttcacggatctcgtaaaagattccgaacaaaattcagccagtttcagaaagagaagatgcatgaattcgccgaacgtgttggttggaagatgcaaaaacgtgacgaagacgatgttcgtgatttttgccggcagatcggagttgataaaagtgttctcaaagtttggatgcataacaacaaaaacacctttaaccgccgtgatatcgccggaaacgagatccggcaaatcgataacggcggaggaaaccacactccgattctcgccggcgagattaataaccataacaatggacaccacggtgtcggaggaggaggagagcttcaccagagtgttagtagcggcggtggtggcggaggatttgatagtgatagcggcggagctaacggtggtaacgttaacggatcatcgtcgtcgtgaagttaaagatgagagtgtcaggttaataagaagcttagagtaagcttattcgtattatcatcgttaataactttctattaaatattaattaagatctttagctttgtttgtttttgcattattattagttttgatttaatgttctttaccacgtcggtgtctcgctcgatgaggaataataccataacaatgttcgaattatatcatttgttgtaaacatttctattaatgaaccctgaaatgtgactaagtactccaataaatggtacacttttgatgtggtaatcttgtttcggatgaagaaacaaaaagattaataaacgagtgaaacatgattagttactataaatattcatttggtttcttatcttttaaagtactcttcttaattttatttgcaaccaaactagatgtagtaggtgtactttttttctttcttagatcctcttaattttattttatttttttattctatatcaaatgattagccatcattagtatattagtagcattgttgttaacacccagtgttttcacgtccgacccggaccgtccggtccgaccggttgaaccgtgacccgaacacttttccggtttgggtttagtattaaaatccaacaagttcaaaaccgaaaaaacccacaaaaactcatcattaacccgtgacccgatgaaccagttgaactggccggatgtgggttttaaaaaattctcttgattttggaataaaatatgagattttagactttattcaatcaatttttagatatttttcagttcttaaacccatttgatgtttaagattttgatgaagacttcacaatgccgccttaaaaaatg

SEQ ID NO: 23447 - DNA, 542 bp, Unknown; identical to SEQ ID NO: 1609
  misc_feature (1)..( 542): 2750-1469P.txt file - cDNA_ID_2141504; gDNA_ID_1620424; Annot_ID_156681

SEQ ID NO: 23448 - DNA, 3003 bp, Unknown
  misc_feature (1)..( 3003): 2750-1469P.txt file - cDNA_ID_2141543; gDNA_ID_1620419; Annot_ID_156534
ttgttttggaatcgtttattaaaccgaaattgtggagttggataaaggtcacgtgattgaagtttttgagtttctaaactgagagatttaattaatctaattaatcagttcttaatcaaggtttagaatttggtttggatattagattaaatcatagattataattgcatttaatcttgatcgtttagtctaaaccaatgcagcccgagattgttcctgaagccgtttttgttgttcctagttcaaaaccgaggaatcaacccattttgttaaggtgaggacgcgaccttgttttatttgttatatgaatatatttagttgattatttagtttagagttaagccgaatatatctatgagttacatattgtttgatgtgtgtctatgactgcttgtcttaggtttagactttgtgattctagatatatttatatatggaaaatttgtgagctctaaggtttaccttcaatgaaaaattttagattgctcacccctctcttttttgcaggttggttaagttgagagttcgttttccattattaattggtagttttgcgatgaaagttggttttgaaccgggctaagaagtgaatacgttgaccagctccttgtaccagattcgggtcctttcatttttaatctccataattaaaccagccgcgagtcttgaagaagaagtatgcagtcgatagtttctttcttccagagaatatacatcgaagcttgataggtaatcctaagaaagtaaggatcgtagtcatatttttgtcttagaacggattcttaaggcatctaacaccatcgccaaatttatctctcatgacagttattaggtttcaaaactctccaagattatattgaattgcacaagaagcatgtcggaagttgaaacaaaagtaatgttgctgatctaagaataaattttgggcttgacttaattgtagcccattatataacattcaggtcagtgtataaatcattttaatttattttctttccaaaatcatatataccacaacgaaagcataaaaaccacaaaaaaatattaaatgaaaaatacacattccaagaagaaggtaaacaaatcgtgaagtgttttgtgggtttaaatctctaccaatctcactttctttttttctgagagaacctgaattttttttctgataatggacatagcgagtaccaaccggtttaagaagaaggtttgtgatggttgcagtgaagctatgccaactgggaaaaagcggaagaatgaaaggacgttaatgaacaaagatgtgaatgccaaaagattgaagaaagatgtgaaaaggtgagttctcaaaggttagagtggagtgaggaagacgagatccgtgtgctacaaggtatgatggatttcaaagctgtaacagtacaaaatctttctaatgatatgaacgtaacttacgaaatcctttaggaatatataagcgttgatgtttgtagctatgcatttgtagagaagatgaagagtatgaaaaagaaattaatggagaaaatgaggattaacgctaaagatttgtcttcttcggttccgagttgttgaaacttatttggggatgtgatgtgaaattggcttgttctatcttaagtaagttatactcaacaacagatttcacatcatatctccaaatcagttttaacaactcagaaccgatcgaagaagacagatctttagcgttaatccccattttctctattaatttcttcttcaaactcttcatcttctctacgaactcatagctataaacgtcaacgcttatatattcatggaggaagttgtaagctccggtcatatcatcagaaggattatgccttgttagagctttgaaatccatcataccttgtagcacacgatctcgtctttttcacttcactctaacctttgagaacttacttttcttggcattcacgtttttgttcgttaacgttctttcgttcttccgtttctttccagttggcttagcttcaccagaaccaccacaaacctccttcttggaccggttggtattcgctttgtccattatcaaaaaatgttttaggttctctgagaggaaaagagagcgagaattggtagaaatttaaaccaacaaagcacttgactatttatttacctttttcttagaaatgtgtattttttatttaatattcttttatagattttatgcttttttgtgatatatataattttgaaaagaaaataaattaaaagaatttatatagtgacatgaatgttatataatgagccataattaagtcaaacccaagattggttcgacaattcgtttttggttaaattgatagcaagtgtgggcgtgagtggagattctgtgaaaagaagatggagtttgttgcacacaaacaagataaagatgattgaagacaaatggagagtcttgatgaccaaagaagataaatttgtgttgcaaaagatagagcttttgcatgaagtggtttctctgatcatttacgttgaagcatttactcactagatgcaaaatgtttcttgatttgctttttttgttggatttttctgtccaagtttttgctttatattatgtcattgttgcttctatgtttagaatctgacctctattaaatgtgaaacttcattagtatttttggttactatgttgctctttcgttgataacaactttgaaatgttagtcgcaccaaatttagtaaaaccgttttcttatacatgttacaaagcttgcttgaaggctataacaaaagatttcaaagggtttaacaaattaaacagatactaaatttgtgtttattacggcccattaagaacccaattaagagcgatattgggctaagactgatattttaatattaaacctattacggcccattaatagcccaatcaatatgtaaacatatgcgtcttcgttccatgtctccaatcttatttcttcttacccttttttccaaaatccagaaaccccagagaaagcaaaaccgcgagctctcatg

SEQ ID NO: 23449 - DNA, 3003 bp, Unknown
  misc_feature (1)..( 3003): 2750-1469P.txt file - cDNA_ID_2141551; gDNA_ID_1620419; Annot_ID_156536
agtctctgaaacccaattcaagaaaatcaaggaaatggtggaacaagggcttgctggaccagagatggcgataaagaagctggaagaaagcggggaattagggaaccgagtaacgagattagctaaagagatcgattcagcgagaaagtgggtgaaggagaaggacaacaatatgaagcatgaggtggaaactctagaagcgaagctagaatgtagagaagcgcaagaatctctgctaaaggagaagctatcgaagctagaggctaagctagcggaggaaggaacagaaaagctgagtctatcaaaggctatgaggaaaattaaaaagcttgagattaatgtgaaggagaaagagtttgagttgttgagtttaggagaagggaagagagaagccataagacaactatgtgttttggttgattatcaacgttgtcgatatgatgatctcaaaacttccatttgtcacgtagctcttcaagcatagagttcacttcttcttctccttttgggtgtaaaatgtaaatattatatgttgcaagatttgggtattttttcattaatggttgtaaactaaactaattttttttgtaaataacacattttaactttattttttttgtaaataacatattttaactttatttttcaaatattcttaatattgaacatcctacgcgttttataaaagtctccattagtttgttaacttttttttttttttgtaaaagtctccattagtttggtatgttttggccttcatatatttaatcatccttttgttggaagttaggttagtttgtattaaaatgttttaagttatcatcaattatagctcatctggtcaccactattttatagaaagaaatccagagaagaattatatatgaatgaaaatctggtaacaattaataaataaaaaagcataatgtgaaaaccctattaataagaacaaatcacaaataaactcaaaactaactactaataaataggagaaaatgaaagaaatataattgaaatgaaaattactcctaagaaaaaaagaaataaatcagtctcattttataatgtgaagataatgtagtctaaattaggattacgtaagtaaaatcagtctccttgatagatttcctaattaatagtatagatataagaaaatagagtcatatttcttttgacaaagacccaccaaaaaaaggcgggaaacgcacttagtgattgtgaggcattaatcatgtgttataaagttaagtacggcattagacatgctaaacaaaaaccaaaatccagctaatttgtatatctccgtggcaaatacgtaataatcttgaacattgataactacagtcaaatgatattttgaccggtgttgacgagaatttgaagagaaaataaaagcgtgtgatggcagaagcgtaataatctgataaaagggaggggtgtttgtggtaagacgaatttccaaaaagattcctccagtcttcgtctttctccctcaaaattgaaaacacacacaaaagttgagctttcataactgttctctcctctcaaataactccaaaaaccaaatcacctttttttttctttcttcttcaatctctcttttgcttcgatttcaatttcgtaatcttatcatctctgtagccaaaaacacacacatcagaccagagagaagagcgagagagagtttttctttggtagttttctggactttcttcaaatctcaggagcttccgtaatccgtatccaggtaaaattctaggttacgaaatgattttgttggcttcgattattgacttttgaagtttatttgattcttcgatcagcttttagtttacgctttcgttgcttagtagtgttggatcatgacttcatgagtagaaacatctgatggttttgtttgtttgttgatgtgccttttactggggaaattatgagtttcttgttatccagttcatcttaagtctcgttgaggttttgatgatttgcatcagattacctattggattatcgttgatttggttcgttagaaatagagtaatagggtttatatcaggtgaatcaaggtcatgagctgcaatttccaaatttgtttattattattcaagtttttgcgattgggatttcatgtttaggcacagtaactagatgtccttagattttactatcaagtcatctttagtttctcatgttagtagattttgtaatttaagcttctatcaactgctgtgtaatcatcaaaatgctaagtagaattcttggtttctatacagggaaacacgaaaaaccatagaaatcgattctggaccttaaaggaaattcgagagataaagtgtaagtgaaactagaaactctactcctttccttgtatttacagttttactagtaactttctttttaagaaagcgttggatgatcggatcgagattgttttagttgaaactgtattgttaaagccttaaaggtagtaagtaacatataagaacaaaaagaaacaactcacattttcctgaggtatgaaaattgaataatgatagctgtcttttatcggttctagaggtatgtgctttctggtccatttccaaaattgctgaggtggctccacttgagatcttttgtcttagccaatgccatcagattccaaatttagacccggcactaaaaagtgattagctttaatccaaactcgaaactctaatcaaattggcatttgttcttgtaacttctgttgaagtaaaataataatatatcacttggtaagacagttactcattgctgcaaagattttggatctatgatgatgttctttgcgggtcccacgaattctattattatctgcgtaccttgtcagagtacaattgctggatctacttctattattatattctctttatgttgaatatcaagatgcttaacctatgatctggattctgtaaaagccaaattattagtattagttttctaatttgttagtattatatacgaaacaaaaatgtgaaaaggatg

SEQ ID NO: 23450 - DNA, 3003 bp, Unknown
  misc_feature (1)..( 3003): 2750-1469P.txt file - cDNA_ID_2141559; gDNA_ID_1620419; Annot_ID_156538
aatatcctcaagaacttaatgcctgatgaaggaccgactctggctcctatcgtggtgattggcttagctgtcatctttgtccttcttcagcttttcgccattggccttgtaagtttataactagtgtgatcgttattcgatgttacttggctgtgagacgagtgactaaatgtttcttttttttggtaactggttaggtgtattctcaagttgcgtatgaaataatggagaagaaatcagcggatacaacaaaagggatattctcaaaacgcaaccttgtgccgcgtttgatactaagaacactatatatggcgttttgcgggttcatggcagcgatgctaccgttctttggggatataaacgcggtggtaggagcgtttgggtttatcccactcgatttcgtgctgccaatgcttctatacaacatgacctataagccaaccagacggagcttcacgtattggataaacatgacgataatggttgtgttcacttgtgcaggactcatgggagctttctcctccattaggaaacttgttcttgatgctaataagttcaagttgtttagcagtgaagttgttgattagatggttttgatagtgtgataaaaacataaacaatacttgttttgtggttacacttgtacatgaatttctcgagttgattcattatcacacaaaatgcaaaaccaaactagttacaaaatgcaaaaccagacaaggattatcacacttacgtcaattgttcttgagatgaatatgttttttttgttaaatgattttctatttaaatacaaagttcctttgggtataaacactaaacagattactgggttcagtaaactctctcagagtgtgttaattttcagtattcgtagctgattggttcggtttcggaccgattggatatccaccaatccgaaataatacattacatattattaattttatgctcaattcggatcgtgtaattcagaatttcatatttgatatagtaaatttcaaataattttgataattctgatcggataattcggatattttggatttcatcggataattcaaatccaaataagaattaaaaccatacatattttggtttcgaatacacttgggattctaaaatatcaataaaaaccgatttaagtctaaaaaaattagaatcataaaattgtttggattctaatcggattctatcagacctaatctaatctgatccgatccaaaattcgaatgcccagactatcacatactatggtcatggatttcggagcggatactccaatctcatttgcattttgtcttcttcttctttttttttttaattattaaaaattaccttaagaatctaaatggaaatgcaaaacaatgtggacgtaaagaacttaggatcaaggtaatctagcaacaacaaaataaatggatatatagtaaatttaaaaataaaatatagacacaataacaaggtactattttttaatagcatttcaatataacaactaaaaacaaatcatgaggaacaaaaaaataccgaaaaaagctcgcgcatagtgcagatactcacctaattatatataaaggtttgtattcatatagtatcttttggccattttctgtaaatatatattatattgagagtatgatttgaggatcttcatcataaatgaaaaaaataaatatatgtggggacaagatcaaattaatgatttatcatgtgatgtatcagcgatagtatttgttaaatactatttctaaggtttacgtgttaggattaggaatttaggaacgagcacgaatagtcaacatacagaacctaactcgttttgtgttaattgttttagacacatgtgtgtaagtcagtaaaagtttttttcctaatggcaaaagtaattcatccattcaagatagaaatggccattttctttaagagaaaaccaatctgatgaaatagagtttacttagaaaaagataataccacatgatcgtgcttttttgcaagacactcatgtggaaaaagagtgtttgaaagagctaaaatcttctaattctgacagtaaaagtttaagctcgtttatttattacatttttcgtcattgtcaactaactatacatgagtacttcataaaatccatgtgatttagcttacaaaaaaaaaaaatgtaattacgtacgtgtatagaacttaaaattcgctaatggtttggtaaacgctagagttggggcttaataatggttaaccaaattttaccacaagtcactaaaatatgatagtttagtatgattattgtagtactataatatatagtcagttgcattacattcacgtgaaaattccaccaagctcgggacacgcgtagaggtaggatatcacttctcactttccagacatttaatgatttttaatcgagcttatgggtcaatcatatctatcaatttttattttcttaaacatatctatcaattactctaaattataattaaaaaaatgtattaagctttgtgatatacaaaattatggtcagttcaattagttgagaaactttcagcattaatagatctaaatttggccacatgagataattatgtattttactagaaaaatgttaaattagagccaaaaattccaaaatttcaaccaaaaacttagaatttttatttgtctttcactaagaacgtcgttatcgtgggattaaatatttaattaataaacattagctgcaatactttcatgttcatacatatataaatgttaaatgatcagaccgtgaagcccataagaccattcataattaaccaccaagtacccacttctctctctctctccatacatatactatattatagataaatatcccatcaatacgtaacaaccaccgagatattacaattcacaggtttctagctattttatatagttattgtaaaccaaaagaaaaagatttttggggatagatcaatctcttgcgttcatttttcttctctttggtacgaaaatacaaagatg

SEQ ID NO: 23451 - DNA, 3000 bp, Unknown; identical to SEQ ID NO: 1572
  misc_feature (1)..( 3000): 2750-1469P.txt file - cDNA_ID_2141585; gDNA_ID_1620419; Annot_ID_156546

SEQ ID NO: 23452 - DNA, 3003 bp, Unknown
  misc_feature (1)..( 3003): 2750-1469P.txt file - cDNA_ID_2141597; gDNA_ID_1620419; Annot_ID_156549
gctttaagaagagtcagcttatcaattagttgacttcaagtgtgtacaagggttttgttctgttagatactttagagaattaaattcatattattgtaactaaccgttaaatcaagcacatttatttctaattacgtagtactcgctttcactatttctgaatgaataaactaaggcagggcaatatatatataacaaatactaattattgttattattttttgtaaaaacatatgcaatgttttaaatctattacttgtgattgttttttttgaatattgtatcagatatatatatggtcgaatatctaacaagctctaaagtgaatataaacaaaaaaaaaaaaaaaataagatctatgttctatgtcgcctctaaaataaacatattacatacccacaatatcggaaatggttcgaccattagtgaatcttcccgtgggttggccgttggaaggtgcaaaatcgatgccataaggcgaagaatcagcttttgacaatgtgaagatatagttgttgtttccaacatctaccaatgagtctccaaatatgaagtttgtgaacgattgagcagcctgaaaatgtgatagccaaaggagaagaaaagtgcaattgaaaggcttgagagaacatctataagtgaaatccatttttaactttctcaaaatatttgccaatgtggtaggaagaaacgaaagagacttgtttggttaaataaacttgattacgttaatactttttgaaccattccttttgcttacgtatgttacagcatgacttgttcaaaagatagcacatggttcttctacgtacactattattactttgttggtcgtgtaacacaaaaattgtttcgtcttgtgtgcacatatactcgacttatatgacattaacatgatctcaaaaataatcctaagttacttataaagaatatctcgatttttgacttccaagtttgtaatcaatgttataaataggacaacaagctaggctaggctgtcttttagatggttaatagtcaaagagagtgatggcaaagagcttaattaatggcacatgtgactcatcgaacacgcttcttcatatcttcttcttctcaaacaacactacagaaatttgtctccaaaaaaaaaaaaataataataacgctaaagaaattttcttttaatatacctctattgttcaatatatatatttggcagcctctatgttcaatatatataatatatatgtgggttagtttcaactaaatacaatacctgactatgtcgggattcaaacaaaacccaaacatttaaactttacaattataaatttaaaaaacctttaaaatgcaactaaaaatgttttcttggtaagaaaacacacaattaatgtttataaaaaataaactaaggatggtatttatttgaatgcttttgttaaatgttatataaatagttttaaagctattgttttaccaaaataaactaaatgtatattataaatactaaatttattggatttaatttattttagtaaattatcattatatatatatatatatatatacataatgttaaaacttaaaagatgtttaaaaataaaatttggttattcatgtaatgactatattcaagttgtgacacatgtatatatcgaccccaaaatagacctcttataaattgtcattccacgtcacttttatccgggattccaggttatatgtaaaaaaacaaaaactgatgttctacatcatttaatagaaaactgaaatgtgatggcacatacataatgcatctcccaagatggtacaaaagtaatcattgtccttattcttcagattcaaccttgagactacccaatctccgtggaggggtttgagcaggagattcaaatatccccaaataacttggaaaagtaattaaaatttcatataagagaacaagtgtgtaagcatgcaattcaatcgagctctcacgatatccccaataggacgaaggaggaactcagtcggaggcggaaagaaaattgacatgatgcagctattcctcgatccgacagatcgtttggaaagaacaatgccttaaaaaccaaacacgttattttttaaagaagaaaaacacattactttaaatatatcataccaaagcaatatatgaaaatcataataacagaagtaacaatatgaaatactgtaacgttcaaaccaaattaggtttgtgtcgagaagttaatttaaaaaaaaaaaaattatcaaagcttttatcaaacaaacgtttcacttgatgtaaaaactatattgtttttttgaatttaatttaatattagattcaaaaacaaaaaaaaaagaacgttccaatactcaaaaagaattgcattggaattatctctctgtttatctgatcaatactcaagcattaggttgtattctaatttaactgttaaaggtccaccggtgtcttcagtgacgtatacgaccttggtacatgtttttttacttcacatgagccaatataccacaatctccaaaagataaacgcaagatgataaaccacaaaattttacatgaatagtaaatcatattaaagagtactttttatttcaaggtaaacagtacttgttattcagactttagtatatgtaaaacagtattttcataggaacaaatatataaactagtaagtcatagtagttacctaattggtacttttagacctcaaaagtctctcaaaccataaattaatatagtacattccaaattataaacatattatgaaaaagtttaattaaaaataaatatttaatttaggtttgcaaaaaaaggttcaacctccacccaatttcatgagtttggacagcaaattattttaaatgaaacaataaattcatatatctgtcttctactataaattaccctctctctctcttatcatcatcatcaatttatataaccctctcaaaacacacatttttaagattcaaataaaatcccttcttcaacattcaccaccacaacatcatg

SEQ ID NO: 23453 - DNA, 781 bp, Unknown; identical to SEQ ID NO: 11
  misc_feature (1)..( 781): 2750-1469P.txt file - cDNA_ID_2141597; gDNA_ID_604; Annot_ID_144143

SEQ ID NO: 23454 - DNA, 3000 bp, Unknown
  misc_feature (1)..( 3000): 2750-1469P.txt file - cDNA_ID_2141624; gDNA_ID_1620425; Annot_ID_156691
ttgttgaatggattaatgcaaaatttttatgctcatgtttgtctagattataacaatctacataactttaagtgagatgttttttttttttttactctttcttaacctagttaagactccatggattgagaatctaacatggtgtaaaagggtttctatcaatataggattctgcaaaaatgcatcagattttagatgcattgagacataatatttttgggctttcactcttgacacataaatgatatattcggaatatctttctcttctgctcgatggttcttaaatagttgcttcaaacctaaatcaagttttgtctcttggtaaagtttggagtattttcttttgttttgtactggaacaagatttgttgcaacttttctttttttatatattcaagtgttttggactaaaggattgatgaattggagattagacgagtgattattgattgtctataacatttgggcgtaatctgttgtaatttacattaccgttctgtttttggtaaagagaagatccacatgttatagtactacaagaagtaggaaatagccgctgacgaagtacgcgactttctctctggcacatctttcgagactttctcttcgccattgtttttcgacgccggtggaggaaggagattctcgccggcgtcgggacttcgaatttcttctctgcttcctcggccatccttgttgcttcacacttttctttgttccgatctatcttgctaaacactcgcgaaatctatttctcctaccaattttagaagaagaaaatctaatggaatcgtcaacgacacacggcggctctatctcttggatggtgattctttggctctccgttgcggcctcgttgtcaaagttagtgagttctctcactcataactgcggaaactccagatctgctcccaaacctgcaaaccccttgatccctaaccactggtctcctacgacggctcgcttccctgtccaagcaaccctagcggtgctccgtcggaattccctctctaggcggctgcttggggtgacggaggagagttttgcaagaggcaaaaccctaattggccaattggactcttcttttgggatgggcttctcacatagcccgctaagactcccttctcagcccatgtctgaaatatttgggctatcccaattagtaatttggccaaggtctgtaagcttggaatttccctgctgctctctgggtttaggccctttcctcacatctccaaggcccatctccaaaaggtgttttccactgtgttctctgcaaaagcccaggttctatctaacacttcctctgttcttgtctagcaaattattgtgtcgactcatggaaccgattgtttatggacgtcgattggaacctagtcatacaatcttgctatgctggtacaaaacttatctaagaacctggctattagaatcacctaaggatattattctctatttgcgaagcttgaagaagaccttgcttgttagcttctttaattgtggccagatgtttagggtgaggaaatacggcattatgaccctgtctctaaggagcggtggttaccgtagcctcctcatccccatagccgtgtatcccttgttatccaagcttatatttgcacaaattaacatcttcagggatcgtcttattatgctcttacccgataagcccaggtctgatatattttgttatgtgttaagccgactacaaactttgtgtggatttcttaatctccatggtagactccatgtgagagagaacccacctgttatgttacggcattatactctacttgtccaaaccctggttttagcttcatttgatatgttgtggaatgttttgctttgcttgaaagactctggtctaatgctattgaaccttctttgcgagactttttatggtggcttgggaagcttgtcaaaggaccacccgtcaccttgctcggttaacgtttttaacgtcttcaaggcttccacctccactaccttttcctgctgctatggtttgcctatgctcatcttctccactacaacatttgtagcaaataaatccaagcaacagagcaccttccccactccccgaacctcgaccaaagctctactttatgtagccttcctcgtgtcggcgaggattgtgtctttgacctcttcttcaacgccatctcgtctattgactctggcaatttgctcttcctttgattcgctcttggaagaatcgtcgataaactttgatctcacaagtaccaccaagcttctttgcttttggctccaagctctcaagaaatctttgtcgattagctctatctatcttagtaaccttgttatgttaatcttggattatggcccttattgttatgttttaaactttgggattgcttccctctatctctgtagttaccttctacactaatggaatgaaactaatccgttgtccaaaaaaaaaaaaaaaaaaaaaaaaaaaaatgatatattcggatttgtaattgtaattgtggctaattaaattatatcaagtgtaatataattaatatattttatatatcatattttcggtacttcagatttttatttggttatcaattttgttcgggtccagtttttttttttttttctaagtatagaaatttaggattcgttcatgtatttcgttgatttctgattggttcgatttctttttttctttaaatatttgtttttttgttcgtatatcttcggtctaagtccagtggcaatttaatcatcgaaatttaactgttgattgttacgttttgatttttgcataatattgtaatgatgcctattgtaatagtggaattaaatcttacataacggccggttcggtttcaaaaaagtgcattgatgcattctattaaaattggtagaccaaaacattcgggctgattttggccttctttctgatatttatttatctccgaaacttttgcttcttaagtctgtctctctcttctatcagattccacactaatcggaaaaaatg

SEQ ID NO: 23455 - DNA, 3003 bp, Unknown
  misc_feature (1)..( 3003): 2750-1469P.txt file - cDNA_ID_2141688; gDNA_ID_1620425; Annot_ID_156709
ggatctgctactgtcttctttgcctacatcgggtttgatacagttgcaagtatggcagaggaggtcagtgtcatttattgttgcagtatcatattttcaagcactggtatatatacttatattgctgtttcatatgcaggtgaaaaatccccggcgggatttaccgctcggtattgggatttcgctcctgctttgttgtttgctgtacatgatggtgtctgttgttattgttggtttagtgccgtattatgctatggaccctgacactccaatatcatccgcattttctagtcatggaattcaatgggctgcgtaagtccgttaatcggttaagatgcaaactattcattggcaggacttgttttgagtttgatttgtttttcccctgccattctgtcttatagatatttgataaatttaggtgctgtcatggctctctgttctgcattaatgggctccattctccctcaggtaaactagaaacataattcaagtgtttagatctgtaaaattaaggatttaacaatgagaattttgaagaacatatacacgctatgtggatttcttttgtaccaacttattcaccaaagagcttattcgtttttcagccgcggattctgatggcaatggctagggatggtctcttgccttcatatttctcatatgtgaatcaacgcacgcaggttccaattaatggcaccataaccactggtgtttgtgcagcaatcttagctttctttatggatgtttcgcaactggcgggaatggtaattaagatgtattatgattcattaatgttacctggtccagtacttgaagcaccacttagcctgtaactagaatttgacaagctttagttggtgtaggtgagtgtcgggacacttgttgcatttacaatggttgcaatatcattgttgatagtcagatatgttgttcctccagatgaggtactgataagattggaactggtaaactctatctttattcgatttcaccttagactacaatatagaagattcttgattaaggagagaagtctctaactctcttccaatggccaaaccagaatccccaactcctttataatgctacgcactagtgactagactaacaaggcttttatcaggtacctcttccctcatcacttcaagaaaactcatccagtcacgtcggaacttccatccgtagtaaacaacctttacttggcaaagtggatgattcagttgtcgataaggaaaatgctccaggaagttgtaagttacaattcatttttgcaaacaaggttataggcttatagctatttattcgcattggtgcatgaactttatatgttagctgatctctggtcttggtataagcaaaatttcatatctgttgttgattctgtaggggttctcaacaaaaaaaacagacggaaatttgctggttggagcattatgttcacttgtattggaaacttccttttaagctatgcagcgtcaagcttcctcttgccagggttagttcatcaacagtttatttacttgaggctctatctttcactgggtttcaaaacttgggcctttttctataatactcagctccattttatgcaaactatgataacagactcctccgatattctctatgtggtgttggtggattgttccttcttgtcggtttgattgttctgatttgcatagatcaggatgatgctagacacagttttgggcattctggaggtacttatgtcctttctttttcccaatgttttgtagtaagcatttcatttggcaacaaaccaaaaagttcagagttgtaacttagaactctttttgttctacaggcttcatttgcccgtttgttccgcttttgcctatagtttgcattcttatcaacatgtatctcttggtaaaccttgggtgagttatggatcatgacaccagatttgtgaatactactaaccgatgacttcactgttgatatacatttgttttgctaatgttttagagctgcgacgtgggttcgtgtatcggtttggctgttcctcggagtggttgtttacattttctatgggagaagaaacagctctcttgtgaatgctgtttatgtctccactgctcatctccaggagattcgtcgcacttctggacattctttggcttaagtctacatgaaaccatcaatggaagctcaaggaagtgggagtttcctttgtaaaatatgttcaacaaaatctgtataataatatatttttgagattggattatcctgtgtaaatacaaagttcaatgccactgctcataggcattgtatattttttttaaaacctaaatggtctaaatgttatctggtggactattgtatattttttgaactgctgaatttggtggactatgttgaatctggcgactaaaatagcaaatggaaggctatctgtgaaaacttgctgattggtggaccggatcctaaatcgactcgaatccgacatggaatagttataaaattcaaacggataataaactatcctacccgaattccgaaccaaaatccgaatatctagcttagataacggtatgtctttctaggatggtcaacgcattcttatatttagctcatatatgaaatgaccacatgtaaagttgatatatatatatatatatatatataaagggccacaatttaaagttgttatcagtcggttaacgtcatataacgtcgtgtaaattttggcatggtcaatgattaaatttgtatgaaatagtccatcaacgatttttacatgtattaaatagtcacatgcgaagttcacatattaaatgatattttttgaaaattcgcgtattaaaagaaaagtttccccaattaattgcatttaaactttattgtgtacagaattgcatcaaaacttaacccaaaataaaccggccggtacaaatcggttaacaaactctgttaaaaaagaataacctagccccttaaaacctcatttggaactcaaaaaagcagtaccggaaaataatg

SEQ ID NO: 23456 - DNA, 3000 bp, Unknown; identical to SEQ ID NO: 1622
  misc_feature (1)..( 3000): 2750-1469P.txt file - cDNA_ID_2141842; gDNA_ID_1620427; Annot_ID_156750

SEQ ID NO: 23457 - DNA, 3003 bp, Unknown
  misc_feature (1)..( 3003): 2750-1469P.txt file - cDNA_ID_2141872; gDNA_ID_1620427; Annot_ID_156758
tttatattcatatttatgcttcattctatcctcttctatgatcgaactgtgttgtgcttcgtctcgtgttattacctttagaagattaaaaacttcaaattatattttgaaggaataatcagaaactgtcatttacaaaaccaaagtattaagtgtaatagttttttaagaggaagaggattttgcttacatggttaactcggaaatacttaaaacgtcatcgttttgttgtttgtgatttaattgattggaccggtatgtaatgagattgatcgggttctgagaaattcagatccggttttagtgttgttgatttttggtcgactttaaaatctttcagtatatatgcttcgagttttgttttgctacgatttcattttgtgaaccaaaattttttaggcaccaccaatctagatgatcattttcaaaaacccaatgggtccgtagccattagccaatcaataactcacaattttcgtttagatgcaactacttaacattaaaagtgatgattataacaaatgggaataagtcattgggccacagcattgagttctcacaatttcacgtggagctgtctagaatctctacgaacatttttgtatactacaacatgtggaccgaacaaaaacaaaaagaaatatcatcccaaatactaatggcttacataaatttatgcactaaatgttataaagacaaaaaaggaaacaaaacatacaaagagataccgttcatacaataacattccttcgctgtccaattacgtttggtgagacaattccctctttctcatgcaaccagatttgtatttcacaactcatcatattactccaaaatcataacggtacccatttttggagtgttcttagcttataatggtaatagtgataggttttgttgttttgattgtgatctataatccttagacgcaatgaaaagttagttgtaattacaaatgtcgaccgcaacgtgtacaaatgtttcttgtttccaagtttgtggagtgggcacaagtcaaacttaactgcataaactaatcaaatggtaatgtttctaatcggataacgtttctgattaagttcttttcgatggacgattcttgttatttctcattcgattcgatcgtgtgggttaggtttatagattcaaatcaatcaatcttccatcaatatattttatgatgacccatgacacctagcaagtagcaacataacaaactgattaatatcattactaatatataaactataaactataaagtcgtggtattaatgagaaaatgagggcatgaatatttttattgttttaaattagtaaaaacaaaatttaacaagatgactcagtggcggacctacgttacaactaggtggagcacgtgccccatattaaatctactaaatattatataagttgttatttttcattatattacagttagctcaaatggtttttcggcaagcaatgccttatactaacccaagttcgaatctccaaaccgtcacttttgtaagaatattttataatctacatacaatttaggtaattaaattataattaatactatttatataaatgatgccccacataaaattaccttctagatccgctcctgagatgactcatcgtcgtttttgttgcgccgcatgagtgattactttcaaatgtgaaagcattttagatgagtcgttctctacggttgaattatggttttaaaatgaagctgtttaattacacgtttcatgaattaagtttggaccgtttcattttttatatcgttaggagatatgagcctgatctgatctatatttaatatagttcttatctacatgagtttctattatagttcttcctacattcatttattataaggttttctcattgccacgtataatataagcacatgcagatataagtaacatcatatcattttacgtacttagaaaataaaaacaatatggaagttagtcccaaaaggaaaaaatgatagtgatattgattttagatagtaatattataactatgtctatatagttcactcaatatccgattcattaagattgataagccaccatgtaacaaaaggataaattgggttatttgtctatacgctaaaccgatccaaaccaaattagagagaatagacagataacccaatttttcttttccaaatccaaatctgaagaaaaataaagatttaatttttttattatacatgtatttgaccatctaatgatgtaaagcagatgaatcaaagtgaaaaacatgaacgaccatcataatttcataggtgacaaaacttattcatttatgagccacacaaaaaaaaagaagaagtagaaatatatgtcgtcgacaaatattaataagtggtccaagaaaatagggttatcaataaaaacattttgtatacgaagaatacaagttccagttacggaaacaaaagtgattcacgtcgacataatgtcatatgattctgcgtcaaaaacgatcgtttaattgtctctttatctgtttatcgcaactttttaatcatttcattatgaatccttttgcatttcgttgcttgctcccgtataaccaatcggattctttatatgatttattaaaaataattgcatttggaaactaatataatcaccaaaacaatcaataaccaatccttgtctggtcctattttaaaccggagttggttattgactgtttctaggtaaactaactccggtttaaaataagaccaaccaaaggaggtttcgtaataatgtaacaaatcatgtccacgtaaacaagtgagtcacaacgtcaagattctcgatgtccttctataaattgcctctgttccataaagagaatcaccactcaaatctcttcaccttggcaccatctataaatatcctcaaacattagcctctttaagaaatcaattccaaccttttaaagattaatcttgaaaagtttctaataaaaggaagagaagtgatcaggtgtggtgacgagtaggatatg

SEQ ID NO: 23458 - DNA, 3000 bp, Unknown; identical to SEQ ID NO: 1627
  misc_feature (1)..( 3000): 2750-1469P.txt file - cDNA_ID_2141889; gDNA_ID_1620427; Annot_ID_156764

SEQ ID NO: 23459 - DNA, 3003 bp, Unknown
  misc_feature (1)..( 3003): 2750-1469P.txt file - cDNA_ID_2141901; gDNA_ID_1620427; Annot_ID_156768
cttatagagaacatgaatcaaaaacaaaaaatgtgatcttagtctctaaagacctaagctttcagcaagaaacaagctatgactcgcaattctgtctggataaaatctactacggagctacttgatcttctagttttatcacacacagaccataggaatgccttacaaacgaaaacatatcacgatagcgacaagcgtgaactgaaagctttagcagcaacaaattgttctctgaatatgactccattgattaaaacgtaagtcaagactattacatgaataacacataattcaaaacctatcgactttatatagcaggatacaagctaatgatcataattctctttctcagacacctagattcttacagggtacatgatacaaacccaaaaatgcaatctcagtctctaaaacatagctttcagcaagaaacaaaaagcaatgtctcgcaactttcccatcaaaagtacactagagagctacaaaataatcaaacaagcttgaaaagcaaaaaaactatctttaccatatgttcattgacctgccctgttgatggggccatgaattgactaagaaaaatctcatctttttctggattctcttccaaagttattaccaataacccagaaaacagaatcaaccagaaaactaaacgactccaattctgatcacccattcctcctcgaatcattccaaccatatcttttgcttctcatttcatcagatactcaatagaaccaaattgccgattctacagctttttgctgaaattcgataaagatcgaaactttaacacaaaagctcaacaaccctgatcgaaaatttggagctgacttcgatgcaatttccttggaggaccaattaaattaaagcttcttactacaatgccacgagatcaattacacgttttcgagacagcacaaaaggggaagagttggtgctaatgattgttggccagatccaaatgttgacaatgcgatttgtcgtcggtgcgttcaaccaaacccagaattttgaccagagagagaccaaaaaagtttcaaccttttactttttccgagaaaagtcgacgagataaattcacggagatattagctctcaagcttcatacaaatattttctcgaagctttctcgttctttttttgtttccaccaaactcaatcacgcgaaatttacgcagagttattaatatattggattatttgttttttcttggttttatttctcaaagaaaaaaagagaaggtaaactaaaatcgctgttttaattcttttttatatatattatttgtctatttattttagtttatcatgttattaaaattaaatactaaaacttcagttttcatatacatttgatattttttctaattttgtgtattaacttttaagtaatgtttttttatatagaaatgaaaacattgtttataatgatttcttcatttttgttgttacagttaaggaacagctaatcatgtttatctttttttattttcttgtaccactttaaaaccagattataaataggtaaaatagcaatagaaacaaataaattataacctctgaagataaaatcatttgattccatgtttaaagatgcatgcatgatgcatggcccatctctcaatagtcaaattgcttgggaaagccaagtgttaaaattaataaaagactcagaatcttgatctatcacgttacgctattgatcctttcacacctattttcttacttctcttaagaaagttcacaccaaaagatcaaactatcctaattccatttatcattggaaccggaaaactcaaatgcgtataaacttaagtttggtattaattaattgggttaaatttgtttatgaggagccacccctattatagaagtaacttttgattatgaacttcttaaattaaagaacatctcaataatgaatatcattgattaatcaccatagtgttctttatggagattctttataactacatccattaggcatcggacctttagccagtgaatcgaatgatgtattacagtgtcttggaatccaataaaactgcacctcacaaaagtagtgtaggttttaataaaaattatcaatagagtaacttaaacctaaaaaatgctacaaactataatacttttttggtaattaaggaaatttttccaagacaaacacacaaactaatctttggcctctatacaaaatccgactaatctcgttatttatagtgttcacgttgcatatataattgcctcaacgagaaatagatcacagtgatttaaacatcttttgatagtaataaatactttatacaaaaccaattaaaaataaacaaatacttctttattatacatcgaaataaagatattttttatataaattcttttgtattagttgtcgttttacaagttgaattttgttttaaattagttgttattgtcagtttttaatgtagatgtttaacagattttccaattttatccctattctgtaaacttatttattgatgatatggagggggtatcagttatcaaaatagtacaagatgaagaatcgaaatggtatggctcaaagcaaataagacacatttctttgtgacccttcgagcaatttctacgtcaaaagaacatattcctctctttacttaaagcatgctaaagtatagtcacaaagaaataagaatctctcccaactttttctcttatcatcaaataattttcagcacccactatttttccataatcttcgtttaatttttcttctttaatctactttgcacctatcatgtcaatctataagtatatatattttacatatgctgcaaatatacctccacaaaaaaacaaaagaataaacattctttttatatccccattaaaatcaaaatatttgtatcattttttttattagctatctcaaaattatactataagaacaaaccttgattccaaaactcacacacacaatcaaccactttccttttttcattcgtctcaatttctctcatg

SEQ ID NO: 23460 - DNA, 3003 bp, Unknown
  misc_feature (1)..( 3003): 2750-1469P.txt file - cDNA_ID_2141915; gDNA_ID_1620429; Annot_ID_156809
ttagttggaatatgctctatggatgctgatcagtgaccactatctaattgactaaaaaaataatcatcattcatccaaaatatcctaaatagattttaaaacacccaattacatcagcaactatatatgttacgtgagcaacagcgctatacatgtagaaaataatttccagtttttataacattacaagatcaccataaaaagtacggatgttaaaatgggctaaacatttagagtcggcccaggtccgctaaaataaataaaagcccggtcccgattaaatcaaaggagaaacgtttgggcttaaatatggttttgcagaaaaggtttcgggcttttatagggctggccctattatactacggttctgttcgtttctccatttgacagatccatccaattgatccattcaacatgtccatctagatgattcattcgactcttgttcgttttatttttagtcggttcatttgactggaccatccgaatgagatgttgttcgtttacttatctctatctccatccaaatgatttgcaataatacaaatacctaaaatacccatgctttcatctaattcttaatctaaaatatatttaaaagtaaataaatttcaaataatagttttttatatttataaatttattttacggttttggcgggaaaacgtgattttatgatttgacgggaaaactcgattttacagttttggcggaaaacaaaattttacgtttttggcgggaaaacgtgattttacggttttggcgggaaaacgtgattttacggttttggcgggaaaacgtgatttttgcggttttggcggaaaaacacgattttacggttttggtggaaaaacgtaattttttggttttggcaggaaatcacggttttacgggtttgccgggaaaccgtgattttgcggttttggcgggaaaatagaattttacgatttttgcgaggaaaaaatgattttgcggttttggcgggaaaacgtaattgtacgggttttgctgaaaaacgaattttacggttttagcaaaaaaaatgattttgcggttttagcagaaaatttaattttttattttttaaaaaataattgtaaaataagatttaaatctatttatttattttatctaaaaatacatctaaataatcaattgaaataattagggtatttttgtcatttgttattttagattgaatcatctccatccaaatgatccaatttagttcagtcaaatgagtttcaaaatttagcctaaattttcaaactcatccagatgattcatttggatggatcatctgaatgaaccgtttttggcaccaaacgaacatcaaaactcatctccatcgaaatgatccatcttactgatgaaacgaacatgcctacaaacttttttttttcttctttaacactaaacgacgacgtctcttttttttttctttttttttttctttcttcttcttcttcaatcttctttcttcgatctcttattttttaaactctcttctttgattgtgagaagccataaaaaaaggttcgatatctctctcttaatctttcatctttctcatttttctattctcatagattgatatattctctatctttggaatctgattcataggattggggtttaatggttttcgaagaaatctgggttaaagtgtgttcgtgtgttctctaaatttgattcactaaacgtgggtttcgaaaaattgaattctgtgtagctatgatcttgtggcataaggcaaactgattcctgaagttggaacatcgttctctggttcagtagagaaccgacgaacacccttccccatctccgacgatgttgtttttctgcttaggacacaagtttgttttgttttttttctcttaaactttcatactttcacacactcataagtttacacacattacacatatatataggagatttcttctactcaccatacccactctcttagaccttaaacttagtcactatttaaccttacttctagacattagacttagggatacaagcaaccttacacaaccttaccttagccactaacaaccccaactactctacctcaagtacttagctagaataagctacttctacgaatgggccacaacaaaacatacttcaccactttgggcctacacaacttcatcagcccaataagataaaacataaaacccacttctcttgtcttcttcttcttcttcttcttcttcttcttctcacgtctctctcttacgtcgtcttcttcttctagtttccaatcttcttgttcttcatcattgttgtttccttctcactgatgttcttcttcttctttgcaggatcaatcggagagttcaatctcaacagacgaccataccctcgatacagtagctgctccgctcatcaacgtccatttcgccgcctttagccgtcaacgttctctggttctgttgccgtacaaaattcttaaaggtcgcgtttttatgtaagcgtagggtttagttgtcgtcccgctctttttaattagactttgttaatttaattaggttaattagataagacctaaaacggcgacgtgtaagctgtcgtcttcttgacctttttggtgaactcctccttcctctctatcggctatcgctcgctgcgtctctgtgtcttgttgcttggagcaagctctccagcgtgagttaatctaatctctgtaatgattaattaccttcttttacggtttctggaattgcatctgtgtgtgagcacttggtttgaaatatgatttaactagtgaattcgataatgctgttcaataagaatgcttagaaaagccttaactgggttttactcaccactcttcttattgaatctagaaattgaaagtgtgaatttttgcgagttctcttattcaaacttcactgcgaaaggtggagtttttcgtctctgttttctccctaattcttatagtttgagctaatggtgttaatcaggctcaagaatagataaaataaaattatg

SEQ ID NO: 23461 - DNA, 3003 bp, Unknown
  misc_feature (1)..( 3003): 2750-1469P.txt file - cDNA_ID_2141951; gDNA_ID_1620428; Annot_ID_156779
cgtgtctcactcgcttgagctgatgaagtgcgataatgacgtggcatgttgggatggagaccaaagaccagcattttattttattttatagtaactaattttaaaaaccaaacaacctgagattaaaattttaatttttactgtactgtagtaaatttgggtcctgattaagattaggcatatttatctcatagtttataacaagtagcagctgaaatttgtattactagcttatagtaattaaactaaaaactacgttccaggttttaaattattgtttaaagaagatataataatatattaagaaaatagttaattaaggtaaggaggaaagtagggtttggtctgtaggttagggttcaaagagggaagagattaggagaaaggaagcatgaaggcatgacccatttcttcaattagtgctccttaatctggtgacacgtgtaggtcccacgtgtaatcacttcacattgttatttttcaaaaaatcaattagtaaaaacaaaactttgtccatcatcaaatagtagtagttttttatgtgtggttacaatattgtaagaagctctcccccttttactatgtaattcaaccccactctaatttttaaaatatttatgtaaagctttacccgaaaacaatctatcatgggttggtaatgacacatttcattaacagtgttagagaatgattcctttaatttttctacagtaaaatgttaggtgatctcattgtactacatcggaaaatactcaaaattatgtcgtgtaatttagataatggacgaatatggttttgaaatatttatggatacccaacaagatttcttaactagaaagacaaaaaaatagagcacattttgctcgttttccatcaaccctatttctccaatttgttcacatcatgatcaaaaatacagtagcaattaaaaaataaaataacaaatataaatggctatatagatcaaccctatctagctattagtattactagaaattgacaataaaggaaacattcacgtgtgtgagcatgtactactctacacacatgtccacagttattatatactgagtactagtatacgttgatgttatcaataataaaaactcgaaattaagtattattttcttataataatctatttaaccatatttgctactgtactatttagtctattttcttttgccaacctttgtattaaatatttgtactattagtttcaattataggtctatcactatgtatatgtccgaataatggtctaaaattgttaatataaaatacagattttatttcagctaaagatagttgaaattacacaagaaaatagaagagataaaaatgatcaatcagctatgtaagacgtcgtatggatagttcaataattgtggtaatacttaaagacatatatcaaaattatcaacaagcctcgaacacaaactttacaaaaagcctgtgtctactttatgagtgtttgattattaaattgcaaggtcgtagtataaaaatttcgtaggctttcaggacacaagattaaattcatttatctaaatggtgatggagtacttttatttttatatatcaaaatggtgatgatatacgaagaccatatatttagattattaaagaaaaaacgagaaaagaagaaagaaaatataaaaaaatggtttttctttttaacggacaaagattcctacaatggttgcttttagaccacacacaaatgctacacagtactcttgggtcccacacctcttagcaagtgcgttaccaacacgtgaatttcctctccccattttctcgtccttttcctctcaatattgtatcgtctcgttttccttgtcatatcgcgtgtgacgtgttattggcttattgctgaacagtcttcttttttattttccatcgttatcctgatttttttttttttccaaatttgattttcatggtttgtaattttgcaatagattttgtgtttcacagagagatagtttacgtgttgttaaaaataatttgtgcaaaatagtgtgcgtgtgttaaatattaaacgatatataataattagaagaaaataaaaagttttgtcgcgattagttatttgatatttaccttgttcttttgtttatcgctgcgacaagcaccgacggtataaaatataaagaaaaaaagaaagagagatgaaggtgagatgaatgaaagagtcgcagcgacagatctgaagagataggagaaagggaatttgagacgctgaaaattccagcgtctacggaatggccgaattacagtcgatgcggcagagatgaaaaaaatgagaaatgaaagtgaaaaagagatgagaactttttttgggtcgcaggtagctgacgcagcaatcaacaaaagaacatggccaacgttttagtagatactactataaaagaaaaaggttgatttaattcattcgtaatttggacttaatttttttttaggaacactaattaatcttatttgccagctgtatgagtggactacaataaactcttgtctataaaccagattttcttcctttttaacgcttccacttacaacaatatatgtaaatatgtaattatgacggggcatacggaaatttaatttttgaagcagattcatcccattagccagctgtattaagtggtaatccaagagttaatttagttgttcagcaaatgattttagataaaatcaactactagtttaaaataactatcgaatgactgttaaggcttcgtattttttgttctgccatcaggatatcataaatatggttgaggttcgtataatattcgacgatcttttatatatctgagttgtaattgaattagagaaaataaaaaacagataatgaaacgtctttgtttttccataaaaagaaaaacagggtaaattaaagtacgagagattcacgagacgaaaattcctagaggcgcacgatagccaaaagaccatagaaaatgacatccgaaatatctttaaaatgctaaaatg

SEQ ID NO: 23462 - DNA, 3003 bp, Unknown
  misc_feature (1)..( 3003): 2750-1469P.txt file - cDNA_ID_2141959; gDNA_ID_1620428; Annot_ID_156781
ccctttaccagcaagcggactttcaagggtcttgcaaggtcaagaatactcgaccttgaggacgaaacatactgagagtgtagagtgtgatgctcctgagaattctgttgtctggcaatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctagggagcaagtaacaaaacaacccttcacgatacaagaggagacagcaaagtcaagagaagggaactgcaggctctttggcattcctctgaccaacaacatgaatgggacagactcaaccatgtctcagagaaacaacttgaatgatgctgcggggcttacacagatagcatcaccaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggtaaatttttgcaatatgtagcacaaagtgtatgaggttgtgataacccttgaatcacttttcaactaacacatgacacattgatgtaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcagtaagattttgcaaattttccatcttagtttatatcgatgttagtgtttttcttataacactgacacaatgatctctcttgcagggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaaacaaacaaaataaccaacaacccttttgctgcaagccgaggtatgtaaaagcttttgagatattagtagactagagacacagccaaaagtttatgtcattacattcgactgatgtttgttctgttaatgacagcaggatgggggtcgattggtggagactggagagcaaaatgggatgatgggtttaagataagatattaaaaatgcaatttttgaagtattttgttggccacttagataattagcatcttccatcacccttattatctatctaataataattaatagatattataaagtaaaacataaaaaggttacaggtattatatagtagaatatgaaaagctcttttataagtagaatatgatggtgtggagttgtagtcggaggctggtatcggttctttttatggatgtatttttttccttcttccaaagatctcttgaagtctttttattgtttatattaatcccaatgtacataagttttcaagctcttgcccttttttaattatcttgtcgattcacattttctcaacttattctcttgctgacttttggttttggtctggtcttgtcggtattttgcagcttttcgtattagacggtgatatagatatattcacgaaactgtaagacctcttaacaaacggattccatttcgaatccttacattaaataaattcggatgtttctagctacaatctgaaaattaagcttgcaatgagcaaaacagtgagccctctttttaaagtactttgaaaaaaaaactggatgctaaaatttgttgtttcccttgtaacaatgaggaaaacaaggtttgggttttcaagtttatttctctagctatgctcatgtccatataaacgaatccgctgaaaaacagaaagatgacaccatggcaaacacatgatcaaagtttcgtgatctatggtttcattctatcatatggctcttcataaccaaacttgtatttaggtagaactctatctaaatcaagactttaaaccatatgaaacacacaacaccggcaactctggcatactaccgccttaagccgacaatctcaatcgtcacagaaacacaacaaacattttatcaaacttgctgagtttatggaaaaactttcaattgtatcagtttatgccattatcttacaacaatacaaaactgcatagttaaataagtggttctctagctccttgtaattctaccatcgacacatatagtgataggtctgatatggatgacacatcaaagcagacaatctaacaaaattattaatttttccaaaattccaaataaacaataggataaagtaaacaaaatgtgggacctcaccacttggggcacactatatgagggaataaacacgcaactccataggaagtttcttgaagcctaaaacattacgctgcttctcgatcttttaacccccattattacatattactccttcctacattattcttcttctgctttcgtgactttcaggggacacttttgtttttataacttacgcttaaaatcctatgaattcgccgccggttgacgcaatg

SEQ ID NO: 23463 - DNA, 3000 bp, Unknown; identical to SEQ ID NO: 1638
  misc_feature (1)..( 3000): 2750-1469P.txt file - cDNA_ID_2141987; gDNA_ID_1620428; Annot_ID_156788

SEQ ID NO: 23464 - DNA, 3000 bp, Unknown; identical to SEQ ID NO: 1637
  misc_feature (1)..( 3000): 2750-1469P.txt file - cDNA_ID_2141999; gDNA_ID_1620428; Annot_ID_156791

SEQ ID NO: 23465 - DNA, 3003 bp, Unknown
  misc_feature (1)..( 3003): 2750-1469P.txt file - cDNA_ID_2142011; gDNA_ID_1620428; Annot_ID_156795
tatgactggtttggtatatgcacgacaggacaaccgatacaatgacagttggttccaaaaaaaaagtttaatcctaaatatatgaataatcgaatcgatcaataacacgttgacaaaaaacgaacaaataatcacactgatgaaccactttataatgaacagagaattttgtaatctgaaaattttgaaagtcaagaggttaatcaagtaattatagaaaggtagttgtaacgttggcttttgtggaactaataacttacgtgtctttaaacggcggctactttggaaggctacgtttcttaatttgaacctcattttctccattttccttcgtttatacgatatctttttcaaaaaagtgacccaataaccacacatataacatatttagtataactttgaatataaacgaatcaatgatatctgaattttattttgattttgatcttgatttttgttgttttttgtcgaggctattgccttgccactttggatgaaggaacccggctaaggtaagaccccctgcctaatattagcctccggcgaattttgcactcagaaattacattatgttatagttttggaattttagtttaaatttgtaaaagtattaaaacaattggtcaactattatattaattagctcaagagtgctttcaaaaacatatcttaaatttaataaagaaatattccaatatcttaaccagtactaaaagagaagatcagaaaatttcttataaaactttaatctaataaaatcatctacgactctaccattcaatatttttttgttattgttttatttacatatttcttttaatatttacatatctcttttcctttttgctaaaaaaaagttggcataaaaattactaaattttaagcgtaaaaaaataaaattaattattgtctattgccatttttggaggatggatatgatttggaggaatagttaaagaaagtgctaaaatctcctttagtgagtcacaaccgttgaccttcaccgcaaggcacaagagaccaagtctctaacccaacacaacacaaaacccataaactgaaaagactaacctaccctatcttgccatataaatccctctcgagcaacgcatgttaaataaacctaatttatacattcattctcaaagtcaaaaggagacagggagagagagagagagagagagaattcaaagcgttttttttttataaattaaaggcatgagaggttcaagaacaggttcttcagacatgagtgcttggtgttctgctgttgtgttattgtctttaatacttttgttatctgttcgtgaaaacaacgcttctaattcgattagaggttctcaattctcaacgaaaccttgtgaggagatttacatcgtcggagaaggagagacacttcacaccatcggcgataaatgcggcgacccgtttatcgtggagcgaaacccgcatatccatgatcccgatgatgtctttccaggtcttgttctcaagatcgcacctttttacttcaacaggaaattgtaagacatataacaaatacgtttcttttttctttctcttttctcttcttttaaaattttgtttgaagcatactttaccttaagtatgtatgtatatattactaaaggattcaaaaataaatacagagatttgaaagaaacagagcaaaaacagagttgtgtaccgtgagttgattattcatgttttgtgggtttacaagttcatttagatttaggtgtatatggtaattatcgatgatttttggtctttggggtggaaaatttgattaaacaaaattagtagctgatgaatgcaataacgaaacgccaagttagaaaaaggtcaacgactttacagtctttactagtggcaaaatatcaataaaggagttatgttattctacaaataaaaagcttcatcgtttaataattcttccacttatagaattctcgtatccaaagaggacagattatttgatgaataggtgtgctatattcaatgatgtgtgaatttatgcttagaaactcgtggatgaaaatatgaattttattgatatatacgaatttcaaagaacaatagccgcatggtttgtgtctcttgctataatccaaataaggattttgttttggcaaaaaccttaagaaatttttacaaatacatggtcaagttgcccattcccaatccatatcagttcttcaactttcgagccctaagccatcgtttcattgacttgtaatgtgggtcggacctgattatgttggaaacccaaacttgaaatttttgcaagtgggcttaaagttttgaagttttttagcgatatgggtaagtagggattttatggatcgcatagtggatatctttaaagttagaattggtcgcatgatgcccaatgagtgaattatgtcattatgttaccttgatttctccctggtcgaagagaacttattcgtaggtttatcgaatttgacataatatcatatgttccgagaatgctttaaaacttcatattctgttgcttgttaatgtaatatgatgtattattatcacaacaataaagtattatctgaacgttgcctcattcgtcccgttacaaataattatgtttgaaatatatatatgcaagtcaaaaatatctcattctcaattaattacataactattcaaaattatcaccaactctagttctagacttccttttttgtatgcaatattccaaaaactaataaactacacacctagactaattatgtcgtcatctcctaacactatagcttctaatttcaaaaacaaaattcccaaagtaaaagtaaaatgaacattattaccgtgcatgtcgacattactcccaaagaattgcacaaaatctccaaaacctctgtaaacaagaatctcttatatataagaaacgtgagttgttcgctgttacaaacccacaatcaaagccacaaaggaagaagaagaaaaaaaacaaaccctaacttttgtcaaaagtaaacgatg

SEQ ID NO: 23466 - DNA, 3000 bp, Unknown; identical to SEQ ID NO: 1635
  misc_feature (1)..( 3000): 2750-1469P.txt file - cDNA_ID_2142022; gDNA_ID_1620428; Annot_ID_156798

SEQ ID NO: 23467 - DNA, 3000 bp, Unknown; identical to SEQ ID NO: 1656
  misc_feature (1)..( 3000): 2750-1469P.txt file - cDNA_ID_2142053; gDNA_ID_1620431; Annot_ID_156862

SEQ ID NO: 23468 - DNA, 700 bp, Unknown; identical to SEQ ID NO: 1657
  misc_feature (1)..( 700): 2750-1469P.txt file - cDNA_ID_2142105; gDNA_ID_1620432; Annot_ID_156880

SEQ ID NO: 23469 - DNA, 3003 bp, Unknown
  misc_feature (1)..( 3003): 2750-1469P.txt file - cDNA_ID_2142132; gDNA_ID_1620432; Annot_ID_156887
caaacagtgaacttcaatgagtgtgaattgattgtcacgtcacagctacactcgccgcacgcaaatatagcgaccataacggaagtgatgacaaaaagagctctgacgtttgctacggagacggtttctcaaatccaagactatcttctcccaaacgctacagatactcaggacaaagccgttttctccgcttgcgagatcgcgtacaaagccgtggtttctcgtcttcagagtgcttatacgtcgatgaagaacagtgattacgtggcgatgaaggcacagcagaatcaagcacttgggtatattgatgtgtgtgttgagaggactaacttctttcgccggactccgatggtagcagccaactattatgtgaggttgacggcgaagattgcttccattgcaggccagatccttgctcctagtacgaccacgtccctgtccccttgaacaaaatattattttgtatttttgttagagaaaaactcgagctttgattcatcaataattatttatttatttattaattttcgttgtcttttctcatagaaacaagacaaaccacaaaatttagcatttcagaaatttgtagaattcagtgaattttggaaattttctcacaagagattcgtagaattcagtccactaagttttctatgaatgatgtggttattaagataagatttgttgtgtgcaagaaagtgagttaccgaacaaacagccgtcacttacaccaaaaaattcaatatatatcatatatggtgtaagaaattacacactcccaaagtccagcttgtgacgagaggtgcctttgaacttataaaccatctgttattcttttttctttccaatggtcttaggcccggtcaaataaacgaaccaaatgtaccgaatcaaaaccaaaacaaaaataatcgaatcgaatcaaatcgaaaattgaaaaataactgaatggttactaaattttataaccaaaagaaccgaaaccgaatgattatgtattgaaatatttcaggtaaccaaaaatatctcaaatataaatatattttcaaaaatattagttatttctagactaaataattaaaaatggttgaaaaaaatatatattatagtaaaaatattcaaaaataaccaaaaatatccaaaatatctgaaaatattcaaaacaaaataaccgaatagatactaaattttaaaatcgaaagaactggaaccgaaccgaatcgaaccgaactttcaaaataaccgaatggatactaaagtaccgaaaaaaccgataaccgaataaatacaaccgaaaccaaatggataaccgaacgtacaagaatatgtgatcttcttttaacatttacacccaaaaaaaatgtgtgatcttatttcctccaaatgaaatattattatttaggcccttatgaatacccgccattttgagctcggacgtccacgtcggtctaatccaattgcctacgttacgcggttctttctgcgtgaattatgtcactctttctcttttttggggtgttcattagagcagcaccaatggtggtctctcttatgagtcctttatcataaaaataaagaaaaataattaaaaagagagggacagaagagagaggagctccaaaaacccttatttaagggacagtctcaaccccaaatatacacgtgtagttcttttagtagtcaaactctattaaaaaactaaaatataataacaacattaaaatattattattattttggtttttagggactcataagagagaccaccattgctgctcttagtacactagacaaacaaatatactctatttcaaagtaatacttatctagaactatgtatacaattattacatattgcaatacgataaaaaagagtatcatatctagaaaagtggaatggtctatacgtttgttgatgcttaaagtaaaattttaatttatgacataatttggtagaattctcatctgaatatataatagtagttgttagaaattaattaacttgaaggtaaagtgtgcaagtcataattttatgttacctcctaacttacacttcccaaaataaattacattcgtaaagtttcgtataatacgtaatccatacgaatcagaccaaaaaaaaaaccaaaactcaactgtgaaaaaaatatttttgataataaatattgttgttgtgtaacagtgtttttttatatatatataacaaatggatggattatggaataattttaacagaatatatgggtcaaacttttaatattatgggaatagaagctgacaacacacacatcaaaaagctgggacacatcaggtagtaactgaagtcaaacatagacaccaaactcaactaaacccactctttttcaaaagtcagtgctctttctctttgtggggtttgttgtttactatcgacactttcaagggactccatttttttcctatttttataattattaccaacaccaacttcacaatatttgttctgtttttgttaatatacaactttaccggatttgtactaccatcttcttattattctttttttcggatcatatattaaaatataaaaaattgcacggttagtgagtttcagaccaacaaccatatatcaacccgctctgtcttttatctgaaaaacgtgtgttttttccacatttggttgaatctgaatcacataatatatgtactctcaattacaatgcaaaccctaatttgtacttctgtgcagtacactttctctctctcttcattcatttctcttcttctataaaaaaaaattcttcaattcaatatcactaatatgcgattctctcttcttcttcttcttcttccatcttacgccaaacctcgagtctgcgaatcattcgattctcagattcgcatattttcttcgaattcgctaggctcaaaacgttgtttccgtgtacaagaagcaacctaacgatttggggccaggtgaaggaagagctgatttaggttattgagattcgttttcttcaaatg

SEQ ID NO: 23470 - DNA, 3000 bp, Unknown; identical to SEQ ID NO: 1661
  misc_feature (1)..( 3000): 2750-1469P.txt file - cDNA_ID_2142142; gDNA_ID_1620432; Annot_ID_156890

SEQ ID NO: 23471 - DNA, 3000 bp, Unknown; identical to SEQ ID NO: 1658
  misc_feature (1)..( 3000): 2750-1469P.txt file - cDNA_ID_2142147; gDNA_ID_1620432; Annot_ID_156892

SEQ ID NO: 23472 - DNA, 3003 bp, Unknown
  misc_feature (1)..( 3003): 2750-1469P.txt file - cDNA_ID_2142209; gDNA_ID_1620433; Annot_ID_156915
aaactcgaagtatctcccgtagtctgtgagttactcgaaaccaacttaggatccgatgatgatgccgacgacgaagaagatgatctctgaggtatagcttttaatccagaaaacttatcttggtttatcataaaaggaagagaagctaactttgaagaattcaaacgataagaaaccgtttgagaaaacttagccctcctaatccacgaagtagcctcttcatccatctctaagctcgaaaacaaactaaacaacctttttatcaaagactaaacaaccaaaactctcaatatctccaaagtacctaagcaaacccgtgaatacgaatgagatgacttgctgcaatctccaacgatctcatttccacgaagatacaaaatcttttcaaatccatcgaagccccatttctcaccttcaaccattaatccacaaaaactacaaatcataaaagaagaaaactttcctacgaatactactaagctcgaaatttctccaaacgttcccaccaaaatcaccggaaaatcctgaattacatacctcttcctacaaaatcaagcaacaatactcagaaaatcgaatccatagaagctattgaaaacgataatgagggttaaaagatcgatctgaatcaacaaatttaggaaactagttttcgatatttgtttacctgaatcacaacaaaaaactatgaagcgtcgtcgtgtgttaaaaggaagagaagaggaaagccaagtgaatcggaaatcaagaagatccggcgacttgaagccggaggaagatggaatcgaaggagaaatttgagagctaaaccataagacgtttttggattctcaaagacctttttgacgaatccagacctcttacgcctttttagatggattttttttttctttttttttcacagataaaatgtggaaaataaataaattcttttggaatatttagaaaaatacgttaaaacgacagcgtattaatctgtctgtcagcatctctgatatgctctaattattctgtctgaaagagaaatttaatttaggttcccttttttagtcaaataaattctaaaggccatagacttcggcccattaataataaaactggcccaaattactttatgatataggccatgatgattgcttgatagtaaccagaaacgaaagaggcctcaacgttgacaagcttcactaatcctatgagaaaaactcttctgttttttttttaaagaacataattcacacaaattaaccattctaaacaagaactttaaactacataaaaccattcctatctcttattctcaacattggggaagtgcttaaacaattgttacaaaacaacttttgaataaatacatgctagttttttttttctttgtcaacaactttattagattgactcaaaacaagcccatgctaggtttttatatcaattaaattcttgtttttttttcaaaaagaaattaaacattgtttttttttttttttgttaattaaaacatgctagttgcatgaagttataagttctgtgatgacactgttttaaattatgtattagatcatatgcatctatatttttttctattttatttgtaaaagagaaaattataaatgctactggccaaaaatacgtgtgtgtgtggagaaaacaaaatggccaaaaaataaatgataggagaggaatagaagagaaagaaagaaagatttaagaggtgagtccaaaagattggtaaaacacaaatgcttaacaacagagttaatttttggggacaccacacacatgacacatcactttgtctccagacctatgtctgtcctacgcctttggacatacccttttctcttttatccgatcatcgtatcctacacacattatctcatgattactaatcttgtcttcctttttttttcggtttaaagcaataagcgatatgtacacatcgcatacattaatattttacaccactagctattttaagtttctttattgaacatgtgtacctagctagctagttcatatgatcatatcagtggaagactggaagatatactaaattatacacaaatatactttctgttcagcaaatgttttttgagtcaactattacatttaattaatggtttaaaatagcgagctaagagtggagttaaaatggatgcgacaaaaggaaaatatttgaaaatttgacaacatttttaagatatatttacaagaagtaccaacctctggtcatcattgtattcttctaaatcgcagaatacaaaggttagtacaaaagaatctatcaaataatgggggtactggatttgtcaactatatcacttggaaagcttatgcatggggtataaccaagtacgaaagtataactttattcttaggtcaaacttgcacaaaatattagggttaagaaagtcacctgaatgatttcacgggaactatatatggttaatgaatacccaccctataaaaaaaaacaagagtgacacagaaaggatacaccatttatagacaaactagaactggcttaattttttcgtagcttgcacaatttcatatatatttttaagaaagtcttatggaagatatgtacattaagaggtcatgcgtttctgatttatttgtgacaacctcagttgaaatcattttgccttgttgagcgtttgtgattctggcttcagttttgattctggatatacttccagtgaagttaatatgatttgtaataacaaactagacaacaaatggctagatgtcgaaacttgaaacaagaaatatcccactcctcaattataatttcataattaaataatcaagtttgatacttgtcacatcaaaactctttttcctcattggcctgtttctctcaaatcttcaataaattctctatatatatatgagaaactttgaacctcatttttcatatatatcactgttcttcttctatattggagttcatctcttttgtttctaaagaaagagagagagagagagagagaagagaagatg

SEQ ID NO: 23473 - DNA, 3000 bp, Unknown; identical to SEQ ID NO: 1685
  misc_feature (1)..( 3000): 2750-1469P.txt file - cDNA_ID_2142244; gDNA_ID_1620435; Annot_ID_156981

SEQ ID NO: 23474 - DNA, 3000 bp, Unknown; identical to SEQ ID NO: 1692
  misc_feature (1)..( 3000): 2750-1469P.txt file - cDNA_ID_2142259; gDNA_ID_1620435; Annot_ID_156985

SEQ ID NO: 23475 - DNA, 3003 bp, Unknown
  misc_feature (1)..( 3003): 2750-1469P.txt file - cDNA_ID_2142267; gDNA_ID_1620435; Annot_ID_156987
aataatgtgaatcaatatcattgttctagcataataaaactgtagatttacaaacgtcaaacgatatgaaatgttttaccgacctctaccaaaaaatgagtgatgtgagaatatacgcgcgttatcggttgtttctcactcacctagtgacattggtcgagcggcaaatggtggtgatgactggcctcttttacgactcgcagttttagattttagtccccttaattgggtattctcagttatggggagacatataaacacattttgtatgttttgacaaattcagaatatcaaaacaagacacgtttattatgaagtgtgttaaataatacaaatagattagatgagacacaaatatacaaaggaataagaatctctcacaaaaataataattgaatgaataaaattttgaggagggaaggaagatgtcccaatcccatatatatcatctcaacgcatcatcaaaacaaactcgtcaaagctgagaactccatcgtcattctgatcaaacccacgaatcataaccttacaagcatcaaccgtacacgactcgccgagtcgactcaacgtcctccgtaaactcgccgccgtaataaactcttccccctccataacatacatcccaaacgcttctttcaactccttcctcctttcttcatcactaccatcttccccttccataagcttcaaaaactcctcaaaatctataaacccgtctccgtcaacgtctgatgtcttcaccacttcctccacctcacgtgacgataacgcgccgcctaagagactaacgcagctttgtagctcttcaccggagattttcccgtctgagtttgcatccatatagtcaaaaacggttcttagctcgttaacgtttaacgagctgcttccgctactattactgctcgttcttgattcgtcttcaaggtttcttgacgattctgatctcttcgaggaaactttcttgtatagtcgtgacaatgatgatttttggttcttagcgagagtcatttcttgatttgaatatgaatctagaagatttgggaaatggatttctgatgcaaattcttttcaagaagtggtagattatatatagatgagtatgtgaatgcgtgtaatggtggagagattcttgattgttcgacggttaaaacacgggtttgaatattttggtgttattatttaaagctagaggcggttgcgcggcggtggccgggaagtttcctccgcaatgagtgtttgtggggaaaggtcaagttgaccacgactaggggtgttttcgtaataatgtgatggtaagtttttctcacgtattgtgtgaaatgtgatgtcatatcgacgactagattaagaaaagtagcaaaccttctctttgactttgattgagtatacgatgtgcggacacgtggttttggtcttttaaattgttaaactgtcatgaagtttcatataaccgtccagatatgctccacgaaagtggtatgacttcctctgttcctagaaacttgaattaaaaataaaatatttcatgtgatgaagtttcatctaactgttacattcccggtcctgaattccctttccataagaaaatatatttctatatggaccaaaagagagttttatttttatctttttgcatctcaaatgccaacttcatgtaaaagcttttactgatgtatagttcggctttctaagctcgacggtttaactcggcccagcatatattgttcaaacaattcagttattctttgaaacttctccccgtaattatcgagctcaaagattatttaacaaaaacatctctgtttccccccataaaatctccttataaatacttaatttgatcctaatatcaacaaaatgttagactttaatctatatcttcaattcttgatgaaatgaatttccatgatgcggtgctggcatatcgtgaccttacttaattcacattaattaaactttctgagcaaatagtttaaattgttggtatcaaatctcacaaataaacttactatgaaaaactcatgatcgccaaagtgaaaatagtatagaaagcctagtttagagtgacaaacacttgaaatcctaaacaatcgatcttgtaaccactattgcacatcaccacaaaacacacattatctgacgaaagctaatcacattcaaatgattaaaccaaaataacagaatctaaacattaattaacttaatattcgagatacaacgagacctatacgagtttgaatgaaagacaattttcttgtctactatatgtacaagaaaaaatagagatcatacaaatagcttttcttctaactatcgaaatcaatattcttataattaggcatgaatcctttaaaaatttaggggtcatgtaacacttaacataagcaaatatatgaatgcataaaattattaacttttcgatcatttttttaaaaaattataattttcgcaacgtatttaaaccaaatttcacaaaattacatcaattttttttttagattgctatctaagcccttaaccgaaatacctaaacctaattgaaccgatcagttcaaagttgccagcagataaacaatgttttcatgtccgactcatactccatagtcgaacgattaacccaagaaacatatttccagtgaaggtttagtcttaaatctaccaatataaccagaaaaatccagaaaaaacttgccattaactaccgcatgatcaaccggttaaaacttctgggtgaaaatctttccaaaatattgagattttgacttcaaaccctttgctacaaatagaaggtttgattttggaattaaaatatatagtttgtattaaaaaagaaagaaacattaatatactcatataaaaagagtttaacaaaataaaaatcaggaaggagaagacaataaacgtagctaacctcatctccctcttcttttttttttgttctttaatagtttccgtctctctttttctcctccacctctcctttgtcctcaatagccgacgatg

SEQ ID NO: 23476 - DNA, 3000 bp, Unknown; identical to SEQ ID NO: 1688
  misc_feature (1)..( 3000): 2750-1469P.txt file - cDNA_ID_2142328; gDNA_ID_1620435; Annot_ID_157000

SEQ ID NO: 23477 - DNA, 3000 bp, Unknown; identical to SEQ ID NO: 1682
  misc_feature (1)..( 3000): 2750-1469P.txt file - cDNA_ID_2142367; gDNA_ID_1620434; Annot_ID_156932

SEQ ID NO: 23478 - DNA, 3000 bp, Unknown; identical to SEQ ID NO: 1684
  misc_feature (1)..( 3000): 2750-1469P.txt file - cDNA_ID_2142375; gDNA_ID_1620434; Annot_ID_156935

SEQ ID NO: 23479 - DNA, 221 bp, Unknown; identical to SEQ ID NO: 315
  misc_feature (1)..( 221): 2750-1469P.txt file - cDNA_ID_2142375; gDNA_ID_1563722; Annot_ID_148187
  misc_feature (6)..(7): n is a, c, g, or t

SEQ ID NO: 23480 - DNA, 3003 bp, Unknown
  misc_feature (1)..( 3003): 2750-1469P.txt file - cDNA_ID_2142421; gDNA_ID_1620434; Annot_ID_156945
aaacagactcccaacccgacaaagattggcttcttggggagtcatttcttctgccgattgttgtctctgttcctcattgcctgaaacccgtgaccaccttctgctggtgtgcgactactcatctcaaatttggtctctgatattcgcgaggttaactccctctcatcgcctcatatgtacttgggatgagcttctctcttggactagactttccaccaaccaagctccgtctttgctccgtaaagttgctgctcaagctgttgtgtaccacatttggcgtcaaagaaacaatgtgttacataatgatcacaggatccatccttctgctctctttaagatgattgatcgagaaatccgcaacaccatcacgggaagacgctctcggaagcgttggagaccactcatgcttctttggatcagataatttctatcatatttttcaaatattgtaaccttgtttttatttctttttgccaaggttactctagattaggtattgcttttgtaatacttccacttcatttttaatgatatttacaagtttagcaaaaaaaaaaaccccaacattttcttaacatttagatattctacgaaatgattccatataaaattgtatgggtttcttaaatttgtctttcacctcaagcatagaccttgtttcttctagcatgttctccagttgttcaacattggttaacagggttacaatctcgtggtgaggtgaacttgcgtcgctgacttgttcatgatgttgtggcattggttcattcccgacctcttggaattactgaacctctgcaaatggaattttataaagagtcacattaaacatcataatcattgttcatatgatgttattagttgattccaacatgataatgcaggcttataacaagaaataagtatgtaacatctgaaaaaataatgcaactttggatacaatccgcaacaaaaataataatcagaatatctacctttttcaagagcatcttgcaaggccaagaaaccgtcgatggcttctgttaatgaatccagttcctcggagtaacgattcgtcgtgtttatcgactctcctccttctcctctgattatcatttctctaaatccataccagctgaaaaaccaatccctgccacaaacctagaattataaccactactccctagtatatcaaatcatagaaatcaatctctcgtagatcagtgatcacatctccaaattggaacaaattttcacaaccaaattcttcggataatcaaaaacttaacatgttcactattcgcgaagattttttttttttttttaataagatttatcctttaaatcccactattaacaaaaaatctcattttttctttatttttgagattttctttaaggacctcatacctttagagaaccatgagagatataagatattgttagagttggacttagaatccgtccgtgtatattactggtttggattcggatttggttttgcttttttgattagtttctgttattttcttggatccgaacattagcctaagagtagggagttccttcccataaaagccgataaattgggacccatcgctaaagccacgtgaccacgattcctccgccagctcgcattgtctctccttgtggacctttctccaaaagtcgtccgtgttttttttctcttttttttttcttttctaattctgtgcaactgtgcattaagctttcagaaaaaaagaatgacactttttgtcaacgatcgtagccacaatttgcattcactgtttgttcactttcatatctaacatttctttaatttctcttttagtttttcactgcagtaattatttagttttttcatctgaatataaatataaatatacatatataaaaataagaaaataatatatatcatagccgtctttgcttcataattacgtcaacaacccatttttttggcggtgtctgttttcttacctaatcatatttaaataccaaactgacactataaacaattgtagtttagatgtaaacctttaaaccaatccgttggtcatagcttgtgagacataactccacaaaggtattgttagttgcaaatataaggaaaacgaattaaacttaaaacttacagttgtaatttaggtgaacacataattgctaaataaactctaaaaggaatgtattcaatcaaacattttaggtgatttgtatttaaataacaaattttatgttattcaattatggatttttgaaaatctcattagattagattctaaaatctatttaaaaatcattaaaaacattttaagaattaaatttttaatgactataagagacttaagtgaattttagtggatttccttagttaaaaatacagaatttgaaatttcatgagtttagatagaattttagaaaattttacaataaatcataacaacttcttaaaatttatccaaattcttgaaaattgtataaaaattcaaaataactcaaatcatttaaaatataagattgaatacgatctcctaaaactcttttatgtaataaattttacaatcatttggtatatgtgtacattacaacggcacatgcaataaagtaaagaatttgacctaattttctctctttgcttaaatattctcctccaccactttttgtcagaagtcacacttgaaagatagaaagagagaggagaggttagaaccgggaagagtgaaaggaaagtcacgtcggtccgttttataagaaaagaaagagatagtaaggactaaagagtgtagcctaagggaagttaaaacagagtgttattgtcgttgcggttaagctctctcctcgataaagttttttttttcttttacaaaattccatttctaccctttccttttttccaagtctctctctctgtccaaacacatcatcaaaccacatttgtctgtctgcctgcaacttcactgtctctctctctctctttctctcttcttcgattctagattacttcttcttcttcttccaatg

SEQ ID NO: 23481 - DNA, 3003 bp, Unknown
  misc_feature (1)..( 3003): 2750-1469P.txt file - cDNA_ID_2142556; gDNA_ID_1620436; Annot_ID_157029
tatgcttaatttggggtaataatgaaaaatttgacataggattatataaagggaatagagagagaaattaagtggtggtcttcacatggcagccatttttagaatatgatgagatgcaagagatgagtggacctatccacaaaaacaacaatgccaatccaccactcttcccatttatatccatacattcttagtttcttacattagcatatctttaaagagttggaaaaacatgtcttgacaaaattagacatgaattatttgcccaaatagatcttcatcattcatcaaacgatttatgttttgatgtaaacaaattttaccaattaatactatttttctgatctccaagtgctatttttttattttattttgcacaaatagtaacccaaggtctctaaatacttagatttctatatttatgaatgtaaggaatgaatgattgcaaggatccatctaacaaacgatataagtcatttggaggataatataatattatgcatagaagaacattcaataatatgtattttttataaatacttatgaatgtttctatgccattgatgttctctaaaaacaatacactgcaattgctaatccattctaatttaattattgctagctaattaattagtcttataccaaatattttctctaaaaacaaatgaacaaaagtttggtggtaagaggcaatgaagtgagtcttctctttcatccaataataatacttttgttttgtgtgttcccttttgcaattatatgcaagtgggtctataattgagtttgattatgaaggctacacacccatctttgtttttttcattattttttacatatatacattttcttttgtattttcactttaaagttctatcggccaaggatggttgatgtgtttagtgtgttattcatctttttttgtcaccattgagaaaatatggttaacagctccaaagttttttaagaattgtttttgtaattattggtgcgaacaatgaataatttgtatatgtaaatatgattgtcttgaataattgtttcatccatatttctcaatagtaaataatgtatcgtttgctttcttaatcggacaaaattaacaacaattgtcgtagattccttcacatttttatcatgaatcatttaatatttcagccgaccgtttcaagtttcaaccatgtgtacactgttttttcacatttacctagcatattcatttcaattgttgccaccattttgaatgaaacctaaattaattattttgtattttatagaaaaataattatttgagtagcgtttggatttatatgatatggaaaaaaaggaatttaataataaatttgctaatgtcatcacctactgactacgtatctccacggatggtgtatgtcctcataaccagacaaattcagccagccttgcttttctttttttcctcctttaacaacccacaaaattaataaaattaaaaactcaaactttgatttgtgtaattaaactacattctctctgaaattcaaaacttgaaaacaaattattgtcgtcaaaaaaactgtattaacaataagaagtgccaaaaaaatataatagtgtatggaagagcttaatcctatcttattgtgagccaaaaaaatatatattctatttcatttcggatatatttaaagataattaaccaaatagtgttttaaaatgtcaaatgtcaaaatatgaaatttatccttgcttcactcggaaataaaactttgttatgaatataacaaacatcttcgtttaaataatcaattaacaataattttagatggactgcgtagaatttgttcctgctttggccaatttttagatgaatttagtttgctctatgatatgttttacaacattaatttagcatatctaagatcaatgtatgctaatgttatttttataaacttttttttggattggacaatgaattttttttttgtaaataaaatttttaattttgtggtttaagaaaacattaccaatagccaatacgtaggtaagtgaatggttaacattctttaaataataactaatcaatctttaatcacataaattagttgaataattgataattattaacgaactactacttaatgactttatttctgcgagtacataaatctctcttactcgcccacaagacaacaatggcataattccgtaattaaaccataaaaccaaggtcaattacaaaatctctctcaagtctgacactactacatcaccttctcttttttctctctttggcgagaatggcctcgtaaccagtgattaggacacatgcatgccatttcccatcaacggtcaagatccatctcctcttcttctccttcaaaccattccccaccgttagatcatctccaaacctaaccacggttcattctttaaccacggtttgtttcggtcagccaggtaggggcctctctgatgtccttcaagactttttatttttctccattaccaaagtcaccaagaagccagaagaaagagaatagagagagagagagagttttgttcttcttctttctggttcctttgctttgctttggttgcgtgatctcctctctcatcaatcttcttcatcatcattctcatcatcattagcttcttgatttttttttccttctttttttcgtttcaagaaactaaacaaagtttctatttatggttttctgattcttcttctacagatctattatttgattctccttcgatcattgtcaacgttttcttcttttgtaatcatcacagttttttttgagaatttgttcatttttttttctcatatattgattcgagttctttcttcttgaatcttgttcttcatagatctagtttttgttttttactctctagatctatagatctgttgaattcacttctttaatccatctctgtgttcttgagttcctatggtctaagtcaaactcaagttcaagatctgttgaatttggaatcttgctggtgaagttagagatg

SEQ ID NO: 23482 - DNA, 3003 bp, Unknown
  misc_feature (1)..( 3003): 2750-1469P.txt file - cDNA_ID_2142560; gDNA_ID_1620436; Annot_ID_157030
tctctcaatgatttttcttgtcatgtccatcttattttgaatgaaggtaaacgtctgagatgagagagaagaacatataaggatagccaaggagactgcctgatgtcttttgatgagtaaaatggtcattgcttgatataacttatagtcacttgtcaaacatgacactaacccattttactcaaagaaacaggcaagtcatccttggctaccaaatatgattcttctattcatctttgacttctccttctaaataatgtatacactcactttcatatactataacaaaaacttttgaaaccaactgcgaaaatttgacatttttgaaatttaacactttaacaaagaatgaaagtttctgaagtgtaaattttatagtgattttgaagacagaaagaaaagtaggtataacatggatggaaaaagcatgtcaagatagccaaagagactgcctgaaacctaacccgcaagattcaacatgatatttgacctattatactttaaaaggtataataatccaaaatgcatgaatttgaaattgaatcgtggaggcgaaaaagatcaggcaagtcatccttggctactaaacatgacgctttccgccatgttagacctctcttcttcatcatacacttcattactctctatatgtttttgccttattccatacatgcatgtgctctctttttataaccctcgagactcgagagttgagaaggaatatatgcctatcatatcgatttctaaaattatctcttttctttttgcatgggataaatgtagtcaactttatattctccatcacgggaatatgctccttcatatatcggacaatttttcgggtcactaacataatcttcttgtcggttcattcactaaattgtatcgtttttcattggtgggtttaagagttaatatatatatataacgttctcgatcatcttagatgttgtatattatatatacacacatatataaacaattaaatgcaactttagacgtgtttagttcattctgtctgaaagaattgtttaaattttatgaatccgaacatattttgaaatataataacgttaagttttgatataattatgaaatatctatatagatgcataggtagtttaaaagctcaatgatatactatagacttaatattaaaaacgacatttcaactaatatatacacacgtgactcattgtggttgataaaatgttccaatttatttagtggttattaacttattattctcactactttgcatacgttttctttgtactttttgtactacaattcaaattacacgtagctaatcgaatacatattcggtcccttttaccctagtgccatgtgtaaaattatgttccttaaattgatgcttccgccttatggtatgctcaagtgactcaagtggttctcgactatttctctaatttaaaatgaaagtttatttttccttaaaaatccaaattaggaaatttgtgtgatatgttacatttttatcatataaccactattgggtataaaaaggtttgaccattacattaaagaagagtcataatactttttggcatattttttttaggacattgtggaatctcatttgaaagtcttcgattctcttttctgtcatccgatccatatctttttcatttccaattgttgagatttgatttggttcgaatgtcatcatcttgtcgttgcaataaaagtttacacaaatattattcactggtacgactgaggatatattgtgggctaatttttgaattgggctaaagcctcacatgtgattaattttgagttgggctaaaacctatcacataattgttagttatttatgttaaaatagaggttgctctctctcactattcatacatttctcagcattttggctaagatcaagtatagtatctgattttatcaatttaatatctgatatatggactattggttcacatgatacgctatttttaagttagaaactcacattaaaatagcttatctgagttttcacaagtggtctaagcgttgcttatattattgcacggatatggctcattcccaccaccaaatatagtccaaatttttatgtaaatgcaaagacatgggatttggtggtcttagacaacttgtctccaatctccctccatctgagttttgtttttgaattttctctaactatgttagaaagatttgtagtgatgaaactctatcatatatccaacacttcccctaaaattcctttgtttccgtttctgcataattccagttacacacaaagtgcatgcttccatcaagtaattctaagaaaaaaaacatttgttcacaaactatgtcctttcatttttggatggtatagtatatatgggacaacaagtaactagcttttttggagtgtcttgttcaaatttttgacatatagatttgtttgtatactactatatttcatttaactgcatgttttaataaagaaacggatctttgatacatataggtagttttctaaaatcatttggatcttgtgtcatatcgatttatttgtacgtgagatttggctcaccttgccgattaaagttcaactaacgttttgtaaattttattttgtttatagaaattcagaagaggaaacttgcacgtctaaatttgtatataaattataaaaagagccaaaatgtcactgttgttggtgtttataacctctcttacatacaagtcgcaagacaagaggtggtaaatgtggacttttattctaactaattaaatacagaaagatggaaagacaactttctcaattactctctcaaacacaaatttgattctaactaaattaaagttcaactaaagttagtttgtaaattgtattttaggttatacttaattgtactactttttcaaaaaataaaaaacaactatgtttttattttccgcgcatctttgcttggacgagtttgtcgtgttcttattataaacaaatagaaaaacggcaaaagtctcacacaaatg

SEQ ID NO: 23483 - DNA, 3003 bp, Unknown
  misc_feature (1)..( 3003): 2750-1469P.txt file - cDNA_ID_2142564; gDNA_ID_1620436; Annot_ID_157031
tacagacaattgttgccaaggatgatgtatcaagcctcacatggttggtcttgtgaaatcccaacgtttgatctctaacttatactgtggctatatatgttatagacatctaatcatatgatgtttagaggttctaagattctttagagatctaaagatcttttatttgttcatcgaaaataagacaagattatttaactgaatgtacatgacatgaatctatctattactttcgtaagattacaagtttttatttatgttttgaatgtaatgttaaactagactcaaataaatattaccacaaatctgacattcttttgaaaaatctggcatgctttggaaaatatggcattcttatatcaagtgtgagatattcttttgaaaaatctgacatcttttgaaaaatatgacatgattacatcaagtgtgactgtgacattctttagaaatatatgtgacataactcttttgaaaaatctgacattcttttgaaaaatatgtatcataagtttttttagtacaccaagtgtgacatatattcttttgaaaagtctgaaaatattctaagaatttgagactttagtttccagagtcaaaccaaacttggaggcctttacatgcatctcttatcaccagtcgctcggatttatgaaagttataatgaatgcagtcgtatgtaatctttctttaggatcaaacaacaatttcaattactctgtctaaaattcttgatttacatgcgatcaaggtatactgtatataggtaatttgttaaaaatgcaaaactcacaaccgaagaagatttatgttattttggttcttaaagtacgtagatagttttctaaaatcaaattaaaaatctaagaaaatatacaacgttaagaaagaaaaaacaaagacacacacacacatacatgtgaacaccctcccgattggagttaaaactaatttaagtttcgaaattaaaacaagatccaaaaggtcactgttgttgcggtctttacatccaaaaaatgtatttatttgtgctctactcttttaaatacaacaggaggtgtgcaatatggactttctcaattatgttgtatcctacctatataatgaaataaaatccaacggaagaaggccattaattctcctccacgtgcgttatgtcttttatttgttttctatggggctctattatgtttggtcagcgcaacctaattattatttttttgtatcatcaaacagttgtgtttttattcttccacgatagttcaatcttgttttgtgtttttattcatcaaagattcaattatcttttaaacacctaattttcatacaaaatataacttttttttttataagatgataagacttttggtattccttctattataattgtgattccactcttgtgtattgtaatttaaaaacttaaaattttatattttagactaatatatcgtcaatattaaccacttcaaatatttattataaaatctacttcggcattttcaaacgtacccacttccgattctatgcagtttaacttattacactaatttttattttgatgtgtttttatttattatgaaattattacaataatctagtaaagttaaattataattcaccaaaagtttgcggttgccaaatattcttcattattattatttttcatatctcaaacaaagtagttatgcaaccttgcttaaaatatatgatcccataaattttcaaaaccggttttatatgcaaagtacatgtcaaaacgttatcttatttacatccatttactaatcaaatatctattttaccacaaaaggtgtgttttataccctatcatgttttactcttgagatatgttctttgacaccacccacaaaatatctctacgaaatacgaagccactatatgtctctttaatttcactttttatagtttttttcaccgctaaaattgttgactaaaaaatatattgcataaaaataattgataatatatttataagaaaaactatgataagaaaaaatataatcggttgaaatgagtcatgactaacaataattaaaggttaggaaattaaaagaaaataaattctgaaataactaaaaaaaaaaaaatagaagatgatgatatatggatccctatactaatattttggaagtacattgaaaaactaactttcaaagacccaattaattaagctcattaaggataaacatgttaaatactaacttatggacattaattaaattaaaaattataaaacgaaaataaattgatgacaaaaaaaaaactatgaattttcttattaggatttgtaatctactttcttgaaaaaaattgaagtttactgacggcttcctttttttggaaactccaaaataacaaaacatatgaagaagttttggaatagcctttgactcaacaactttaacaatagaaagaaaacatgtttaattaatgttcatgcacttcgtctcggctgccccttgtggcctgtggggttgccgggttggcttagcttgagacgacccaatactgaatttgttagctcggtcagtgaagtctacatgcatgatacaaaaagattgactagtgtttaagttttttttttttttttttttttttttcataaatggtagtgtctcatattagaaatggtagtttgaaaagtattcagtttgtttgttcactttggattatttgattttggttttgttaattgaatcagttttgtttgaaaagtattcacttttgaaaagtgttcactttaaaaagttttgtttgaaaagtgttcactttgaaaagtattctttgagaagtgctcagttttggtttgtccacttacgattattattcacaagctacagcggatagtagtgactagtgacttatgactttgaataaagaatttccctctaaaggaatgaatacattataaatagattattaacctaagcttgatagagaagacagaacaaaaaaaaacacaagaacagggcaaggaaaatg

SEQ ID NO: 23484 - DNA, 3003 bp, Unknown
  misc_feature (1)..( 3003): 2750-1469P.txt file - cDNA_ID_2142568; gDNA_ID_1620436; Annot_ID_157032
tatagtagagagaattatttgtaaagttgtttagatatggatataagaaatggcattaattgtaattcttttgaaaatgaagatttatttcaaattttcacttcaaaaatactaatatagattaaaattgtgctacaaaaatggtcattatatcacataatacacactatgatatgtgaatatataataccatatttaaacaatgttatcatggtcaccctattatagctccaacaaatacatcctatactattatttggaaagtacataataaaaaataaccttattttttgtaagtaattacataggtatgccattagaaataaaattttaaagagttaattaatttaatttaattagaaaaacgaaaaacattattaatttccaaaaaagtaaccaatcaatatcaacatataagatttgatatctaaattttaattaatttaatttagttagaaaaataaaatacattattaatttccaaaaaagtaaccaactaaaatcaacaaattagatttgatatctaaattaacatgttaattttttattaattattatacttcacctctcatctttatatgattctatttttgcgaaagaaataatatcatcatatcatcagtataaaaaaataattagagttttttcgcatattccatgatttgaatttttaaaaacgaatagaaactgttcaatacatgaaaatatattataacgggtcaaaaatagatttaagaaaacttttgactgagtaacgggtcataatttgaatatttatatttaatttcatacatattattttgaaaatttataatcttatatactataataattaataacatattagatttttttttatgtgtatgatgtaatttaatttttagtacaagctggaaaatcctacaattgacgggtttagatcgatatgaatacaagatggtatactacaggtgaaacgctaaaattaacaatcaaaatacaagtgtataatcttaaaacactaaacaatataaataatatcaacaaaacatatacaactcgcagtgtactatacatttaaaatcaaataaaataatatcatatatttataaatcatctttacaaaaaatgtttttagtttagctaaaatataagtctacctgcggtataccgcgggttaatatctagttgtttatgaaaacggtatcacaacaattttttataaggcatcatatttagatgttctaagattctttagagatttaagatctttatttgtccatggaaaataagacgagattatttagttgaatgttcatgagcctatctattattccggaaggtgtcaagtttaactaacttgagtataaaggttttatgattctagtcatatgtgatgtggctctagcagcacaagtatttcaactatactgtttgaaataatggattcttcaggtacatgttgaaggtagagaggtaaaattttcattgtaaaactcacaaccgaagaagagcaaattacaccttcaaaatacacaacgttaaaaaaaaaatgacatgtacgtaagtttgtaaattttgttttgttttgtagaaatttcagaagacgaatcttgcacgtctaaatttgtatctaaaattataacaagatccaaaaggtcactattgttggtgtttataaatgctttcttttcatttttgctctaaactctctaaaatacatgaggtggtaaatatggacttttagtctaaactagatacacacagatgcgaacaaaactatctcaattatgctggagttttgcctttcctaaactttgttatagattttctagatgttagacacaaataagataatatcctctaatagtatatgtcttctgtttccattagcattattattaccaaaccttcatttattccctgttgagttttgatccaatttttcctgtttctttttaatctataatagtcctttttatttatctatctaaagagaattctcatagtggcagcaagtaaggattatttagtttattgttatacttaaaagtgtaaagtataataatttaagtcgatcgaaccagggcttagattgatgtcggctggtagattatagtgtcccacgtcagttgtcatttgtaaggttgcaattcatttaaaatttgaaaaattgatattaccatacacacattctatgcataatgtgcattatcattttttggacaacgatgttattactttgctagtatattgttctaattaatcaatcagtttacaactttgactagccatacaagaatattgacttatcattaacttgacgatttcttacttcataaaaattaattagtcaaacgaatatctatttcttaatttgtaaattgtttggtaaattctctaatatttatactgttttctaagattacaaacaactctcttattttcatgcatgatttacacgtgaataagtaacaacaacataggtccgcaatgatacccaaagcatttcctgaccattcacaccattcaggtctagtacttgtgctcttattcaatcatatatgttatcactagatttgtttctttatttatcccttttaatcaaattgttcaccagtttctacggctcaaaaaccaaaaaaaatcataacacatgacacatgtgacatgtcaaatatatatatttttatccaaaaaacgacatgctaaagttttattttccaacagaaaattcctttttttgtctttttattttttatataactaagaaattttccaacataagttttttttctttcaataataactactattactatatttatttcatatattgtctatttttaaccaataattaccacatgtgacatgtccaatatcgtaattgtatttttttcaaaaaggaaatactaaagttttaatttccgcgcactttcttggctctttctcggaatagtttgtcgtattccgactataaacaaaaaaacaaaaactcttttcttttagagcttctcacaaatg

SEQ ID NO: 23485 - DNA, 3000 bp, Unknown; identical to SEQ ID NO: 1700
  misc_feature (1)..( 3000): 2750-1469P.txt file - cDNA_ID_2142584; gDNA_ID_1620436; Annot_ID_157036

SEQ ID NO: 23486 - DNA, 3000 bp, Unknown; identical to SEQ ID NO: 1695
  misc_feature (1)..( 3000): 2750-1469P.txt file - cDNA_ID_2142598; gDNA_ID_1620436; Annot_ID_157038

SEQ ID NO: 23487 - DNA, 2652 bp, Unknown; identical to SEQ ID NO: 1694
  misc_feature (1)..( 2652): 2750-1469P.txt file - cDNA_ID_2142601; gDNA_ID_1620436; Annot_ID_157039

SEQ ID NO: 23488 - DNA, 3000 bp, Unknown; identical to SEQ ID NO: 1730
  misc_feature (1)..( 3000): 2750-1469P.txt file - cDNA_ID_2142667; gDNA_ID_1620440; Annot_ID_157129

SEQ ID NO: 23489 - DNA, 3003 bp, Unknown
  misc_feature (1)..( 3003): 2750-1469P.txt file - cDNA_ID_2142672; gDNA_ID_1620440; Annot_ID_157131
agcaatttcttcttatggaaatgagtttgaaaaaaatgcagtaaacattttggtataaaagatttaaggtttctctattctttccaaaacaaaaacattccctttcccatctctccctacttgtaaatcttcgtctaagtatctgcaataatttctcagaatcaaggaatccaatccataacaaacacaattctagttacgattttggattttaattaaaaaaggatacgaaatctcgaatagtccctcggggttgaagattcccaaaagaagatccatgttcttcctaaatatgttcatcaactgattccaacacgaaacaatttttttattaccaaaaaaggaatttgattatatatgtcggagaaagaaaaaaaaacaacaacacagacctggtctggtttgatcgttgagctttcataagtaatctctacactctacaaacaaacaaacgcaattccgtcaaaacgcgatttttccaagaatctaaaaaacctaaaaacgtcaagaaaacggtaatgtaccgatttggacgagatcttgaaggaagcgacgattctaaactcgccgtcgagtagattcaatccccggacatcgaatttcaacacatggaccgttttgcccttcgttaattgaaaaagaaacacattaaaaacgtcatcactaaaaagctgaactgatcaatttcttttttatctacctgagcaatgtcaatctgttgaagaagatcaccaagagagacgaaatctcgaagacccaatttagttcgtttagaacccaatacagtgattgtactgtaaatgagtttccagcaacctccgatcttgtctaactctccagtcggctccggtgtcggattccgacattccaaaagcttcaccagtccctcgatctctgtctttttatccgacttaactccgaatatccctctattgatccctttaatcccaatacaatcagataacagaatcaaagcatttaaaatcaaaatttgaactacgagctaatgagtttcgaattaaagattctgatagtcgaaaggaatctgaaaggagcgaatctaatcacctttgagagcttcgtagagctcttcttttatatgagaaactgtaatctcttcttgttcttgttcttgttcttcatcttgttgttgttcatttggggaggaacaagaactctgttctgtgactttcccgatgaacatgggtctgagcctaaatgagttgtcactaaaactcagcgttttgccattagaactggtgaaagagactaatactttcacgtttcctgttcttctcgagattgctcctcgtgaagctgccattgatggtggctggaaaaggttactcgtcattagcagtttatacaccagaatctctaaacccaatggagcttaataagaagtagaagaagaagatgggatttgaggaaaaagagagagagatagatttatggggaggagaatggacagttttttttggttattttatccatcttttagcatctatctctcccccccaccatacactgcactgactctattataaaatttagccaatcccattggtcttttttttcttttttaagatggtgtcatggtaaaattctcaaaaaaatctccatctaaattgagaaaaacccaatttttgttatattttgcaaccaattgcatatgttttaaaaaagtgtttacacttcatcaaaagcagtaatcggagtacagtaaccacaaagtatcaacatagtaaatgctctgttctttgtcacaaggcttttaaaaaacagaaattcaggcatctttggttaaggttgcagagtcttgtgatggtggcttccattgttgtggagtctgagctttcttaatagagagagcatgaatctctttcatttcttcttctagcgcagcattcaccatacgatgcctctccagcaatctcttcccttcgaattgttcagagacaacctccacttcaaaactcgaaccacaactgcaataaacagttttgctgatattaagaacaagaaattatgccataagccagagaatcaaatgtgtattgacaatccggtacttaccctccagatatgtcaatgacttcctggtacacacaaaaacaaacaatgtcactaaaaaattctaaaagctaaagattgaaacaattggaacacatgaatcaagtgaaaagggaaatagattgacattgaagtaacttcaatcttcacatgttataaagcaaagaaactatacacatccttggatctgctttttgagttctagttcacaaaaaaccatgacacaaataaaattttccgacaagaacactcactactaagttgctaatacatcaggaacactacgtcatcaaatcctgagctcagtatcacactgcatcaaattacacctaactacgcaaacaaccaccttttatattctgtttcagagctgaaagacaacacatagtgatgtataatctagatgctgagattattacaatacatagtacctcttatgatccaactatcaaagtgtatgattttgatcaaagtgagcaggtcaaaaatctcaaatttggcaattttcccagatcaatttgatgattagggtttcaaagtttcccacaaaagtttcaaaccctaatcaatagatgaaattgaaagaagaaagcagtataagaacactcacgagatgaattggcttaagtttcgaagtcaatgaagcttcgacttgctccttcgtcaccatctctctctctctctctcaaacaaaaattgaaatccctaattactgtactcattgaattagaatattaaaccatacgctatttggttttggtttagcgagagtacggtttagtttggttcaattgggataccattcggttatcgacaattccaaaataataactagggtttaagctctgctttcctttacttcgtcttcctcactcctaaaaccctctcagtctctccatttcccggagcaaaaatagctctccgaccatg

SEQ ID NO: 23490 - DNA, 3003 bp, Unknown
  misc_feature (1)..( 3003): 2750-1469P.txt file - cDNA_ID_2142684; gDNA_ID_1620440; Annot_ID_157134
cagtttactgaaatgggaatcgaaggagttgtcccagttgaactattgccgcctgaggtccggtccaaataccaagctaaaccaaacgaaaaagccaaacgagcgaagaaagaagaaaccaaaggtggatctcatgaaacagagggaaaccagattggtgtttctaatagtgaagctgaagctgaaggaggaaggggtgatgcagagacgatggagagtgatgctattgcagacactcctacgcctgaggaacagcaaagactcggtggttctgatacagaaaacggtcaagaggccggtcaaatcgaagacggagagacagaagaagctggtctgatggacactgatcttgatcatcctcctatgcccgtctcatgaatacgctttcagtttgtcgaccctttcttcaatggggaatcctttggatatgaagttcaaaagtattgatgtttaacaaattatgttaaaaggtattttctaaatatgtttgtatgagtgcaaatctgctagcttattacctgtctttccatttctatatactcaacaaaatcatcatacaattaagttcttttgcgtaatttatcgtctaagtgtaacactagacacatattcgcagctaataaacattggattcaattgcaatccactaaaaatacactcaaacaaacaaaaaaatcaaatacttgaggaaccaaaagctaaaagtgttactattatagctatcaacataaactttatgttttgccatcaatatttatttagaatataaatgagtggtttttaagtcgtgtcacgatttttaaagtccataaacaccaccgatctccatataataataaggtttcatcatatgccaaatccaataatacgtgaaactataccagttcattgtaggcttatttggttatattattactacctccaatcattgaaaatgtatatactttgtttagtcgttatcacttgtcaatgcatatcaaatcaccttataaatttacccaaattcactattgaattgttgatgcactgtcacataagatcacagttgtcttatagtcgtcgcactgttatgacaaaaaaagtgtcgactcatattgaaacaaaaaaaagactaaacaatgttggcacagcgatgcgataaagaatcgaccaagagacaaccgagtgatttgtgttgtcaacgacaaatgaaaagttgcctatttttgttacttatcgtttgaatacaaaaccgtagatcgatctaaacataatccgaatatactaattttttgtttaaacatgatttattaacaaagtcatttaattattgtaatacaaaaggtttttgccaaaacaacaacatgctactttttcatcattttcccggaagaaactaaagatacatgtggcaccgacacttttctaattttctatcagatcatgtggcccaaaggatttggaaacaaacagtacctagaatgcattctaatcatagatatttatttttataaacctactacgtctttaggcatatattagcttaacactaaaaattacatatgtttttttatatataaagaagacgaactcacaactttattagtactttattgaaatttaagagcaggttaaaaacattgaaaacatcatatattgtgattttagtgttacgcaaatattgtctaaaaaatacgttagtttttcttgacttaacttatagtgtacatatataggtatatagattgtcggcaaatgtatacatatggatgtatggcatataaataaatatgatgtgatatgatagtctcaataatttgcacattgttttccacttgtacataatattttgtggtcaacagtacattaaatttgtatatgcaaaacaggagaaaagacaaatgggaaaaataatggtgtgggtggagcctaatttaattgtatctacgcaagagctagtgaatagaattagagaatttaagtctgtatcaaggcaaatgaaagaaataaagaaagttattccttgaacatttctaattttatatttcaggttaatataaagtacattgataaaacacagttaaaagtcaaaaccaatgtgctcaacatcctctaagcattatatatatagcttttatttttgtgaatctatttttattgtgattagtatagtcatcactcaggagacagaagaacaaaatagagggaaataataaatgtaaagggtgatccaatgtttaccaaatctatataaaattttcgtccttttccgataaaaagactcagtgagtcaaaattattcatttaatttttcttacgtcaatttaaagtcaatttatacattttaatttttgtgtctactttataagtactcagtattttttttttttgtataaagaatttaacgaaattaccaactgttaagacaaaataggagtggaggacagagagcgccaagcgacacacttttactgggtcccacattttaaattcatttattatcttttatttattttctaaatctctttttatttttttgttggtagtttgtgtggttttctttctctactttggtttggtagttgattacttgaggaggtacttcaatatcttccgtctgtgtctctctctcttcgtcttcttcattacgcgtcttcttctttctcctcttcttctacattagcccctctctctttaattagctgcagctcacctttcactatctcttcttttatattgattgtgaacttgtgtgtgtgcgtacatttggagtttcagagaaaaacagttggattcactccaatacctaacctttcacccatcttcctcattacttcttcagaagaaactgagaaatcttctctgcaaagcttgtaattgcatgttttgatgggagttgtaacgactggatctctctcgaccaacctgttgggttgacttgacccggttgcagacctcggaagctagagattgcgtgtgtgtgtctgaatttgacatactgtctactgttttgtcggtactatg

SEQ ID NO: 23491 - DNA, 3000 bp, Unknown; identical to SEQ ID NO: 1723
  misc_feature (1)..( 3000): 2750-1469P.txt file - cDNA_ID_2142696; gDNA_ID_1620440; Annot_ID_157138

SEQ ID NO: 23492 - DNA, 3003 bp, Unknown
  misc_feature (1)..( 3003): 2750-1469P.txt file - cDNA_ID_2142734; gDNA_ID_1620440; Annot_ID_157148
acatgatctatttatcttctatcaacaaatttcatataaaaaatttctatacttttttttgctggtatcaaacttttctatacttgatacgtacgtacacatataatagttgaatttttgactaactgtaattacggtaaatattaattagtttcacacatgcacccgttttcaactgctatatatgttaatcgtataaatcgttagtaaacattttttttcttggtaaggatcgttaataaacattttagtaatgtttatattcacaatttaattaaatctattgcagcagctggttttaatttgttgacatcatcattagaatattatgttagcttagctcgtgggtcatatattaatcaatcataattactcggcgtttgtaacgcattattccccttagcgagacatttttgtcgtatcttattgttatatgctacgttctataaacatatccctaattattgtgtaaatagtcaacgtttgtattgttacatatgtacatgtaaatcagtaaataatgactcataaaagtgcaaaatcgtttgatgattagaccaaaaactgtttatcaaattacgatttatgacaatataatctaattaatgttattatactttgtttatcagtattatggattgttttcacgtttcaaattcggtttatattattatgatcaccacagacgagtatatagtattcaatttcactactttttttacacgagtacaggacataaacaaatcgtaaacaggaagatgcaatataggaatagatgcgaccgataagctgttacaatcagattagtatatttaattatcatattttagttataaccactcaatgtaattgctgtaagttgactaagaagaaatgatgagtgatttgaactctatttatgacccaatctcttgtagttagaagaaagaagaaaaaaaatggagggagagggaagaagagaagatggagattgctcttatctctgcatcccttttaactccatccgcgatatctttcaatcgttcttcactaggtttcgcggtctaactcctgataattctccggtgacggtgagtaatatgaatcaacaattcttataagttaatatgcacggattcatacaaaatagatttatgatcacttctatcaaaagcaattttctcgttttccttttaacgtgaaattcacaatcctatatcatatatattaaaacgatgattaatttgtttaatattcgtcagtgttatgaagtaaatatttctgataactgtttgtaatttcggagtttctttaatcgttattttttgtattttacaattttacatacttgtggaattttgaataactatttgccaaatgatcatgttcttaatcgtgattaaatttactcggatgggtacgatattaatatatggtagttggtacttgtataaagaaaatggtaaatggtttcttgagctcattcatataaaatcaatcatttaaaaaatcaaatacatgtttcgaatccgtgggctaatttatgaaacttgatttggaaactaagtctaaagtacgacatgaatgtttttttttttgtttctgaattattgtcacatctttcttttcaatatgaaatttctaatggaaaatgtgtatatgtaataatgttggtgacgaagatatcacaagaagtagaggaagagacagaggtagtgaatataccgaggagtgtggtgtcggggaacgttgcagcgcgaaagggtaagcagcaaacgagttccgggaagggtggaggtaccaactaggcaccttcctaattttagcttccacaagtcttcgtttcaacaaaaagtcaacttcaacattaagttaataatattgttaacatttacaacttctcaagcttatgtatattgttataagtatcttatattttatgtgaattatgtgattattgactgtttgtaagctctttgagtcatttcatgtatgaataaaagataaaagcaaattccctcttatgatatatgaaaaagttgtaaaagaaaaaataattaaataaggatgaataaaaagtttgggattgtgactgtaaataatagtgctggctagttaagattgtgattcagaactacagatcttggccaaggtgaataaaaagtttcacaaatgggcacaagaatgtaaaaagacaatgagttagataaaaataaatcaagattatttgttgtttttatttataaataataataaaagttctaattgttttactgatatgcaactacaaaactgtagagtgagtgggtcattcgtacgcaaaccaaaatattccctttatctgtcccaaaatgaaactaaactccaagggttttatgggtttgcacagttggccactgatctctgcatctgaaattcaaactccacattttccattgtatgtgaatacatgattaaataaaaaaacaattttgccaaaaaatgaaactaaacactctacaagtaaggcagcgtaacaatatcttttaaagaataataagaaagcgattttgtccactaccttgaatatttttatgtcttgatttctatagtagacttttttgataattcccaaaaacagtgatatttattcttttaaattaatttatatatttttgattgaatagtttgataaaacttctcacagctagtttatatatagaagaaagatctaataagataaattaagactttcatcgatcattggccttcaaaaccaatttgatctggtcaaccttattgtaagtagagcacatgtgtacatcatgttgaaaaacataaataaatagtaatattttataccgaacatgcaataatacgaaaagacgcgccaaatgagctgttattagtagattaatatatgtaattaccattttataataattagtgtaaattactaaatactgatgagcctatattaataaactcaagtcacacctcagtctctcacttagctctcacgaagcagaattgaagaaaaacatg

SEQ ID NO: 23493 - DNA, 3003 bp, Unknown
  misc_feature (1)..( 3003): 2750-1469P.txt file - cDNA_ID_2142739; gDNA_ID_1620440; Annot_ID_157152
attacactcttaagctagaaagactcaagcggactctgaaaaagggtaaagagaaaagtggcatctgattgatcaccttctaggcttctactgcttagcacgctttgcaagataacttgtagtgattttagagaaacgagtgattgtggagaacaattgccataaagagcgtcccttaacaacaccttctctaaagctcctcgcttgtttagccaacattggttctgtttcatctgtcttggtttgacgcatcacctcctgcattgaagctactgatgaggtaaaaatggagttaaccatgaaagtccatagttcgaatagaagagttcagaagtgaaaggtcagacctggattcatgtttgttaaccgtcttagtctatcttcagctacacgaatagcccgtgtcgagcttttaacaccttgagtgataccttggctacacaaacactgaaagagttacaaaacagatatgaagaaattggtaatcatcatggtgggatgtgagacaaaccctaaatcactgagctccatagttaagtcactgatctccattcccgataaacgaacagcagccattgtatctggtagctcttctctagttacatccaaaagcttttcaagagactcagctgctttcttgaaagcctttctcaacattccaaagtaaaactcaaatcaaccttcaaaatccatcaaagggttgaagaaatctgtaaaagcaaaatgttggagaacgaaccagaagagtaggaatcgcagcaaagaagagccacgatgctgaaattgctgtctgcaacagaacccatgatgatgattgtttacaaagtgacataaagtccagatctttattgagcaatttgaatcaaaacctaaatccaagagaggcttaccacgcaagcgacgacattgagcaagacgaagtgcttctgtgtgaatgtccattgagagagttggagaggaggctgtcccacggacgatgttaattgggaagagatcgatggctcctgaggattcgagtacaatgcagagggagtagaagatgcgattgagtctgaacccttggtcaatcgtgaaatcggtgaagctagccggagagtgacccgtcggcgaaaggagagatttttatcgatgaatccgttatggagaatcggattccaagagattagagattggggtgattgcaatttcgaaggcgagaataacattgtgaatggttttagctctattcgtcagaaaccattgttaagcttcgagtcgacgataacaatggatttcagttgtgtcagcgagaaaatttgcgtcaagtttagaaacaacaatatttcacgaaaagtcctctgtttatgcgttaactattgaaaataaccccattactatcatttgagttaatttgaccttctttgcgtcatatgcaaaatcggaacaccaccacattggtttggaggtttgtgagctacaagcctataaactacacgtagcacctccctatgcacgtgtcacatgaatgattttaagggtttgggctgatgtttgagctataactacatatatacatttggtttgattcgtttttcttacattatagtttcatcaaaagccaaagcataattgatggatcaagtactctactcctcttacatcataaaaatccctgtaatatcacgaatatcaccatcacaagctcaacttacgaccaggctcaataacacgacttattttggcttgtcatcgtcgagaggcaattttgggaaggtgtttgcaaaagagtctcgtaaagtgaaactgattagtccggaaggtgaggagcaagagatagaaggaaacgaagattgttgcatacttgagtctgcggagaacgcgggacttgaactgccatactcgtgtaggtcagggacttgtgggacatgttgtggaaagttggtgtcagggaaagtggatcagtcactagggtcctttcttgaggaagagcagattcaaaaaggttacatcctcacgtgtatcgcacttccactagaagattgtgttgtttacactcacaaacaatccgatcttatatgagttacacatgcctgccttgaacttttgaaatctcagtattaaaatatgtatttcagtatttgatgtgttttgatgtatttttatgtattgatatcattttacatacgttgattcaaaatatttaaatcggattccacttacaaaatcagactagtaatgtatatgtgcttcgatcatctttgttcagtagttgaggcttttatccccatcatgggtctgtaattggtatcaaatatactatataggcccattaaggattcgtaagatatgggaaataacgttgggctttatttcgtcaccatgggtttagttgttgttgttgagttgtctttttcgcatctggacggatattgtccgtatgaatttcttagactataaagattaaatgtaatttcaaattattatttgatatacttaattcaattttataaatttaatatcttcaaaaaagtttgtgtccacaatataacaaatgttatcaaagcaaaaaaaaaaaaaaaaacttcttctaatataacaaatttccctaaatagcttgcaaattatctgtaaacatgatgaaaatattaaacatgatgaaaaatattaaattatcatattattcaaaaaataattaattagccaaaagctatatatgaattttgggccttacaataatattttcgcaaacggcgcctaaataatttgggggaaaaaatcaaaaaccctatttccttttcatgaagagcgctcgttgaaatcacgcaataagtagaacacatttggacaaaaagaaaagataaaataaaataaaaaacaaaacccccaaatttgtgtctcctccggaaaaaaaattcgaaattccggatccaccgccatcaatccctagctttctctctctttctctatcttcgccggcgaaaccagtagggttgctcaattcgttggtagagtactgtggcaatg

SEQ ID NO: 23494 - DNA, 3003 bp, Unknown
  misc_feature (1)..( 3003): 2750-1469P.txt file - cDNA_ID_2142757; gDNA_ID_1620439; Annot_ID_157106
ttatactgtgattgcgggttcgggaagtggtcggagacatgatctaaggcttgatttgcatcctttggtgagcattaatccgaaatattatgatgctattctgaatggtgtggagattctcaagatgaatgatcccgatggtaatcttgcaggacctaatccagatcctctagtatcaccagacttaataccaaaccgtgcaacgccgcggattcgaaaaaataagtcacatattttgccgatcacacttgcagtggttggttctttagttgtgctagcaatgtttgttgttggtgttcttgttatcatgaagaagaagaagaagagcaagccatctacaaactcgtcatggtgtcctcttccgcacgggacagattctacgaatacaaaaccagcgaaatctctgcccgcggatctctgtcgtcgattctccattttcgaaatcaaatccgccacaaatgatttcgaggacaagctaatcatcggagtaggcgggtttggttctgtctacaaaggacaaatagacggtggagccacacttgttgcggttaaacggctggaaattacatcgaaccaaggtgctaaagagttcgaaacagagctcgagatgctctcaaagcttcgacatgtacatctcgtctctctaatcggctactgcgacgaggacaacgagatggtactagtctatgagtatatgccacatggtacacttaaagatcatcttttcaggagggacaaaacctctgatcctccattgtcatggaaacgaaggctagagatttgcattggagcagctcgtggattacagtatcttcatactggagccaagtacacgatcatacatagagacatcaaaaccacaaacatacttctcgatgagaacttcgtcactaaagtatctgactttggtttatcaagagttggtcctactagtgcttctcaaacgcatgtctccaccgtcgttaaaggaacgtttggttacttggaccccgagtactatcgccgtcaagtcttgaccgaaaaatctgacgtgtactcctttggagttgttctgttggaggttttgtgttgtagaccgattagaatgcaaagtgttccaccggaacaagcagatttgatccgatgggtgaagtcaaattacagaagaggaaccgttgatcagatcattgactcagatttatcggctgatatcacttcgacatcgttggaaaagttttgtgagatagccgttagatgcgttcaggaccgtggtatggaacggccaccgatgaacgacgttgtttgggcgcttgagtttgctcttcagcttcacgagactgctaagaagaagaatgacaacgtggagtctctggatctaatgccaagtggtgaggttggtacgaccacggacggagaagatgacttgtttagtaggactacaggacacgtggggaaatcgaccacgaccgatgactctgttctagttgttggtgatgagaggagtggttcgagttggggagtattttcggagatcaatgaacctaaagcacggtagatgatggcttggtaaacaagtattacattcttgctagggttaatatatttgtgtatgtataattgtggaattaaaaaattaatgtatatatatatattattatgagttacatgcgtagcaggttaagttaatcaaaaaacaaaaatctttgtaattattatgtctctctcttccttgactcatgtgataagatattatcttatcaagtttccagttatcatgagtcatgatccttgtagatgattaggctaagcaaaatgacattaagaactaagacgtttgtctaatctagagtggtgttaacatttttcgcctaatgtatgtgacaatataggattcgccaaatcctttatgacaatttttaatctgtacaaatctgatcatcatcgatcccgatacacaaaaactaaactaaataaccaaggactcggcacaaagaacacaagtcctgaagtccaatatcgattagctcaacattgaccttgatggggataaggaaaaattaattcaaatcttggagaataaccgagaaaaaggagaaaattttcatatccccattcgaggaataaggaagttaaacatatctcgaagtgaagactccctcgtataaaagtgaagttcgacagccagccaatagatccacaacttcacgcttaggaaccctacatttagttattgctaagaaccttaacttgctcttcaagataggggaaaatccttttgtaacaatctaatttaaacttgatttttgtactcttttctattttcagtttacttgtgtgttttactcgaacagtcacaactacaaatgtttttaacagattataacatttgcttatgtataaatattctttctttgggtagtcggtacacataatcttttgtttaactactacggttctcgagtaaataaagattgtttatgataataagattttatcaaagacgataattttttattttttaatgagaaatttaattttcctttttctctattttaaaaatatttagtgttaaggctaagttgtagtagatagatgtttatttagagaatagcataaacctaaatttaattatgacgtatatgtatattttacatgaagataattactaacgccaaatcgataaataactgttttaattattatttttcttaaaacatgatattgataacaatctcatcaattaatatctttcaaaaacaaataaaatataatattcgtggaaatttatcaaagaaatctagttacgttctatatatataaagaggcaaaataaataatagtctcgttcgaattaagttatatttattttttaaaggattaaacgccgccttcatataaaaaaaaggaaagtactaattatcaaaaaataaaaagaagtacacactatatatatctaagactttcaaaaccctaacacaccaaatcttaaaggaatcccaatctcatattacttttttctcgatg

SEQ ID NO: 23495 - DNA, 3003 bp, Unknown
  misc_feature (1)..( 3003): 2750-1469P.txt file - cDNA_ID_2142765; gDNA_ID_1620439; Annot_ID_157108
cccaatttcttagtacattaatctttgaacaagatcttgcatctatgaatttccgtggatagagcattttcaacacaacactcgaaaccttcacatacttatagaactaagaaaataattaaaaagagttaatgtttgactcaaacatgtatattagattgtgttttgctctgaatagatactattattcatatatatatatatatataaacaaaaacctttgcccaaaaataaaataaaaacagaaaacctaaattaaaaatctagattggactacgttagtaatatacaactacaaataatttatttaagacctaaaataattgaaagaaaaaaccaaaaatgaggtaccacttgtaggagtatgtaatcttaactagtatgaacaatgagaagtcagacactcagaccttaaataattgaaagacaaagccaataatgaggtatcacttgtgggagtatgtcatctttactagtatgaacaatgagatatatataatcgcagaaaaacatattggtgttattttcgttagtgactgctccgatctactaagatggtgtatgtgaatgtcggattcgcacactcaagtatttatttattttgtgagaaagattatttttgagggcaaaaatcaaatgtaaaagctagagattaacactcaaatgactatagtatgatttagaaaaattgtgtgtgtgttagatagtcccaaacctctactacttatactaaaacatcgtatttactctcaattatactccataattcttcttttaatgcttccgtttcagtcctcgggtttaatgcctcaatgttcgaatttgaattaatttcgattctcatgggcttctcagttcggcccaacaccccaggccaaactatccccaattcggctttgtcaccatctcgtagtgtcgacacctcgctacatctctgaccatcattccgggtttttttttgggccatacctctcgtgggcttcctccctgcttacgtgacaatctttggttggttccggactacaggtgtgggatccgacaccaacagcgtctacccccacataatgattagtcttttaagatttatctaaaaaaagtagagaagagtaagaaagtgttctcgtcttttactattcccctgtttttcgtaacactagtgttaaaacggatcttttaacacggaacgtccgtgttgtattatgtatgcaaacaatatatttttcaattaggtttccaaatcctctatatgtatattaaaatagagtatatttgatgtttatatatcaagctcacaattattctcaatacagtatttttatttttctttatttaattataatatctttcttatcaaacattctcatttcctagtaatacatattttgattattctaacactaattgccaaacattcaagaatcctaaatttaccaaaattaattattttagatatttttatacgtacaccggagtttaatgttctaaactattctctctctttcacaaagagtgttattcttgttttttttttttcacaaagagtggcattctacattttcaatgtgatacactaagtttcttgatttacctttacccaaagctattttattgaacttcaatcactaatcatgtattaattagggcatacatatatagttcaaaatttcttaatttgtgtaaaatatatcaaaatgacactagttgtgaaacggaaagattacaaaaaatatttttctaaaattaaggaagtgtactggtttaaagattttagagaatttggtgaattttacatattttgagagattttgataggtatacggatgatttgctagatttcatatttaaaaataacaaaataattggtcatttggtgaaatttactaactttcattttcaaatcaattgttaatgtgaagatcgatcttgtatcgatccaatgactctaagcatttcctatttcacaattaaatctctgattctgatcagcttaactacgggtatctgtagaagagagctaaaccattcacgatgttaatcacttttaaattgcaatcatctttgagttgaagttgggttagatgttgatcaattagactcgtcaccgtaagctctctgactacattcaccattgttttttatagactttttttttttcaatcctttcaaatactattttagaggcgtgattgtttactcttatttttcaactaaaaaatattcaaagtctctcaaaatcatttttcattattttttaaaaaagttgttaagcttgaataatagtggattggatatggttttaataaatctattgaataacaagtgattgtgaagaattttgaatgattttccacaaattttagtttcaataacatgaaatttgtgaggacattttaaaatcacaaattgaataaccagtgatttaaaaaaaaaaaaaaaaccaaaaccttcaaaatcctagttccaaagtctatataacaaattttaatacttttctactaaataaacataagaagaaatagtattgttaattagtcacaatccaaatttacagaaccaaatacaacaactttgtaatttcttaatgtattaaaaattttaaaaatttccattagagatagattctgatatataaaacttggataaaataaatatcataaaattcacaagtgcataacacgaacacttgcctagttttcagttaatatacatatgttgaccaaaaaattaagtcttaaaaaaaagaaaaagtaatagtttatacctttattggcttaccaaataacgtctgacgtgtaatcttgactcttgaccttaacttaaatttagatttcatttgatactaattaaactattccctaaattaccaggaagtaaccaaattgtggagagaacaaaaacaccaattcgatattttcattcatggcttagaaataagaatcctctaagttctcctctctattgaaaacccaaaacaaaagttgagaacttttcatatttcagatg

SEQ ID NO: 23496 - DNA, 3000 bp, Unknown
  misc_feature (1)..( 3000): 2750-1469P.txt file - cDNA_ID_2142785; gDNA_ID_1620439; Annot_ID_157116
ttggaaataatatacacacaaattataatagttgatttctatgtgaccttacatacatggtggaaattccgtccttccttttgtccctgttgcagtggttaaagaataatattgaccaactatcttcgcttaatttgttattttagtgttaacattatttttactcaagaaagtgctaggtgctaaccaggcggtaatccaatgtctagcacctaaaacgcttaatcgaggtttaaattatttttagacgatgtaagcgtttttaacataaacattataaatatgatattacatataataaatatataaaaatatttattaggaaattggataaaaatgttaatacgtaaataaagttaaacaaaacatttattaaatttatatgaacatttataactatataaatataaataaaacttagttagaaattgataaaatactaaaacaaaatctatacgattgtaggtggtcaaagcgactaggcgctgtccgagaacctagcgtctcgtcgaggtttatgcgactgcctaaatcggttttcaaacactgcattaaattaatattttttctaataaacaacattgaattagtctttgcatactataagttaaaactatatgccaaaagaccaatgaatttcgcaataatcaaaacaatgcacgtaaactttgttatattattctagcagtagcagtcgatctacagtaaaagcatacgtttacatagaagacttgttcgtgttagttgtaaatatgcttatcaaggcagattaagcaagtcttccggtaaacgcaaatttgacgtagtcatagataacttatataaagtatgctctagttttacctacgtcaaagcagatttgcaaaaaatgttgtaattctatctatgatatatctagaagacaaagatataaatctgtcataaatctgctaatttcgtcttaacagtcttgcatggtgatgtcatttttcatggatacgtaatgaggtctgaaaagttggtacaaaagatcaaactactcaaataaggttaacgaaaacaaaacatattatataaatatttacattaatatatttgcatcaatttactgctaaatcacatctaaacttataaaactattcatatatttcaagggaaaactgacatgataatttcactattgattttttttttttatcttcataactttaatctatcttggtaaacaaacaacataacttcaatcttttaaaataaagcccaaaaccacataaatcatgcaatacatttctttttaaaaggatataaatattaatcatgcgattaatacgaaatggatgtacataaaatcaaagtatcattttgaaagaagcatgagttttacaaagcgtgcattgttggaaaaatatacacacaaattataatggttgttttttatgagaccttctcacatatatgatggaaatttggtctttgcttttgtccttgttgcagtggttcaagactaagatttacctactaaatcgcttaatttgatattttcgtattaaccttacttttcctatatatattgaattagtctttttattttattttcccccaataaacaacattgaattagtctttacattttatgagttaaaactattcagaagaacaatggatttcgaaaatagccaacacagtgcacgtacaaaaactatactattattctaggtattgcattcgatctaaaagtaaagcagacgtttacatcgaagacttgttcgtgtttgttgtaaatatgattatcaagggattaagcaagtcttctggtaaacttaaatttgacgtagtcatagaaaacttacataaagtatgctttaattttacctacgtcatatgttgtatttctatctaaacaaagatataaatctgctaagaatcttaacatttgttttcggaaaatgaaatatttgtttggcttcttgacttcttgtatataatgtttggatcagatggcggttctgttgtgactcacaagtcacaagttgactaataataattttatttattgtcaaaataaaatgttaaaaatagtgataaacaagacatcttttcttttttatttagcatggaattcgaacataggctctagtagtattcgtggacccaaaaacagtctttaatctatttttgttttgggaatactccttttcgcaaatacactcgaataatgattttcctctcttatgaaaaccattagaccaaatgtttgatagtcatcataacagttaaaaaatggcataattgcaattactatgtctgagatgtttcactggtagcacaacagagaattttccgttcacaaactaaatgaaaaagtttttagaacaattgtatattgataagttttgttgaactaaacaattcatgccaaaaaaaaaaaaaccgtggttatcactcaaagtactaaaaaagttagcacatgtttgatagtcatcataaatcaatataggctcgaccatgcactaccatgttaactttttggatgtaactatgagttctctgatttggggaagatatggcttctttgccacccttcaatttgtgtatggtagtctccaagtcacttaagttgatccgattccttgttaattaatttgaacaagtcatttcttttctttttcttttttcttttttttttgaacaagtcatttctaggcatggttccaactgcaaaacagctaggaaacttcttaaatctagaataaattaatataagctctggtcgtggctttatttatataggcatgcaaatccatttataattaaagatatatgaagtcatcgatagacttgttaaacttttttaaactgccaatttaaaacaatgtatatagaatatctttggaccacgtcaaatatgacatgcgcttttgccctataaatactgagctcaaatgcttcacaattcacaaacaacacacacacatataaaagtctttgaaaagcattagcatatccctttgtttcaaaatg

SEQ ID NO: 23497 - DNA, 3000 bp, Unknown
  misc_feature (1)..( 3000): 2750-1469P.txt file - cDNA_ID_2142788; gDNA_ID_1620439; Annot_ID_157117
atttatatagaaataaaaacttagttggaaattgatgaataaactaaaacaaaatatataagattttaagtggtcaaagcacatggttgtttagacattgtccgagaacctagagcctactcgaggtttatgcgaccgcctagatcggattttaaagcactgctttcactacattgaattactctctttttctaataaacaacattgaattagtcttttcatactataagttaaaactattccaaaagaccaatgaatttcgcaaataatcagcacaatgcacgtaaacgttttttatattattctaccagtagcagtcgatctaaaataaaagcagacgtttacatagaagacttgttcgtgttagttgtaaatatgcttatcaaggcagattaagcaagtcttccggtaaacgtaaacttgacgtggtcaaagataagtatgctctagttttacctacgtcaaagcagattttcaaaaaatgctgtaattctatctatcatatatctagaagacaaagatataaatatgtcataaatctgctaatttagtcttaacagtcttgcatggtctataacgtgggtagttgagttgtctaaatctgctaaaatatctttgtttggcttcttgtatataatttttggatggcggttttgtagttactaacaagttgactaataataatttatttattttcaagataacgttattagacaaaccaagtgttttcaaaagcagtctataccgtatacggttgtctaggtcttgattagacgtttagacgatgtgtagatgaccgctaagactaaaattacataaattttgttttagtttattttttcaaattttcaactaaatttgatttacatacattaattataagtattcatatattatttgatatacattaaaagaaagggttggctaaaattttgtttgataaatttttatatgtaatatctaatatgcttatgttataaacgcctaaatcgcttagatttcgattagacattatagacattaggcaatgattcaccgtctatttatcgtataccgcttttttgaacattagactaaatattgacaaacaatacattttttttttttttccaagatttgaacctaggctctagtattttttgtccaggaagaaagaaactcttatattctttttttggttttaatgttaaagactctaaaattttgaatagatgctatggataaagctgactaaaccgctagcagagtagaccactctattttgagaacaaattgctaaggaccaagtttttctctatataaaagcggtatgtagttagtacgccgcgaacttgttctattttttttaatttactattacggactaaaatttgtgaataataaacaaaaaacggtctaaactttaaacagatttgtttgccctaaccgccacaaccatttaaatcctaatattcgtggacccataaatagtctttagtctatttccttcaaaaatatttgtttttgcaggtgacacgaactaggatgcttctctcttacggaaaccactacaccaagaaccacttggtgcatttataacagttaatatgtcacaactgcaattaccgtagtttatcaccattctcgttttcgtgaacaccctagatttactatgtttgagatgtttcactcgtagcacaacagataattttggattcactactcaaagaaaaaatttagaacaatttgcacccaaaaaaaaacaattgtatattgacaaattttattgaactaaacaattcttgccaaaaattcttgtttatcattcaaagtactagaaaattaagtacatattagtcactataaatcattagaagcttaacaagcctataattggtgttattattgagatccatgtcatggctcgtttataattaaccatcacttccattttaagttttggaatgaaactacgagttctctgatttggaggaaatatggcttctttggcgccctcaattcgcgtcatggtaatctccaagtcacatcagttgatccattgctatgttacttaaactaccatttgttgcagtggaaatagtcgtgtctcgtatctcggaaactttttgaactagtacaaatcaacataagctatggctgtggttttgtgtatctatatatacatttttgcagccattttgtgaaataaatcatggagttagaacttatttacaatggctgccactgacttttaattattgaattttttttgcaataaattaattaacaaataaaaaacattccaaatatatttcaatcccatatatcacgcaaatttctccaaaatttgaactagatttcggtaactatttaaaacaaaaaatatttgacagaccaaaatacaattgcaatcccttaaaatgagcaaaacacacttaaattcatttcttatcaattcactaaacttatttctccaaaatttgaactagatttcgacaactatttaaaacaaaaatttgtttgttaaactaaaatacaattgcaatcccgtaaaacatttattttcattatatatttaaattagcggtgtactgcggagtttttttacgggacgggtttggcggaacgggtttggaaggacgttacttaataacaacagtaaactataaaataaaaataatttataaatagatataatttgcaaacttttatatatactgatttaaaaaaaaaaaattgttttcgcggtgtaccgggttaaaatctagtatagtcatgtaaatccaatttaattaaaatatatagattgaagttatcgatagacttgttaaacatttttgaactgccactttgaaacatgcgagttacaagatatgtagataatatcttggaccacgtcaaatacgacatgcgcttttttgtcctataaatactaaactcaaatgcttcacaattcacaaacaacacatacatttataaaagtctcaaaaaaggattagcataaccttttgtttgaaaatg

SEQ ID NO: 23498 - DNA, 3000 bp, Unknown
  misc_feature (1)..( 3000): 2750-1469P.txt file - cDNA_ID_2142790; gDNA_ID_1620439; Annot_ID_157118
tgtcctataaattttaaagcactgaggattcaccaagtatacatgcataacaaatttagagcgagcaataatgagggtttctcaatctctaatcccttttgccataattgctttggtcctttcctttgtcaatgcttatgatccaagtccactccaagacttctgtgttgccattgatgacctaaaaggcggtacgtaaagaaatctccggttatctatttctctacttttctccttatgattaactttgacgtagtaatataatatatactctttgatattatatttctacatgcagtttttgtgaatggtaggttttgtaaagacccggagcgagtcgatgcaaaagattttttcttctcaggtctcaatgtgcccgggaacaccaataatcaagttggctctaatgtgaccactgttaatgttgatcagatccccgggctaaacaccatgggaatatcattggtccgcatagactacgcaccgcatggccaaaatccacctcacacgcaccctcgtggctcagagatccttgtccttgtcgaaggaacattatacgtcggttttgtctcttccaatcaagataacaaccggttattcgccaaagtattgcaccccggtgatgtttttgtgttccccataggaatgatccattttcagttaaatatcgggaaaattccagcaattgcttttgcgggattgagtagccagaacgctggtgttatcacaattgcaaacactgtgttcgggtcaaaccctccgatttatccagagcttcttgccagggcgttccagttggatgcaaatgttgtcaaagaacttcaagccaagtttgggtccatatgaactgatcatctaagtcgtttaagagtgtttatcattgaaacacaaattaaaggaatacactactatgaaatatttatgtaacaaagtaaaaatggcttatgtacctatttctatattataatataacaactttaatagtgctgtgaagccaaatttgcaatgaatcggtgaattttgtcttaccccctccttgctaaatatgtgtcttaaaagttgcaatcagttgctctaaaaatggtctcaggcgttgaaggttgcatgttttttttcctcactttccaaagataaagtagatgagaaattgtacgacgtgttgtctaagagcagcaaaaactactcaatcggataaaattacaagaataatcgacacatgtaatctagtggtttgtgtttgtgttgttgttatgaaaccataaacaaatatttataaacaaaattttatatgttgttaaagtattatcaaaaaaattacatggataaaatactagtcaacgtaacttaacatcaagtctttttttaataattttcaaatcaagtctttatgatgtcgcttttcatggatacctaatcatgtctttattttaatgttgctacaaaagataaaactactcgaattaaaaaaccgtttagtgtaaacgagccataaaacataaaatattaactttcgtagaaatgcatcaatttactactaaaactacatctttttttattttgaacaaagactaaaactacatctaaaatcataaaatataactattgttgaaggggaaagtaataaaaaaaaaaacctttcatcatcaaatatttactggaatcaatttgggtacacaaacacacttcaatccttcaaaacagacccaaactcgtatcccaggtgaatcatcatgagataaatacgataaagacagtcaaattattattttccccccaaatcatagtatcattttgattgagagttttataaagcgtgtcttgttgaaaaaaagatacacataaattaaaatggttaatctctacaaggccttcgcacatacatgctaggaatttggtcactacttttgtctttctggcagttgttagagactaagatatttaccaactaaatgatgtcttttgcttaatttgatattttagttttaacctacttttcctgatttgaattagtcattacgttttataagatataagtattattccaaaaagaccagtgaattttgaaaacaaccaagatcaatgcacctaaagatttttgaaatattctaactataccattgaatttaaaataaaagcaggctttacatatatagaagacttgttcgtgtttgttgtaaatttgcttatcaagacaggttaagcaagtctctggtaaattgacgtaagcatagataacttacataagttatagcagattttttgttttatttttgtcgtcaagttatagcagatttgcaaagtacgttgtaaatatatatcttgcaaacatgaaataaattcgtaatatatctaccgaaaatataatgagcataagatatgctctactcatcgcttgagattgctttgcctaaatttgtcagaaatatctcaaaatatctcatatatatgcttgactttattattagttagaaacatgaaatttttgtgataaaggttggtatttttgaaaataaatgaagctattaattgttcattggtaagtaaataataactttatttagtagtaaacaacttataaaaaaagttatgaatggtgaggtgcatttacaatacttaggatggcatttagaaaaaagatagtaatagaaattattcacacacacatattctacctgacttgaatctagaaggtgcatgatacaaagacaacaatattacaaatcaataaactacgagctcttgtcattggattgtgtatatagtcgtgcaaatccaattttaaataaagattgattgtcgatcgataatactgattaaacgtttttgaactgccactttgaaacatgtgaactacaaaatgtataggaataacttttggaccacgtcaaatatgacacccgcgttttccctataaataatgagctcgaatgcttcccaattcacaaacaacacactacatatctagaaagcattagaaaaaaaaacctttgtttgaaaatg

SEQ ID NO: 23499 - DNA, 3000 bp, Unknown; identical to SEQ ID NO: 1719
  misc_feature (1)..( 3000): 2750-1469P.txt file - cDNA_ID_2142793; gDNA_ID_1620439; Annot_ID_157119

SEQ ID NO: 23500 - DNA, 3000 bp, Unknown; identical to SEQ ID NO: 1718
  misc_feature (1)..( 3000): 2750-1469P.txt file - cDNA_ID_2142800; gDNA_ID_1620439; Annot_ID_157121

SEQ ID NO: 23501 - DNA, 3003 bp, Unknown
  misc_feature (1)..( 3003): 2750-1469P.txt file - cDNA_ID_2142838; gDNA_ID_1620631; Annot_ID_162685
tcttgtttactgtactgctggaatctcaggttcaggatctgttcttgctctgaattttgtttaaagttttcgaatttaggttgaaggaatctggaattagggttacttggttgtgagaaacttggatataatgaagaaagtttgatacttaaaagtaatttcacatttaaagattgaaactttgagtaattttcttcttaaagtttgaaactttggttagtttgccccactttgtttcttctgtgtgaagatcataatctgattttgacttgtgtgtggcgaattggtttggtaatgagcaggaggacatattaatccggcggtgacttttggtttgttcttggcgaggaagctatctttaaccagagctctgttctacatagtaatgcagtgccttggagctatatgtggtgctggtgtggttaaagggtttcaaccagggctgtaccagacgaatggcggtggagctaatgtggtggctcatggttacacaaagggttcaggtcttggtgcagagattgttggaacttttgttctggtttacactgttttctcagctactgatgctaagagaagtgccagagactctcatgtccctgtatgttgctaattctctagtatccttgagttgtgttgagttcatattcttcacatagagctcatgtgttttttggttatcgaacattttgcagatcttggctccgcttccaattgggtttgctgtcttcttggtgcacttggctaccatcccaattactggaactggcattaacccggccaggagtctcggagctgccatcatctacaacaaggatcatgcttgggatgaccatgtaagttttcctctttaattacatcaacggttgtgctaagtatgataagttatgaattgcatctaaatagcaactcagaatttttgataattctgctcttatctgttgtctcttttgttttatgtgtctgcagtggatcttctgggtcggtccattcattggtgctgcgcttgctgctctgtaccatcagatagtcatcagagctattcctttcaagtccaagacataaagtttcctacatattctctgatcatcatcaagctaagaatatatcaatctttaattctatatgctttcttcttgtttcctatgtcatgtgtgatgatctctatatgtaccactagagctttgatcttgtaacagtgtaaatgtgtaatctattatgtatcaatggcattgtatcttgtaacattaattatgtcaatggaagaatacattgtgtacatgtgtaagctcagaatcttgtttgaatatcacagagacataactgaactggacataggtatgctaagttgctaacattgtcaataagtgtttccaataccaaacattagcaacataattgtaaaatgtgtagaatttgatagaacaacatctaagccgaactgaactggtctaacaccatcatcgcaagtatttcttcatcttctttcttctataagagtctttcattttccactttttataacatgcttataactgaattttcaacttttgaatcacagtttcagttatagatattcttggatgatgttcagttcggggttttggttttggttttggttttggttgatagtcatgaaaatgcatgttctgttccacatggtagggttccagtaaaataataaaagaaccagatttagtaacatctttcacatgaatgataacatatttcacatgtttgatgcagcaacttgtaatatggatgatagtcatgaaagaatctaatgggccaagaaatgtgaaagagtctacatgactatcatccaaaaaagagttgtagcaatatggatgggccaagaaagtgcaagacttcagcttgagcttgactttaagagaataagtaatttgcatttgccctttggtcatgtagtactcgggttgtttacatttatcaaacaaatatcagagttgtttattgttatttgggaaaatctttaaactttctacataatctttgagactagtgggaattaagagtggtgatgtagtggatcaagattaaaaaaagttgattgtttaaaacatcgagtatcttgcaatacaaaacaaaacccttaaaccaatcaatacgaaaaagatgaagatgtcaactttccttttcaaaaatatgcaagtttgaatccggatggtaacatactgatgttactagttacacaaatatctaggctagatgtcctaatcatcttcaaaatattttgttgatgttttatcttaaataatcaaagtttttcaattattgtgggtgttgtatatatttaacataatcttaatccataaacaaaaagtaatataaaggtgttgcgggaaaaggttacttaatggttaagaagtttggcttatgatcatcccactttgtgaagtatggcatgaactttctttttaccgatattagagccaaatgaaagcggtttcttaatcgccaagttccaaccaaaaaacaaaaagcccacatttacgaaaaatactcttaaaccaacattttgaattcatatgatacaaagcttcaaatatccaaatcgaggaaattattttttaaaaaaaacaatacataacttttaaatataaattgcgaaaaaaggtaaagccactcatcaaaattcaaaagtgatgagattaaagcaagtgaagacgcatacattatcacattaaaagtagcaaacacaccaagaaattagataaaaagataacaaaataattccatccactttctttttcttttgttttgtcaagattttgttttttgtatttcagtcatacgtgtgaatgtatatcaacaacattgtttttaatgtataaaaatctcaactactataaagtagctgaatgatatgtgattaagatatatatcgagagagacaagccagcaagaattttcagcacacatacacacacaaaagattcaaagaatcatctagtaacaaataaaaaaggagagagaaggaaaatg

SEQ ID NO: 23502 - DNA, 3003 bp, Unknown; identical to SEQ ID NO: 23501
  misc_feature (1)..( 3003): 2750-1469P.txt file - cDNA_ID_2142838; gDNA_ID_2926182; Annot_ID_200330

SEQ ID NO: 23503 - DNA, 3000 bp, Unknown; identical to SEQ ID NO: 3207
  misc_feature (1)..( 3000): 2750-1469P.txt file - cDNA_ID_2142850; gDNA_ID_1620631; Annot_ID_162689

SEQ ID NO: 23504 - DNA, 3000 bp, Unknown; identical to SEQ ID NO: 3207
  misc_feature (1)..( 3000): 2750-1469P.txt file - cDNA_ID_2142850; gDNA_ID_2926182; Annot_ID_200334

SEQ ID NO: 23505 - DNA, 3000 bp, Unknown
  misc_feature (1)..( 3000): 2750-1469P.txt file - cDNA_ID_2142859; gDNA_ID_1620631; Annot_ID_162692
cttatttatatttacgtatgaaaatgtgtgttttgagttaacagttaattactttcaacttgtggaaaaagggtttctagtcaatattttcagcaatatatatgtactatataagtattgaacattggacattaactgatctgtccttgcattacgtgattaagtgaagtttcttcactctttagtatatcggaaagtgaagcttcttcttttgcacatgggtgatgggtatacattttataactcggatcattcgtgaaacctagatattaacagaaaagaaaaaaaaaaaaaaaaaagacatagataactttcaaaaatgtaacgaattaattttcttgtcatatttacaataccaaatgtagaaacactagatgagggcttgatctcttatcccgactaacaaaacaaatttttacttattagctcactatgtttgctaaattgtataaaaccgaaaaaaaaagcagaattttataaattacactttgtttattttgatgtttttatcataaataattacgtcatgtaccatgtttaatacaagttgttttaagaaaaaaaaaatcttcggtacgttttcattcaaatgtatttgtcaaagacgcaaaccagctaaatcaatggactatatctctggacctgaatgaaattatatattaaatatgcggcaaatatgaaataatgaaaaagtacgaggctattttataaaattatttaattaaaccaagagtcccggaccttctcaaaccttcctctgcctttgaaattatccaaactaaaaacaaatctgcgatcagtcttcactgaagaaaagctttcgcaaaagaagaaaccgagacactcatttgaatttgctcagactttgaaatctggtaattatttccatcttcctcttgtacgttaataatctctgttttctcatttaatactacgattcttgaagttcttgatcattcaattccttgtaatttaagaataattatttgattgtagttggtggtttatagtctctcaagtgttgcaagagatctgatcatatgttactctactgttcttgtttgcttgatagatatatattgagatcaacgtagaacctaacctcatgcgacgttttcctgctcttatagagaagttaaaaccgatcttcacggtctcaggatcaaacggtataattaactatcttgtatcaaaatccttcatatgatttcagtttgtcataattaggaagaaaacgaaaatagtgactctgtttttttttgtgagaagcaggtaaagtggtaagaaccattgtaccgaagaaacctgtgaacgagaacattagtgaaagcgaaacaatgaagaagatggaggaaacggtagagcctatggttgccttaagtagaccaccaccattttcaccatttgtcggtccagtgctcatgtattccctgcttcaatcatggacgtctagccgcgacgaagacggctagttgtgtcagccaaagtttcttaacaagaagctcttaaatcttgtctgatagacaataactgagtttttagtagaaccttatgagatgtttattagagataataaaggtttgatgttgtttatagtaagtcgatggtttgtttgttacagtgaccaattctctccaataccttaaacactgtaagaattgagtcatgattttacaatttgaatgattatgtgctctcaaactctcatcaaatgatgggaattcaaaacgaaagcgtttgagagtattgaagtttagataatgagcttactgtttcatcaaaagctaatgggctttggccgatttcaggtccatcaaacattaacctaaagttttttttctttcttataaacaaaatagcaagcaataatgaacaaccaaatcatataaaagtggacatagaatatgatatccctgtgcaatagccctaatgctgggaccaaagatctctaaatataataattagagaatatagagcaggtatatatgcagctttttattattttattcataattccattttaatattaaaccaattaagaagaggacagaaacagtgttaatcaagaatccaaaggagaatgtaatgcaatatttaatgggggcaaatccctctcatttatcgtcttatgttatagttaattcaaaacaaaacatacgagtcccatcgttttcttaggaatttgtatttagttggttacagaagaaatttgatattggattcgttttcttattaaccttattcatatggactaggagtttacaacaaaaaattaccaaatccatacttttaaatcacaaactacaaatgtcaaacaccaaaatagtagtggttacaattatctatcaccttctccaacaacaacaaactaatcattgtggtatagtttcatatctgtccactttttttctccaatagttcaagttttatttttgcaatttcaacgatagtaaatattatatataaataatatattgagtatttgaaaaaataaattttgtttatgtaactattatatatacatataagttgactttgtactaatagatccaaaaaatgatttttctcagaagttggcaacaaagaaaaatttggagccagagttaattgacttaaattcataacattcacaatcaataacatgaccttccaaaggatataaaattgaaaatgtataaagtattaactattaagggatgttttaacaaaaaatatgctaatacatgcattggtcattaatgcattataatgttgaatttctatttataaaaatatgatcacctattagaaaaataaaaataaaaatattagcatctatagtcttttgatcagtacatatgaataaatctaaaattagatttccaatcttccaaatgtccaaacttttaatgaaaaaaatctaaaacccattattcatttccaaaaaaagaaccaaatctgggttgaaataaatatacacaaacacgtggactgactagaatctaacaatgttaaatgatg

SEQ ID NO: 23506 - DNA, 3000 bp, Unknown; identical to SEQ ID NO: 23505
  misc_feature (1)..( 3000): 2750-1469P.txt file - cDNA_ID_2142859; gDNA_ID_2926182; Annot_ID_200337

SEQ ID NO: 23507 - DNA, 3003 bp, Unknown; identical to SEQ ID NO: 21081
  misc_feature (1)..( 3003): 2750-1469P.txt file - cDNA_ID_2142867; gDNA_ID_1620631; Annot_ID_162698

SEQ ID NO: 23508 - DNA, 3003 bp, Unknown; identical to SEQ ID NO: 21081
  misc_feature (1)..( 3003): 2750-1469P.txt file - cDNA_ID_2142867; gDNA_ID_2926182; Annot_ID_200341

SEQ ID NO: 23509 - DNA, 3000 bp, Unknown; identical to SEQ ID NO: 3213
  misc_feature (1)..( 3000): 2750-1469P.txt file - cDNA_ID_2142875; gDNA_ID_1620631; Annot_ID_162700

SEQ ID NO: 23510 - DNA, 3000 bp, Unknown; identical to SEQ ID NO: 3213
  misc_feature (1)..( 3000): 2750-1469P.txt file - cDNA_ID_2142875; gDNA_ID_2926182; Annot_ID_200343
